United States Patent 11,882,838 (BACTERIAL INOCULANTS) - sequence listing, part 2

SEQ ID NO: 31 - DNA, 267959 bp, Unknown
  Kingdom: Bacteria, Phylum: Firmicutes, Class: Bacilli, Order: Bacillales, Family: Paenibacillaceae, Genus: Paenibacillus
cggctgtaccgaaaaagaaaagagacgattgagcgaagcttcgcggatgccaaagagctccatgggtttcgctattgccgtttgcgcggtctaccaaacgtcagggaacaagcccttatgacggcagccgtgcagaacatgaagaagatggcgatccacctggatcgcctggagaaacaggggtaacccccctgtttctccagagaccagagccttatgatgtaaagaaaaagaaacccacgtctcaaaaagacggggtttctcgacaatctgagaagaccttagaggtcttctttttttggacttacatgcccctgtatacaaggaatacgatgaagaaggcaatattctgtctttttttggcgcctgaacgatgtataatatagaaaatgaaaaaaacaataaggaggccgttcatagtgcggaaatttcgttggatttcagcagttgcagtcctcatatttgtagccaccgcgcttccggttcaggcggcgaccattcctgctgccgcggaaacgacggacaagcaggttggctcgctaactccgacagtggtaagccgtttagaaaaagcggtgcaagaactcattggttcaaagacagcatttcaatttgacgatgtgacagatatggggaaaacctggattgtagagggcgaactggaagacggaactgctacgttgcagacagaatataataaagaaaaaaacagagtggattctacaaccatacgatataaaataagcagcttgggaaaggcgatgaacgcgccactcaagacgaaagtgctaaacagcgccaaagcgtttgacagcaagcgtcctctgcaatttgaagcattttggcgggtcaaatccccttatcagtccaacaagccttcaaattactgggtgttttggggtgcaggagaacaagcttcctcgttgtatgtggatgtggatcgaggtaacgctattaccatcaacgcggactatgccctgaagcaggtggaccctgtgttactgaaccgtgcaatgaacacatttaagcgtgtgagtggtcagcgaatcaaggtacagcacgcttcacggtacaaggacgagacgaagggactttcatactggtcgtttgaggatgcaaacgaggcgagtgaggtcaaaattagcgcggtaaccggtaaagtgctggccgtatccacctatggggtagactggaacgatgacgcagatttcaaaaaaacatttgcaagcccgaagtatactgcctcagaagctttgaagctagtcaagcccaaggctcagatgttgtttaatatcaatttgaccggctataaagtgaaagttcaagggaatcaatatacgttctccaagcagcaaaagggaacggattctattgtggctaaagtgaataaaaaagggactttttacgcttactctctccattcttccgatgggaaaatgtagtagaaaatagaaaagataaatgaagccgcttcactcctgatatcatattgtcggggagtggggcggctttttttgtttttggcttatgtttgtagtctctttatgttacattagtatgaaaataaagagcggggtggagcagaggacatgaaaccggatttgcgtactgtgctgaatcgtgaaattattgtcggagacggcgcaatggggacttttttataccagctaggatttccagtaaatacatctttcgaagaactgaacatcacttcgcctgacgttatatcagacgtgcatggtcaatatttaagtgcaggagctcgattgctggagactaatacattttctgcaaatgattataagttagcccggtttggattggaatctaaggtagaagagatcaatcgtgccggtgtgagaattgccagagctgcggccggacctgaacattatgtggtaggtgcggtgggttccatatgtgggggcaaacggcttaacatatcaaagctggagctggcaagaaactatgatcagcaaattgatgcccttctctccgaaggagtcgacggcattttgtgcgaaacgttttattcactggatgaaatacgcattgcgcttcacagtgtacgtaaatacagtgacattccggtaatttgtcagtttgcagttgatcaggttggtcgtacccaggatggttttttagtggcggaagctttttcggtgctgcgtaatgagggggcagacatccttggatttaactgtcactcgggtccgcagggaattatgagtgtaatggagcagctggacggccctttgtctgtaccgctgtccgtatatccgaatgcaggactagcagattatgtggacggtcactatgtatacggtgcatcacctgaatattttggagaatgtgccaagtcctttgtagacctggggacgaggctgctcggtggttgctgcggaactacaccggaccatattgcagctatctccaaagccttgaaccgtttgcaaccgcctccgctggcttcaaaagaagctttgtcgaaagagtcctttcaagtggcagagcagattgcagatgaagaggaacgaggaaatggcagacataccagcgagcccaatattgtggatctggttaaggaacgacatacggtcattgtagaactggatcctccgcgcgatctggacattacaaggtttatgcaaggtgctcatgcattgaagaaagcaggggccgacgcgcttacactagctgacaactcgcttgcagtcactcgcatgagcaacatggcgcttggacatttggtcagtattgaaacaggcttgcgcccattaattcatatagcatgtcgtgatcgcaatctgattggtactcaatcccacatgatgggttttgacgcgctcggtattgaccatgtactggcggttactggagatccggcgcggttcggtgatttgccaggcgccagttcggtgtatgatatgacctcttttgaaatcatacgcatgatcaaacaattaaatgatggtgtcgcattttccggtaaaccactgaagcagaaagctaattttgtggtaggtgccgcatttaatcctaatgtcaagcatttgggtaaagccgtacagcggttggagaagaaaattgcctccggagccgattatgttatgactcagcccgtatacgaccacgagttgattgcagccatcgcggaagcgacacgacatttggaagtaccgatttttatcggtattatgccgctggctagtgggcgcaatgcagaatacttgcacaatgaagtaccggggattcagttatccgatgaggtacgtgcacgtatgtctggtcttgagggtccggaaggacgagcaatgggcgtgtctattgccaaggagttactcgatacggcaatggaacattttaatggaatctattttatgactccatttatgttctatgaaatgacagctgaactgacttcttacgtatggcaaaaatcaggccgtgcacaggcccccttgtttcgactataataatcaattacaatagtataatggatgtgatgccgatgtcattgagtatgaccggatacggtcaagccatccttcattatgagggctataaagtgcgcttggaattgaaatcggtgaatcaccgctattgcgaagtgatgatgagaattccgcgcgaatggactcgatacgaagatggcttgagaagaacggttcaacagcagattaaacgcggtcgtatcgatgtcttcatccacagggaacgcgatgaagaacagatgcccgccgcgcggttgaatgacactgtggtgcaggcttacctgcatgcagcggagcagctggcggatcgttatggagtgaaaggaacgttagggataagcgatattcttgctttgcctgacgttctgggtgagcctggagaggcttgccatggagatgaagaggactgggaagagcaactacagcgggctttgaatgaagctttgcaaggtttactggagatgagaagacgagaaggcgggcatttggcgcaagatgtggaatcccgtattttacgtctggaatctctgcatcatgaaatgacggtgctggctcctcatgttgtgagcgactaccgtaacaggctgaaacacaggcttaaagagcttcaggacggttcatttacgcttgatgaacataagttcggaatggagattgcgttattcgcggatcgcagcaatattgacgaggaacttacccggcttcaaagtcactttggacagtgcaagggattgctgctgtcagacgagccggccggtcgcaaattagattttttaatccaggaaatgaacagggaagtcaacacgatcggctccaaggctaatcatctcacattggttaatttggtcgttgagatgaaagcagagctcgagaaaattcgtgagcaggctgcaaatattgagtagctacctggtagcggcacggctgcaagagtcacatgtatagggggaaagacctgaatatggcaatcaaattgatcaatattggtttcggcaatatcgtgtcggccaaccgaattatctccatcgtcagtccggagtctgctccgatcaagcggattatacaggaagccagggaccgtcatatgctaattgatgctacctatggccgccggacgcgggctgttattattacagacagtgatcatgtaatcctgtctgcggtgcagccggagacggtcgctcatcgcctatccactaaagatgatgacaatgacgaataaaaatggagtgtactatggctaagggattattatttgtaatatccggaccttcgggtgtcggtaaagggacggtaggcaacgcattgcgtgacaagctaccagagataacatactccgtttctgctacaactcgaacacctcgttcaggcgaacaggatggagtgacctatttttttaaaacgcgtgaagaatttttgggtatgattgaacgagatgaaatgctggagtatgctgagtatgtagggaactattatggtactccacgtgattttgtagatcagacccttgcgcagggaaaagatatttttctggagattgaagttcagggagcgctaaaggttaaagaaaaatttccagaaggcatattcatttttctacttccgccttcgctagacgaattaaaggatagaatccggggacggggcacagaaactcaagcgaccatagaccaccgtatgtcggtagctgtggatgaaatgaatttgttgcgtcactatgattatgcggtcgtcaatgatgagattgatttcgcttgtaaacgaatagaatccattattatcgccgaacattgtaaggttcatccttaaacgagggctttacatatgccaagcgtacttaaagagaaataatactgtataagctgagcttgaaggtgtacactggagttcagcttatacagtcccaaaactacatgaagaggtgtctattcgtgctgtatccttccattgatgaaatgatgaaaaaggcagatagtaagtattcgttggttgtagcggcttcacgtcgtgccagacagttgcgcgagggtgaaaagacgactctcaagaatcctaaatcccacaaacaggttggagtggcgttggaagagatttacgcggatcatctgcgtcttgaaagcggcgaagacgagtaagaattatacacaactattataaccgggcgcaatgccaattcctttgacaaccgcaaggttgttatttttttaggtcagggggagttaacgatgttgaagggaaaagttattattcttggtataactggcggaattgctgcttacaaaggggcagcgttgtgtagtaggttgacgcaaaagggcgccgatgttcatgtgattatgacggcctctgccaaggagtttattaccgaacttacgctgcagtcgctctctcgtaatccggtgtacagtgacacatttgatgaaagagagccatcagtcgtatcccatattcatctggcggatgcggctgatttggtgcttgttgctcctgcaactgcgaatattatcgggaaaatggcgcatggtcttgctgatgatatgctgtctacaacgttgttggctacaacagcgcctattatggtggcacctgcgatgaatgtacatatgtacactcatcccgcagtcatgcaaaatatggagacgcttgtatcacgtggcgtgaagatgattgagcctggtgaaggattactggcttgcggttacgttggcaaaggacgtttggaagagccggacacaattgtgcaaaccatagagcgtttttttgatcagcaagctcaggaacaaaaaaccaccatcaagtctgaaccacgatggtttggtgacgaatctatcgaggctcaagtgcctgagtcacttgtgaatgagaatgaatcggtgctttcaggcaaaaaagtcattgtaacggctggaggcacgatcgagcgaattgatccagtacgttatatcacaaatgattcatctggcaaaatgggctttgccattgcaaaagtggctcaggagatgggtgcagaggtgcacttgattgtcgccaataccagcgcggaaccgcctactggtattatgattgaaagagtccagtcagctgaagatatgtacgacgctgtattaaagcaatgggaaacgagcgatatggtcgttatggctgctgcagttgcagattatcgaccacgtgagattgcacagaccaagatcaagaaaaaagatagtgtatttacgctagagctagtgaagaacgtcgatattttagaatcactcggacggagtaagaaacatcaatttttaattggctttgcagctgaaaccgaacatttggagacgtatgcgatagataaattagaacgtaaaaattgtgatttgatcgcggcaaacgatgtaactgtgaatggtgctggttttggcgtcgatacgaatgctgttcaaatttatgaccgaagcgggatcgtagagcgtattcctgtacagtcaaaggaagaagttgcgcgtaagttgcttactatagccgcgggacgcatgggtggggtgctgcattaatggagacgggcaatttagttgccaaggtcattgtcgatgtacctgccaaggatacggaccgcaccttcgattatctgataccagactcaatgagaccttggattgagccgggtagtcgggtagctgtgccatttggcaaacggacggtgcaggcttttgtcatctcggtagtcccagctgatgatccaccgaaatacagaatgagagcgatccaggagctgctggatttggtaccacccttatctgccgacctagtcgaactgggcaaatggatgagcgaacgttatgcttgtaatcaaattatggcactgcaagtgatgattcctaccgcgctcaagggcaaagcagaacgttatatctcaattgcggaacagcatgagttaacgcatccacaacgtactatacaaccgaatcagggcgatgaactcgaatgggcacttctgaccgacgatggtatgagtgatccgacggagcgtcggatcgttagcttcattcaggagaaggagcaagtcccattgcagcaactcagtcgacgtttccctgaggaagcggaagttattaaatcactgttacgccggggtgtgcttcaggaaagtcaagttatcaaagacaaacttggcaaaaagaccatgaaatccgttgatctggctatcggcatagacgaggcatcaacggcgctggagcaattttctgccaaagcgcagcgtcagcgggaggtacttgcttttttgctggaacgtagcgagtttctgcctctatcgctgaaggaagtcatgacctcactgagtgtctcagctgcaacggttaaggcgctggaagataagggctatgtgttgctggaggatgtcgaagtgttccgcgacccctaccggggcagacacttcaagcctacagagccactccctctcacagcagagcagcagtcggtatatgaacggattattcgccagctggacacacgtgagcaaggagcttatttgttgcatggagtcacagggagcggtaagacggaaatctatctacagacgattcagcgttgtatcgagcagaatcggcaggccattgtgctggtacctgaaatatcgttaaccccacaaatggttgagcgttttaaaggccggtttggcgatcaggtagcagtgatgcacagtaggttgtccgggggggaacggtacgatgagtggcgcaaaatacgcgaaggccgtgtgaaagtggcgattggtgctcgctcggcagtatttgcgccttttcgtgagttaggtcttattataatggatgaggagcacgaaacgtcctataagcaggaagagacacctaaataccatgcgcgtgatgtcgccattcgcagagcccatcagcatggggctgttgttattctcggttcggctacaccgtcgctggaaagctactatgcggctcgctcacaaagcaacgacgagtttgcgccgttgctgcttgaaatgccaactcgcgcactggggaacacgttacccgaagtacatatcatggatatgcgtgaggaactgcgtgctggcaaccgctctatgttcagccgtgcgttgcataatggaattgcagagcggttagagcgtaaggagcagacggtactactattgaatcggcgtggacactccacgttcgtcatgtgccgtagctgtggctatgtcgcgggttgtccgcattgtgatatttcgcttacgtatcatcagcggtcgaacaatttacgttgccattactgtggctattccgagcccgtgcctcagacttgccctgagtgcggtagtgagcatattcgctatttcggtacaggtacccagcgagtggaagaagagctggcgaagctattccccggtatacgtgttgttcgaatggatgttgatacaacaacagaaaaaaatgcccacgaaaagctcctcaagcaatttcgtgataaaaaagcggacgtgctgctcggtactcaaatggttgccaaaggcctggactttcccgatgtgacactggttggtgtcattactgcggattcggctctcaatttaccggattttcgggccgcggaaaagacttttcagctgttaacacaagtagctggacgtgctgggagacatcaattgccaggggaagtatttgtacaatcctatactccagagcattattcggtgattcacgcaagtcgccatgattatgcttcttttgtgagggaagaattgaaacaccgccgcaatttgcactatccaccatattgtcgtcttattttggtgaccttttctcatgaacaactcccggtgctggtccgactggctgagaattattcagcaacactgcagggacgggccagacaacggggctggttcgggaatatggatcgtcttacatcggatgtactcgacattttgggaccagtagcttcacccatttcgagaatcaagaatagataccgatttcaatgtatgataaaatggcgtggaaatatcgatgcgattagtttggctcagcaagtagctgatgaaatggccgaatccgcacaggcacaaaagttgctgattagtctggatgttgatccgcaaatgcttatgtagagtgttgccacaaaagttattagcacaattaatgcggacaagccgtccgtacataggataatgtagcagtcgcgtttgtgatgaatacagttaggcctaaatgaagcataaagaggaaggtgttctgttgtcatgtcaattagaattatagtgttggagccggatgacgtattgcacaaagtagcaaaggaagtcactaaaattacgcctaacgtgcaaaagctgctcgacgatatggcagatacgatgtatgaagcggagggagtaggtcttgctgctccgcaagtaggtattttgaagcgtctcatcgttgtagatgctggagatgagcatggtttgattaaaatgattaatccagagatcgtggccgaagaaggggaggaattgggtcctgaaggctgcctgagtataccaggattgaacggggatgtgcgtcgtgccgagaaggttacagtcaagggactggaccgcgagggtagaaccattaccgttacagcgacagggttgctttctcgtgcttttcagcatgaaattgaccatttaaatggaattttgtttacggatattgcagaaaaagtatatgaggttgcgctggaacagccaggaccgaaccgtcagataggagagtgaggttcgatgagtcaagacattcgtattatctttatgggtacgcctgagtttgcagtgccatcgctgaacatgttactggataacggttataacgtggttggtgtgattacacagcccgataagccacagggacgaaaaaaaatattgacgcctacaccagtcaaggaagcggcagaaaaacgaggattacctgtactgcaaccgacccgcctgcgccagccagaagcggtggctcaggtggcagagctgcgtcctgatctgatcgtaaccgcagcctatgggcaaattttgcctaagtccgtactagacctgcctcggttcggctgtctgaatgtgcatggttcgttacttccccgttatcggggaggtgcaccgatccagcgtgcgattattaatggtgaaactgtgacgggtgtgacgctgatgtatatggcggaaggactggacactggcgatatgatatcgcgagttgaggttgctatagagccggaggatacctctggtacgatttttgagaagctaagcgtagctggagcaaagcttttgcaggacgagctgcctaagttgctggcgggccaatcagaccgtacgccgcaaaacgaggacgaggcaacttatgccccgaacctgaaccgcgaggatgagcgtatttcgtggagtgacaatgctcagcagatatacaaccggattcgcggcctggttcctttttccggtgcgtttacgctttgggaggaaaatgtttttaaaatttgggctgctgagcagcctttcataaacagtgaagtgagtggctcaaatgttccagcacccggaacggttcttcaattgactgctcgtggcattgaggtgcagacaggcgaaggaactctttggctgactcaggttcaaccggctggcaaaaaggttatggatgccggaacctttgcgcgcggcggacagatgaagccaggcacggtgctcggatgagcgggagtcactcccgccagggaggccaaggcaagggagtgggtgccagatccggcaagactcgcaatcagacggcgcgggaagttgcacttgatgtgttgaccggtgtggagcaagagggtgcatatagcaatcttgagctaaatcgtcggcttcagcaggcaggtttatctgcaagtgacgctggtttggcgacggaacttgtatacggtacaatcgcacgccgaaatacactagattatttcctgaataaatttgttcaaaaaggaacggccaagcttcaggcttgggtacgttcgttgctgcggatgagtgtgtatcaggtggtttatctggatcgagttccagatcatgcagtcgttagtgaagcggtgaccattgctaagcgtcgtgggcatcaggggatttccggtatggtcaacggcgtgctccgcagcatgttgcgtgagccggacaagctgcgtattcctgacgatttgtcaccagaggaacggatttcattagaacattcccatccacagtggctggttaagcgctggattaagcaatacggtgcagatactgctgaggctatctgtcaggctaataatgagccccctgcggtcagcgtacgggtgaatacgacaatgaccagccgtgatcagctgctggacgagatgcgctcaaaagggcttgatgccgttccttccgcagttagtccctatgggattgttgttcgtagcggtggaaatatggcgcttacctcgtggtatacggacggcttgctgtccgtacaggatgaaagctccatgctcgttgccgaagcagtcgctcctgagcctggcatgctggtactggattgctgtgccgctccaggtggaaaaacagctcatatggccgagctgatgaaggatcaaggccggatagttgcgaatgatctgcatgcccataagcatcaattaatccgtgaacaggctaatcgacttggcctggatgctgtggaaacagtcactggtgatgcgctagaactgaaagaacgctatgctccagcttcttttgaccgtattttactggatgcgccatgctctggctttggagtaattcgtcgtaaaccggacctgcgttggagcaaaactgcgcaggatgttcgcgacattacacagcttcagcatgagttgctggatagtgtggcgggattgttgaagccaggtggtattctggtgtatagcacatgcacgattgaaccggacgaaaatgaaggacaattgactcagtttttaagcgaacatccagagtatgaattggcagagggtcattccttcccggacgtgagccacgaaaaggatagtattcagggaggctcggtacagctgttaccgcagcattttcacagcgacgggttttatatcgcgcgcctgcgtcgggtgaaatagcgcggaagagaattccaggcagctgcccaccagtatttccacattccgccggaacatttccggcggttttttgcatgaagatgaaaaatttttacccctccagggatttgtgctaaaataggaagaatgaaaaatacgatctacgatcaaacagaacttaatgaagaaggaacgggtgcaaacattgatgaaaccttttatatatgatttaactctggaggagcttcaggactgggccaagaacaatggcgagcctgcttttcgtggcggacaaatttttgactggctgtatgtgaagcgggtcaatgatttcagcgagatgacgaatttgtccaaggcgctgagagagaagcttgaggagcaatttagttttgtgacgcttagtgaaattacaaagttggaatcaaaggacggtacagtaaaattcctgttcggtttgcacgatgatcatgccattgaaacggtcattatgagacacaattacggaaacagtatttgtgtaacgacgcaagtgggatgccggattggttgcactttctgcgcatcgacgctcggaggcctcaaacggaacctgacagctggtgaaattactgcacaggtagtacaggctcagaaaattttggataaaacgaatgaacgagtgagcagcatcgtgattatgggctcaggcgagccttttgaaaactatgaagcgaccatgacgtttttgcgtacaatggttcatgaaaaaggtctgaacattggtcaacgtcatatcacggtgtcgactagcggtattgtaccgaatatttataaatttgccgacgaggatacccagattaatctggcaatatccattcatgcgcctaatgatgcgcttcgttcgaagctgatgcctgtaaatcggcgttatccctttaaagatgttatggattctctacgttactatcttgctaagacggggcggagaatttcgtttgaatatgccctgattggcggggtaaacgatcaggcagaacatgctgaagagctagcggatgtgttaaaggacatgctgtgtcacgtcaatttgattccagtcaatcatgtgcctgagcgcaagtatgtgcgcacatcacgcagcgatatttttaatttccaacgtattcttgccgaaaaaggcgtcaatgtgacgatccggcgtgaacagggtcacgatattgccgctgcttgcggtcagttgcgtgcaaagcatatggagttggggtgaaaccatttgatcaaaacagttcatgtcagccatgtcggacgtgtacgttcggtgaatgaggattctgcctggatcaggcacttggagcaaggctatattcttgggattgttgccgatggtatgggggggcatttggccggtgatacggccagccgccttgcggtagagacacttgccgctgatttggcgacgctggagagcggattatccgcacattctttgacggcggcgctcagcgacgctattttgcatgccaatgaagtcatcttccagacggctgcacgcgatgacaagtatcataatatgggaacgacagttgttgcggttttactaaacgatgcatccggaattatcggacatatcggtgatagtcgcgcctacgtcatatccaaaggagcggtacgtcagcttacagaagaccatactttggttaatgagctgttcaaaaacggtcagatcagtaaggaagaacgggagaaccatccccgtcgcaatgtgctgactcgggcgctgggtactgattctgaggtgaaagtggatattgactccattgcgctggaaaaaggcgatgtactgttactgtgtagcgacggattaagcaatctggtaacggaagaacaaatcagtaaagtagtaggtgccgcagagaatcctttggaggagcgtgcggatcgtctgctacatctggcgctgcttgccggaggagacgataacattactgtggctttgtttgaattgcccgatgacacggtttcattgagtgaaaaggggtgtgacgcatgatcgggcacctgctagggggaagatacgaaattattgagcgcatcggtggcggcggtatggcgctggtgtataaggctcaagacattttgctgaatcgcaatgttgcagttaaagtgttgcgccagcaatttgttcatgatgaggaatttattcgccggtttcggcgtgaggcgcagtctgcggcctcgctttcgcattcgaatgtggtcagtatttatgatgtcggccaagaggatgaaatccattatattgtaatggagtgtatcgaaggtaaaaatttgaatgagattattaaagaacgtgcgccattgcaagtggatgaagcagtacggattgcatcccagatttgtgatgcgctggagcatgcccatcaaaatcagattattcaccgagacattaagcctcataatatattaattggacgtaatggacgggttaaggtaaccgattttgggattgctagagccgttacgtcaacgaccattacccagacgggttctgttgtaggttctgttcattatttttcacctgagcatgcaaagggtgtcgtcaccggcgaaaaatcggacttatattctttaggtattgtcttatatcaaatgctgacggcgcagctccctttcctgggagaaagtccaattagtgtagcgctcaagcatttgcaagaggaatttgaggaaccgcgtaaaattaatccgttgattccgcaaagtgtggaaaatgtcattctaaaatccatgcgcaaaaatccagaagagcgttatcaatcggcagacgagatgctaaaagatttggaaacctgtttgctgccgggacggcgtaatgaatccaagctggagtttacacatttggatgatgaggatcaaacacgggttattccggctattaagcctcaacaattagggatgtcttctagcggggatgatgtacctgctcaaccgcgtgagtctgaacagcttccgagcaagcaatcgtccaagaaaaatagaaaaaaagcgattttgtgggtaacactagtgttggtgttacttctgtgcatgggcggagtggtgtactatgtgcaaagtgtactggtcgtgcctgaggtaaaagtaccaggtgtattgacacaaacagaagaccaagcgaaggttaatctcagtaaagcggggctactcattgaggagccaatccagcatgaatacaaagaaggaatcgcgcctggagttgtattttatcaaagctatcctgcagattctttagtcaaggaaggaactaagattagtctgaaagtcgggattgccaagccgctcaccccgatgcctgatgtcaaaggccaaagctacgaaaatgctgttaagctgctgaccgcccagcaaattaaggagacgcagattcagcaaaatgagcagttcagtgatcaggccgcagggaccgtccttagtcagacacccgctgcaaatgagccattcgataaggattcagtccaggttgtgctcacagttagcaagggcgctgacactgtgaaaatgccaagtctcgtagggaagacgcagaaccaagcggaaaacgaggtcaaaaaggctgggctgaaggttggctcgattaaagaagaatttagctatgagcaggaaaaaggaagagtaaccaaacaatggccttcagaggcaggcagtgagttgccgccaaatacggaaattacgatttatgtaagtactggttacccgccagaagcgattacgctaccatttaatgtgcctgttgcgccaaaggaagagggtaaaaacagcaaaattcgtattacttatacggatgcgcgtggagaaaatcaggaatggggaagccgcacgattaatacgacacaggtgtttactattaacctgctaatggctccaaacaaggacagtgttgtctcagtatttagagatggtgactttattgatacgtatcccgtctcatatattgaggcgaaaaatggaacggtgacaatgcctcaaattgctccgcctgctggcacttcgccaacggatacacctgatgatacttcctcgcagaatggaaatggaaacggcgagggtgataacgggggatcttctaatgatagtggtaatagtgggggcgactcgaacaatcaggaggacatgggaggtaatggtgacccttccgcctttgctcctggaacgagttccacggggggcacgcgcagtgagttggcggtcagccataaaaacaacacaggccatgcttcccacaaaaagaaggaaaaagtgattgaggctgttcagcatcagtaaacttgcaatagaaagatgctcgacctgttatacgcaatgaaacttgaacattatgaaggaggacatcttacacatgcctgaaggtctgatcgtcaaggcgcttagcggatattattatgtctccagcctggatcaggatgggcgtccggtatccggcgaagctacggtacaatgcagagcacgcggcatttttaagaaaaaagagattacgcctcttgttggtgatcgggtcgtttacgaactgactgaaaacggggaaggtatggtcaaggagattagaaagcgtacgacggagctaattcgtcctccagtagctaataccacgcttgccgtgctgctgttttccttgcgtgagccggatttaaacctgcctttgctggataaatttttagtccacattgagcacgccgggctggatacgattatctgtctgactaagcgcgatttgtatgagggcagcccttcagaggatgacaccgtgctggccgttcaggaaatataccagaagatcggttatgaggtgctggtaaccagtgcccgtaccggagaagggacggctgagcttaagaagctattggctggtcaaatcagcgtgttctccgggcagtctggtgtaggaaagtcttccatgcttaatgctctagagcctgggttaacgctggagacgagcgccataagcaataagctgggccgaggaaaacatacgactcgtcatgtggagctgattcctctagacaacggaggatttgtagcagatacaccggggtttagccagctggattttctggagctgggtgtagatgagctatctccttgttttcgtgaattccagcagtatgcggaaggatgtaaatttcggggttgtacccatattcacgagcctggttgtaaagtaagagaggccctggaagaaggacatatttcacaggggcggtatgatagctatttgcagttctatcaggaattaaaagaaaaaaagcggaggtactgagtatatgttaaaaatagcaccgtcgattttatccgctgattttgctcgcttgggcagtgaagttgcggaagctgaggcaggaggggcagactggattcatgtggacgtaatggatggacattttgtatccaatattacactgggcccacctatcgttcaggctattcgtccgcacacgactcttcccttggatgttcatctgatgattgagcatcctgaacgctatattggcgatttcgtaaaagcaggagccgatatcatcactgttcatgctgaggcctgtgttcatttgcatggtgtccttcacttgatcaagcagcaaggcgctctggctggagtggctctcaatccgggtacttcaccatatgcgatcaaggaagtgctgccaaatgtagatatgattctagtgatgacggtcaatcctggctttggaggtcagtccttcattccagagacgttaaataaaatcagacaaatccgtgcttggttgaacgaattgggtcgtccagacgtacatatcgaggtagacggaggtattgcggaggagacggcaccagccgtatttgaagcgggggctgacgtgctggtggctggtagtgcggtattcggcagagcagaccgcgcagcggctattgcttcgattcgggacagtgcagcacgtttgtccaagtgaagctgaccgaagcattgtggatgactgtagcgagtatggcgacgggattgctccttagctgtttctcgctagtgaaggctccttggaatgctgttctttcacttttggctgttctaattgtcctgttttattttcgaaaaaatgaacggcgtggtttacgaataggttttgtggtgtgcagcgtactttattatatcctgtttattttcatactctcagcatatctctatgttcgcggacttgtctgatggtatagcctgggatggttgtgcataaatatggttacatgagcgggattctcatgtagcctttttttgtggggcacaacccttgacaggttgcataaactacagagaacggatgcaggaggatgatggggagggtgaggcatgaagttttacacaatcaagctgccaaaatttctgggtggattcgttaaagccattttgaatacattccagaaaaactgaattcaacgtaatgtaaacacaggatgtaggatgaaagctaagaggtacacagggcacgcttcccgggcataacagataggtagctcggcagtaaaaggttggaacgcacgggaaggtgcctgacattttgttttcctgaaccagatggatattactttcgaataaccaaaaaagcacccgtttaaaacgaggtgccttttgtttataacgatatttttttacgactacacgcgagtcactttaccggctttcaatgcacgagtgctgacataaacgcgtttcggtttaccgttaacgagaatgcgaactttttgtacgttgacgccccaagtacggcgattacggttgttagcgtgagatacgtggttaccgctgccaggctttttgcctgttacagaacatttacgagacatgattccacctcctattctgaaaataaccaaattccatatggaatgggtctctcttcaggccgactgggtcagccggactttgtaagtcactaacctgaacaaaacaatacttatatataatatcatagtcaaaaaagctccgtcaactgattcaaaaactttatttatttctctttcgcattatagtacaatatgggatagttattgctgcgattattttgtatttaaatggaatgtgaattcttattccagtcatgccggcggttcagaggcgggactatagttatcattccagccgatgatttatgttgggtagttgactggtttttcattttatatgacctgtagaagagcgaccagacgtgagtacaagagcttatgaaagtgtgacattcgtattcgtcgtctggctttagtataatttaattgaacctgtaggcacagctggataaggtgtggtgaaggttgatagtaaaacaagtgtattaagctaggaaggggaattctcttgagtaatcgttctttgaatggaacagattttaccgcaatggttttagccggggcggaacaattacagcagcatgcggaacatgtcaattcactaaatgtattcccggtgccagacggtgatacgggaaccaacatgaatttgacgatgagcgcgggcgtaacggaattaaagaggggggattcttcctccatcggtgtcatgtccggcatattatccaaaggtttgctgatgggagcccgcggcaattcaggggttatcctgtctcagttgtttcgtggcttcagccgttacgctgccccatacgaggaattgaatacccttcagttcgcatcggcattgcagagcggggtggatgcggcctacaaggcggtggttaagccggtggagggtacaattcttaccgtggcgaaggaagcggccaagcatgctgtatttttctcgcgccggacgaacgacatcacggaattgatggaagaagtgcttgccaaagcgaaggaaacgcttgccatgacgcaggacatgctccctgtactgaagcaagtaggagttgtagattcgggtgggcaaggccttgtgtatatttatgaaggctttatgcaacatcttggaagcggcttggtgacgtctccaactgcaaaaagtgataatgtacgcccggtttttgctcctcacgtatcggagagacctactgctactgcagttgttccttccccagatgcaccgatttctgcgcaagcgaagctcgaaacggataatattgaatttttgtatgatatggagttttttattaatcgacaattgggcgaagcgcaaggtaccgattttgatgaagaagccttccagaaagcgttatccgtagatggtgattctattatcgtaatttcagacgatgatgtcatcaaggttcacgtgcattctaaggctcctggtgaagtgctgaatttggcactgcgttacggagaaattacacagattcgtattttaaatatgcgcgagcagcatcgtgatttgttgtctgcgggtatggatgttgctcctgagcctgagtggtttgctgaaataccaacagagcctgcacgtgaggaagagccgtctgagcccccagctcatgaactggcatcctttggttttatagctgtggcttccggtgaaggaattgctgatattttcagaagtttaggcgtcgatgttgtcctttctggcggccagacaatgaatccgagcacagaggacttcgttaatgcggcgcgctcgattgcggctcaacatatttttattcttccgaataattccaatattattttggcggcagaacaagcgcgtgaactgctagagatggaacgtatggtgtcggttattccgagcaaaacaattcctcagggcattgcggcagcatttgccttccaggaggaagaggcttttgaggtaaatcaggacaatatgcgtgacgcagtcacccgggtgaagtctggccaagtgacctacgcggtacgggatacgacacttgatgacctgcatattacagccgggcactacatcggtattctggattccaaaattgtagcgaccgaggaacacttaatggcaacgtcccgtcttttgctagcgaaaatgctggtgaatggcgatgaaattgttacgattctcacaggttcagacgcaaatcaagaagacacagatcagcttgttgcatggcttgaagaaaattatgcggatgctgaagtggaagttcatgaaggtggtcagccgatttatccttatttgttctcagtggaaacctgatgtgctttagcaagcccatggaagtccacaacaaaaggaggtctgactgatgagcagtaccatcattttgacggatagcacggctgatattccacaagaattagcagaccgtctaggtatagttgttgtacccttgacagtgatgttcggcagcacagcttacctggacggcattgagatgtcagcgtcacagttttacagcgaactagtacgggctgatgagctgcctacgacgtcacagccttcaccagcccgttttttggagacatacacgacgctgttggagcaataccccgagagccaggttatctctatccatttatcctcgggtgtgagcggaacgtatcagtctgctctgctgggcaaatccatgctggagaagcatgaacatagagtgactgtggtggattccaaatcagcttcatacggatacggcatgctagtggtttatgcggcagagctggcggctgccggacactccccgactgatattgttcgggctgtggaacgtcgtggggagcgccgttgtttatatttcctggtggataccctggaatacttacaaaaaggcggacgtattggcaaggcagcggcaatggttggtacgttgcttaacattaagccgattctttcgattgacaaagaaggtattatttattcggttgataaggcgagagggcataaaaaagcgacagcacgaattattgaactactggagcgggatttaaaaggccaaaaaattaatattgctgtgggtcatacggcagatcgctcagcggcagaagcgttcgtggctcagctggcagagcattttgagctgggggatcgaatatatactgaacttggcgctgtgattgggacccatgtagggccaggaacgattggcatttttgtatggccggccggagatgagaggtaatatgctgcaattggatcaaatacctttaaaacaaatacatggcgtgagtgctctcaaagagggagagcttcacgcttttggcatttctaacatacaggacatgctggaatattatccgtttcggtatgaagattaccgactgcgctcgctaagcgaagtgaaggacggagataagattacggtacaggccaaaattatgggcattccggtgcttcagcgttacgggcgcaaatcaaggttgacttgtaaattgatggccgaggattggatgtttaccgcgacatggtttaatcggcatttcatgaaggagcagctaacctctggtcgtgaaattgtggtgactggtaaatgggacctcaaacgtatgcagatgactgttgcagattctgagtttcctgataaaggagtagcccgctcggggacgcttcaaccggtgtactctataggcggcaagattacgcaaagctggatgcgaaaaacgatgaatcagacgctccagcagtttggcgaaatgatccccgaaatattgcctgagttgcttgtacgcaaatatagtatgatgccgcgcaagcaggctattacgggtatacaccagcctcaggacaaccgtgaggggcaagaggctcgtcggcggatggtgtatgaggagctatttttatttcagctgaaaatgcaggcattccgggcgctaaatcgtggtcgagcggacggggtggtacatacggtggataacgccacgattcgtgaatttgtaagggctttgccttttgaattaacggatgcacagaagaaggtagagcttgaaatactgcacgatctacgctcaccttattgtatgaaccgtctgcttcagggagatgttgggtcaggtaaaacagttgttgctgccatcggtttatttgccacagtacgttctggttttcagggagcgctgatggtgccaaccgaaatattggccgagcagcatatgcggtcgcttcacaagctgtttgagccctttggaatcagtgtgggcctactgactgggagtacaaccgggaagaagcgtaaggagctgctagctgctctccaaatgggtctgctggacattgtagtaggcacccatgctctcattcaggaagatgtatattttcgccagcttgggcttgttgtaacggatgagcagcatagattcggagtgaaccagcgtagtgtactgcgtcgcaaaggctataatcccgatgtgctgacgatgacggccacaccgatccctcgtacgctggccatcactgcgtttggcgatatggatgtttctacgttgtcagagcggccgaaggggcgtattccaatttccacctattgggtgaagcacaaactgatggatcgggtacttggttttatttcccgcgaggtagatcagggacggcaggcttatctgatttgcccgttgattgaagagtcggagaagttggacgtacagaatgccattgatttgcatattcaaatgcaacaggcttttccacattaccgcgttgggctattacatggacgaatgactcccgcagaaaaggaagaagttatgcgttctttctatgcgaatgaggttcagttgctcgtttcaacgacggttgtggaggtgggggtagacgtccccaatgcgacgctaatgatcattatggatgcggatcgttttgggctgtcccagttacatcaattacgtggacgtgtcggacggggagcacatgcctcgtattgtgtactgatcgctgatcctaagtcggaggttggtcaggagcggatgaaggttatgaccgatacggacgatggttttgaggtggctagacgcgatctggatttgagagggccaggtgacttttttggcaccaagcagagtgggctacccgagtttcgtttagcagatatggtagcggattttgaggtgctggaaaaggcgcgtgaggatgcaactgatctgatcaaggatgcgtccttttggacatctccgcagtatgaagcactgcgcggttatttgcaaaaagagcagattttccagggggatctcatcgactaatccaccatgaatcatgaggttgttctaaacgttttaaacagataggcacaatggacaggctggccgtcatatatttgggaatgaccgaatgatatgggaggtgtggcaacattgagctatcagcaatatggaatcagtccgcaactggtggagcggattaagttgaaaatgaaaaatcgtgcgctcaaggatcgggttaagcagcagatcgaaggtgtgactaaagcggacctgcaaaataaagctaaggtgcgtcatcttgtgaagaccacttctgctattttaaacgagcgtttgacggctgcgcaggaggagcaattgaccgccttcgtattggcacaaaaaattgatccgtccaatacattccatctaatcaagctgtggggaatgttccgttgattgctatttgaagaggtgcttcgaagcgctctccatgtttttttgtgaagcacagataaaaaaaggattgcctgatatcaggcgatcctttttggtttgttttagttagttcattccccgggcaatagctagtgtgagcttatcatgagattttttatttgtaatgaccgccaattttgatagaccgttccatggcctgcccggcatctgttaaggacgatgcgcgcatgatgatggactgaccgtaccgatcctttaaagtgtccgtcaccttttccaaagcacgggatcgctcctgatcctcaaaaaaatccagttgatacagttgatcatccaccaatccgcttaaagtaactcctgcgcgcttcacaggcatatgattccaaaaagtataaaagatttttttaacggtttcatataccttttgggtatggtttgtaggatcgggtatcttcatttgtcgggagaatccggttggtgcctcgtagggactgcatatacaatgaacagtcacaaccgagcccatatatcctttgcggcgggcgtcccgacacacctcctctgttagttcaagcaggatggtttccacttccgcaggctggagatagtctcgaggaagagtcatcatatgaccgatggatttgggaggtgtattaaatgtttccggcttgaccgggctgtgatcgatcccgttagcagttcgccatattacctctgcctgaatatcggactgcttaccgaaatgagaccggaatttgtcctgtagccgaggtaaggaagtacgtgcgatatctccaatggtgtgtagtccaagcttctccaaatgccgttccattcgtgaaccgatgccgaacataagacgtactggctggggccatagcaacgctgcaatatcggatgcaggcaacaagaaaatgccactgtcattttttttagcccatatatctgttgcggttttagccagcattttgttggagccgataccaattcgaatccatactcctgtttgtgccagtaccttttgctgaatttcacttgcaatactcaccggatccccgaacagggagaggcttccgctcatatccagaaactgttcatcaatgctgaaaacctcaaccaaatccgtatattcgttataaatttctgttatttttaatgagacatcgatataatgctgcatacgcggacgtacaatgataaggtcaggacattttttcaccgcttctcccagacgttctgctgtagatataccgtattttttggccagcggacacgcagctaaaataatgcctgaacgaagtgcagggtcaccggccacaacgagtggcttatgttggtatttgggatcatctgctttttcgatgctagtataaaaactttggcagtccgataagaatatggttctatttctgcgttcctccaaaaatacgacctcctttcctgatatgtgtggatcatccttccaaaatattcttgaatgtatactcttatagtagtattatatacagaacaagtgttcctaatacaaatgtattttttggaacgttacagtttacggaaaacctaacatggcgtatcataatatcttgagcaaaaacaagtggaaatgaatgaatattgaggggagaaaaccatttttatgaacccaaaacgtcgaccatcatctcaaaaacgcagtaggtggcgtatttttggcagagttttgctgattaatatcaagtggttctcgtttgcgggtgtacttggagtgctatttgctggaggtcttatatccggttatgtagcggcactggttcatgatgaacctgtacgctcacgtcagttgatatatgaaaaggtaaatgagaacgctctgaccagctttgtattttttaatgatcaggtaactccggttggaagaatgcgcatggaggaggatcgacagctcgttgatctgaaggatgtccctcagtctattgtggacgccctcatttcaacggaagacagccaattttatgagcatcgtggtgtggatttaaagggaacagctcgtgctgttaagcagaagcttttgaatgaaaaccgccaaacaggcggcagcacactgacgcagcaggtagcccgaagggtttttctcagtctggataagacggacagccgcaaggtgaaggaaatgctgctggcactgcgtatggagcgttttatgggtaaggataaaatattaacggcttacttaaacaaaatgccctttggtaatggttccgctggttacaatttatatggaattaagtctgcttcgttagggattttcaatgtaagtgatctacataagcttcatattgctcaggcggcttatttggcaggtcttccccaactgccatctgtttattccgcttttgatggtaaagggaactttgatgaagaaggcttcaataaagcgatggagcgccagcgtgtcgtgttgggaagaatgctggcaacaggtaaacttacgctatccgaatataacgaggcgcttcaatttgatgtgaaagccactcttgcgccacatcgcgaaaaaagctataacacattcccttatttgatgctggagacagagcgggaagccgcccaattgttagcgctccaacaaaatcccgatatcacagcagccgagatttccaagcctgagtatgccgagcttcttcaaaatacgcgagaagagttgcaacggtccggatatcgaatttatacaacgataaataagaaaatttataacaatatgcggcagattgcagccaatccacaaaacttttctccatacagtaagaagaagggattagagcagattgcagcaatcatgattgatcataaaacaggggctatactcggtatgatcgagggcagggattttaataccgagcaaatgaactatgcaactcaaatgacacgtcagcccggttctgccatgaagcctattgctgcttatttacctgctttggaaaagggctacactcagccagccggtcttattgatgattcacaaatcatattgaaagacgggcgtaaaggttatcatattcctaaaaattataacagacggtacgaggggcttatgacagcccgtgaagcactcaatcggtcaatcaatatccctgcactgaggctgttcttatatgaagttaaaattccaaacgcttggaattttgtgcgttctcttggaattacgacgattcagccgcaggatgaacatgctcagacaggggttctaggtggactaagcaaaggggtatccgtcgaggaactgactgcagcatatggaacgattcccaatatgggtgtatataatgcacctcatctgattagcaaaattacggatgccaacgggaagatcatatatgaatttaaaccgcagacgaagcgtgtatattcgcagcaaaccgcatttttgatgacggatatgcttaaaactgttatatcagatccgaggggaactggtaaacgcctgcaaaatgcttttaaaagctacggtgccattgatatcgccggtaaaaccggtacaacacaaaactttggtgatgtgtggtttatggggtacacacctgacgttacactaggcgtctgggctggttaccgccaacaggttaatacattatctcaagaaggccattccagagcacagtcagtgtgggcactgatcatgaatgaggcggtcaaggaccagcctgaactttttaagaataagcactttatacggccggaaggtgttgtaagagttacggtttctagccttacaggtaagctgccagggcgttattcccgtcaatcgggtcaacttgtgactgactggtttaatcaaaagtatgtgcctactgaagttggaagagaacggcttccgcgttctgctagaccagtggtcccgtccaaaccagatatcaaggaaaaagaagtcccagaggttgaggtacctgcaatagatcaagagaaaattccaccagaggaaacggatcctgctgttcctgacgcagacacagagatagaaatgcctgatgagaataacgatgtgccatcaacagatacttcgcaaccttctgttgaaaacgaacaggggactccttctgaatcggaaagccagagtgagactccaaaaacccaatctgatgaagttatttatccagaaataatatctgatcaacccaaaaactaaacgacaggaacggcttagtttaaaatgccgttcccgacaatgtctacagtgacctgcggatgaaaacggacattgggatattctttattccaatctacacttttccatactgctggatgatgagcgatcaactgtctgcctacgccaaaggcatcacatccattttcctgaagtgtacggataatttgttccgtatcctgggtcatgatttcggaaagttgacggtttagacgccgtacgttagctttatcttgaagatgatttcgtgcatatccaacaatatcgacaggcaatttcaggttaagctccacatcaatttgtccatcatgctgaactttcactttaaggctacgtttgacattctgaatgttagcctgatacgtaataaagttttgcacatcaccgacagatcctggatgtatcctttttacaaagcgagctgtatttttccactttccagtcatcaggacatataaaacaccttgctcattatttaggcttcctgtgaatttttgtccgtgaaataaggcaattccacgtgctgtaatatcttctccttctttggaaagatagggaagcacaaaatcttgacccggatcaagcattggggggagcactgtctccagtgtcatttccgggaacataaacatttcctcaaggcttctgatttttttggttataaattcgccaattaagaggttacctatgcctttttgatctattatttctccagctaatccatctacaatagctaccttgacatgggaagtcggatggtcaggctcacgatacaacacatccagatagggatatagatcttttcgggccgagcttgtaccatacagaataactccgtatttgaaaaagcggatatccccggttactttggctcggattttgtctgtactttgccgaacggaatggccggtgcctgagtgaatttcattggtgcttttatcttgattgctttgagaatcgtctacaacctctagcgtttgcaacaacataccttcaggagtgagatcataagccgatgcatttgccaatcgggcatccttcaaattgtcctgatcccagcagcctgttataaaaatgagtagagttagcattccaagcgctctgctcttttttttcatgtttcaggtccctccttttttttgaagagataggataggatcagcagcagaaaagggaatacaattaggaaaagataagcagaattattggctatggaaccaataagctcgaaatcttctcttcgttgaggtaaataggcaatacaacatgaggcgagcacaacaaagggaaccgcctttttgtgactcttttgcttgaatagatagcttattccgtaagacgccgcataataataaccacttatagcaccaaagatcgaaatgagccaaatcggcagaaaaataaaatcgactcgatccatcgttcccagtggaatggatctgagcaaataaatgactggctccggcattaattcaagctgttgggggctgaatacggttgtacaggtaaatacagtaaaacaatacatagtaccacgatcgcgttagctgccaaaattgacttgagcttgcctatacttttgccctcagtcatgggaaagacgataagaatgaactcaaaaccaaacatcgccaggagcgtttcttttgaaccgacaataatacggggccatcccgcctcagttagaggtagcagataaagcgggttggactgctttataccatagctaattaacagcatcatgggaaaaatcagaaatgaaattaaaacaagcactcgagaccaccaacgattccaatagtttggccaacccgactgggtagacgaaccccggcttctcgtagcacctcaaagatcaattcaagcagcatagcctccacaatcgctgggaatggaacattttccagtgattttttaatggtatgcgccaactctagtggcaaaatagctggatgaaaagcaatcgtcgcaatgtaaatagcaggcagcgtaaaagcgatcaaaaagctcatcattcgaatcgttcttagaaatgaactaataatccaacggccgtgataatcatctggactttggtaaaatgcaaaaaaagagacgggagctatagagcagtagggctaccttcagccaaaatcgctatccgtccctccattagattggcggtcacacgatccggtcgttccgtgctgagctgttgagggaagagggaaaaagggttgtccttaataaactcttgaataaaataaaaccgagggagagcaccatgtcggaggagatcgctttaattctcgttttcactgcttccactagctcaggattagccaagtcttgaacatagacaatagcgattttagtccgggttttagatcccacataaaagtagcgtacaaccagcgacggtgtgacaatttgtttgcgaatcagattcagattgatggataactgctcaatgaatccattgtgcggtccgcgaataaccccttcgttttctggttcgtctgtactgcgagcatacgtcttttcggaagaaaggataaaaaattcttccgccccaattatcataaaaatgcaatatccctgaataagtgaatcagcagcattttgaaggtcggtgtctttttgactgcttaaggtggtgaacatttgatgagagactgcatcgattttctcatataaggcgctcaggatatgagtttgaatcatctcctgatctacgagcgaatcaacatagagcagtataccttctttgccgtcaacggaaattgcctgtttttttaaatcatccgtataaaaaggcttgctcaataaaggaaacatttctgtttaattcaacggaagctgcgtcatgtccagccaagaaagccctcctttttggatgagataggcataatgtgtgccatatggactgagtttatggatcaattcctagatagtgtcccagtttccgccggacctcgctgtgggcaaaggatgaaagcatgaaaaatcgtctttgatagccgcggcatatatacaaaacctctacgccttcacgatttcggatttcgctgtatattttaacccctagtgttttcattcgcgcctttgtctctgctaattgaacagccacacgctgttgtactccagtcaggctacgaacatacaaatcaggcatttttagaggggaagtatgtataatacgaatgtctcgttccagcacatccagcacaagagttagaagtacacagatcttgactagccctgcgtcttcttcagaaggcaaaggagctttattcttgtggttcagtgtcttttggcttggcataaaaatctcctttactccgagtaagaatacaatatataatcattatatagaacgtgtgttctgtttatacctcatcataggtatttttccaaggctaaagcaatcctcaattattggaaaagtggtagagagcgatacccatgtgccattgtgtaaagaattcttgagtttatcgccaatgacagtcaaacagagtttatgttaagctaatggataaaaacttacataaaagaggagatcgttctgactgcggtcagcctctactatttaacttaagaaagtggagaaagaaggtatacatattgtcacgttcgttatatgcagctttattattgttgagcctcatttggggcggttcgtttatgtttatcaaggtgttgttgctacatcaagtaggaccgtggactattgtatttcttagatccagctttggacttatttttatcgtcttattaatgctacttatgcgcaggccgtttaaaattaaaagcattccgtggaaatcggttactctggtagctttggtcaacatggttttgccatggacattgatcggttttagcgagaccaaaatagctagcagtatggcttctgtattgaatgccaccacgccaatatggaccatgttggtggggcttgtttttttcggggctatttttcatcggatgcagtggttaggaatggggctcgcttttgtaggaattattattttattgggtattaatcctgcatctattatttctgttgatcctgtaggttttgggtgtatgctgcttgcgactctctgctatggatttggaacacagctctccaaacgttttctctccaatctttccatgtatcaggctacctttgcaacactgtttggtgcggcggtagggggtggcattatgatgacaattgtggagagacctaatttgtcgattgtttctgatccaggtgtattgggttcccttatagggctgggagttttgggatcaggagtagcatatattttgttcaattacatgattttgcgggggagcgcggaatttgcttcttcggtgacgtattttgtgccagtaagtgccatcgtatggggctttttgctcctgaatgaacatatcggctggaatgttcttacaggacttgtccttatacttggaggggtgtttatggccaaccagcgtagaaccgccaaattaagtggataataatctaaacagaaataaaatacgctttgggctatattaaatgttatattaaatgtacattcgccaaaccttcggtataatacgttaattcgcacatacaataaagcatgctcacacataaaataaaatatggtgcagcaaaaaaagcaagctgtttagcaggtgacaaggtgtggtataataaattatagaattatatgtaccacagaaatgtcggagttttattccacaaaagaaaggatcaggataccatgtgtccccgaaggatacttccccaaaggacgatttggaaacgatttgatctgtcttatacttagcttttccgcggagtaacgtcaagttgcgaaagccaactctgcggaagaggggattgtacatgcgaaggaccaagtcctccaggcacatcttatccggtagcttccgtaagagtgggttcatccacatcaaacttacgagaaaccgagggagcctgtatgaggaaaacttacgaatctatcgtgaacaatggagcattgagacagattgctgtcatgttgctcggaacatgcattttagcttttacgtactatcatattaatgctcagaatcatttgtcagaaggcggatttgcaggcttggccctgctgggacattacgcatttggcatatctccagcatggagtatgttgctgcttgatattcccgtcatattgctggcatgggtactgaagggcagaagatttatgctgcttgcgttaatcggagccgtcgctttttcactgttttatgcaggatttgagaagtattcgactctggttatagatctacatggaaatctgctgatagctgctctactttgtggggtgcttacaggtttgggagccggaatcgtattgcgattcggtggagcaaccgggggcgatgatatcttatctctgctgatcagtgagtggcgcgggtggaaaatcggcaacgtgtttattgtcagtgacatcatcgtattgggattatcactgttgtatctgcctatgaaggaaacaatgtttacaatactggctgtgtggcttgccggaaaaataattacatggacgaccacgttccaactgcaccgacctgtgaaaaaggtactgccagcggctattcccgctaaaaaggtagttaccaaaacagtgccggtcgtccacagccttcgtcaataaggaaagggtgttacgtcaggagagaaatcttctttcgtaacaccctttcgctgtattcagcttctatcaggaaggctttaaagtagaatggatgcgtccattctgatcggaagaagcggaatgatggtcgtgtacattttcgcttgaatgctgtttttcatgttttttaggtttctcatcttgctcggctggatgattatcgttccattcctcggcttgggaagtggcaatcgcaatcgtgcgtccttcttcatagccgtcacggagtagagcgttagcaatatcaacggctttttctcgcacccgaggtcccaggtttttcatggatggagggtaatcatgtttgttccaaggcatagttgcacactccttatagcggatgatgtattatgtattacccgttgtcggcttaaacaaacggaaatcaaagaaatgaatatattgtaaaatgtaccttgaaaaaaagcgtataatggtgtgcagaatacgaggaaaaggagtgaagcatttgcttgcctggggttttgtttttttgctgactatcatcattcatactacagatagcttgtcctatgctctccggcttggtggtttgcgagcgcgtcggattggattggcgttaaccgttgcgggaatgctgctgttggtttcacgcacctctaacatggcgcaggggcctttactcggagggatggtcgatcaggctaaagctgcagcacaagggggcggtacggatattagactggagctatatatgcatggggtactgctggcagcaaccgttggaaccatgcttgctatattactgtatccaacagtggtacgcatgtcagccagatggattgtgcatttggagcataccggatctattccggccttgatgcgtcatttattgctgcgaagtcgctggaagcatgcaggctactacataaagcgccctacctggtccatgctaacctcactgattggcggagcgatacccaagcgtctaattattctgaatataaccgttactgccatttatacaactggagtagtatctgctttatatgcatcattcctctggcctgctcaaggtacagccatgtcaatgtcgtcaggtctaatcaatggcgtcgcaacggtattactgaccttgttaattgatccaagattggcggttctgtcggagaaaacgctacgaggggagctacccttaactcggatgaacagcatgtacgggtggatgatcatctcgcgtttggcaggtactttattagctcagctattactagtaccgctagccatttggcttggatgggtaatgagttaaattgctagcttacgtaatgatgtgcggccatatcccaaaaaggctggcccgtgatcatctattaaagatggatcgcgggtcagccccaatgattctatggctacttacttttcaaataatgacttatatgctccgtatccttcacgctccaaatcttcttgaggcacaaagcggagcgcggcagaattgatgcaataacgcaaaccatctggacctgggccatcatcgaatacatgccctaaatgggagtcggcttcacgacttcgcacctcggtacggatcataaaatggctgagatcggttttttctttgacattgtagctgcgcagcggacgggtaaagctgggccaaccgcaacctgcatcatatttgtccaatgaactgaacaagggctctcctgatacgatatccacgtaaatgccttcaccctcatgatcccaaaactcattttgaaaagggcgctcggtcgcgtttttttgtgttacttcgtattgaataggcgtcagccgatctttaagatcggatttatcaatcttgccggaccaattttgctcgataaaatcttcacgtcccgaacctttgcggtagcgtttgtaatgagcggggttcttcttatgatagtcctgatgatattcttctgcttcataaaaagtggccgcaggcagaatcggtgtagcaatcggcttgtcgaagcggccactttgagtcaaagcttctttagaagcttctgccttgattcgctgctcttcattatgatagaaaatagccgtttggtaggatgaacctctatcgtgaaactgtccaccttcatccgtcggatcaatctgctgccagaagagctccaacagtttttcatacgggaatacttgtgggtcaaatgtaatctgtacggcttccacatgtcccgttgtttcagaacacacctcttcataggtaggattttcggtatgtccccctgtgtatccagatctaaccttcaaaataccgggtaattcctcaaaaggggaaaccatgcaccagaagcagccacctgcaaaagttgctttttctaccgtgtgtggattgttggtgctcatatttgtcactccaatctgagaatgtttaattagttgttatttaaatagcttacaattaaattatatacgagatttttgcaaaatccaacgaaacgtcagaaaccaagcgtagtgtaaatggctatgtcctaaaaaacgcaatgaaacatcctacagagacggtggcaaactatcgctttatattctattggcgcgttgaagccttttcggtagagtataaaggcgccgccaaccagtgcagtatatagcactaaaatgagcaaaccggtgattgggtgttctgcaaaggtgccgccagcataagcatacaccgcaattgcgggaagcttgcccatagctgtacctaggataaagctccagaacggaaaccctgctactccagcgtatacatttaccgctgcttgggggatgactggaatcaggcgagccagcagaacagcagcaaaaggttccctctccatgactcgattgaagcgctccaatgcgggaacccgcttcaaataggtacgtcctttgtcacggaacagggtacgtactgcagtgaaaacgaccaacgcagccaatgtagtgccaagccagcagatcagagcaccttgccaggggcctgcggcataagcaatggaggcgataatcagcttgtaaggcacaaacggaattagcgcgaataaaaatgcgagtagtagcagaactggaaaggaggtctgcttgtccgcccaagcgagccaatcatatctgtagataaacgcgatgcaaagcagcgaaacataagccgcgacgaatagccattttttcatttacatacctctttcaatatccctgttcggcttatcgcttatacagaaaaaaatagggttcacattcccaataatgtgtgctatactgccactaacagaatagttcccaaaggggagtagctcaacgagtaaagtcgtcattacgggatttttaatccccggctttattggcaacgtaatgttgtaagcgagacctttgccaggattttaggaatccgggtaaatggtctttttttgatgccaaattttgggtcaagcgccgtttccggattccgtgaaatggcgcttttttagtataaagcgctgaactatgtacagtataacaaataaataaaaaaaggtgggagaaacgtatggattttttgtcaattgagtttttaaccgcattagtatccatcattatcattgatctggtgctagctggtgacaatgcgatcgtaatcggtttggcggctcgcaatgttgataaggccaatcaaaagaaggtcattatttgggggacagtcggagcggtcatcattcgggtgattgctacagtgctggtcacgtatttattgcaaatttatggattgcgtttgattgggggactcgcacttatctatattgcctataagctgctggtcgaagagaaaaaacatgaaatttcagctacgaatcaaatgtgggcagcgatccgcacaattattatcgcggatacaatgatgggcctcgacaatgtacttgctgttgcgggagcagctcatggaaacatgttgctcgttatattgggtctggcaatctccgttccaatcatggtgtggggaagtacgattatcttgaagctgactgaacgttacccagtagttattacgatcggggctgctgtactggcttatactgccgccaaaatggtggtggcggaaccgctgattgcacactggtttatgaacggggtcgttaaatacggctttgaggttctggtcgtggttctggttgtagccattgggatgcgtgttaaaaaaattaaaagtgaaaaaacaagaaagcaagcgcagcacgcctaaactaacttacattaagtaaacttagctgaagctgaacgttcatgccatagagggtgttccgttaggtcctccaactggaccgggagcagtctcttttctttgcttgtcagcagacttccatgtaaactagacaacagatgaatgagtgattagaggtgggaacgatatggacaaacaaacgaagacaagagtagctattgcaggactgggtggtatcgctcgaaaagtatacttaccgttactggcagcacaccaaggtgtagatattgtaggtgtcatgaaccgttcacaggagccggtgagttccattatggagcaatataggttaccaagaggaacgacagatgtgaaggagctgctagcatgggaaccggaagctgtatttatacatgccgcgaccgaagctcattttgatctggttatggcgtgtattgaaaaaggaattgccgtgtatgtcgataaaccgttgtcctatgatgttcgtcagaatctggaaatgaccgcttttgcggaagcgcaggccgtgctgctggcggtgggctttaatcgacgttttgccccgcattatgtagctgctaaagcatggttagaagaagtaggtggatttagtcaatgtgcggccattaaacaccgtactggatatgatcgaagaccggcggcacagacggtttatgatgatttaattcacatgcttgatttgcttttgtggctgggtggcgatgattatgagctgctgcatagtagtctgaatacgacgagtgaaggatatatggatgctgcgttcgggaccgtacgtttggggaatgctaccggaagctacagtatgagtagacaggcaggagctgacatagagaagctggagcttcacggggcaggacggtctgttgaagtaacaaatatggaacaggctgtttttatgcaaaaaaatcattcaccactaacgcaagcttttggaagctgggatacgattttggaaagacggggattcaccggagtcgtaaatcattttctggagcatattcatcgtccagaggagtgtgctgtacgggctggaaaagtattggatagccatatgctggctgacgagctgatcagccgtttgagtaattaatatggaacatccgaacgtgatcttaacagtccagacagacatcaagaattaggttgaaggagaaatgaatgaatggaagaagataaccgtggtaaacagctagaagaagccatcattgaaaattataagcaagaagaagatatgatgatccttgtgtttgcgcaatggtgtatcaatcacgggttggagccagaggaactatatagtgaagcatatccgcatcaggatagcaacgagcgtctgctacgagtacgcaagttgactgtatcgcgtgaagaagcgggtgatattccgctggatacggtattaggggtactgtccatgttcggaaatgaggacttggcgatggtcgtatctgaggcggctgcgggccttccgtctgaacggaaatagggctagccagaatagagaatatactgttatcatttatggcatcatggacttaactatatttacttaagacattgttgatggggaggataagcttacgatggaagatatacctgtgccaagtacttgtaaaggctgtgaaagagatatctcgatatcggaagagcaaattaccagaattctaaccaacatgagacccaaaatggaatgtgtaaatgatgaagtgtacgaagccagactgttggtctgctcacaatgtgaagagttaatgtccgggcatacatgtggtatcagcggaagcattgttcgtgtacgtgctttggcggcagctcaaaattgtccaagttaccatggttcacgctggataggtacagcctaaaagatacaatgctcaggctcggctgaacctagattacgggttaaaatagtcataccttggtctgccttaatggcaggctttttggtttgattggacttatcttaacgattgacaaaaagtagacaataaaatatattaaacacgtgaaatgtttttgtttaattattaatatttatattaatgtttactaaaagtaatgatgcgtaaaaattatgatcgaaagaaaatcggtggtatgagtgatatttaggccaaaatgaaagcgcaaacatttgtgcgggtgttccaacaatcttaatatttttggggagggtttgttgtgaagggttctgttgttgttaataccgattggaaacaaggcattattaataaaaacatttatggacaatttgctgagcatcttggacgttgcatttatgaaggcatatgggttggagaggactcaccgattccgaacacaaacggaattcgtaatgatgtagtggaagccctgaaaaagctgaacattcctgtgctgcgctggccgggaggctgttttgccgatgaatatcattggaaagatggtatcgggccaaaagaaaaccgtaagagaatggtaaatacgcattggggcggtgtggttgaaaataatcattttggcacacatgagttttttcaattgtgcgaactgttagatgcagagccttatatttgtggaaatgtcggcagtggtacagttcaggaaatgtcggagtgggtagagtacatgaccttcgatggagagtcccctatggctgcatggcgtcaggaaaacggtcgtgagaaaccatggaagctcaaatattttggagtgggtaacgaaaactggggttgtggcggtaacatgcgtccagaatattatgccgacctgtatcgccgctatcagacatatgtccgtaactatggcgagaaccgcatttatcggattgcaggtggggcgaatgtggatgattatcgttggacagaagtgttgatgcgtgaagctgggcatcttatggacggtttgagcctgcataactatacgatcccgggaaactgggaagggaaacggcaagcagtcggttttgatgaagcggaatggttcgagacgatgaaaaaatcattgcatatggatgaattgattactcgtcattcagccattatggaccaatatgatcctgacaaaagggtcggactgatcgtcgatgaatggggaacctggttcctgactgaaccggggaccaatccaggcttcctgtatcagcaaaatacgatgcgcgatgcactggtagctgggctgcacctacacattttccataatcaccatgaccgaatacagatgacgaatattgctcaaatggttaatgtattgcaagccatggttctgactgaaggccctgctatgctgttgacgccgacataccatgtatttgaaatgtttaaggtgcatcaggatgcgcaagcactggctgttcatgtaaaggtaggcgattatgaatatgacggagattccatcccacaagttagcgtgtccgcctccaaggcgcaggacgacaatattcatattagcttttgcaacgtccatccgggcgagtcgggaaacttgaatttggagctaagaggactggaagaaattaaaaagatcagcggtgttgtccttgccagcgacgatatgcaggcacataatacgtttgatcagccagagcgtgtgaaaaaggaagctttcacatcctatcagctgcaaggtcagcatttggatgttacactgccaccaatgtcggtagtgatgctgacaattgctccgtaaaaaaaacggtcgtggtatgtaagcagtattcactattattggttatgaacaaagagagcgttcaggtgaacgctctctttgtcctacaattgctcacggtgaatcaccctgaattctttgggcgacataccgaagcgggaacgaaatacacggtgaaaatacgtgtaatttgcaaatcctgacgattcggcggcttgttccagtgacatgggactgaaaatgattcgttctctcgccatgttaagcctgatgtccagcgtgtactgcataatgctcgtatcgaatgtttccttaaacagatgtactgctcgggatacgctgataccgacgtgtgaagacacgtcatccagtttgaagttagaggatgcgttttcttcaatataatttttaatctgatacgcaagatagttatgatgagtagcgataggatgatcggatagcatacggtcaaactccaaacataaaatgcgtatgtaataacttgatatttccgggtaaggattagaaatacgtcgttgctccatcacaagctgacgaaataggccaagcagggcttctgtgagctgaaccttaattctgttgggtcgtttatgatggttccaccactcatctacccaggaaccaccgaaaaaaatgtgataatctccactttccacgacctgctctcccatggggttcaactcactatgaatatccagttcataaggctcggtaggattgaatagcagtaggtcacccgcctcaatccgtgtcatttccccgttaatgcgggcctggcagcgtccatctgtttgcaaacggaataaataatttttgatcccatcaggctggttcgaataaaagggctttcgatggaaagaatagcctgcggtaagaacctgacaaggctcgacgatagacatgatgatgactcctttgggcatatggctgtttcaaatattgaccagattgttcatgttttaatcatattattcattttaaacgaaacagaaatagaatactatgtgaactgtaaagcttacatgttagatgagaaagtacatgttggaggccaaggagtgtgacgacgtggaacgaatgaaggccgggattatcggatgcggtactattagctcggtatatcttgaaaatctccaaaagagcccacttattgaagtggtggccgtcgctgatttacaggatgagagggccaaggagagggccgatgaattcaacattgtaaacgtatacaaagtggatgaattgcttcgtcagcctgagattgagcttgtatttaatctgaccgtgcctggcagccatgcacggacagatgtggcgaaactagaggcaggcaagcatgtgtacagtgaaaagcctttggcgcattgaaattcacggaccatcgtgccaatgctgaactggcctaccatgtgttagaagccatgcatgcttttcagcgctcaccattggatggcaatcacattacgatggaaagtacgttcaaaccggacgaggatttgtattatggaacagatataatggaaaatccatcctaattaaagaggtgaaggggaatggctaaagtaggattgcaattgtacacagtaagggaagagcttgaacaggattttgaaggtacattgcgcaaggtagctgagcttggctataaaggggtagaatttcatacctttttcggacgcaatgccaaggatgtcagagcgcttttggatgagctgaatctggaagttgtcggaactcatatacaatattctcgtttgctggatcatttggatgaggagattgcataccacaaagaattaggaaataaatacctaatcgttccttatttaaccgaagaacagcgacagtgggatgaactttttgctaatttggatcgtattggtgaaaaagtgaaagaacagggcttgatactggcttatcataatcatgattttgaattgacagaaaaaatcaatgatcgcccggtattcgatgctttatatgatgcggtttccgatgatttgttacaggtcgaaatggatacttgttgggtatactatgggggctatgatccagtggaatacatcggacgttataatggacgcctgcctatcattcacttaaaggatatggcacgtgacgagcaacaaaaagcagtgactgtagagcttggcaaaggtgaagtgcagcttcaggccattacagacgccgctattcaggcaggtgtggattggatcgtcgtagaacaggatttctgctcaaaccctccaatcgaaagcattgaaaccagtattaagtggctccaacaatacgcagctcagggaggaaatattcatgtctaaaacactcaaaatcgggattattggttgtggaggaattgccaacggcaaacacttgccgagtcttgccaagcagaaacgtgcagaaatcgtcgcattctgtgacatcattcaggagcgcgctgaagaggcagcagaaaagtttggagttgaagactcgcaagtttatagcgattaccgtaagctgttagaaaataaagacattgaagtcgtacatgtatgtacacccaacgactcgcactcggaaattaccgtagcggcgcttgaggcaggtaagcatgtgctgtgtgaaaaaccgatggctaaaactgcagagcaggcacgggaaatgctcgatgcggccaaccgtacaggtaagaagctgtctattgcgtatcaaaaccgttatcgtgatgatagtttgtatctgaagcaattggtcgaacaaggagagcttggagacatttatctgggcaaagccattgctctacgccgtcgcgcggttccgacttggggagtattcttggatgaagagaagcagggcggtggcccccttattgatattggcacgcatgcactcgacctgacactctggctgatggataattacaagcctaaaagcgtactaggttcaaccttccataagctaggggatcgtaaagatgcagcaaatgcctttggaccttggaatcctgaggaatttaaggtagaggactcagcttttggttttattacgatgcaaaatggagctacgattgtactagagtccagctgggcattgaacgttgtagaatttggcgaagcgaagacgctgttatgcggtaccgaaggcggagccgatatgcaggatggattgcgcattaacggggaaaagaacagccgcttgtttgatacgaaaatagatctggatgcaggcggtgttgccttttactctggagaaacggaaaatgaagcagaccgcgaagcccgtttgtggatcgaatctattctggacgacaaagaacctcttgtgaagccggaacaggcactggttgttactgaaattttggaagctatctatgaatcggctcgtacggggaaagctgtctattttgactaagcccgtaattatcccgaatagaccatcattataatgaaagcagctttattcacatatgatacagggagggatttcttttgaaacttggagtatttatggtgttgtttggcggacgttcgctggaggaggcgctggattatgtggcttctcaaggattggatgctgtagaaatcggtacaggcggcaaccctggggataagcattgtaagccggatgagttgctggagaatgatacagcgctcaaaaatttcaaaaaggcagtagagtcccgcggactaacgattagtgcgcttagctgtcacggcaatcctctccatccgcaaaagcatttggcccaggctgatcatgatacgtttcttaaaaccgttcgattggcagaaaagctggaagttccagttgtgaacactttctctggctgtccgggtgatcacgaggatgcgaaatatccaaactggcctgtggctccgtggcctaatgattttcaggaagtgttgaagtggcaatgggagaataaaattattccttactggaccgagacggggaaatttgcagcagatcatcatgttaaaattgggctggagctacacgggggcttctccgttcatacaccagcgaccttgcttcgtttgcgtgaagctgcgggagaggttattggtgctaatctggatccgagccatatgtggtggcagggaattgacccagtgcaggcggttcaaattttgggccgagagggagccattcaccattttcatgccaaggatacgacgattgatccgatcaatgtaaataaatatggacttaccgatatgcaggaatatacgaaaatgctagatcgtgcttggcagttccgaactgtgggctatgggcatgatgtaaaaacctgggcagatattatcagtgccctgcgtctggtgggatacgattatgtagtgagtattgagcatgaagatggtctgatgtccgtggaggaaggctttactaaggctgtccacaatcttcgccaggtactaattgaagaaccgctgagcgagatgtggtgggtctaacctaatagggggaaatgttgatgattaacgtcaccatttggaatgaatttttgaacgaaaagttgaatgatgaagccaaacagatatatcctgacgggatacacaaagcgttggctgacggcctggcaggagagggatttgccattcgaacagctactctgcgtgatgatgccgagcatggtttgggagaagatattctgaattccacagatgtgctgctgtggtgggggcataaagcccacgatcaggtgagcgatgaagttacggcgcgtgttgtcaagcgagtgcaggaaggaatggggttgatcgtgctgcactcaggccatttttccaagccattcaaagccctaatgggcactagctgtgacctgaaatggagggtggcaggtgaacaggagattatttggtcggtgaatccgtcacatcccattgcagaaggcatagatgccaaaattttgttgaagcaggaagagatgtatggcgagttctttgatattcctacgcctgatgaactggtatttgttagtaactttgaaggcggcgaagtatttagaaccggatgtaccttccgccgaggtagcggtaagatattctatttccgcccaggtcatgagacctatccgacttattaccagcctgatattttgaaagttatcgccaacagcattcgttggacttcttcgacaagtattaacaaaccaatatatggtagaagtgaacctgtaaggcctctcggtggagtgttggtataatgacaatcatcacatatagatgagctgtataatgaacagattgataggcggaacctcctgggattccgcctttttgtatttaatgatttagacatatacctgctgtgttggtttgttgtataatcagttttggtcatggcaactttatcggcgcaggtatttaatttaagaagaaagtgttttctttcgggataaagtatgctaaaatgatatatactaacaaaaggaaagctttatcaaaccgaaatgcaaaagaaggtgaaaaatttggagagtcaaccgcaatgtgcaaaaatgtgtccgcgttttgaaaccgccttttcatgtttgggcaagcgttggaatggattaattattcaatccatgatgagcggtcctaagcggtttaaggatatttccaatctgattcccacaatgagtgacaaaatgttatcagagcggatgaaagatttggaaaatgaaggaattcttacacgtcatgtatatccggaaactcctgtccgcattgaatacgagctaacaaccaagggccgtgcacttcagccggttatggaacagattcaattttgggctgaggaatggattagatgagcaccaaactaaataagcgtttctcatagcaaaacagccttttcctaggaaaaaggctgtttttttattttgtgtataggactacttatccatatcacagaaatgatgtgcataggtagcacggcttaatagcctttgacgcgccctgcaactgagaataatgctgctgttgcacggcggggcacacgggtttgaatatccagcgcggccgaacggaatgtacccagacaggaatggcaaagtcttcctgcataaataggggaacggcaggactcacaaggataatcgagctgactgtatgtggagggaaacttgcctgctcttacccagtctgtgagtaattctataggtgtgccggttacatcactgagctggcgggtatgagtagaaggatgcttccatagatagttagaacagcggtctaagaatatattttcttcctgaatacaagtactacacaggtttctaaggttctgacgaaaaacggaaccacattttgggcaattagaagtatgtatctccatagaaaccagtcctttgtatcgaagtgtagtgaaattttaaaatttattagttacatattactatgaccttatacctatatcaatctttatttatggaatcactgatctaagtgtatgttggagtctgtgttgacataactctgttacttatgtactattacttacataaagttacttaatgaataaaataaattattgatgacaaggggatctttatatgatgccatctttatttttggcccacggctcaccgatgcttgctattgaacagacggactatacttcatttttagagcaactggggaaaagtattcgtcctaaagcggttgttatctttactgctcattgggaagcgcaaacgttgacgatcagttcgatggatgacgtgtacgataccatttatgattttggtggtttcccaccggaactgtacgcggtgaaatatccagcacatggctctgtcgaactggccaataagctgaaaaaattatatgaacaaaagggtattgacgtacaaactgatcgggtgaggggactggatcatggatcctggacattgttgcatcgtatgtatcctgaggcagacattccggtagttcagatctctgtaaatccatatctctcgcccaaagcacaatatgtcattggtgaagtgctacgtggactgggagaacaggatattctggtcattggcagtggcgtgactgttcataatctgcgtatcgtcaaatggggagaaacgaaaacagaaccttgggctatagattttgatgattggattattgaaaaagtgcaaaatagagatatagaggctttggatcactatgaaagtgaagcaccgtatgctcgtcaggccgtaccaagagcagagcactttgtaccgttgtttattgcgatggggagtggaaatcctgcaaacaaagccaaggtcatccatagaagctatgagatggggaatttaagttatctatgcttacagttttagaaagtttgttgccagaagaaggactattgttaaaatgcttcgctactgctcctgtataagtaggggagtggaaataaattagggagtgttataagctataatggcttataacactcccttttacataaataacgattcattatatccggcaaatctcacgagggcacaattcacaatgacacacgccttgcagcatttccaaatccttgacaacaatcatgccgttatcgtattctactgcatttttcttacgtagatcactaagcatccggtttacgctttcccgagtcgcaccgatcatattagataagtcagtatgagtaattttcttatgaatcaggatatgttcgccgtgaggctcaccataggtattgcatagacggatgagtgttgaacataaagcacctggcttgccgtacatcatcaaatcgcggaacttagtctgagtaatacggtgatgcgaacccatccatttcataaagtcaatcgcaaaatcacaatgctggcaaataagcagttccaaatctgtatgatcgattacgccaatatcactatcttccagaacctcagcagaaaaggaatgcttagtaccgaaaaatggatcagcttgaccaacaagatcgccgctttgatacatatatagaataagttccttaccttcatccgttgttttggttactttcacgcgtccgcgcttaatataaaacagcttatccgctgtatctccttcccagaacagatgcgagctttcaggcataactcgatctttcatcatcacttgcaaccggttgaagctggcctccgagaagcaacaggtgttgccgcgggcttccattacatttgtagggtttctcatcgtccatttcccctttgtatcctatgttttttatctgcaacttgatcaattcaaattcattatatacctgcgcaatgcgtttttggggcaagaagagggggtaaaagtggcagaattccaaactttgtgatttaattcacttcataaaataaaattttaaatagattgtgaaaaaaatcacaatatatcttgaaaagctgtgttacgatcagtgcgtgaacaagagatagtacacgagataacaggaggatgagggaaatggctgttaaaaacgaggttatccaaaaagagcaaagcgcagagcagtatattcaaacgctgattgaccgggggaaccgggcacagcaagctttcatgagtatgaatcaggaacagattgacgaaatcgtacaagccatggcactcgcagggatggataaacacatgtacctggcgaagatggctgttgaagaaacaggacgcggtgtgtacgaggacaaaatcaccaaaaacatgtttgcaacagaatatatctatcatagtatcaaaaatgaaaaaaccgtcggtgtcattgaggacaatgattttgacagttttcaaaagatagcagagccagtcggcattatcatggggatcactccagtgacaaacccgacttcgactacgatgttcaaagcgctgattgccattaaaacacgtaacccaatcattttcggtttccatccatctgctcaatcgtgtagtgcggaagcagcccgcgtcttgctcgaagcagctgttaaacatggtgctccagctgattgtattcaatggattgaagcaccttcgatggataagaccaatgtactgatgaaccaccctgatgtggcgctgattttggcaactggtggatcaggcatggttaaggcggcatatagctgcggtaaacctgctctgggtgtaggcccaggtaacgtgccttgctttattgaaaaaacagcagacatcaagcaggctgtgaacgatctcatcctctctaaatctttcgacaacggtatgatttgtgcttccgagcaagcggttattatcgaagagccaatcttcgaacaagtgaaaaaattgatgatcgctaacggctgctattttgtaaataaagaagaagcagctaagctcactcaaggagctatgaatgtcgagaaatgtgcagtgaacccagcaatcgtggggcagtctgctgtgaaaattgctgaaatgagtggtatcacagtaccagcaggaactaaaattttggtcgctgagattgaaggggtaggaacaaaattcccattgtctgcggaaaaattgagtcctgtattggcttgctataaagtaaaaaatgcggaacaaggtattcaacgtgctgctgaagtcgtggaattcgggggcatgggccactcgtccgctattcattcgaacgatgaggacgttatcgctcgcttcgcaaaccgtctgcaaacaggacgtatcattgtaaatgcaccttccacacatggtgcgattggcgacatttacaacaccaaccttccttcgttgacactcggttgcggttcgtatggtcgtaactcgacttcgtcgaacgtatcggcagtcaatttgattaatgtgaaaagggtggcgaaacggacggtgaatatgcaatggttcaaagtaccttccaaaatctattttgagaaaaactcgacacagtatcttgctaaaatgcctgatatcacacgtgtagccattatcacagaccctatgatggtacaactgggatatgtagatcgtgttattcattatctgcatcaacgccaaacaccagtagctatcgaagtgttctctgaagtagagccagatccatcgacagttacggtagaacgtggtactgaaatgatgagacgtttccaaccggattgcatcatcgcactgggcggcggttccccaatggatgctgctaaaggcatgtggatgttctatgaatatccagatactgatttcaataatttaaaacaaaaattcatggatatccgtaaacgaatttacaagtacccacgtctgggccaaaaagcacaatttgtagctatccctacaacctcgggtacaggttccgaagttacatcgttcgcagtaattacggacaaaaacctgggcgacacgaagtacccactggctgactatgagttgactcctgatgtggcaattattgacccagtgtttgtatattcgctacctaaaacagctgtagcggacacaggtatggatgttctgacacatgctatcgaggcttacgtgtccgtaatggctaatgactacacagatggtctggcaattaaagccattcaattggtattccaatacctagaacaatcggctctgactggtgataagctggctcgtgaaaaaatgcataatgcttctacacttgctggtatggcatttgctaatgcattcttgggcattaaccacagtcttgcacataaatggggtggacaataccatacagcgcatggtcgcacgaatgccattttattgccgcacgtcattcgctataatgcgaaaaaaccgacaaaatttgcttcgttccctaaatattcgcactttgttgcggatgagcgttatgcagaaatcgcgcgcatactgggactgcctgcacgcaccaccgaagaaggggttaacagcttgatcgaagcgatccgtaaaatgaataaaacacttggtatcgaggaatcgttccaacaaatcggtttcgatgcaaaggatttcgaatcacgtgtagactatctggctgaccgcgcatttgaagatcaatgtacaactgcgaatccgaagttgccgctggttactgagttggctgatgtctatcgcaatgccttctacggacgttttgaccaataatataataggtacgaagaggcttgtgaaaaagcattttctcgttcaataccgatgcaggctctctatatagagggcctgttggtttgggaagggaggtgaacggcaaggctaaggatataggcgtgaagctagggaaaataaagtgacaaaaatcactcatattgtgatttttgtcacatactacactctatcattattctacaataagggtgtaagaaaggtcccgacactgagcgtaaggcatcggtgaaaaggccgggctcaagaaatagctttatcgtgaaaaaaatcacaagtccggaagaccaaacaatttggagggatttacatgtcggtgattgagagagaattacaagagcaacaatctggctggagaggttttaaaaaaggcaaatggactaaagaagtcaacgtcaacgattttattgaaactaatatcttaccttatgttggcaatgaagaatttttggttggtcctaccgccaacacaactgcattgtgggatattgtatccgatcttactaaaaaagagttggcaaacggcggcgtgcttgatgtagacgtgaatacgccatccactattatttcacataaaccgggttatctagaccgggataaagagcaaattgtcggtgtacaaacagatgctccattcaaacgctctttgcagccgtttggtggaattcggatgatgatcgacgcttgtaaagcctatggttttgaagtaccagaaagtatcattgatatcttcactcatattcgtaaaactcacaaccaaggtgtatttgacgcttatacagatgaaatgagagcagcccgtaaagctggtatcattactggtctgccagatgcatacggtcgtggtcgtattatcggtgactatcgtcgtgtagctttgtatggtgtagccttcttgatccaagataaaaagctgcaattgaaaagccttgaagttgattccatggaagaagacgtaattcgtcttcgtgaggaaatttccgaacaaattcgtgctttgaatgaactgaaacaaatggctgctgagcacggttttgatatttccaaacctgctaacaatgcgaaagaagctttccaatgggtatattttggatatcttgcagcaatcaaagaacaaaatggtgcagcaatgtccttaggacgtgtatcttccttccttgatatttactctcaacgtgatatggaagagggtacaatgacagaagaacaagctcaagaactagtcgatcattttgttatgaaattgcgtattgttaagttcttgcgcacacctgactataatgaactgttcagtggagatccaacttgggttactgagtccattggtggtatgtccgtaactggagaaactcgggtaactaaaaacagcttccgtttcctgcacaccctctacaatctgggacctgcaccggagccgaacctgactgtactgtggtcggaaaaattgcctgaaggcttcaaaaagtattgtgcgaaagtttctattgaaactagctccattcagtacgaaaatgacgatctgatgcgtccaatttatggagacgattatggtattgcttgttgtgtatcggcaatgaaaatcggtaagcaaatgcaattctttggtgctcgtgccaacttggctaaagctctgctgtatgcaattaacggtggtaaagatgaaaaatctggcgttcaagtagggcctgaattcccagccattacaggtgaagttctggattatgaagaagtgttgagccgcttcaaacctatgatggaatggttggcaaaactgtacatgaacactttgaatgttattcactacatgcatgataaatatagctacgaacgcattgaaatggcgttgcatgatcgtgatattctccgtaccatggcttgtggtattgcgggtctgtcagttgctaccgactccttgagtgccattaaatttgcaaaagttaaaccaattcgtaacgaaaaagggattgccgttgactttgaaatcgaaggcgaatatccttgctatggtaacaacgatgaccgtgtagataacatcgctgtggaactggtagaaagcttcatgagcatgattcgcaagcataaagcttatcgtaatgcggttcctactcaatctgtactgactattacttccaacgtggtgtacggtaagaaaacaggtacaacaccagatggacgtaaagcaggcgaaccgtttgcaccaggggcaaacccaatgcacggccgtgataaaaaaggtgctttggcatctctgagttccgtagccaaattgccttatgaacacagtctggatggtatctcgaacaccttctccatcgtgcctaaagcactgggtaaagaagaagaaacacgcaaaacaaaccttgtttcgatgatggatggctactttggaagccacgcacatcatctgaatgtcaatgtgtttgctcgcgaacaactgttggatgcaatggagcacccagaaaactatccacagcttacgattcgtgtttccggttatgccgttaactttatcaagctgactcgtgaacaacaattggacgttattaaccgtactttccacggtacaatgtaaataagtattacaatgacgcacgcatagcggatgcgggaaggatgatgcaacatgttgaaaggtcacatacactcattggaaaccttcgggaccgtcgatggtcccggcatccgcttcgtgctctttatgcaaggatgcttgttgaaatgtcaatattgccataacccggacacttgggccttgaatgaaggtaatccgatgacgttggaggaggtattggctgagattgagccgtatttagcctattaccgttcttcaggaggcggattgaccgtatccggtggagaaccgacgctgcaagctcattttgtcgcagagctgttcaaagaagtgaaacgtcggtggaatttgcacacgacactggacagtaacggatttaatgacgcgggccgtatccatgaactgctggacgtaacagacttggtgctactggatattaagcatattgacaatgacaagcatattaagcttacaggcaagtctaacgaccgtatgctgagtacggctcgctggttgtctgagcaagggcgcaaaatgtggattagacacgtatttgtaccgggtattcatgatgacgagcaagatttattgaatttgggacggtttatcggaacgttgaacggagtcgagaaattcgaaattttaccttaccatcaaatgggtgtttacaaatgggaaatgcttggtaaggagtatccgttggagggagttccatctcctacagatgaagaagttcaacgtgcttaccgactcattgaagagggtcgtctggagactgctggaaagaatgctgtctgtcgtccgttataatattggggtagtttgtattagagatattaaaaaggttaaatgttcgtattttttaattaggaaaaataaagaagactaaataatcagcttgtaccaatattgaaatggtgcaagctgttttatttttttgaaatatttaatgtttttaaaatagaaatgcctttggctatccactttttcttactttggtaaaagggtataaattcttagcattaagatacgtaaaagaaaattttaagtgaggatccaattgcttcttttagggtagttcttttgaggttaaatgctctaatagtaagttgtattttcagacgtatactttgagttttgactagtaggagcattgattttatacaattttgtattgtatttggtagaagttaaagcgatatgattaaatgaaggaaatctcaatcgagataaaggttatttctatgaacatttagccgtataaatatactacactgcatttgggtgggatactgaaaacacgaataccatataaggtttagcttctagagattgctctatatttttttgaaagtcattcaacccaaaatttgtttgtaattgttttataatctttgaataataactatatttcaggaattattaaaataaaaactcaaacatattataataaggaaaaaaatgtttactttttcgcctaactgttatagtattaatttgtagaaactaaaaaataaaggagacaagaaacatggaaaaatctaagttgttaggtttaactgctctctcagctctcactttaactttaagtttattacctactcaacaaacctatgctgaagaaagtggagttagtttaaactcaagttcgcaatcatctattgtacaatctgagagtgtagttacacctcaaggatcaagatcatatcaacttggtcaaacctccgcctctatttatttgaacggctctctagatgttcagatttatacgagtctaagcagttcagatttatatagtattgatatttatgatagtaacggtagacatgtctaccagcgagatagaaatccaagtgaaggaactagttttcatgtgagtggtttatatggctatcatacagttcgcgtccaatcctataataataacggaacttttactctaacttggccttgatagatagattatttattgggtgtctaaagtcaattaatgacttgggacacccctttttaatagatctatatttttactggtaagcaacccttattttgttttccgcttttttgtacatatctttattctatgcattttggaattatatattttgcttatatataaaacatgaaaaagactttatttaaattaagaaatttttttgagattagataaataagtggaagagaaacccgtcttgttattgctattgcttgtttaatagattttcagtgtattaagtccaatgaatagaatatctaaacgatattctatttatttctttgcagtcacaggagaaagttccctttttttcatgataagcaaaatctccagaaactttttaacaactgacgcgtctaatagtatgactttttacgggaatgataataatttggtgatagaaggagacagacaatgaatttcaagaaatggaccatgctcaccgctttggcagtagctcaggtggccgcagtagcgcctgtaggagcagaagcagcatcaacaaccgttcaatccaccgattcggttagcgcacagcaggctcaggccaatgctgctgattcaggcgttcagaatagcatcggagatcaagatggaactagcacacaaaatgacacggtggcacctaataacacaggcgtatccaatgatccattgactggcctacctacggatacaaccaacggatcgaacgtatccaatgatgtatacgttggagacggaacgatcaccaatcctggtggagctccaacatccatgggtgctaatcaattgattttgtacttaaacagcgcgaaaatggaacaaaacggacaggtgtacacagcaactcagccgatgaccgtgaaggacggagtttcctatgtagctatccgttcacttgtcagccgtgtcggattgcagtttagttatgacactgccaccaaagaaaccgtaatcacacaaggaacaaatgtcatgcgcttcaaaacagacagcaaggtttatacggttaacggtgaagccagacaaatgaagggaccggcttttcagcaaaagaacgtatttatggtgccattgacctcgattacacaggccttaaatattccttatactgtgaataatacgactaaacaagttatcatggatttgaatcagaaacctaaagcttccttcacggttcaacaaaaagatatctatgcgggcgaaacccaagttacgtatttgacgaaggaatcttctcctacaggtcttccgattgtgaaccaacgttgggaaggtaagcaggacgtatttcaggagccgggtacatatgtagttacctattctgttcttgactctgctgggaactggagtgatccttactcagttacaattacagtaagaccaccaaatcagccgccagtggctctgtttacaactgataaaaaagagtacaaaatgggtgagaaaatcaccattaccgacctgagtacagatgatgagaattctatcactaagcgtgattgggagaataagaaacttgccttcttccaaccaggtgatgtaacaatcacactcactgtgactgataagcacggcgcaacaggtaccaaaagtgaaacaattaaaattacgaatgaattgctgtacaacgaagatgatttcaataaaatcttcacaccatatggtgataaatatacagtagacggcagtcaggtgcctaccatggctaccattcctttgactagtacatcttctccgcgtcttttgatccgtgctaacagcccggaacgtgtatttcaggacggaattgtgtatcaggaaaccggatcaggcagcacgcgcatactcgtccatcatgtgaatgaaacgggtcgagatgtgaaaatgtacgtgattgcgacaaacaacaatattactgctaccaacctgaatgtcgaaaattccggttttgctggaccatctgaatttgcgacggcagcgggtaaagtttcaattcaaaaatattttcaatctatgatagatggaagcaaacgttctagtacggttctgaatccgggtgaaagccgtattattttgcaggatttgaacgagaaaaaaatgaagcaaaagcaggtcatttctctattgtccgatctatacacggatcaaccaatccaatatacggtcattatggtggatgcgaatgcagatcctatgaccgtactgcctactctggcaaaacttccgaaagacggaattcacaaccgtggaacgtacgctaatgctgatatctcgctcaattataccgaagaggttggtaaaacagctcaacgtatcgttcttggtgataataaggtagatccgaacctgattggtacggacggtctggacggctcttctgcttccaatgccggtaattttggtgttgtatataaagttaaattggatcatgtagcgccgtattcactgattacgttcaacccgcgtggaggcgaatattccggctatgcgatggtaaacaatcaggttgtgggtatcccgacgaacggcgcagtatgggctccaaatgagatgagtgtgctgtatcgcacagggcatatcgaggaaagtgtagagatgtatttcactgctgctgcaggaagtaacttgccggtttccgtagtagttatgcctttgccagctattaaaaattaatatgaaataaccggtgctgtttaccggcttagaccttgggtctcgtcattcaccgtttaaaagtcgatgtcacttgcagaatataggcgttctcctgctgcgaatttaatcgtagcgccggagagcgtctttttcttatgtctagatccgaatatctcttataatattgactttaatcgtggtataataaatagatgcaagcctaagcctgcatcagaaaacctgaaactacagacaggggagggtgaaacgcatgctgacaaaggatgagattattgcaacaatgtccgctcaggggctgcgtattacagatcagcgcaagacgttggccacgttattttccgagaatgaagggtatctgtcccccaaagacgtttatgaatatatgggtaagaagtacagtggacttagctttgatacggtttatcgtaatctgcgtgtaatgcaggaattgggtgtgttggaacaggtatcttttgaggatggaatgaagtttaaggtgagctgtaatgagcatcatcaccatcaccatatgatttgcttgagctgtcagaaaacattaccgatttctttttgcccaatgcaaatgacagatacaacggatcaattccaaatcgtcgagcacaagtttgaaatttttggttattgcaaagattgtcaacagaagaatgggcatactgatagtaattcggatgggggattcagacagacgagcagtcacactcacagccacgggggctactgaaatgaaaaccaccacacgcagagtggtacaggctccgattaagttttatcgttcctatatttcaccgttaaagccggctacctgccggttctatccaacgtgttcggcgtacgcgttggaggcggtagaagtgcatggtgcgctcaaaggttcatggcttgctgctaagcgtatagccaagtgccatccctttcatccgggtggcgtagatttggttcctcctgcaaaaaagggaacagataggtctagcgaagatcgtttggctacccactccaagaagggtctgacttgacagcgctatgcggatttggttatattttggttaatattgttttcctgcgaagggatgagtagggtaaaccgcccagtacagagagccggggctagctgcaaaccggtctggagcgaagcctgaatatggtcctggaggaacctttttcgagcgtatttgccacagttattagtgcttgggaggcaagtgtaagggggaggcgtgttccagcgttaatgggcggtcagatgtgaccggtgaagcctgtagtctgcgaggatacaggaaaattgggtggtaacgcgtgaggtgactctcgtcccataggggcgagggtcttttttgtgcccaatttgtgccaaattcatgaattggagtaccatcatgtcagcagatcttatcgagctgccgtgaacaaaacaggaggcaacacacatgtccaatgagaacacattttacattacgactccgatctattatccgagcgacaagctacatataggtcatgcttacacgacggttgcgggagatgcaatggcccgttataagcggctacgtggttatgaagtgcgctatttgacaggaacggatgagcatggtcagaagattgagcagaaagcgagtgcagcaggcaaaacgccgcaacgtttcgtagatgatattgtggcaggtattcaagaactgtggcggaagctcgacatttccaatgacgattttatccgtactacggaggaacgtcataaggctgtcgtacaggaaatttttgatcgtttgctgaagcaaggcgatatttacaagggagaatacgaaggctggtacagcatccctgacgagacgtactacacagaaactcagctggttgacgtggtgaaggacgccgaaggcaatgtggctggaggaaaaagcccggatagtggacaccctgtagaactggtcaaggaagagtgttactttttccgtatgagcaagtatgctgatcggttgctgcaattttatgaagagaacccacagtttatccagccggaatcacgtaaaaaagagatgatcaataacttcatcaagccgggtctggaggatttggctgtatcacgtactaccttcgattggggcattaaggtgaagggggatccgaagcatgtcgtgtatgtttggattgacgcactttccaactatatcacagccttgggttatggctcttccaataccgagttgtatgataaattctggcctgcaaatgtgcatatcgtaggtaaagagattgtaaggttccacacgatatattggccgatcatgctgatggcgctggatcttccgttgcctaaaaaagtatttgcacatggttggctgctcatgaaagacggtaaaatgtcgaaatctaaaggcaatgttgtagacccggtgacgttgattgaccgttatggtctggaccaacttcgttactacttactgcgcgaggtgccttttggggcagacggaacatttacaccagaaagttttgtagatcgagttaattcggatttggcaaatgatttgggcaacttattgaatcgtaccgtggcgatggtagataaatatcttgatggcaaggttccggcttatgaagcgaatgtaacagcattcgacggagctttggaagacatggcaacatcgacttatagcaaagtagaagaagctatggaaaacatggagttttccgtggcattaacggcgattagccaatttattagccgcagcaacaagtatattgacgagacgcaaccatggaacttggctaaggatgagggaaaacgtcgcgaattgtcatctgttatgttgcatttggtagaaagcttgcgcatcgcttccatcttactccagccattcttaacccgtgctcctcataaaatttgggaacagctcggtattagccaaggtgagctgactacatgggatagcggcaagcagtttggtcgtattccggaaggaacgcagctggtcaaaggtaatccgatctttccgcgtctggattcagagcaagaggttgcttttatcgtggaagcaatgaccggggggaagaaaccggaagaagctacagcacaagttcaaccgcaaaatgcatctgaggcgagccaggaagcgccggaggcaaaagaagagattggcattgagggttttgccaaggtagaactgcgcgttgctcaggtcgtcgcctgcgagcctgtgaagaaggccgataaactgttgaagctccaacttgatcttggttatgagcagcggcaagtagtatcagggattgcgaagttttatacgccggaagatatcattggacgcaaggtgatctgtgtgaccaatcttaagccagtaaaacttcggggagagctgtcgcaaggtatgattttggcagcatcacatggagatcagcttacgctggccaccgtaccggaaggtatgccgaatggtgcggttgtaaagtagtacgctatgtaaaaataaaagaacgtaatgagcgtatgtccgggaatcattcttcctgggcatgcgctttttggcttgcatcatattttgctcccgctacacgtatgttttagtaggcagggcttgtttgttcgtgttcacttaagacaggtgggagggaatatgatgacaaatatcaacgccgggttggcgatcgtagccggactggtttcttttttttcaccgtgttgtttaccgctgtatccatcttatttatcgtatatgacagggatgtctgcgcgtgaactggctgaaggacggcacaaggcagaggttcgttatcgtacgatgggacatacacttgcttttgtattgggcttttcggtcgttttctattcactgggtgcaagtgtcgggttgcttggagaatggtttgctaattatggggatacgctaagagtggtagcagggttacttattttactaatgggactggtatctcttggtgtggtgcgtcctttgattctaatgagggagcataagcttcgctggacatggaagcctgccgggtatgccggttcctttgtgatcggaattggatttgcggcaggctggtcgccctgtatcggtcccatgctaacagctattatcgctttggcggcagtagagcatcacatttggttcaagctgattacaggctatgcgcttggctttgcgattccattttttgtattagctttgctggcaggctctgttcgactatcctctcgctatacctccatcctaatcaaaacaggtggcatactacttgttatcactggcattttactggtaacggatcatatgactgatgtaacgctatttttacaacggattaccccagattggatgctagttatgtgaaatattcaatacagcttaaagggaaatgttcaaaaatgcgctctgtgataaactctcgtagtgcattttgctgttcatcgggataaacatatttgttttgtccccagcggccccattttttcttgcgtttctctatgtccatctccagcttggttttcggataacgtttctcgatgacagctttggatgttttggtgaagcgatgctgaattaattcgaacgtcaaatcttttgtagcatgctgaggcaaggtttctcccaatttacgcagcaactcgccgtagccttcttcccagccgtcataccagatgatgggtgcaatgatgaaccccaatggataaccggctcgtgcgattttgcccgcggcttcaatacgttcctcgaagcgtgaagttgcaggttcaaactgtttaataacataatcggaattaatgctaaagcggatgcgagtatgaccattatgtttaatatccagcaatggatcaacatgatgatatttagtaacaaaacgcagacgaccaaattcctcatctgccatgaaacgaatcaagtctccaagcgttccggtgatatgctccaaaccaaccggatcggaggtacaagctgcttcaaaacgggtaatttcaggcgcacgctcctcgatataagctttagctgctgataagatatcgtcagtgttgacatatacacgaatatacggttttgctcccaaggttgtttgtaaataacagtagtgacagtgccccatgcaaccagtcgaaatggggatagcgtattcggcagagggcttggattggtcaaaagtcaacgttttacggataccgactaccaaagttttttttgccattcggtacttttcaacttcggtttcacctggtaaattggtaattcggttgtgagaggtagtcattcgatacggaatatccttggctttaacccaatccataatacgctggcccttgggataattcagtgcgtctggctcaaaaaacaccaggtcaggcaaaaatggcttggttcctctggtttggacaggagtacgctcaagcgtagacatggctaacgctcctttcgaaataaatccacactgctctggtgtccaactttaacattttgccgcagaaataaaccgatacaggacgactatattagtgtgcccggcttaaattgaacaaatcgtggcaatagctgtgagtaaagggatgagacttgccaatgggcaatgataacatgtatcattacatagtaggtttaacgcaggaaatgaaggcggtaagcgcccgttcaataacagaaaagagggaaacaagtgccaacgccaagcatggaagattatttggaacgcatttaccaactgattgatgagaagggctatgctcgtgtctcggatatcgcagaggggttagaggtgcatccttcgtctgtcaccaaaatgattcagaagttggataaggacgattatcttgtatatgagaagtatcggggactgattttgacaccgaaagggaaaaaggtcggcaaacggttggttgatcgccatcagttattagagcaatttctggatatgattggggttgacaaggacctgatatataaagatgtggaaggtattgagcatcatctgagctgggattccatcactcgtatcgaaacattggtcgaatattttcgccgggatgaagatcgcttgcgccagcttcatgacatacacaaggaattgagtggagattcctaaaagcatctgtccttacggacgatgcttttttatttgtcccgaccgcaacaaatatccggttattagcgtctatccattatatagcaggacaagataggggttaaaattaacagggttagcggaggattgtaataatatgaatcgaaagaaaatagtggcgttggctgcaggtctactcttagcagtgcagactgccatcgttcctggtgttcaagcagctccaactggtgatattcaaattatattggacggacagtccctgcaaagtgacgcgtcaccgtatattgtacagggagccaatgttacgatggttcctttgcgagtgattagtgagggattgggcgctcaggtcaactggtcggaatcgtccggtacggtaacgattacagcacagaacaaaaatatatctatggagaacggtgcacaaagcgctacagtgaatggcaagtcagttcgactggatgcatctgcccgtatgacaagcgggagagttatggtgccactgcgttttgttggggaagagttgggattaaaagtggattggcaagcttcagagcgagtcattacgttaagcagtggtaaggaaggtgtctctactggcgggaacacttctgcgggaagcagcggctccatatcagatacgtctgcatctagcaatcaggacagggtaagtacagatcagggagctatcgatgatgagcaggcggttgtcacttcaccgtcaacgtctactagtgaggagggttcaagttcttcgcaggcaaatgttgttcaggtaaaggcttcaacttccatgcgtggagcatggatttctaccattaatggagattggccttcttccgctgcccgaagcagctccgataagcaaaagcaggagtttactaaaatgctcgatgatttgcaggggatgggcatcaatgcggtatttgttcaggttcgtgccagcggtgatgcgctctatccgtcgagtctcgtaccatggagcaagtatttgaccaacacccaaggtaaaaatccaggctatgatcccttgaaatttatgattagcgaatcgcataagcgagggatggaatttcatgcttggtttaatccattccgtgcgaattctacaggaacaaccagcggtttggctgcaaaccatgtggctaatcaacacccggactggattgttaagaatggtagccaattgtacatcaatccaggaattccagctgcacgtcagcatgtcattgcggcgattatggaggtcgtgaacggatatgatattgacggcgtccatttggacgattatttttatccttacagcgggacttttgatgatgatgcgaccttcagagcatataatgccaacaaaatctctaacaagggcgactggcggagagataatgtgaacagttttgtccgcgatttgggcaaaagtattcatggcagcaagtctaaagttcaatttggaattagtccttttggggtatggcgtaacaaatctcaggatttaacgggttcagacacgaaggcaggcgttacagcgtatgatacgacgtttgcggatgtaagaacctggattaacaaagaatggattgattatgtagctccacaaatttactggagtatcggtttcccggcggcgggatatgacaagcttgtcgcatggtggtccaatgaggtcaaaaacacagatgttaagctgtatatcggtcattctccgtataagatcggcacccctgaaaagggctggcaaacggctcaagagctaattaagcagcttgaactgaacgaaaattataaacaggtcaaaggggatatttactttagtgcacagcatttgcgtaaaaatccatacggactcattcaacttcttcaaaattattatcaaatgtgatataaattggatcatataggttctatttgggcctccgttctcatacataagcagtagaactgcttactcccaagagaacggaggttttttgatctatgctgatcaatgctgtgttccagggtggaggggttaagggaatttcgctggcgggtgcagttaaagctgcggaggagcatggaattgtattcaatcgtttggcaggtacatcatcaggttctattgtagctgctttattggcggcgggatactctgcggatgaaatgaaagccgtaattgagaaaacccccttggtcaagttgttacgacgttctccagtgttcaatgttaagtgggttggaccagcagctcgtgtctttcttaaaaaagggctctactcaggggaggcactggagcactgggtacgtgagctgttacgagctaagggagtgcgtacgttcgcagatttacctcctggcaaattgcgcattattgcatcagatatcacgaatggacgcattttggtgcttcctgaggatatcaaacgttttggtatcaatccctcttcactggaggtagctaaagccattcggatgagcacaagcatcccttatttttttgatcctgttatgttaaggcttgattctgcacttgccaagggaaagactttttctcagcaatttgtatttgtagttgatggggctttactaagcaatttgcctttgtggctttttgatgagcctgtaaatgaacgtgaggccaaaacgattccaacggtagggtttcaaatggtgggcaaaacgggtacggagaccaaagtttcttatatacggggtccattgaccatgctgcaggctatttttgataccatgctatcagcacacgatgaacgatatattgagcaggagaatcggtatcggacgattaagattccaacattgggtatccgcactgcacaatttaatatttctacagagcaaagtgatttgttgtatgcttccggtgtgcaggcaggggatgcttttttccacaaatggagcatcacttcttaccagcagcagtatagcaagtatcaattgatgaaggataccatgtacgctatgaaataaacactaactcgcagttaaagttaatttaaaagggtgtaaaaaaggagcctcttcccggtcatatttgaatacgcgggtgatggctcctttgtgctacattttaaaggatgtgattatcattaatgatatttaggttgttcttcttcattctttcccttagaaccttcaatcacatgaaaaggataagctttgcgcttgcctgtagtctgctgcttacgtgcgttggttgttttggccatggtacgcacagagggtttaattttgggagtacgattacgttgtcctggcaggtatttgtatagcagaaatataactgcaaaaacaaggacgggaattagtaaactcatgagaaagccccagcttcctctccatagcatatccacaatcccatatgcacccaaagcaagggtaagccagaaaataacggcatgtctgttcattattcactcatcctttcacaggatcaaggaccggactgttgaaggtctcctttacaggtacattttccaactcagcatccaattcaagcatacgcttaaatgaggcaatagatacctccacttgatcatcagtcggttctttggtggtaagtagttgcaaccacagaccagggtaacctaaataacgaagtagcggaatttcacgaagggcattggttagcttgaggaattcaaaagaaagccccagtacgatcggaagtagtaaaagccgttgtcccatacgttcccacagactatcgtaggtaaataaggaatagacaagcaccccgatgatcacagtcagcataataaagctactaccacagcggtaatgtagacgactgtatttctgtacattggccggagttagttcttccccagcttcgaatgcagtaattactttatgctctgcaccatgatattgaaacaatcgtttaattaacggagtttgggaaataccccacaaataagccagtaacagaatcagcttaatagctccttctgcgaggttatgcaaaatttggctgtgaaacaagctaccgaacaggaaattctctacaataaccggaacgagagtcaatacaattttgccaaacaggaatgacaaaataccgaccgccgccacaccgatcatcatactcagactccagcgagattcttcttttttcttttgctcagcgcgttcttccggatctacttcatcatcagcatacgcatcggctgaatagtttaaatgcttggtacctttggcgctggagtcgatgatgcttacaatcccccgcaataaaggaattctgcggaatttggatacccaggattgctccttgcgtggtacttccaaatatgtgatttcgccagtcttgcggcgaactgccgtgacattgacacgcttgccgccgaacatgacaccttcaatgactgcctgaccgccgtagctcacaggcttggatgcttgtgacaaccgtctcacctctcttaatacatgcttttttgtatattgtatcgaatttggaagggaatatctagttagttgaaactggtgtaaccacaggcttataaaaaaagcatttatggagcgtcagactgctcacataaatgctaatcattataaaaccgaatgaatatttggaaacaacttattttgtaatcgccccgactacctggtcaaccagcccttttgatgagagaggaccgccaaatgtccatgtcgtaccgctcagtgaataggtacgtttttctttaacgaaattcagaccgttccagactgaattatttttcatgggtgcgccgaaaacattatcgtccggctgcacaatatagataaagttgctatcctgaacggcagacagagcttcaatgcctacagttgaaaagccatactgttcaactttgctcggtttccaatcattaatcataccgatcttcgccagtgttgccacgacgactgaattatccgaaaacatacggaggctggccgcattttgcgaagtgaaagcctgtgtcagtatataatgataatccgacttgccagcagcggcgagcttttctttggcttcagcataatgctgatccagttcggcaagcacctgcttagctttgtcttcttttccaagagcgactgcgatgctattaaaaatttctaccattttatcatgatcgtagccgttaccatcgtttagattatattcgatcgttggagcgatggccttgagttgatcatagatagcttcattcccatcaacattggaaatgattagatccggcttcaatgcagcaatcgcctccaggttcggctcgttacgcgtaccgacatcgaccacgctgctgtccagagccgcctccggtgtcacatacaccttgtagttggcattgtcagcattaccaaccggctgaacgcccaatgcaatcaaatcctctgtaaatgtccattccagtactacgacacgctgtgcgggcttgttgagcgtgatctcaccacgattatgctttaccgtcacaggaccggtcgctgtgtcagtcggtttgctacccgacgtgggtgcctgatctttatccgatgctttgtcggctgctccgcaacctgccaaagtgagcgtaaaaaccattaataataaaatgccaatgagtccctttttcatagaagcattctcccgtatatatgttttttagaaaatgataatgattatcatcttcatcattatattatgtatagaggattgaaattttgtcaatgcaaaaaacgggtccgaacgcttgactggtaagctgctattattctgcattccggttcattgttaaacgatcctccttttgagcatactacctagcaaaatgggaatgcagaatccgatggaagtacatgcatcttcattgcaatagtctttaccatgaaaaaagtttgcatcttgaaaggggattaaacaacatgagtgaaacctactctatacccaagataggccatgaacaggagcagtctcgcgaatctcaggatcaacgtaatcataacgacagtggtggaggcaggcagcagtcaggcaaaatacatacgcctctcattccttttgcacttgagttgggtttttttgcgggtgtgctctggggattgctgcgctggctgttttataagttgcactttacggtagtagcgcctggctttctcgcagagccatttttcaagcattcgtttatgaacaccatggcggggcacctggtagggctactgttttttattgcattatccgtcgtagcttcactggtgtacactctgttgctacgcagatttaagggtcctttacccggaattgtatatggcctgatttggtgggttgttttatttgtattaacaggtcctaagctagggatgatgaatgctcctaatcggttaacatggaactccttatatacggaaatttgtgtgtttatgctgtggggactatttatcggatatactgttgctgtcgagtatacggatgaaagaaagcgcgagcctgagaaagctgagggctgaacgtaacaaaaacttctcaagcgcctattccctgtgttaaaatagcatttggttatttgacagaggggagcggaatgaaagatgaagaatgaccgggtgttaaagctgcggcaggcgctgggcgagcataatctgcgggctatgctaattactagccctgtcaatcgtcgatatttgacaggcttcacaggttcggcgggttatgtgctgattacggaatcccatagctatttgctgactgactttcgctatatgacgcaagcgaccgaacaagccgaaggcttcacggtggtgcagcacgctgcacaggtcatggaaacggtgaaagaattgctgtcttcccatcagatcagcgaaacaggcttcgagcaagatgctgtaactgttgcgacgcataaagcttatagcgaagatttgtcacctatttcactggttccggtgtcgggcattgtggagaagttaagagtgtacaaagatgcagaagagctggaagtgatgcagcgggcagcggatttggcagatgctacatttgcacacattttaccttacatcaagccaggtgtcagcgagcgtgagctggatctggaaatggaattcttcatgcgcaagcagggagctacatcctcttcatttgacacaattgtggcttccggggttcgttcggcattgccccatggcgtagccagtgctaagttagtacaagcaggcgagctgattacgtttgattttggtgcgttgctggatggctattgctctgatttgacacgtacagtggctacacaaggggatttggcgccccagttgcgcgaaatctacgatattgtacttaaggcgcagcttcacgcactcgaacatattaagccgggcatgacaggctgtgaagcggatgcactgacccgggatattattgcgagccatggctatggagacaatttcgggcacagtacaggtcatggtctgggtcttgaagtacatgaatctacacgtctgtcgaaggcgagtgatgatattctggagccgggtatggtggtaacggtcgagccaggtatctatgtccctggattgggcggtgtacggatcgaggatgatatcgttattacagatagcggcatcaaagtattaacacattcgagcaaagaatttacagtcgtttaataacgataacagtcctgtaggaggggtattttagtgattaacgtaaatgattttaaaacaggtttgaccgtcgaggtagacggagatatttttacggtgctggatttccaacacgtaaaaccgggtaaaggtgcagcattcgtacgctccaagttgaaaaacttgcgtaacggtaacaccgttgaacgtacattccgtgcgggtgaaacgatcggtcgggcgcaaatcgaaaatcgtggtgtgtcctatctgtacgctagtgcagacgaccatacattcatggataatgaaacatatgatcaattcacattgtccagcgatcaactgaaatgggagcttaatttcctgaaagaaaacatgaatgtaaatatcgtcagctataacggcgaaattctgggtattaacctgcctacaagcgtggaactgaaagtaatcgaaacagagccaggcattaaaggtaatacggctacaggtgctaccaaaaatgccaaactggaaacgggtttgaatgttcaagttcctttgttcattaaccaagatgacgtattgttgattgatacacgtgacggcaaatacatgtctcgcgcataaaatttgcaacttttagatttcctctgtcctttttaagggcaggggatatttttataagcactaatattaaaaaacattggctccacacagcactttcgtattatactgaactaaagttatgccgcaggatgtcacgttcagtcgtttggtgccatctcaaggttacatactgttgagtctgagggagtgaatatcgttgtctttgtatgtcatgaaattcggaggcagttccgtcggtgacacggagcgcatgaagcgcgtggcaaaacgcgttgttgagaaacagagtgaagggcatcaatgtgtagtggttgtttccgcaatgggagacacgacagacgaactgattgaccaggccaaattgttgaatgagcagttgcctgcacgtgagttggatatgttgatgacgacaggtgagcaaatttcaatcgccttattgtcgatggctattcagcagttgggtcatgaagcggtatcgtttacgggatggcaggctggtttccgtactgaatctgactttggtcgagcacgtattacggacattcaacctcagcgtgtgctggatgcactgagcagcaacaagatcgttgttgtagctggtttccaagggatgtctgcagagggagacattacgacgctgggacgtggtggctctgatacgacggccgttgcgctggcggcggcgattcaagcggatgcctgcgaaatttacacggatgtggacggtatatattcaacagatccacggatcgtgaaagtggctcgtaagctaaaagaaatttcttatgatgaaatgctggaattagccaatctgggtgcagctgtattgcatcctcgagcggtagaatatgccaaacataaccgggtaccgctgattgtgcgatccagttttaaccataatgaaggaacggtcgtaaaggaggatgcagtaatggaacagggcgttgtagtcagtgggattgcatatgataaaaatgtagcaagaatcagtattttgggcgtcgccgatatccccggtgtactggcgaaagtattcggaacactggcggcagctaaaattgatgtagacattattgtacagagcggggtcgaagctggtaaagcagatttctcctttacagtagctctgacggatcgtgaagcagcactgaagacgctggaaggtattcgtggagagcttccgtaccgtgaagtaacgtctgaggaaaacctggtgaaggtatccattgtaggtgcaggaatggttagccatccaggtgttgctgcgcaaatgtttgccgtactggcagagcaaggcgttagcattaaaatggtaagcacatctgaaatcaaagtatcgtgtgtaattgaagcgggtaagcttcatgaggttattcaggcgttgcatacagcttataacctggacaccgaggagcaagcgtttgtgggtggaccgcaagaccgtcgttaataactgcaacgtgatctagacatgaatatgtctaatgtgaacgatgctatgacaggtaaaggttgatacattataaatcctctatttatagtttgataaatcatagaatacagcagtaggttaagaggttgttccatcagtgagagttaaactgaggggcagcctcttttttgctgaatctatcttttctacccaagggtatcccttagccgacaaggctttgagaggcccttttttatttgtgcgaattagagaatggtgctttaacaagcgggggaaaggtctgttgagcgttgataggagttagcaaaagtttgcctaggttttcaatatattttcggcataaaaagcgagagtcaaccatagacttgtcttaaagaaaaaggacaactgtgagggggcggcatcggtatggaatggctggagttatttcccgaaccgttgcacggtatactcggaaggcttccggaaacggtatttaagcaactggaagaaatccgggtcagggaaggaaggccgttggaaattaatgcaaatggtgatcatcattatgtaacgtctgcgggtcggctgactttgaaccatgtggaagcttataagcctgaccgtgaggatgcccaccgactgctggattttatcagcaatcattccctgtataccatggaagaggagcttcgtaaagggtttattacgatccctggcggtcatcgtattggcttggcagggagaaccgtgctcaaccgaggacgagtggaacatttgagggatataagcagctttaatgtaagaattgctcgtgcaattcccggcatagctgatcggatattgccttatgtagcagatcgaatgtccgggaaaatccggcacaccctcattttgtcccctcctcagcatggcaaaacgacactgcttagggacttggctcggcaactcagttacggagggatggaaagcaatggggggcgacggaatggactcaaggtaggcattatagacgaacgctctgagatcgctggcagtcacaaaggtatccccggttttgatgtcggacctcgcaccgatgtattggacggatgtccgaaagcagaaggcatgatgatgatgatccgctcgatgtcaccggatgtcctcattgttgatgaaatcggacgaccggaagatgcggaggcggtgcgcgaagcgcttcatgcaggcattgcagtcattgcttccgcacatggtcgcgatgtggctgaaatggcgacccggcctgcttttgctggattaactacagggcaagagctgtttcaactctacgtcatgctggagcggacgagccggggcgtctcattccggttggcagatgccaaacaacgcaggattacactgcctggagaagggcaaaatgggggcatcttctatgcttaagttgcttggtgccgccttggttatactggccgctacgctggcaggctggcagcgggcaaggcagtttgcgatgaggccgcggcaaatcagggagttgattcttgcactgcaaagactgaccaccgaggtttcctacggggtgtctccgctaccagatgctttcgccaagacaggagagcccttgcgagagccgctgcgcactctgtttcagcaagcctcacgctggatgcacccctcttttggcctgactgccagagaaagcttgcataaagccattgaagactcgtggagccgttcctctatgaagcaagccgagaaggaagcgatgcggcagcttgcttacagtcttggaaccagcgaccgtgaagaccagatcaagcacattgcgctgaccatccagcagttatcccatgaggaagcgcaggcgcaggcagatcaggtgaggtacgagcgtatgagcaggagcctgggactgctgatcggagcattgatcgtcattttgatctattagcggggtgctcgaatgaatttagaagtgaatgcgattttccagattgccggaattggcattattatcgctatgattcataccgtattaaagcaaatgggcaaagaagacatggcccactgggtaacggtcatcggtttcgtcgtggtcctgttcatggtggtgcgaatgctggataaccttctgcaagagatcaaatctatctttctttttcagtaggtggacacatggaaatcattcaggtggtgggcttcgccctcattgccacagtcctcattttagtcattaaggaacagaagccgatgtttgcctttttgattgcaacagctgcgggaatcgtcatttttttgctgctgattggcaagatcggatctgtggtttctgtactggagcgactggctcggtcttcgggcatggatatgatctattttaaaaccgtattgaaaataatcggtatcgcttatattgctgaatttggagcgcaaatcgttagggatgcaggacaagacgggattgcttccaaaattgagcttaccggaaaggtactcattatggtgctcgcaatcccgattatcagcattattattgataccattctgaagctgatgcccgcctgagggggtgatgccatgaaaaggctagggggcatgccgaatctcaaagtaattgcgatgttgttgctatgtctttggtgtgcctcagctgcggtcctctttgcagatacaccgactaacgaatggatcagacagcaggcggagcaaatgcccaaagatgaagtagaacattattgggacgggctcatgcaggaatacggcggattttttcctgatcagaaaacgccttccttcatggacatgctgcttccaggcggtgaaggattcagcataaagggtgtattaagcgctatagctgattttttcatccatgaaatccgagtaaatgccaaattgctcgtcaccatcgtcatgctcagcattatgagtatggtgctggaaacgctgcaaagcgcttttgaaagcaaacaggtcagcaaagtggcctacgctatcgtatacatggtcattatcattctggcgattaatagctttagtgtagcgattggttatgccaaagaagcgattgatagcatgattcacttcatgatggcaatgttgcccttgttgtttaccatgttagcctcgatgggcaacgtcgtaacagtttcggtgacccacccgctgattgtatttatgatcaacacagtcggaacagtcattcatacgctggttttcccgctactgttcttctcggctgtgctgtacttggtcaactcgctgacgggcaaatacaaactgacccagctagccgatctgatgcggaacgctggagtagcagtgctgggagtgctgctgaccatatttctgggagtcatttcggtacaaggcttgacttcgtcagttactgacggattaacgatccgcacagccaaatatattacgggtagctttgttccggtggtcggcaaggcgttggcagatgcgacagatacagtcatttcggcttcgctgctcgttaaaaatgccattggtctggtaggagtcattattatattgttcctgtgtgcctttcccgccctcaagattctgacactggctctcatttataaagtgacagcagcgatcatgcagcctttgggtgatacgcctatcgtggaatgtctggatgcaatcggcaagagcatgatttatgttttcgcggcgctggcggcagtgggattaatgtctttccttgcgattacagtcatgctcgcagcaggcaatatgacggtcatgatgaggtgaaccaatgcatgtaaaccaacaagggggaggggagtaacgtgacctggctgggaggctggcttaaggaactggtgctaatcgtgttgctggcttcttttgtcgatatgatcttaccgagccgatctatggaaaggtatgtcaaactcgttctcagcctacttattttgctgacgttgctgtctccggtcgtgcgcttactgagtagtagcccctccgaggttctagggcgagcattggatcttcaacgtcaggctgagacaggcaagagggaaccgacattggaggagattttagcaaaaggcagccagttgaagcaacagcaagaacaaagctccatgcaatgggccggcaaagaggtagctaaggaaatgaaaggacagttggaacaatatactgggttagcaattcagtcggtccaggttacccttgcaaagattcaacagaaggaatcggagctggaggcaggaacgggtgtccagtcggtagtggtcaaattggcagagcagcagccagaaaaagaaaagaacaacacagacgtctcgcctggtgcagatgccaagccgataatggtggagcctgtagccgaaaagacagtgaatattcgtgtggaaccgacacatacaaaaaattcagaacttaatgaaggaacgcgagaagaagatcgtaatcctgataaaactgctgaggacggaaagccaacggatacgaaagcttttggtttaattacaggacttctacgtgaaaaatggggaatagacagcaaaaatgttcaggtggtttcttcgcaggatggaacacatgaatggtaacaggaggtgagcagaaatgagcaaatggctgaaaaagctggagcaatggctgggtggaggggcggatggggcgaaaagattcaactcatttcgttggctgcttatacttggccttatcggtgtagcgattatgctttttaattcattcgttaatgtgaaaaaggttgatccagaaaacgtaggccgtgagccgcctggggtgatgaaaaatgagcctacgttagagacaacaacaggtgaagaaagttcctttgccgggatcgagaaggtttttgaggacaatatgaaacagatgctggagcagattgttggcgtaggaaccgtcgatgtcatggttacggtagattccaccgaagaagttatcgttcaacgcaatgtaaaggacatgcaggaagagaacaacgagacggacgccaatggcggacaacgacacactactcaatatactcgtgatggcgagattgtcacctatgagtcatcaggtggccagcacaccccgattgtgacaaaaaaagtaaaaccgcaggtgaggggagtgcttgttgtggctatgggggcagaaaaccctacagtgaagcagctaattgtcgatgctgtacagaagggactaaatgtaccttcctacaaaatttcagtcgtaccgcgcaagcagggataatttgggatttaggaacaaagaagtttatattttaaaccattaatgaatatggaggacggaacatgaataataaaagacaaaccgtttggctggtgtccatgctgagtttaatggtcgtgctgtctgcgtattatttgtttacggaggactcaagccctgccaatccaccagtagccgatagtgagcaagtgagcaaggttaagcaggatgccgcacaggaagcaacgacgaaggcagaggaacaattgaacgaactgaaggtaaatgaagtagtgacgaatggagaagtaactgatggagcatcagcaacttccacaaaatcggatacggcttccacaactgacccagcaacagaaaactcaaaaggcgataaagatacggcagctacccctactactgaaccagcgacatccgatcaaaacacaactgcgactaaaacggacacgacagcacaaagtgacgacaaagcagcctctacagccaaaaccgaccagcaagtactggatcaagtggcaaccgatcaagctgcccaacctacagcagcagctgtgattgacaactatttgctggaacgggacgtggaaaatcagaagaaaaatgatgaactgactaccgcaatgaacgacagcacacccaagaaagccgcagaggctcaaaaagaattacatgtacttgaagataagcaggctaaaattactggaattgaagaagagcttcagcagcagttcgccaatgcggtcgtccgtgaggaagatgctgataaatacaaagtagtggttctgagtgaaaaattggatgctaagcaagcggtaacaattgttgataaagtcatgaaggaactgaacgtaacgcaggataagatcagtgtccagtatgttacacaataagacaaaaaacgcgaaaaagcccggatttctgcattattccgggctctttctatttttaatgattgtgatataatacataaagctgtttcaacaatgtaatcagcaaccggcaaaatgctgaaggagtgattaatagagatgtttaaattaagcgagattaaggaattgatcaagctggtggatgaaacgtctgtgcatgagcttgaaattgaaaatgaaggaactcgcctgttgatccggaaacctggcaaaagcgagatcgttacggtacaggctcctgtggcaacacctgcttatgcagtggcaccacaagctgttattccaaatccacaagtacagtccgatgttggatctacaactgctggggaacctagggaatatgcaagcaatctacataaaatcgtatctccgatggtaggcactttctatagttcttcatccccggatacggctccgtatgtgagtattggcagcaaagtgggcgaaaaaacaacggtatgtatcattgaagcgatgaagctgatgaatgagctggaagctgaagtgaagggcgaaattgtggaaattttggccgaaaacggacaattggtcgagtatggccagccattgttccttgtgaaaccggagtaaagcttgtttgaaccctcttttgagggtttggcaagactgctcccagggaggtaaagtcatgacatttcaaaaagtattgattgcaaatcgtggagaaattgcggttcgtatcattcgcgcttgccgcgagatgaatatttcgacagttgccgtatattcggaagctgacaaggattcgttacatgtgcgtctcgcagatgaggcttactgtatcggaccgacgctatctaaggacagctaccttaattttacgaacctgatgagcgttgctacattgactgaatgtgatgccattcatccaggttacggatttttggcggaaaatgcagacttcgctgaaatttgcgaatcgtgtaatattacgtttattggtccttctcctgaagccattaacaaaatgggagataaggccgtagccaagcagaccatgaaggatgccggagttccggttattccgggttcagacggtctggttgaggatttgcaggatgcgatcagcatcgcacgtgatatcggatatccggtaattatcaaggccacagcaggtggcggaggtaaaggtattcgtatcgccgaagatgaggataaccttattcagcaaatcactaccgctcagcaggaggcgcaaaaagcatttggcaacgcgggtgtgtacctagaaaaatatttgaccggtatgaaacatgtggaaatacagatcatagcggacaagcatggtaatgttgcccatttgggcgaacgggactgctctgtgcagcgtcgtcgtcagaagttgttggaggaagcaccatgtcctgtaatatcgcaggatgttcgtgaagaaatgggtcaggcagctgttcgtgcagctttggccgttcaatactctggtgcaggtactctcgaatttttgcttggcccggacaataatttctatttcatggaaatgaatacacgtattcaggtagaacatcccgtaacagaaatgattaccggtgtagacctgattaaggaaatgatttctgtcgctgaaggacatccgctttcctttacgcaggaagaagtcaccatcaatggttgggcgatagaatgccgtattaacgctgaggacccggatcgcaattttatgcctgcaccgggtaaaatcggattttatctgcctccaggcggtcctggagtacgggtagacagcgcagcatatccaggttatagcattcctccttattatgactctatgatcgccaagctgattgtgtgggcacctacacggcaagatgcaattgccaaaatgaagcgggctttgtctgagtttgctattgagggcatacccacaacgatttcttttcatcagcgcttgctagagcatccgacctttattagaggcgattttgatattaaatttttggaggaaaacgaagtttaatcggtatatttcctcagtttgtcataatgaacgccaaatgatatagtatggataataagtgagcatgtctgctttgaaatccaaagctggaatgaaacttattttgaccgaaaggtgttgaaggtatgagcacagtgccaaccgaattcgaacgtacagaaattggggagattcaaattgccccagaagttattgaagtcattgccggactggctaccgttgaggtaccaggcgtagcgggaatgagtggcggatttgctggtgggtttgccgaactgctaggccgcaaaaatttatctaaaggtgtaaaagtggaagtcggacagcgtgaagctgctgtagacgtttccgtcattattgagtacggtaaccgtctgcctgaggtggctgctgctattcagcataatgttaagcgttcgattgagaacatgacaggtcttaacgttgttgaagtgaacgtgcaaattcatgatgttcaattcaaaaatgccgaaaaagtagaagagccggaagtgctgggcgccggacgggttaaatagagcgatactttgtacaaacccccgacccttatgggtcgagggtttactctaatttaaggaggctgtgcgtttcgtggctaaagttatggacagacttctgctgttcttgtacagcttaagtatcggaattatttccattctcgccatcctcctcctgagcggggccattccgtatgttttaagtattgaggatgagcgagtggtgtggtttaccagcctgattattgcaggggttctgttgttattgagtcttcgttttttttatatctctattcgacggaaccaaaccgtacagcattctattgatcaacgaacggaatatggtgacattcagatttcagtggacaccattgaaaatctgtgcctcaaagcagcttcccgatttcgcgggatgcaggatttgaaagcacgcgttcgcgtgttggaatcgggacttgatattacgattcgggcggttgtagacggggaaagctccattccggtgttaacctccgaggtacaaaagggggtacacgatcatgtggaagaaattacaggaattcctgtgtccaatgtgtcggtgtacatcgctaatgtttctcagtcacccagctttaagagtcgtgtggaatagaggtgattttccctgatgccctggaaagaaatatggggaagttacaagggccggatcatggggatcacggctggtatttttttcggttttatttatttgtgggcaggcttttggaatatgttgttctttgcattgatggtgttcatcggatatacgctaggaagacgtagcgattcagcgctcggttcatttctcccttggaaggaatggggcgattggttgtcgcagcgttggcgtccttttaaatgaaccctgtgatacgtgttctccaaaatagagctgtagcttctttgcgcccaacgttttggaggatgcgttcacaggtttttttgtggaaattggttagaatgaaaaatagatataggcaagcgtaggaggcagggcatgaaaagacgtctggcgagggaattagcggtacagagtatgtaccatatggaaatgaatgaagtggatgcggcagcagccgtggacatgttgcttcaggaagccgctgaggaaaacgaagcggaagttgtcgttaaagacgcggcagtgttaagagcgtatgttttagagcatgtgcggggtacgtgggagcacaaggaagccattgatgggctgttggtggattatcttaaaggctggcagatcagcagactttcacgtgtagatcgtcaaattttgagacttgcggcatatgagatgattttccgtgaggatgttccagccaaggtagctgttaatgaagcgattgagttgtcgaagcactttggtaccgaggaatccggtaaatttgttaatggtgtactgggacgagtgattcaagaactggagcaattgaaagcacgtttttaagtagagactactgaatcaggttggagagtggttaaacatgtcagcaccgatcattgatggtaaacaaatctctcaggatattcgcgcaagcattcagcaagaggtcattcgtctgaaagagcaccgctttcaaccgggactggctgttgtattggtaggcgaagatcccgcttcgcaggtgtatgttaaaaacaaggaaaaggcgtgccatgatctcggctattactcagaggttcaccggttggcagcagatacttctcaggaagcattactggaactagtggacaagctgaaccatcaaagtactatccatgggattttggttcaactgccgttgccaaagcatattcatgaaaaagctgtcattgacgcgattgcagtggagaaggatgtggatggattccatccggtgaacgtagggaatttggtcatcggtgacgatagtctattgccttgtactcctgctggagtcattgagttaatcaagcgtgctggagtggagattgctggtaaacatgcggtagttattggtcgcagtaatatcgtaggcaagccagtgtctttattgttgcaacgtgaaaatgctacggttacgatgtgccactcccgtacagcgaatatcggggatctaagtcgacaagcggatatcttagtcgttgcgatcggcaaagccaactttattgatgcttcgttcgtgaagcccggagcggttgtgatagatgtggggatgaaccgtctggagaacggaaagctggcgggagacgttgattttgagagcgtgaagcaagtgtctggtccgattacgcctgttcccggcggagtaggcccgatgacgattacgatgctgatgcaaaatacgcttgtagcggccaagcggtcgcacggtttggcataagggcagctgcctatggctgaacaacgtatttactctataaaggacctgaatcgttatatccggatgaaactggaatcggatcaggtgctgtctgatgtatggatacgcggggaaatttctaattttacgcatcattcgagtggtcacatgtactttacgctcaaggatgaggggagccgcatacgttcgattatgtttgcaacccataatcagcggcttcccttcgtaccgaaagaaggtacgcgtgttattgcccggggaaacgtatccgtgtacgaacgagatggacaatatcagttttatgcgactcaaatgcagcctgatggtataggaagcctttatttggcttacgaacagctcaagcaaaagctggatgcagagggactgtttgatactgctcgtaagcgtaatctccctgcccatccggcaaccattggcgtgattacgtcaccgaccggagcggctgtgcgtgatattattacgacccttcaacggcgatacccgcatgctggaattgtgttgtatcctgtgcttgtacaaggaaaaggtgccgcaccctcgattgtcaaggcaattgaagctatgaatcgtatgcaagaggttcaggtgatgatcgtcggacggggaggtggctcgttggaagaactgtgggcgtttaatgaggaagcggttgcgcgcgccatttacgcatcggtcattccggttatttcggcagttggacacgaaacggattttaccattgccgattttgtggctgacttgcgtgcagcaacgccaaccgcagcagctgagttggctgtgcctaatcaggcagagctacgggatcagctgctccagcgtgagcaacgcctgcgcaacgccctccggcagcggctggaaaccagccgtgaacgcttggtgaggcttcagcgttcaccagtcctgctgcacccacgccgctatatgctacagcatgcagagcgaatggacatgctgcatcagcggctaatccgcgcagtgggtaaccgttcacgcttaaacgcagaaaagaatgcacgtatgcgtcaggtactagagcggtttaatccacgtgaacaaattcgttcggcacgcaagcaggcggatatggcgcaacgtcagctggagtctgcgatgcgtgctattacgaaaacgggacggcagcagttgcacacgggaattcgtcagctggatgcgctgagcccactcaaagtcatggcccgaggctatagcttggtatacgatgagcaggagaaacggctgattaagtcgctcaaagacgtacagccgggagattccatcaagattaaagtgagtgatgggcagttggactgccaagtatggggaatgaaggaggacgcgaagcacggtgacgaatgaaacggaattgaattttgaagcggctatggccgctcttgaagaaattgtcggacaactggagcatggagacgttcctctggagcaagccattgatttgttccagcgggggatgaagctgtctcagctttgcagtcaaaagctggagcaggttgaacgtaaaattgaaatgatcgtggaagaggatggagatttgcgcaagaagccttttggcggcggattagatgaaaacggcggtgaagggcttgaatagaccgtcgttcaaggaatatttgaccggaacggcggatgcggtttcgtctgcactgaccgagcagttcccggccgattggaacattcccgatgttcttcgagaatctatgaattattcactcaccgcaggcggaaaacggctgcggcctctgcttgtgatcgctgctgctgaagcattcggtggaagcagggaagctgcgttgccagtggcatgtgcggtagaaatggtacatacgtactctctcattcatgacgacttgccagccatggatgatgatgattatcggcgaggtaagctgacgaatcataaggtatacggcgaggcggttgccgtccttgcgggtgatgctttgttgacccatgccttttacagcattgtgcaagcaggacgacgtcacggtgtttcatccgattcgctattgtccattgttgaggatttgtccgaaatgagtggcgcgcggggcatggtaggcggacaggtcgccgatatgtcaggcgagcaaggaatgacggggatcgaggaactggaatatatccatcttcataaaactgctgatttgattattttctcgctcttggcaggtggacggattggtggggcggacaagactcaattagaggcgcttcgccgctttggacgagacttggggctggcttttcagatacaggacgatatactggacctcataggcgatgagagcaaaatgggtaagaaaacgcaaagtgatgttgagcaggagaaggttacctatccgtatttcattggtatggacgcatctttgcggcaggtggaggaactcaccgcatctgctaaaaaaatgataacagagagcggtattcccgattcttctcgtttgctggagatagcggattacctgatgaagcgtgatcattagttgcgttagagctgttttgacttgtctgcgtttaagcacagttaaaaagtgtgatataatacttgttaactttacacacaaacttgaaggaaagcggggagatatgcgtgctgcttccacacataaagcaaccaggcgatctgaaatcactgtcggttgaggagttggcttctctagccgaggaaatcaggagctttttgattgagaagctgtccgtgactggggggcatctggcatcgaatctgggagtggttgagctcacgatcgccctgcattattgctataacagtccaaaggacaagatgatttatgacgttgggcaccaagcctacgtacacaaaatattgacagggcgaatggaccgttttgatacacttcgtcagcgtgatggactttgtggttttgtaaaaagaagtgagagcgagcatgatgtttgggaagccggtcatagcagcacttctctgtcggcggcaatgggaatggccttggctcgagatttgaagggcgaggacaataaagtcattgcaatgatcggagacggagcgttgactggggggatggccttcgaagcgttgaatcatatcggtcatgagcgcaaaaatttaatggtcattctgaatgacaacgaaatgtccatagcacctaatgtaggggccatgcataattatttgagcaaaatccgctcagaccgtcattatttgcgagcaaaagatgagctggaagttttgctgaaaaaaatacccgcgatcggcggtaaacttgccaaatcggctggccgtgtcaaggacagtcttaaatatatgatggtgcctggtgtactgtttgaggaactgggacttacgtatctcggtccagtggacggacatgatttgccgaagctaatcgaaaccttccagcaggctgataatgtcactggccctgtattggtgcatgtcgtaaccaccaagggcaagggttataaacctgcggaagcagattcacacaaatggcatggaatcagtccctacaaaattgaatcgggtcaggtactcaaatctgtaggtaatccgatgtatacggaaattttcggtcgaacgttgattgagctggctgagcaggatgagcgcatcgttgcggtcacacccgctatgcctggtggatcaggattggtaccgtttagtaaagagtttcctagccgtatgattgacgtcggcattgctgaacagcatgcagctaccatgtgtgctgctttggcaatggaagggatgaagccggtgtttgcggtgtattccacttttatgcagcgtgcttatgaccagattgtgcatgatatctgtcgtcataatgcgaacgtaatgttcgcgattgaccgtgcaggttttgtgggggctgacggggaaactcatcatggcgtgtttgatgtggcattcttgcgtcatatcccgaatcttgtgcttatgatgccaaaggatgagaacgagctacgccatatgatgaaaacagcgctcgactatgaagatggtccaattgcttatcgttacccgcgtgttaatgtggttggcgtgccgatggataaagaattacaggctattcccatcggcagttgggagctcctgcgtaaaggcgagggctttgctgtaatcgcatcaggaccgatgcttcaggtggcgacagaggctgcggaggcgatgaaacgggaaggtttgcaagtgggcgtcgtgaatgcccgtttcctgaagcctttggacgaggatatgttgcgtgagctggctcgtcagcatacgaagctgatcgtattggaagaagcttctgaagcaggaagcttgggtagcgctgtactggaattttacgctaaagccgaaatacaagaggcacaggtgcgcctaatggggattcccgatctgttcgtggagcatggctccatcaaagagcagcgtgctgaagtaggtcttaccattgaagatgtatgcttaaagctgcgtaaatgggctgctgagccagcatatggcatgggacaatccgtatagggtaacttgaagtgaagaccatgacgtttataaaaagtatgacaagagcagcctgcgctgcctaaagggagattaacatgtctgttccgaaggaacgcattgatgtattacttgtagaacaaggcttttttgaaagccgtgaaaaagctaaagctgcgattatggctgggctagtgctggcggacagcgaacggatcgagaaggcggggatgaaggtaccacgcgccagcgagcttaaagttaagggttcggtgcatccgtatgtaagccgtggaggattgaagctggagaaggccatccgtcaatttgagctggatatgaagggcaggacaatgctggatattggctcgtccactggaggttttacggattgtgcgcttcagcatggagctgaatacgtatacgccattgatgtgggttataaccagctggattggtcccttcgtaatgatgaacgagtatgcgtaatggagaaaacgaatttcagatatatgacacccgcggatttgaatggttccgtgccgaatttcgctagtattgacgtttcctttatttcattacgtattattttgcccccgttgcttgccttgttgcatcaacctgctgatattgtagctctaatcaagccgcaattcgaagctggacgcgaaaaggtcggaaaatccggtgtggtccgtgatcctgctacgcataaagaagtgttgcagaccattctgatgtttgcacatgagcttggacttacgctgcaaggtttggcttattcgcctattacaggtggagaaggcaatattgaatttttagcgcattggcgtttggatgggcttcctgctgcagaatcgcagctggagaagttggatttcagaccactgattgaacgtaccgttcaggaagcaggtcagacttttaataatggtccatcgcgtaagtaacattcaggggttctccatgagttctgtgaacttaagggaacctctttttggtgtgagggattgattgtagaactcacgttcgcctataatgagatgtacaaaggaaaagggattttacatcttgtcctagaatatgtccatgaggtgatcggtccatggacacaagatatgatacggttatcatcgctgtgatcggggtgatattagggatatgggctttgtatagcctacgtgcctggttaaaggagccagggccgctggtgctaaagacgataccgattaacgaggacttggacgaagggcctgtcacagacctactcgaagaagcaggatatgaagtagtgggcgggaagatgaaaataccgcttgcttttaaagtgaatggacataccgtgtatagccgtttgtttatagactacgtggctgtacgaaacggttcgacatatatggtcaaaacgtcacgccgcaagaaaccaatggagtggagtggtcctgatttaagggacaggctcatgccgtatttattgctctatccgggctgcgcgggtgtattatacgttgatacggacgagcgaagtattcgccttattacattagtggaagacctcgaagaagaggaatatgaaggttaatccataggaggattatatgaagggtcaacgacatattaaaattagggaaattatttcacaacatgagattgagacgcaggatgatctggttgaagcattgcgtaaggctggttttcaggtcacgcaggcgaccgtatcgcgtgatatcaaggagttgctgctcatcaaggttccaatggacgatggcagatataaatattcgatgccttcagatcaacgttacaatccggcccagaaactgaaacgtacgttggtcgataactttttgcatattgactacacaaccaatctgattgtgatgaaatgcctgccgggaacagccaactcgattgctgctttattggacaatattgaatggtccgagatcatggggacgattagcggggatgataccattttgattatttgccgatcggaagaaaacagtgaagctatcgtgaatcgtcttatgggctacatttcctaattataatggctacgcatattaggcgttttaatttgtacatcatagaggtgaaagaacgatgctggtcactttgtctatacggaatttggcggttgtagaggccgtcgatgttcatttttataaagggtttcatgtgttgagcggggaaacaggtgctggtaaatccattattatcgatgcgcttgggctgattgcaggcggtaggggctctgctgatttagtgcgttacggttgtgataaagcagagatggaagccttatttgaactgccggtaaaacatccagtctggaatacacttgaggaacaagggattaaggctaatgcggaggagcatttgctgattcgtcgcgaacttacggttcaagggaaaagctcttctcgaattaacggccagatggttaatttaacgatgctgcgtgaggtaggtgagcaactcgtcaatatccacgggcaacatgagcatcaaagcctgctacgtgcagatcgccatctggcgctgctggatacgttcggtgattcggtcatcggtccggtcaaaacgctttatcgggagcgttacaatgcttttgtcaaagcggaaaaagaagtaagagaactgcaaagctccagtcaaaaggcttatcagcttttggatatgtaccgatttcaattagaagagatcgctgcggcggagttgaaattgggagaagatgaattattggcagaggaacgggtcaagctatcccatagtgagaaaatgatggatgggatatcaggagcatacgaactgctaagcggcagaggtggactggatacgatcaataacgtgttgtccagattaaacgatgtccaaagctatgacagcaaaagccttcagcccattgcggagcagattcagtctgctttttaccagttggaggacgcagcattccaattacgttcttatcgtgaggatattgaatttaatccaggcaagctgcatgaagtggagcaacgtttgaatcaaattaccggattacagcgaaaatatggtgatagtatagagcagattttggaatactatagccgtattgagcaggaaaccgatctgctggaaaataaagatgagcggttggagcagctcattgcaaaacgggacgagctgctttccgatttgcttgagatttcggaagagcttacagaagcacgcgaaatttgtgctgaagagcttgcagagcaagtggagcaggagttaaaagacctgcagatggaaagaacgtcactcaaggtgcgcattgatccaattgaagatccacgcggatatgagtataaaggtctgaaggtaagacctaccaagcagggcattgataatgcggaatttcttatatcccccaatccaggtgagccattacgtccacttggtaagatcgcttcaggcggtgagctatcacgtatcatgttggcgatgaaaagtatttttgcgcgtcatgatcaaattccagtactcatttttgacgaggtggataccggggtgagtggtcgtgcagctcaatccattgccgagaagctatatcgtttatcttccgtttgtcaggtcttttccattactcatttgccacaggtggcatgtatggcagatcatcagtaccttattgagaaaaatgtccatgatggacggaccatgactcaaattgagggacttacggaggacgggcgtgtcaaggaattggcacggatgctgggcggcgtggaaattaccgaaaaaactttgcatcacgcacaggaaatgctgaatttggcggaaggaaagaaagcctgaaaagagcggctggcgtaatgtttaacagttataaaagcctgggggcaaggttaccttataggtacgcaattggcgaccacctttactcgtcaagcgaaagaagcaaagggagcgtgacagccattgaatttttactccaggatcaaattgctcggtcttttgcttgtttttcttatgtgttctatcggtaacgctcagcatgtgcaagctgcgctgcctccacaagcttctttggatttgttcggctctaaaagcatgaggacaacccaagaaagtgtagttcccgatttaaaagtatacccgggggggcagacgattggggtcaaagtaaaatcttcaggagtgcttgtcgtcggtcaccatatcattcaggaaagtaatgatcgtaaggtgtcacctggtgaaacagcggggattcgcctaggggatcggattacacacatgaacggcaaaccactcaatagcctggcaagggttgctgaggcagtagacgaagcaggtaagaataaaaagccgctcgacattacactttgtcgaggagagcagacgatttccacgaagttaacaccagcatatgatcaagatgataaagcgtggcggcttgggttgtacattagagactcggctgcaggtgtaggtacattaacgttttacgcaccggaccagggtgtatacggggcattgggccacgtaattaccgatatgaatacccaaacccctattgtcgtggggagcggagagattgtgcagtccaatgtgacgtcaattgcgaaaagccaaagtggggaaccaggagaaaaacgcgctcattttctcaaagatcatcgggtattaggaaatattgaacgaaatacgaatttcggaatttttgggaaaatgtcagatgagccgcaatatggattgtattcaactcctattccggtggctcttgcgaatgaagtaaaggaaggaccggcagaaattttgactgtactggaaggtcaacaaattcagcggtttcaggcggaaattgtacacatttctcagcaggacaaaccagcaaccaaaggacttgtgattcgcattgtagatccaaagctgttggataagaccgggggaatcgttcaaggaatgagcggtagtccgattattcaaaatggtaagcttatcggggctgtgacacatgtatttgttaatgatcctaaatcaggttacggttgttttatcgaatggatgctgcgcgatgcaggaatcatgcagaataacgtaagcttgaaatcatcttctaatcttaaggcgagctagtggccttaagatttttttgtcgaaaagcaggggaataactcatatttgcaagataaagaatcaattataatagaaactataaaaaaaataaataaaaataattttcgacagaaggaattcataattcgatgtcgaaatcatatactccgacaagaaatatttatatactgtaaacagatatcacaatggaatatcactcaatgaggaggaagtacattgcaaaaaattgaggtattgttggctgatgacaaccgggaatttacgaatttgcttgctgaatatatttccgatcaggaggatatggaagttacaggaatcgcctataacggcgaagaagtgctccaacgcatcgcagaatcccgcaacatacctgatgtacttattttagatattattatgcctcatctggatggtctcggtgtattggagcgtttaagagaaatgaacctgactccacagccgaaaatcattatgctgactgcattcggtcaagaaaatattacacagagggccgtacagctcggggcatcttattatattttgaagccgtttgacatggaagtgctggctaaccgtgttcgccaattagtggggccgcagttagttagcagcagtccggtgaccatttcatccatgcggtccaacgttgtacctatgggtaagacgaaaaacctggatgccagtatcacagccatcatacatgaaattggtgtaccagctcacatcaagggctatcaatatttacgcgaagccattacgatggtgtacaataatatcgaaattttgggagccatcaccaaaacattatatccggcaatcgccgaaaagtttaaaacgacggcatctcgcgtagaacgcgccattcgtcatgctatcgaggtagcatggacccgtggaaatatcgacagcatttcacacctgttcggttacaccattaatatcagtaagtccaaaccaaccaattcagagttcatagcgatggtggcagataagctgagaattgagaacaaggtgtcctgaaagggccagaatgattgatgaagcaagggattatttggtttgacgtttatcaatgataattgcagggatggctactaatttcaaaacagccgacccgatccgataaacttctgaatagtagacaactaataccgcctatttattggttcttccaagaaccagtaaaggagcggtattttttatgaacgtttttgaatttcaatttgacaatttaaagttttcttcaattatcatcattttcatgctatcagtggtcgttctattaaggaagaaagttgttaaaatactgaatgataccggtctgctaccccgaagtatttatccttaattggaaggtggaaagaaaatgaattcaatagagtataaagagttttataataagattggaaaaatcaacggctggaatttcagcaatgtgaaatgtatctccaaaggagtaaaatgggacttctacaatgaagtagcgaagacatgcaagaagtcggatatattgcttgatatcggtactggcggcggggaagcaattttatcaatagcagattctgcattacttttagttgggattgaccattccaccggaatgattgaaacagcaaccaagaattctgctgaatcagacatagcaaatgttcgttttctccagatggatgctgaaaatctaaattttcctgagaacttctttaatgtaatctcttctcgacattcatgtttttatgcaaaagaaatagcaaaggtgttagtaaaggatggtatgttcctgacacagcaagtaagcgaaaacgacaaattaaatattaaagaagcgtttggaagaggacaggcatggggtgctaagaaagactcgttaaaagctcaatatattaccgaattaagtgacgcgggctttaaggacatacagtcatttgaattcaatgcaaccgaatattatcagactcctgcagacttaatatttctcttgaaacacacaccaattattcccaacttcggagaagaagaaattgattttcaaatactccaacaatttatttcggacaatcaaaccgaattaggaataaggacaaattcagaacgatttatggtgattgctaggaagtaaaacataaagggatacccgttttttgggtatcctttttttaaagtttgatggaatgagtgaataaagatttttagcatcgtcctcgctaaatggcagaaattatgagacataatacccttcacactgattataaaaataaacctgaatcagttgcactaaccatcacgaagaaaaagttcccttttgtaaacagttctgaaattctctttaaatttgatataaacaatgtgtcgtttcttgtcgatatagtatctaatataaagagaactgaggagcgaatatatgaaatttaacattcgaacaaaattgatattgggttttcttgcggtaataatattattgattgtcattagtacaacatctatctcaagaatgaaaaatttaggcgacacttcgatggaaatagatagccattggatgccaagtgtgactatcctgggaacactaaatggcgatatatctgatgtagagcggatctcattaaacattattgtagaacgtgacccagaagaaatggagaaggttcaggccgaatatgataaggttttaaaaaaggttgaggaaagccgaaaaacatacgaaaaattaattgctacccctaaagaacgtgaaatgtatgaagaattctccaaaaattatgcggagtatttggctaagttgccagaaatgattgaagcggggaaagctaatgattacactcaatcaagcattcttcatcaagagtcctataagttatggtatagttcaaacgataagatcagccagctcattaaattgaatgcagatggatctaaacagactacgaaggaagctgttgacaactttatttcagggagacaattggtcatcattctgagtatagcagccgttatactagcattgatcatggcaatcatcatagcccagattatttctaaacctatcttgcgaattagtcgtgctgctgaaagtatcgcatcgggtgatcttacaagtgaaactatcattgtgaagggcaaggacgagatcagtacgttggcacattcctttaacgccatggttgagaatcttcgtcaactgattcaatctgtgagtaatacggctgagttggtaaccacttcctcagaagaattgacggccagcgcagagcaaaacagccaagcatctgcccaaataaccgaaacggtgcaagaagtagctactggaacgggagaccaggtagatatggtgacgaaatcgtcccaagctattgaggaaatgtctatcggtgttgagcaaattgccatccgcgcgcaaaatgtattcgcatctgcgcaagatgcggcccataaatcggctgaaggtaaccagatgattcaacaggcagttacgcagatgaatgccgtaaatgattcgatgaatggattggcagatctcatggctggattgggagagcgctcagacgaaattggcaagatcattgatgttatcaccaatatttctagtcagaccaaccttcttgccttgaacgctgcgattgaagcggcccgtgcaggagaacatggtcgcggatttgctgtagttgcaggcgaagttcgcaagttggctgaacaatcggctcattctgctcaacaaattacggagcttgtgggattgattcaaaaggatactacccatgctattgaggcggtagcgtccaacgggaaggatgtcatgacaggtcgtgaagttgtacaaaatgcaggcgcatcctttgaactaattcaggaaactgtaaataaagtggccagtgaaattgaagaggtttctgccggatcagaacaaatgtctgcaagtactgatgagattgttggttttgtcagacaaatttcagcgattgctgaggaagccgcagcagggacacaacacgtatctgccgcaactcaggaacagctggcatccatggaggaaattgcctcttctgcaagaaatctatccaaaatggcggaagacctgcaagggcaaattgggaaattcaaagtataattcgtatactgctttttatggttcagaggaactagctgctctattgtgagcagctttttttctattttttattaatatattgtgattaaagggtggggatatgagaagcctgtaattggaacgatatgatataatggtgggaaattcttttgggttggagtgaccatcatggataataagactgaacttaaagcaagtgaactacgtcagttagcgatagacaaaatcatagctacaccatttttgaatgattttaaatatctgaaaagcagaaaagttttgaaaaaagaaaccaaggaatttatatttgaaattagttttggtgcgacaaaatatggtgcattaaaagtttatattatcgtagaatccaaaagaataaaaaagaagtatagtactggcgcttgttttcacagtgagttgattgctctcaccaagaaatatacggaaaacagggattaccctgtgtccacagaagctgaaagagaacgggtgatccaagagattattgaagatatttacactttcgcgttgccctttttcaagcgatttgaacatgtagaaacactagcagaacaagtacataagtcaggctttttaccgcaccgcaaacgctttgataagtttaatccgttaacgaaaagattcattgatttttattatcaagggaagtaatgtagccatctgggccatttttattctcaccattgggcagtagataagcattatgataaggagaacgatcttcctagaggggatattatcgtttttcaaaagtatgatgtacaatttgtaaaacgggtcaatgtacttctcaggtaaagatgatttacctaatatgctcagttagaggcgagtcagatgttgcacgggagggtacgatttttatatggagaccatcggatgaacagcacagaggctgtatacacgggtatatttcaatgaataaagctataggctaagtcatcgcattgaacgggctagtggtattaacccaattgattctaaagcaaaggcggggatgagagcatgtggtatagtctgacttgggtgttcttgggcgtgttgttggtggggttgggttggattgttaaagtaaggcgtagtcgcagcagcaacaaacaagtgaatgaacagcgggacagtaatgtcgttgaatttcgtcctcgtaagtccgctcgacaatcccgcacccgtaatgaatctaagtctaaagtgtcctccggtccacgcacgaatgcaaaagcagcaggtattcaggcccaaactgggtttggactgtctgactctatccagggcacaggcaagcaaaaatgctccttttgtaaaaaagaagacaaattaaccttctatgcggatgacaatgggtcgttgtatggggtatgcaaagagtgtaagcataaggcggaaagacaggatatgttgccactttagtctatacagacgattgaggaccatcattaaagaattcttttaattaataaaaactcccaaccgatgtagtaaattggttaggagttttttgtttgtatttttacattgttatctaatttgtctgtcaattagttcctcgagtgcatccgctatgtgatcgggtccataggagagctcttcccggcttaagctcaaccaggcatggcgctcatccatatcaaatgcagtctcaagccaaccagataaccccctgcccctgcggtctacttctacaagcacatgcacaccctcgggttccaactgcataaccagctctagctcctcgatatcacgtacatattctgatccgggcgtaaattcaaattcctgtacgtacggaacgccgcgtcccagcttaggatgacgttcgcaggtggaggagcggaatcggaagcccaacaggtgaaccgcctcaaacactgtattcatatagggatgtggctcgattttgagtgaatcacgatcggtcgggtccaaagccatgccaatatctaatgctgtttccagccagacgggctgtttggcgtgagtaacaggagtttccaacggcaatctgaaggaaaaaggaatttcaagctcctgtccttgctctagatgaaagccgtcagataccttaatccgtgcaatgcagcaggtgctggtagtttttttatcatcgtgctccacgatatattcagtcttgagctcgatgtcaattttgccgatttcctgatcaattttgccgcctttgatgcgcatgatgccactaagttcttccccaggcacatatacagcttgatccaccagcgtatcgactttagctgaaccgattcctgcgcttgctaagattttattaaaaaaactcattattccgtccccccagataatctcatggtcatgatatacaaacgaaaactaaaaacttgtacagcttaaccggatatacggggcaatggttcgattcgttccaaaaaaatgcaagaaaaaagtcactggtactcacgtaggcatattgcagcttgtcgagctatctgtccactaatcgcagttcactttatgaggaggtataaagcaatttcgacaacgaggctcataagcctcagagtcgccgatcatcacaataggtcccacagtggaaggtttaccatttaccatacgttgcgtaaatactgcttccgagctaccgcatacagcgcaaaaggaagtcagcttctcgatgtcatccgccatggcgagcagaccaccgacatagccgaactccttgcctcgataatccagattcagcccatcggcaattacatgcttgccgcaataagctagctcttgtacaagcgacataatatgacgactgaaaaactggacttcgtcaaaggcaaccacgtcggcatcttttgtttcttgcaaaatacgctgaacgagctcatctgtaagttttcttgggatagagatagcgggcagccgatatccgatccggcttactatttcgtcctcggcatagcggttatcttcagcgggtttgtaagctaccactttacgatgcccgtattggattagtttttgacagcggcgaatcaattcgccggatttttcactgaacatggggcctgtaataatcgtaattcgtcctgtaggcaaagcgaattcccctctctgtaacatgtacataacactgtaaatcttcttctccgaaagaaaacgccattatagattaccataaccagccgtatacagactagagaaaatatattgattttcgacatgtttttgtatgtccattcctaaaacgtaaatgtggtcgtcattgctctgccgccgcgggcatgatatggtgaagcgtagtggaatgaagggaagagtgaaaggcatggacgaaaaaaatacggattatagtgccaaaaaaggagcattactggagcaagggctgatcagcccgcaagctctagaactcatcactgagctggagacagagctgaactttctgcgcaagcaaaatgaatcatttcgcaaggcgctgcgagccaaatcagcacaaagttcaaggatgtctactaagttacgagatgcactgtatgaatgatatggaaagatatctggattaaagggttagtttttttgtagcctatgcctaaacgctatattttgtacagtgaaataaagagagtacaataagctatatataatcaattgttaatggaggagaaacatgactatacattgtgatgtcgctattttgggtggaggaaccggggggtatgtagcagccattcgtgccgcccagctaggcaaagaagtggttatcatcgaaaaggacaagcttggcggaacctgtctgcaccgtggttgcattccgagtaaggccttgctacgcagtgcggaagtatatgccacgattaaagaaagtgcacaatacggtatcgagacatcgggagcacagcttgtatttcccaaggttcaggaacgtaaggaagccgttgtggaacagctgcatcagggcgttcaatttttgatgcgtaaaaataaaattacggtactgagcggtaagggacgcgtgattggtccgtctatattttctccaaaaagcggggcagttgccgtggaactagaagatggtgagatggaaacgattgttcctgcacatctcattattgcaacaggatcacgcccgcgtgtgctgttcggactagagccagatggcgaatttattctgagtagtgacgaagcgttaacgatggaggagctaccagcatccctgattatcgtgggcggtggtgttattggcgtggagtgggcttccatgctaaatgattttggcgtggaggttacggtggttgaagctgcgaatcgacttattcccacggaagacgaagacgtttcgcgtgaaatgcagcgcttgttaaccaagcgtggtgtcaaggtgctgacgggttcacaagtgctggctaaaacatacggcaaagatgaggaaggtgtgcagattgacgtgcaaaaaggggaagaaaccgaaacccttagcgcttccaaactgctcatttctgtagggcgtcaggcaaatgtggaaaatatagggctggaaaatacggatatccgcgtagagcgtggctttatctcagttaatgaatatttgcagacgaatgaaccacatatttacgccattggggattgcatcggcggcttacaactagcgcatgcagcgagccatgaaggtttgcaggcggttcatcatctggcgggcgaagattttcacagtgtacctaaccatctgattccgcggtgtatttatacacgtcctgaagccgcaagcgtcggcttaacggagcaagaagcccgcgagcgtggacatcaggtgaagacagggaagttcccttttcaagctatcgggaaatcgcttgtatacggcagtcgggacggcttcgtcaaagtagtggccgacgagaagaccaatgatattctcggtgtacatatgatcggtacgcatgtgacggacctgatcagcgaggcggctcttgcgcaactgctggatgctacgccgtgggaagtcggacagcttattcatccgcatccgacgttgtcggagattttgggagaagcgatgctggccgttgatggacaggcgattggcatataaacgtttcaaataaatcggtgcttttctttttggggagaaaaggattataatggggttagtcagagtttagtaccaggttttaagacaagatggtactaggtactggaagtaggatgtttgacacttaaggaggtgcctcaatgagttctaaaggcgctgtagacgctggcttcagacatgaacagctaggacttactcacggacaagttattgatatgtacagatatatgttgcttgcaagaagatttgacgagcgcaacatgctcctgcaacgggcagggaaaattaatttccacgtttccggcattggacaggaggcggcacaagtaggtgcagctttcggccttgaccgggaaaaggactattttcttccctattatcgggattatggattcgtgcttgcggtaggaatgacgccgcgcgaactgatgctgtcggcatttgctaaggcagatgatcccaatagcggtggtcgccagatgccaggacattttggtagtaaacggctgcgtattgtgacaggctccagcccagtaacaacacaggttccgcatgcagtaggtgtagctttggctgccaaaatgcagaaaaaggattttgtatcgtttgttacgtttggagaaggctccagcaatcagggagattttcacgaaggctgtaactttgctggtgtacaaaagctgccagtcattattatgtgcgagaacaatcaatatgcgatatcggttccgattcataaacagttggcaggcaaggtaagcgaccgtgctttgggatatggatttccagggattcgagtcgatggtaatgatgcattggcggtatatgcggcggtgaaggaagcacgcgaacgtgctgtccgcggtgaaggtcctacgctgatcgaagccatgatgtaccgactgtctcctcactctacctcggataatgatctggcttaccggaccaaggaggaagtggatgagaactgggccaaggatggcgtagcccgtatgaaaagctacttgatcgaatgcggcatttgggatgaggccaaggatgcggatctgtcggctgagctgctgctcgaagtcaaggaagcgattgaatatgcagataaagcgccttttccaaagcccgaagatacgctgctgcatgtgtatgcagatagcgatggggagggccggtaacgatggcgattatggaatatattgatgcgattcgtcttgccatgaaagaagagatggagcaggatgaaacggtttttgtattaggggaggatgtcggggtgaagggcggtgtctttacaacgacaaaggggcttatggaccaattcggtgagcaacgtgtcatggatacgccattggctgagtcggctattgccggggttgcgattggtgcggccatgtacggaatgaagccaattgccgaaatgcaatattcggacttcatgcttccggcgaccaatcagattattagtgaagctgctaaaatccgctaccgctctaacaacgattggaactgtcctgtggtaatccgcgcgccaatcggtggtgggatctttggcggtttgtatcactctcagtgtccagaatcgatcttttttggtacgccgggtttgaaaattgttgctccatttaccccttatgacgcaaaaggattgctgaaagcagccattcgtgaccctgatccggtgctgttttttgaaaataaaaaatcctacaagctgatcaagggtgaagtgcctgaggatgattatatcgttccgattggcaaggctaatctattacgtgagggtgacgatattacggtcatcggttatagccagcctttgcattttgtcatgcaggctgctgaggaattggagaaggaagagggcattaccgcacatgttgtggatttgcgcacactccaaccgctggaccgcgaagccattgttgaggctgcacgacatacaggtaaggtattaatcgtgcatgaggacaacaaaacgggcggcatcggtgccgaggtatcggctattattaatgaggaatgtctattcgagctggatgcgccgattgagcgtctatgtgctcctgatgtaccagccatgccgatcagtccaccgatggagaagttttatatgttaaacaaggataaagttaaggaagccatgcgccgtcttgcaatgtattaatatagggcagattggacgaaaagcattccaaaagtatagcggggtagcggaaaaacgcgccctcctatgatgttaaggagttgaaaaaatgtcagaccaaacacaatggaacgacgtgaccatgccacaattggcagaatcgctcgtatcggcgacaattgccaaatggctcaaacaacctggtgaaacggtagagcaatttgagccgatttgcgaggttattacagataaagtgaatgcagaaatcccatccacgttggacggcattatgggtgatctgttggcagaggaaggtcagacagtagcggtaggagagttgatttgccgtatccagacgaagtcggctgcacctgcggcggcatcaggggcgacacctgttgcaccagcatctcaaagcaccgtacaaacacaatctcagcagagtgctggatcggatcagtccatgagaggacgtttttccccagcggtgcaaaccctggctgctgaacataatgtggacttaagccaagtaccaggcacgggcatgggggggagaattacccgcaaagacgtactgaattatgtgcagcagggcggttctgctcccactggagtatctggacagccgactgcgacgacatcaggacaaggctctccttttgcaggaagacagcagtctgctactcagcacggtacaccgattcaaaatatggaccctgctattccggttcgtaacagtgggattcatttgacggaggctccaaaagctcctgtgatcgaagttgaaggtggcaacaacaatagatccgagtattttattgatgttacacccattcgcagtgcaattgctcgcaatatgcgacaaagcgtttccgaaattccacatgcttggacgacgattgaggtggatgtgaccaacctggtgatgctccgcaacaagatcaaaaacgaatttaagcaaaaagaaggaattaatattacgtatctggctttccttatgaaagcagtcgtgaatgcaatcaaggaatatccgattatgaattcggtctgggcagtggacaaaattatcgtcaaaagagacatcaatatttcgctagccgtaggtacggaggactccgttcttacccctgttattaaaaaagcggatcagaaaaatattgctggattagctcgtgaaattgacgatttggcacgtaaaacccgggaaggcacgctcaaactggacgacatgcaaggcggaacgttcactgtaaacaacacaggctcctttggttcaattttatcttatccggtgattaattatccgcaggctgcaattcttacctttgaatccattgtcaaaagacccgtggttattgatgatatgattgcggtccgctcgatggctaatttgtgcttgtcgctggatcatcgcattttggacggagtgatttgtggacgattcttgcaacgggttaaagaaaatctagaaggctacactttagatacgaagctgtactaatcatccgaacagtgggggaaatgtacggagaggaagtgacaggccgtgaacagacgaccgcttgatgtaacctatacgaataggatggaatatgcccatgcatgggatgtccagaaggagattgtgggaaagctggatgcgggagaggcaagagaaacgcttatgcttctccagcatccgccgacctatacgattggttctcagcggcatcctgaacatcttctcctcacaccagagcaactgaaggagcagggaatcagcgtctttcagattgaccgtgggggagacattacatatcatgggccggggcagcttgtcggatatcctctacttatgctcggcaaccgggaggcgttgaatctgcacggataccttcgaagtctggaagaagtgatcatccggttgttggcatcttatggagttgagggaagccgtaagcctgaatatacgggggtatggatcgggaatcttaaaattgcggccattggcgtcaaattcaacaagtgtaagcaccgtcggggcttcgtaaccagccatggctttgcctttaacatcaaatcagggatacagcatgagggctttgagggtattgtcccgtgcggaattcaggaatacggtgtgacatcattggaggactgcatacagaagcctatatcggtggagcagattgcgaaggaaattgtaccgtactttgaacagcaattttcatttgttgcgcaatggcaaacgcattctttccaataaagtaaggcgggctattgtgtatctacacgtaagcccgcctgtttgctttacgtaacagctcgtccactcgaggcctcaatagtgccttagagcagccggataccttgagcgataatttattatagtggcataataaacggctcaattaccatgaacagcgtagaaccaatcatagctgcgagcataatgtagacgaaaaaacgaacccattttttgttcgacatgtgtaactcctttaggataggtttaagtcatagataagaacatctatccgtattgtagcgtaatcgggaaagagaggaaagtttaatgacagtaaaagtagtaaaagaccgaatcgtacaggaatttatggaactcgtacaggtggatagcgaaacgaaaaatgagcaggaaatatcacgtgttctaaaagaaaagtttaatgcactcgggctggaagtaatggaagacgattctcgtgaaagaactggacatggctcaggcaatctgatcgtcacctggaaagcggaaggtgtagagcaagcacccaaattgttttttacctgccacatggataccgttactccgggtaaaggcattaagccacagttgggtgaggatggctggattcgtagtgacggttcaacgattctggggtctgacgacaaggcgggaattgctgctttgttcgaggcgattcgtgtcgtgcgcgagcagaatattccccatggtcaaatccaattcgtgattacggctggcgaggaatctggattaatgggtgcacgggcgatgaagccggaagtgctagattctgatttcggatatgctttggattcaaatggtgaggtcggctctatttgtatagctgccccaacgcaggcacgtattgaaatgaagataactgggaagtccgctcatgcgggggtaaatcccgaagatggcattagtgccattcaggtcgcttctaaagcaatttctaaaatgaaactaggacggattgataaggaaacgaccgctaacatcggcagtttcgagggcggcggcgcgacaaatgtggtatgcgattttgtattgatccgtgcagaggctcgtagtattgtgcaagaaaaggttaatcatcaaatccagcatatgcgtgaagcgctggaaaccaccacacgtgaatttggtgcacagggagagttccgcagtgaagtcatctatccagcattcagttttacggagcatgatgaagttgtacaggttgctcagcgtgccattcaaggactgggactggcaacgccaaccttccattccggtggtggctcagatgctaatgtattcaacgggcttggaattcctacggtgaatttggctgtgggctaccagaacatccatacaacagaggaaaagattaaggccgatgacctggtgaaggttgctgaagttgtcgtagctctgattcaagaaaccacaaaataaatttgtattatacacttgcaacatactgaaaaaaggttcaggttaaagacaggaacagcgttccttcgtctttagacctgaaccttttttggaacagctagcgaagcgatggtggctgtaggtccatgttctttttgccattgacgcaagagtgcttgaatctgccaggctttaccaacgatatggagggtgctttcagtacggtagcttttcatttctgcatctcctcaagacaggaagtttgttattctaccaccagcatatgtacaaagtggacaagttagactaactttggtgataattaataaagaaagatagatatgaaggaggaaacttaccgatgaacgagcaaacgaacggacaattgaacaatccaacaaacgatgcacatcgcaagccttattccaatcctgcgctggaggaaaagaccgtgtccacacagcctatctttgagggaaaggtcattacattacaggtagacacggtagagcttcccgacggctccactggcaagcgtgagatcgtaaagcatccaggtgcggtggctgttttggcactacataaagggaaaatgctggtcgtggaccagtacagacaggcgatggggcgctgtgaggtagaaattcctgcaggtaagctagagcggggtgaagacccgatggaagcagcggggcgtgagctgagagaagagacaggttatactgctaagtcgttgaagctgctgcactccttttatacctctcctggctttgcggatgaaatcattcatctgtatgtggccgaagaactggagttaggtgagatggaaccggatgaggatgaatttctggagctgtttgaggtgacgctggaagaagcacagacgctcattcgtgaaggacggattagtgatgctaaaacgattctggccgtctatgcatggcaactccgccaacttacagggagcttctaagcgtatggatgaaaatatagtagaacttaacgactactttgcagacttgcatattcatattggcaggacagagaagggaaatccggtcaaaattagtggcagccgcgatctgacctttgccaacatagctaaggaagcctccggtcgcaaaggaattgggctgatcggtatcattgactgccatgcacctaatgtacaggaggatattcatacctatttacatacgggtgaaatgaaggaaatcagcggcggaggtatcgcataccgggatacggtcattctccttggcacggagctggaaatacgtgctgaaggtcgtcctgaggcgcacgtactggcctattttccagatctggtggcgatggaggattttacccaatggctggcccggcatatgaaaaatgttaatctcagctcacaacgaatctatgcaccgccacgcgagttgcagcagcaaatttacggacgtggaggcattatggtgcctgcgcacgtctttactcctcataagggcatatacggcagttcagcggctcgtatggaggaactgctggatatggagctcattagtggggtggagctggggctgagcgcagattcatctatggccggtttgatttcggaactggatcgcttcagctttctcacgaattcagatgcccattcacttgggaaaatcggacgagaatacaataaattatcactggcaaagccgtgttttgatgaattcagaatggctttggagcggcgggaaggacgacgggtgcgtgccaattacggattaaatccgaaactgggcaaataccatcgttcttactgtcaaagctgcggtacgattattgacgagcaacagatggcggatgaacgttgtcctgactgtggtcataccaagcttgtgcgaggtgtgttggatcgaatatggagcattgccgaccgtgagcaacccatgattccgccccatcgtccgccgtacatttaccagattccactggagtttattccaggtctgggcaaagccaagctgaaccagctattggctgcatttggaacagaaatgaatattttacatgaggttacacaggaggagttagcagcagtcgtgggtaaagtgttggcagagcaaattgtgctttcacgcgaggggcgactgtcgcttgtatccggtggtggtggaacatacggcaaaatagctaagtcctagtaaagtcttgtccctctaaaggcatatcagcgtctgcttgttcataaccataaattatcttgccgctggcttggcacatcattcgtgatgtttgatctgcagcgaaagctgccccatttctagccatcagccatcggattacggttgttttttggacaaacaagcagatgaaaggggcaggacgccgatgcaatggtttcgtcatacgttaaaggatcagacgccgtattatgttttcttggctgtgctgtttctggtgggagtcgtctttggcgcacttatggtaaacgcactctcgctggagcagttacaggatttgtcccgttacctgaaggatttttttgtaacggtcaatcaaaacgaacagggcttcgctgattcgcaggcggcctcgaccttttgggatagcgtatctttacatctgaaatgggtcggcctaatttgggtgtgtggcctttcggttattggtctaccgggcattcttgtattgaatttcctcaagggtgtgctaatcggattttcagtaggttatatggtggggcaatattcgtggaaaggactgctattttctttggtttcagttgctccccataacctgctcgtgattccggtactgctcgtctgcagcgtggctgcgatgactttttccatccatatgatcaaaaccaaaatactcgctacccggccgtcagacggaatgctgcgtccgttgctgtcttacgcaggattgactgctgtgatgatggtgcttcttattggtagcgcgtcctttgaaacttggatcaccccggttatgatgcaatgggtcactcctatgctgacagcttccgtgtcatcttgatccgtttcaaaatgtttgactttatttgtatagaccccctataataataggagtgaaaaaagtgcagtaggcagtagctttgcagggggagggagacacatggaagcacggatcgaaaaaattaagcagcaactgcaatcccagggctacaaactaacgcctcagcgggaagccaccgtcagagttttacttgagaacgaagatgatcatctgagtgcggaagatgtatttatgctcgtcaaagagaaagctcccgaaatcggtctggcaaccgtataccgtaccctagaactgctaagtgaactgcatgtcgtggagaaaattaattttggtgatggcgttgcgcgttacgatttgcgcggcgatacaaccaaacatcaccatcaccatttgatatgtgtgcagtgtggcagtgtagatgaaatactggaagattggcttggaccattggaggagcgcctggaacgggaatataattttaccgtagtggatcatcgtttggacttccacggtatttgttatcgttgtaaggcgaagaacgatacgactgctcagaaatctttgggcaaatccaaaaaaaacaaatctcaggactaaaagctgactacccaagctctcaccgacgaagatgcgttcgggagagcttttttggttcgggatctgttgttcgggattaagcggtataaaaaggaatagcttgtcatacccttccatagagagtcctaattagggccatattctggggaaaaggcggctgatccacatggtactatcgttgcggagaggactaaaatggctgcgtttggtaatcttgttcggggtactagcatgtatgttcttttttagcctcaggctgtttacagattggataacacctgtagatcattaccgaataccggaaggacatgcagttaaggtatttggcggacaaaaagtaaatgaagggtccgagcatcgaatagcagtgttggaacgtttacgtttcttttactggtatggtgaatagtctaagtaatcggtcttgatgagcttatgaaatgaaggcagcacacgaagaagcagacgctgagactgaaccgctgtatgcagaacaaggagacttttggaactcatgaaaatgtacattcaacctttcgctcaatatatggaagaggaaaagggtttgtcgcgcagcactttggaagcgtatcaacgagacgtacagcagtttgtcgagttcgcagaaagctgtggtattgagcagccggataatgtccaacggtcacatctggtactgtatttgggccatttgaaggaacagggaaaagctgcggcgacgatatcacgtagcgtcgcctccattcgctccttttttcattttcttatccgggagggaattacgatccatgatccgtccgttctgctggagttgcctaaagcgactaaaaagaagccctcggtgctaacgcaggatgaggtagagcgtttgctggccgcgccagatgtgactgccccgcaaggggtgcgagacaaggcgatgctggagttgttatatgcgacgggcattcgcgtatcggagctgattgcccttaacgtgtgtgatgtgcgcaccgatctgcgctttgtgcactgtggcggcgaggcaggcaaagagcgtgttgtaccgattagccgtgaggcatcacagtgggcacaagcctacatggacgagcagcgtctattattgctgagatccgggcagggtgaagaagctcaggtagagcaggaagccatgttcctgaacgtatctggacagcgtctcagtagacagggcttctggaaaatgattaagaagtacggccaggaagcaggcataagcgaggatatcacgccccacacgctgcggcattcctttgcggtacatatgctggagggcggagcggacttacgctctgtacaggaaatgctgggtcatgctgatctgtcaacgacgcaggtatatgcgcagacggcaagacggaatatgaaggaagtatatgaaaagcatcacccgcacggcggcaaccgcacttctcatgaaagcaaagatcgaacgtaacgatactttactttcatagaaaatgtgattatgactataactttacgattgtacaagtcaggagagatattaatgtcaacagccaaccaagctacaattcaggaagcagcagaatatatccgtgccaaaagcggaatacgtccagagattggtcttattctgggatcgggtctcggtattctggccgatttaattcaggatggaattagtattccttatcaggatattccccattttcctgtatcgaccgtagaaggtcatgagggagaattactgttaggcacgattgaaggtcgcgctgtcgtcatgatgaaagggcgcttccatatgtatgagggctatggcccacaactgacggctttcccagttcgggtgatgaagcaattggggattcaaagtctgctggtgacgaatgcagcaggtggtgtaaatacttcctacgaagcaggcgatctgatggtcatctcggatcatcttaatctgacaggacaaaatccgctgatcggaccgaacgatgccggtctgggcgttcgttttccagacatgtcggaggcgtacagccgccgcttgcgtgaaattgccaagcaaacggctaaccaacagggcttcagcctgcaagaaggtgtatatgctggattgctgggccctaactatgaaacgcctgctgaaatcgttatgctgcgtacactgggcgcagatgcggtgggtatgtcgaccgtatctgaggttattgtagcccgtcatgcaggtattgaggtactgggcttctcctgtatcacgaatatggctgcaggcattctggatcaacctttgtcccatggtgaagtgatggagacggcagagaaggtacgtgagcaatttttgaaacttgtgctagcgattattccacaaatgtagattggggatcatgttcaaccgaagcggtggacatatatcccaagaaccccgtatccgaacgccttttgttggcgtgggtacggggttctttttcacatacagcggttgagctgagtatgatctcctaatgaagaggctgtgtgctcaatgcagttgaattcgctttttctgctacagccagtttatgtcgttcttgcaccttgatcacaataaccataaaaataatccagtaaatagatagcgagttcaggaaacggctgtccgttatattattcaatacgataaaaaggaaaaaaaccgctgccgttagccatgtatacatatctgctttaccaattctgaatttaaataaagtggttatggcgagtgtaatggttgccagtagtcctgtaaggcccacatcgatccacagatctcggaaaccgctatggctgcttgtcagatcaaatcgaattccattcgcatagatactgggccgggctgcccagtaggagccgtaaccatgtccgaaccagtaatggctctgaatagcaccaccaatcccctgccagatttccgttcttccagttaaggtcgttgtttttccaaattccgacgcaatcgcatctccataagtaaagatgaataccaaacccaaaagaacgaacaagcaggaacagctaatgaagaaaccgcgtaatgcaatgcttcggattctcttgaatagcaatataaacaatataaatacgaagagcgaagatgtcagcaccaaagaggtggtagattggcactcgatgagcaataaggcattgagtaagatgaagccaatatgcaaaactttatgtttacccctgaaaaagtaaataacatgtgaaacaaaacttaacagagagagagttccaagtgtatttttatgaccagagatgcccttccatagcccagtatgttctacgccaccatgaatagcaaaggagggaacgagcaaaacggcgagtagattgagtatgctcaaaatacttaacgtaacgactaagaggcgaatgcagccctgtgttgtataatgggtgaccaaatagagcccaaaggtagagaaggcaagaaatttgagaaccatcagcaaggaagaggtctgctcttgttcagcccataaacaggaggcagcgatgtacagcatgagtaaagtcagcaacggattgtcgactaaggttgcgatcaatgacttgagtgaaggtagtagcatggtatagctgaacaacagaataagcagggaaatcgtgataactctgggggacaaaccctgacaagcataaggaatcgaaaaagccagtaaaccagctacggtaagtacatgtttcacgatttcaccacctagatacattatgtatctataatatacaaaacgtatcttcttgtacaataataataaaatatttattttcatttttctcaagcctagagcaagccctattgtgcatatactcagtccatgctaagaaaatgaagaattcttcggcttggttaaaaaggaactttttacgtttttaaacatgggggtgttcgggtggcgaatcattttacagaccgtttgaagttgaatttgagtggtacaggcaaagacttaacgccgcagcaattaaatgaaaattttaaaaccattgaaaaagaattcattgaacgcagtgcaaacgtaagttggtttggagctgctggtgatggtattcaggatgacacggcagctttgcaggagttgattaataagacccccgattattccattcttcacatccccagtggacgatacaaaataacctctaccctacagatccgcaagcagggtgtgcgcatttttggcattcataagggcagataccgacaaggcaaaggtgttacgtcgattgaattttatggtacgggtccttgttttcaaattggagatgaaagtctaccatcgtttagcggatttcaaaatgtgcagtttcatgacttatcgatccggtacgagggggctgagagatccacattaaataatccgttttcgcagtcagtgaagcgtggatattatggcaaaggtactttaggtattcaggattggaagggcggtggagttgccctagataacgtcctaattgagcattttgaaacggctttttggggctacgaaagtgatgtgaatttatttaaatgcacggagattaattacaataaaacagggattcacttacagaatagaagttcacagtttactagcatagcgctttttacattggggaacgatacggcattggatctgaacagctccaacggagccagatttttggctagccagcacattaaggatgggagttccaatgatattcccattctaattaatgattttatgaacgctgaatttataggttgctggtttgagggactaagcagagagcataagatgacagtgccttcttttattcagattggtgctaccaaagaaacgaaaaatgtggccttgcgtgactccattttagcgatagcggacaaattcgatgacacccaatccgtatgtaactattttgtggatgtggtcattggcaaaaaagttttggtggacgaggtgggagggtatccccgtaatctaaagcagcttatttctttctctggtagctcttccacacagcaggtgacacttcgctcacatttggattttagctatagcaataatcgttatgacgagaacaatgggacagggcaggctttgctgctagtcgagaaatactcgaacaacgggattgaacatttggacgaaacctttgttaaagcctacttgggagcaaggcaaaatctccccgcaggtagctggcagaaggtaaagttcaatcaaatcaaccatgatgagctgatcgaattcgacgcggcgaatagccgatggcgagccaagcgagctgggaaatacagaatacaagtttacatttcgaccgaccctcaagtggatggtaatcgcacacggctggcacttcacctgaatgatgagcagcttgccgggagttccgcctatgcctatctcgatgatagggttatcggcggactgaactatagtgcattgagtggagctatggaacttagactggaagcgaattcttttattgatatacgggtgtttagtcaaaatacaatggatattttaccgggtggcggtatcacatatctcaccgtaagccgaatttaaaccattatttcacagacgatagatgttctgtcgttttatatattggaaaatgcgcaccatgctgactcagcttggtgctatttgatgtttttgtccatatggaatatttttctttcattctgacgacaatggttagcagcacgcgaataggccggagggttaagtaaatgggctccggtgctttacgccaatatgttgaggagggaaccgattgtgaagaaaaaagtggtggcgttcatcctggcttgcctggtagccttgactgccgtccctgtcggcggttgggccgaagaaagcatacctgaaagcaaaaccaaagagggatcagcggctgagctagctccccaggctctctcggcgatcctgatggatgcagatacgggcacagtcatctatgaaaaaaacagtcgtgaaaagcttcctccagcgagcatcaccaagattatgacgatgttgctgaccatggaggccattcaggatggcaagcttaagctgaccgataaagttcgtgccagcgaatatgcatcttcaatggggggctcgcaaattttcttggagccgggagaagaaatgacggtcgatgagatgctgaagggaatcgcgatggcttccggcaatgacgcttctgtggcgatggctgagaaaattgcagggtctgagcaggcttttgtcgacatgatgaacgccaaggtgcagcagctcgggctcaaggatacccattttgccaattgcaacggtttgcctgtcgagaatcactattcttctgcgcatgatattgcggttatgagccgggagttgttgaaatacccgcaaattacgaaatatacgggtgcctatcaggactatttgcgcaaatcctcggtaaaacccttttggctggtaaatacgaataagcttgtccgtttctatactggagcagacgggctgaaaacaggctatacgggagaagcaaagttctgtctttccgctactgcgaagcgtgatggcttgcgtgtcgtagctgttgtgcttggggagccgaatacaaagatacgcaacaatgaagtatcttctatgttcgactatgcgttttctcaatatacaatgaaatccatatacaagccgggtgaattgctgggtagtgtaaaagttgaaaaaggcgtattgccagagctgaaaattcaggctgagcgtttttacagcgtgttggtgaaaaaaggtggcaacaaacaaacgttgcgtcatgaattacaactgtccccaagcctcaaagctcctgtccgggctggtgacccagtcggtaagctggtcgtctatcaggatggacaacgtcttaaggagtttaatatcacttcgcctgtggctatcgaaaaggccggatggtggaaattgtttaaacgtaccatgtcgaacctattttctttgtagattttacggggttttcttctagttttgtcggagggcaggaatcgtctgcggctacgtagaaatccttgtccaagaccgggaggagagtgagtaagcatgaacctgcaaattgaaatggagcatcaccggggggtactgattgtaaggctgtctggtgagcttgatcaccatacgtcggacatggtccgtatgcaaatggatgaggcgattcagcgtcggcaatgcgagcatattgtgctcagcctgaagaatcttcagtttatggatagctccggccttggcgttatcttgggacggtacaaactgatcaagcaaaagggcgggaaaatggcagtctgtgatgtcaatccgccagtacaccgactgctggatatgtcagggctgttcaaaatcatgcccatatatgacaacgagggaaatgcgctcacggaactggaggtagtgtcatgagagaaggcacgggtaacaatttcatgagcttgcagtttgctgccaaatcggagaatgaagcatttgctcgtgtggctgtcgcggcatttatttctaggcttgatcccacaatggatgagctaagtgatttgaaaactgtggtgtctgaagcggtgacaaacagcattattcacggttatgacagcgacccgtcaggtgtcgtaacgatcaaagtcaggattgaagcggacgtgattacgttggttgttgaggacgcaggccgaggaattgaggatctggaacttgccaagcaacctctatatacgtccaaacctgaattggaacgctccggcatgggctttacgattatggaaaatttcatggatgagtttgaagcagtcagtgagccgggcggaggcacgtcggtccggatgaagaaaaggattgaatccaagaaagctttatacaattaggagttgatcctatggaagcaggaggaaaaaaaacttcgcacagctatttggaggatgcggaagtcaaacggcttattgcactgagtcaatccggtgataatgaggctcgtgagacactggtcaatagtaatatccggctcgtctggtctgtcgtgcagcgctttatgaaccgggggtatgaacctgacgatctttttcaaattggttgcatcggcttgttaaaatcggtggataaattcgatctcagctacgaagtcaaattttcaacatatgcagtaccgatgattatcggtgagattcaacggttcctgcgtgatgacggtacactcaaagttagccgttccttgaaggaaacggccaataaggtccgcaaaatgaaagacgagctatccaaacggctcaaccgtctgcctacagtcaaggaagttgctgatgagctgggagtgacaccggaggatgttgtttttgcgcaggaggccaataagccgcctacttccattcacgaaacggtgttcgaaaatgacggtgatccgattacacttatggatcagattgctgacgaatcacaggaaaggtggttcgacaagctggcactcaatgaagccattggcggactatctgagcgggaacggttgattgtgtacctgcgctattaccgggatcagactcaatcagaggttgcaagtcggcttggtatttctcaggtacaggtatcacggctggaaaaaaagattttacaactgatccgcgatcagattgcccaataataacagtcaggatcttagtgaaatccttatgcttacgtatttaaaaagggtattccaaagccattttaatggccaggggtactcttttttgcgtggggtaaaagacaatacacagaataggtttcctctcttcgttccatactaatcgataattacgaggataaggaggggatcggatgactcatagtccggctcctacagtagctcctattgtctacttgaggctccgcagccgtgtccgtatgatacaagggcaggatttacatttgggtgatgtagcccatctgctgactaatcctgaatgggaaaaggatctgcttgagcttgttctcaagcgcccgcagcaccaggacggtaatctgatactgatagacatgctgcagatcatagcaaaaattagagatcatattccgggggtcatagttgaatctctcgggaagccgcatgtacttgtggaactcgtggagaaaccccgtaagccgtccaaaatactgtttgttttggtatgggtgcttctgttttttggctctgcgctgacaattatgaattttcatgccgacgttagcatgatggaggtacaggttcggattgtggagatgattacgggacataaagatgaacatccgtacctgtttcaaattgcttactcgatcggcatcggctttggcatgatcgttttttttaatcacttgttcaagaaaaattggaacgaggagccgacgccgctggaggtggaaatgtatctgtaccaggaaaatgtggatcagtatgttgtggcagaggagtatgaaaagatggcccgtttgcacacaaaggataagaaaccatgatatttgtacaggctgcacttcagattatcttaggtattgctgggggccttgcggtgggtagcggtgtaattgctttttttattgtgctcgatatcatgccgcgattagcacaactcacccgtacgtataaaaaatcacgtgcatacgaaaaggcaatgattataggttcagtgctggggactgtggtcgatttttggaacatctgcttgccactaccgggcatatttacatggatacctgggttgttttgcggagtgtttattggtttgctcgccgcggctttaacggaggtattgaatctcctgcctatactcgccaagcgactccacatgaccgtgtatatgttcggcctattaatggcaatggtgcttggcaaggtgacgggttccttatttgactggtttgtatacaaccgttaacaacgaaagcgaagggggcaaggaatatggatcgcagagcggatcaagagcatcaggagcaacatcaagaagacaggggaatcggaaaggaatatcatactgacggagaagagttgagtccatggaaggaaaagcaggcgcaggaatctgcgcgttttaaacacaaaaaagagagtgagcggtctgataacgtagaggagtccgttcgctactggcaggccgaagatgatatatcgccgagaatgaaggataataagaatacacttgaaacagtattaggcttgggggagacctttgatgttgtattcagggaaatgacactgggtgggcgtcataccggatatctgttcctaaatacctttgcgaaagatcagatcatgcttgaagtgctaaagcgtctcacctatctgacgccggataatctctcttcggatggactacaagcgtatttcgaaaattttattccacatattcaggtggagaagacagataagatgtctgtcgtcattaacaaggtgctgacaggaatgagtgcctttttcatggaaggcgaacgtttttcccttattctggatactcgtaattatccggtgcgtagtccggaggaaccttctttggagcgggttgtgcgcggtgcccgcgacgggtttactgaaacaatgcttacaaatgtaagtctggtgcgccgacgtttgcgggacccaggacttaaatttgaggctatgcaggtcggacgccgaacccgaacagacgtatgtttgggctacattgacgatattgtggataaggtgatggtggatactgtacgagacaaaattaaaaatgttaatttggatggtattcctctggccgataagcaattagaggagacgattatcaataaaggttggaatccatatccattagtacgatattcggagcgaccagatgtcgtggcttcgcatattatggaaggaaggctcgttattttcgtcgatacctcacccagcgtgatgatcttgcctaccactttttttgacttgtgtcagcatgcagaagaaaatcggcaaaccgcttttatgggaagttatttgcgctgggtacgttttttaggcatatttgcctcgatgtttctgcttcccatgtggctgctaatggtcatcaatcccgaattaaaaccggcgtttctcgattttatcggtcctcaaaaggaagcacatcttccgctgattgcacagtttatcatcgtggaactaggggtcgatctcatgcgaatggcggctgtgcatactccgacaccactggcttccgctatgggcttgatcgcagctattctggtcggtgacatagcggttcagacgggacttttcgtgaatgaggtcgtgctgtatatggctgtcgctgccataggaatgttcgcaacgccgagctatgagctagggctggcgaatagactgattcgactattcctgctggttgctgttgcgatttttcatgtacctggctttgtcgtgggtacgacactgatcattttgatgctgacgctgcatcggtcatataattcttcgtatttgtggccgttcattccttttaacgccaaagcgttagcttccatcttgttccgtatgcctgtactagatgcgcctaaccgcccgtcatttaacaaaactagggacaatacgcgtatgccccatacggatgccgacacagattcgaactcaggcaatggacaggagcattaatataaatgatctgcataaaaatccattgttcttgatgttttttttgctatactggtgtaaacattcgatggaatatgactagcttgttccagaaagagaggcgccagaacatgtatttgcatggaagcagtaaaattaacagcaatggacatttggaaatcggcggttgtgatacaacacttttgaaagagcgttttggcacaccactatatattgttgacgaacagttagtccgccggcgctgccgggagtatatagaagcttttcgtgaaaccggattgaagtttcaagtcgcttatgcaagcaaagcgttttgtgttatggcgatgtgcgctttagctgctgaagaagggatgtcgcttgacgtagtttccagtggagaattgtttactgcgctacaagcagggtttccggcagagcgaatccatttccacggcaataacaaaacaccggaagaaattgaaatggcgttagatgcgcaaattggctgcttcgtcgtcgatagcgaaatggagttgcatttgttgcaggcccttgcctccgataaagaacagcaggtgaatatcttactgcgggttacaccaggggttgaggcgcatacgcatgaatatatggccacaggtcaagaagattcgaaatttggctttgacattggaaacggtacagcacgccaagcagtggaacaggctatcaagctagaccatcttaacctgctgggggtacattctcatatcggttcgcaaatattcgaagtgaatggcttccaaatggctgctgaacgggttgcagctttttccagagaaattaaggaacagcttcagttttctttcaaagtgattaatctgggtgggggatttggcattcgctacacagaagaggacacaccactgaaagtatcaacctatgtacaggctatcggcgaagcggtgaaaacttatttttcaggactttacgatgaacttccagaaatttggattgagccgggacgcagtattgtaggcgattcaggcacgaccttatatacggtaggaagcatcaaggatattccgcaggtacgtaaatatgtctcggtagatggcgggatgacagataatccacgccctgcactgtatcaggccaagtatgaagcgatgctggctaaccgagcgcaggatacgaacgaagagacggtgtccattgcgggcaaatgctgtgaaagcggcgatatgctgatttgggatgtagagctgcctcgtataaatagcggcgatttgctcgctgttgcctcaaccggagcctacaattactccatggcgagtaattataaccgaatacgtcgaccagcagttgtatttgtcagcaacggtgaggccgagttggtagtgcgtcgggaaacctacgaagatatcgtacgcaacgatgttgtgccacagcgcttgattcgtgatcaagctagtccagtggttcagcccaacgccaagattaccgtttcgtcctgattttagaattgtaagatcaagcaggccattgagtcggtaataatacaccggggacaatggctctttttttggacaagactttgctaagcgcggcaattcatagtaaactggaacttgatgttatttagttctcaaaacaggttgaaaaggagatacaaacaatgaaaaaaggtagaatagatcttgaaaacggcggtatcgttgaaattgactttttcccagaagaagctccaaacaccgttgctaactttgaaaagctggcaaacagcggttactacaacggtttgagcttccaccgtgtcattccgggctttgttgctcaaggtggttgtccaatcggtaacggtacaggcggtcctggttacacgattgactgtgaaacagctacgaatacaacaaagcatgccaaaggcgttctgtccatggctcatgcaggtcgcaacacaggtggcagccaattttttatctgctacgctccacaaccacatttagatggagtacatactgtatttggtaaggtaaccaaaggtatggaattcattgatgctgtaaaacaaggcgacaaaatgaaagaggttaaagtatttgacgtgtaattttaccgttaattacatgatctttttcaaatagtgttgcacctaagccgttctgtctttggacagggcggcttttgttgtcttttgtttgacggtttattgattttcgcaatcacgtaggcattacagtgcgtaagatcacattcgaaaagtaagtgttgtgatagcctttcgataagaatgcattttccatttattttatatgagtattcaaactcagtaaggattggaaaagaagggggcttatcacattgtctattttaacgcgcacaaatcgactcggattttttgagatccggctggaatccattggtggactcggcgctaatctggctggcaaaatgttggccgaaaccggggtgcttggtctggggctgaatgcttcaaatttttcgtcctacggttcggaaaaaaagggaactccggttaaaagcttcgtccgcttctgtgagccggaggtcgatattcgggatcacagtccgattgagcaaccgcatgtggtaggcattttccatgaaacgttatacaaaacggtaaatgtaatcagcggactgccagcggatgggattgtagtggttaattccacgcgtccagcagaagaaatacgggctgatttgggactggtatccggtacattggcggtggtggatgcgatgggtatcgcactggaagagcgaaccaaactaaatacgtccatgctcggtgccttgttccgtgtctgtgatttcctggacccggaagcgatgagatcggttatacgcagtacctttgaaaagaaaaatccgctgttagtggaacctaatctccgtacatttaaccgtggttatgaggaaatggaactgcacgtatatccagttactgatgacgcagaggatcgggtttttgaacgtccgcagccattgatgggatacgaaacgcaactactggggggcgttattgcaactcagggaaacagcatgacgagagatgttagtggttcacgtcaagggtatgtacctgaatatgaagctgataaatgtacccattgtgccaagtgtgattcgatttgcccggattactgttttgtatgggaagagcaagctgacaaacgcggaagaatgatgccatttttgcaagggattgattaccagtattgcaaaggatgtctgaaatgtgtagatatttgcccatcgggggcattaagctcgcgtcgggagcaatggggatgggcggaacagaatcgagttgcccaccaatttccggtatatgaaggaggacgtgcgtaatggcaaaactggaggaagaactcaaacagacaggcgccgcgcaagtgacaacgttcgaatccggtaatgaaatggcagctacggcggctgcgcagattaattatcatatgatgggatatttcccgattactccatctactgaggtagcgcagtatttggatcagatgagaacgagaggtcagcataatattaagctggttgcagcagacggagaacacggatcggcagggatttgttatggagctgccgcagcgggagcgagggttgtgaacgccactagttcgcaaggtttcctgtacatgctggagcagttacctgttcagtcaggtacccgttttccaatggttatgaatctggtgacacgagctgtcagtggtcccctggatattcgcggggatcattcggatctgtactatggtttgaatacaggctgggtcatcttgacggcaagtacaccacaggcagtgtatgatatgaacatcatggcactaaaaatcgcagagcatagcgatgttcggctacctgtaatggttgcatatgacggtttttatacgtcccatcaaaaacgtaaagtgcaatattttgcagatgctgagaccgtgcgcggttttgtaggtcctaacccgaacttaaattatccgaatattactgattttgatcatcctgttaccgtaggtgcgcatatgaatggtgatgacctgacgaataatcatgttcagctgtccgaagcactgaagctgtcagaaggagtatatgagcaggtagcagcagaatatgccgctttatccggtcgggaatacccgattttagatctgtatcaaatggaggatgctgaggtcgcggtattcctgttgaattcggcggctgaatcggctaaggatgtggtggatcaactccgtgcgcgcgggattaaagctggtgtgatacgtccgaatatcatccgaccgttcccagccgcacaactgcgggaagccttacgtgatgtcaaggcgctgctggtaggtgaacgtgcagactcgtatggggcagacggcgggaatttaacgcatgaaattaaggcggccttgcaggaggacccactgaatcggacactcgtgttgagccgtatctttggcttgggcggcaaggatttttatgcggaagatgcagaggcgttcttccagcttgcgattgaggcggcagaggccggacgagcggagaagccctttgattattacggaattaatccgggttcaccggacaaggtgatgccgcaagttatgcagccgccacgtggcaatgcataccgtacgggcctgattcaggttacgccagacgaggcgaccgggaagctcaaagtcaaggtaccacccctgcggtcgttgacaaccaaaccacgccgtcttacaccaggtcacggggcttgcccaggatgtggggcattatctgcgctggaactgtttttcaaaggtattgaaggggatattgtcgttctgttccagacaggctgcgtatatgtgacgacgacagggtatccatatacatcacacaaacaaccgatgatccacaatctttttcaaaacggggccgctacactttcaggagcgctggaagcttatatggaaatgaagcgccgtaatgaaattgaaatgtcggacgatccgacctttatcatgatcagtggtgacggtgggatggatataggtatgggttctgcgattggtgcggctctgcgtaatcataagctgattatgttggaatatgataacgaagggtacatgaatacaggttcacagcaatcatactccactccggttggtcacatgaccagtacgtcgggtgtagggaaaatgcaaaaaggaaagcaaggacatcacaaggataccgtgcaaatcatggctgcttgtaacattccgtatgcttttacagcagctgaaagtcatccgcaggatatgctgcgcaaagcagccaaggctcaatggtatgcgaacaacgtgggtacggcttatggtaagatcctgtgcgcctgcccgctgaattggaaatccgaagatagactgggcaccagcattgtgggcgctgcagtcgagtcttgtttctttcctttgtacgaaatagagcaaggcagtacgacgattacgtacaatccggaagacaagggaaaacggattccagctgctgaatggttgaaattaatgggtaaaacgaagcatcttcttaaggaggaggctacgttggctacctttgagcaggagattgagcgtcgctggactatcctgaaaaagaaacatgaaatttcagagctataattacgttttttgcataatcatcgattaacattgttatccgctgttactgtagtggttcaatcaagattctttgcgtttattgcgcaaagaatcttttttgtcgtttatgggttgaagcataaaaaaacaggtaatgatttccgatataggagtggaggcctataagaggcacgttaaaaagttttcttctgaattttaagatgcaatgaggtgcaggtaatgattaagctgaatacagttgaaataatcgaaattataaagaagcagatccctaaggttatgaacatcaagccagtggagctaaagtttacggatgattttggacgggcttcgttggcagcgacagaacacaaattcacgctgacgaaccagcattattctgccaaggtgatggattgcgtgttagaaacacaggtacgccccattttaatgtgcgaaattatttattttctgaaatgcgagtttattgacggacatgttgatgtgcgactggattatgaagcatgttctgaggaaggacggggaccggttgcttcagccgtaattacctttgatcatgcaacagagttgggagtcgaggaactggccgatctgattgacttggcgcttcatatgaatgataaaacctggtttgaagaactctccagccaatatgtcaaaaccaaagcaggagcttctattagataacttgctttttttagaagtcggtgctaatatacgtaacaagtttaatgttaattcaattaaataagagcaagatccttcggggcggggcgaaattccccaccggcggtgatgacatgtttgtggatcgtttttgtgagaaacagcatggcttagtccgtgacccggatgctgaatgatcggcagaaggtggacctggtgcaaatccgggaccgacagtatagtctggatgggagaaggatacgaagcgcatgtgcatgacgtgacatgtgccgatttttagcatacccaattgtgcgtacggcttatttcgttgtaggacagcatcgggcgatagcttgcttaagctttctttttgatgatgttcagagcgtatttggttgtatcctcagtcatgctttctattggcaaatctatgatttcatgtcgtcttaagatgcatatgaactgcgcttgtatactacaaatgtgactctcatcacccccatgacggattgaatccgaactgggggttttttgcgcttatagctgatgaattagggataaactgaaatgtagtggaaaggagtgaaggcatgtttaccggattggtcgaggaagtgggtcgcattcaaacgatttccaaaagcggtgaagcgatggtgctggggatttcgggttccgtggtgttgggcgatttgaaaataggagacagtgtctcagtgaatggcgtttgcctgacggcgatacagatcggtacgaaagactttaaggttgatgtgatgccggaaacctttcgcagcagtaatctgaaagagttgagatcaggcagccgagtcaacctggagcgagcgatggcggcgagcggaaggttcggaggacatatcgtgcaaggacatgtggacgggacgggaacgattcgcggggtaacatcagatcagaatgcagttgtgttcgaaattgagcctaaaaatcaaacattatttaaatatattcttctcaaagggtcaatcacaattgatggtatcagcctcacagtcgcacagcgtacgagagatacctttgccgtatccattattccccacaccttatccgaaacggccttacaagccaaacgtgagggagataccgtcaatatcgaatgcgatattttgggcaaatatgtagaacagcttttaaattacagaggtgcagcggaggcggagagggtagaagaagctcctctcagtttggactatttggcgaaacacggctttgcctgatattgaagggtaagcctgtttaggagcattcgtggcacaagacataaggaggaaagtgttatggatagagatagccaaacaagtgcaatggcaaacgtcatagagcatggcgagttggaacatgacgaagagattcgtttggattccatcgaagcagcgttggaggacttgaaaaacggtaaagttgttattgtagtggatgatgaacagcgcgaaaatgaaggcgattttatcgctttggctgaaaaagcgtcgcctgaggtcattaatttcatgattacagaaggtcgcgggttggtctgtgtgccaatcacacgacaaagagccgaggccttggaattgcatcctatggtagagcaaaatacagatttccacggtactgcctttacggtatcggtagatcatatggagacaacaacgggtatttcagcggccgagcgctccttgactgtacgcgccttggcagacgaagcagtcacaggcagtgatttccgcaagcctggtcacatgttcccgctgattgctcgcgatggtggtgtcttgcagcgtgcgggtcacactgaagcggctgttgatctggcccgactcagtggcttcaagcctgctggggtcatttgcgaaattataaaggaagatggctcaatggcccgcctgcctgatctggcagtggtcgccaagcgacatcaattaaagctgatcagtattcagcatttggtggactaccgtcgtcgtttatcattgtaaaaatacatctcggttccaagtaaatctgaagtattgtccgaagtccctaaataattaaactaagagaggttgattaaacatggcacgttttctagaaggtaatctcgtatcgaacggtttaaaatatggtattgtggtaggcagatttaatgagtttattacgagcaagctgttaagcggcgcaattgacgcacttcaacgacatggtgcacaggaagatgaaattgatgtagcctgggttccgggtgcatttgaaatttcactgattgcacaaaaaatggctgcaagcggcaaatatgatgccgtaattacgctgggtacggtcatccgtggttctacttcacattatgatatcgtctgcaatgaagtggccaagggtgtggccgcgagcagtctgaaaacgggagtgcccgttatttttggtgtagtgactacagaaaacattgaacaggctattgaacgagcaggtacgaaggctggtaataaaggttgggattctgcattggctgcgattgaaatggccaatctcggcaagcaattttaatgataggaatagctgaatagaacgctataaactgcaaggtgaaaaagggattggattgttaagcaaggcgatgacgtatatactacagaaagagggattgataacgtagagcataagtgctatagggaaaggtattgttgaatgatgattggagtaaggcagggggaagcacattgacagtcgtaaattacaagctggaaacattcgagggtccgctggatctactgttgcatctgattgataaagccgagatcgacattcaggatatcccgattagcgatattactgatcagtatatggcttttttgcacagtatgcaggagctggaactggacattacgagcgagtttctggtgatggcggcgacgctcttatctattaagagtaaattgttgcttcccaagccacctgtgatggaatatgacgatttggatttttatgaggaagaggattatgatccacgtgaggaactggtccgcaagctggtggagtatcgtaaatataaggggattgctcgccatctaagtgaacgtgagtgggagcggagtctaatttatggcaaggagccagaagatctaagcgcattcctgcctactgaacccgtaaatccggtgcatgggctgcatgcaagcgatttggtcgcggcctttcagcgtgctttgcgcaaagcagaacgacgtacgacggtaactcgtgttcatcgggacgaaatttcagtcaaggaccgtatccggcaagttatcggagctttagagatggtggggaatggaggacggctactgttctctaagctgatgcatgaggatatgtatcggcatgaagtggttgtgacctttttggctatccttgaactgatgaaaatgaaacaaattttctgttatcaggagaagcttttcgatgatattgtaatggagtggagaggggatttacgggttaatggattatctgaagctgaaatcaattattgagggactgctgtttctcgcaggagaggaggggttgtccaccaagcagatcgccgacattgtagagcagcagcaagagctggttgaacagtgcctggaagatatgaagcaggacatggagcagggaggaagaggcctgcaacttgtccgtattgccggtcattatcagcttgcaactttatccgaacatgcaccttactttgaaaagctcgcatattctccggcacgtgcctcactgtctcaagctgctttggagacgctggccattgtggcctaccgccagcccattacaagagttgaaatcgaagagattcggggtgtcaaatccgagcgggccatacatacactggtcaacaaggagctcattgaagagaaaggtcgagctgaagccatcggacggccaatattgtacggaacgacgaaatcatttttggattatttcggtctgggctctttggcagatctaccacaaccggagttgttcgaagattcggacaatttggaggaagagactcaattattgttcgagcgtctggagagcagccagcctgcagccaacgatctggatcttgaatcccaataaagttcatccggatcttgcggctcacttatgtaaaatttcaaatatacagccagtcctcaagtagttagaggctggctgttggtattttaagatgcatgattttccggcgaacggtcatactatttttgccatgatatttatagcaaaaaggtagggaggactcgccagtgtggaaatggatcagtatcgccatcatcgtcgttatattacttgtgctggctattctgctctctcgtattcgattgaagctggatattgccaaacatgacaatgatgatcgggcgcatctagagatcagatttctatacgggatgattaaaataaattacgatgttccggccattctcataacaggtttgaaaaaagggcttctctatcggcttgatcgcaacaaaaacatacataaaacggatgcttccgtggatagcggtaatattgatacagaaaaaatcaagcaatttatatatgatatacgggttttgctcaagggaacgaaatccttcaatcgatggttgcgacatacattggcacatgtgacgatgtccaaaatggagtggtccaccaacattagtcttgctgacgcggcttatacagctacctcaaccggtattttgtggggattaaaaacgaccttgatcggttttgcttccagctttgtgcgcatggattgtacccctaagctgtatgttgtgccgtattgggtggatcgcttgcgttttaccaccactttgaactgtgaagcaaacgtatcgctcggctatttaattttctccatgctcatcttatcttaccgcatatggcgcgttccgggtggacccgaggcatggaagcgggtttttttcaaaaaaaatgaagatcttcaagctagcaatgaaagataaacattgaaatgtggtgaaacttaatctttctgaactttgggatttcagtgtcctccagattaaggcataaccgaatcggatgacatacatatttccttgaacccctgcgcacaatagcgaaagaaaaggcaatctacgcttgagataagcaaaggaggaattaatcatgtcagatcacccgattcaagggctcatgcaaaccgcaatggaaaacatcaaagccatggtagacgtgaatacgattgtgggagacgcggtggaaacacccgatggttccgttattttgccaatcagtaaggtaggatttggtttcgctgccgggggaagtgattttaacgtagacgaagaagcacttcatacttcctcggcttcgggtaatcatagcgggaaggaaggtcatccttttggtggcggtagcggtggtggtgtatctattcatcccattgcttttctggttgttggcaaacagggggcacaaatcgttccattggacaatcaaacgcatctgattgagaaactcattgactccaccccatacctgattgataaggttcagtctatcttccggaatgcaggcggcaatgtgcagactccacccccacaggtacctgtagatattaatattgatcaaagtaattctggcccggcttacttgtaaaagtcattggaaatgaaaagcgttctctcaggaaggtatcccaaagccgaatataggctaaggaataccttcttttctgcttacacttggccctatctccgaatatactgccttcccccaatgacagcatgtatacggtgactgtattcctgatggtacaaagtatgcagcgataattcattttttcgatttccttcggtagcgaactgcgataagtagatgaagtccggataaaccacttcattcgtcaaataagcagataccgtggcttccggccgacgatgttgattcagggaatcgataatacccttcgccggcaagatgccaatcccatgtccataaaacaagtcttccttcagcttaacgacattttctcctttccattccaatgtatcagatgacacatccggattgttgaaatacagaatatcgccaggagctgctttatgactcccttgctgctgtatgagcctgaggtcactgtcatagtgccagtcatacagcagcatatctgcaaaaatccgattaaactcactttccagaatggaatccagcactcctttgtacagcacaataaccatagctgttgcacattcaaaagcgtattgatgaccgtttaaaaaaatgtctgcgatcccctctgccggagtgacacctgctttaatctgaaaaccacccttttccgttaaatcccaaaattgctggttgcaacgtgcggtagcaaaagtggcaaaggatacaccgcttcgatgcaatgcttctgcggactctacaatccgcgatcttaaaatcatttcaaactggagacgcagcatgatgtaacccccgatccatatttaactttggtaactaatatatatgtactcgggagggcaagttgcttggtttatgcagaaagaaagcaaaaagagagcagctaatggctgttccgtaaaggaattttctgttataaaggtggacatactttgaacagcttggacatagaatggtacaagacttgctcaaaaccggaggaatccaaatgtttaaaaaaaagcaacacattcacgcggaccacagccatttcttgaataaggcacgcgcatttgttttgccgctggtggttctgcttattttgtcattgccgcttacgttgctgagtccacagcccgttcggggagcgataaaaacagaagtagcgccgcccgcaataggaacccatgcacaggctgcttctttaattgatgtcacatcaggaagaatcatttattctaccgagggtgaccgggagctacgtattgccagcctgaccaagattatgactgcaatcgtggccattgaacatggacgcttgcaggaccgggtaaaggtgagtccaaccgcgtatgccaaagaagggtcctcgctttttctgcaaatgggtgaacaaatgtcgctggaaaatatgctgtacggcttaatgctccgttctggtaatgatgccgcttctgccattgctgagcatgtgggggggacggaagagggatttgtccatttgatgaatgacaaggcggttcagcttgggctaagccacacacattttgctaatcctcacgggctggatgccgagggacattattcctcagccaatgatatggcccggcttactgcttatgcgctgcataatccaacttttgcccgtatcgtaaaaacagaactgaaaaaagcaccgaatcccaacgattcttgggactactcatggcacaacaaaaacaaaatgctgcggctgtatgagggagctgacggagtgaaaacaggttttaccaaaaaagcgtttcgctgtctggttagctctgccacacgggacggccgccagctcgctgccgttaccttgaatgacggggacgattggaacgatcatgcacgtatgcttgattacggattccgatattatccgctcattccgattacggacaagcagcaacctatcgatggttacccactattaacaggtacaagctttgcctatcctttacatgaaggtgagaagacccagttgcacaaaaggctggtgttgtataaaaattctgcttctgcagacagagcggacgtatcttttggcttacgagggcgtgtcgaattcctattggaaggtaaacttatcggttctgttcctgtgtatgaaaaaggtagtaagctgcctactcaaagtaccgtacagccacagcaagaggctccaactgcacaagatcctgcaaacaatactcagcaacaaggttggacgagcaaatggaacgaaatcctaaaaaatttgtttggagcctagggcaaacgggaaattagagctgggacgtgtcacatcattgggaaaaggaggaatcagccatgattcatctcatatgggtggctttgatttgtattggatttgtatttgctgccgcgcagggaaatattgaggtggtgacgaaagcagcttttgacggggcaactacgggggttacagtgtgctttggactgataagtgtgctggtgttttggatgggcatgatgaggctggctgaagatggtgggctcttacagaaaatatccaagctgctttctcctttggttgcctttctcttccctgatgttccgcgtaatcatcccgctatgggttacattttgtccaatatgagcgccaatctgctgggcctggggaatgcagccacaccgatgggaatcaaggctatgcaagagttgcagacgctcaatccagataagcaaaccgctacaccagccatgtgtacgctgctcgccctgaatacagccagtattacgcttattcctacgacgttgatcgcgatacggcttaattttcattccgcacatccggcagaaatcgtcggtacgacactggtagcgaccgcaatagccacctttgctgcaattgcggcggaccgttggtaccgtagtcgagaattgcgccgccgtcctccagcgattccgccgtcccagacatccttggcatcactcacctcatcagcaccaacatctactgcctcttcaacgacgctgtccgtatcttcacctgctgttccgcgaacgggaatcacggctgccaagggcagggacaccacttggaaaggatgagggaggcatgcttaattttataaacctcgtatcgacttgggccattccggttattctcgcttttattcctttatatgcatatgctaaaaaggtacctgtctacgattcttttgtggatggagccaaagacggcttttctaccgccatcagcattattcctcatctcgtaggcatgatggtggcgattagcatttttcgagcatccggcgctttagactatttgatctcttgggtaaccccatggattaaacactggggtgtacccggtgaggtactacctttaggcttgcttcgtccattgacgggcaccggttcacttgcgttcacgacggatctaattcgcacttatggcccggattccatgatcggtcggatcgcctcaacgattcagggcagcacagacacgacgctatatgtgctaactgtatattttggtgcggtaggtatccgcaatggacggtatgctttgaaggtaggactattttcagatgtggttggttttgtggcagccattgccatttgcctgcttgtattttaatttctgcatcgttttttgaacgggggttgtgattttgctcatggatgggtatcattagcatgaggtgaattagcgaacatggaaagattgcagaaaatattggcccaagctggtgtagcttccagacgtaaatgtgaagagcttattcaggcgggcagcgtggaagtgaacggggttgtcgtaactgaactgggaacgaaggcagaccctgatcaagatatgattacggtaaagggacgcccgatcaaaaccgagaaaaaaatctatctgatgatgaacaaacctaaaggagtcattacgagtgcttccgatccggaaggccgtaaaatcgtgtcagactatctgaaaggcgttaaggaacgcgtatatccggtagggcgtctcgattacgacaccgaaggactgctgttgcttaccaatgatggcgagttcgccaatctgctcacccatcccaagcatcatgtgcccaagacatatgtggcaactgtcaaaggcgttccgcatggtactgagctggacaagctgaaaaaaggaatcgtgctggaagatggcattactgcaccagccgaggtagaatataaagatgtagatccgaatggtaaggagtctgtgatccagattaccatttatgaaggtagaaatcgccaggtaagacggatgtttgaggccatttcacacccggtcatcagactcaagcggattgccttcggtgatcttttgctacaaaacttgaagcgcggtctgaccagacctttaaccaaggacgaaatcaaccgtctcattcaacttgccaaatcagacaacacgaaaaagaaacggacaggacgggggtcataaccccggcctttttggtgtaaagagactgttggatgagagtaaagtttgaccaagcacgggaaaatagtaaaatagagagaatggtttttttagcgaaggggctgggaatatgtcagaacaaagcaaccgcatattaattgtagatgatgaagaacgcattcgccgccttctgcggatgtatctggaaaaagaaggatatgcaattgacgaagctgaggatggtgagattgccctccaaaaagcgactgcaagcgattacagcattattttactcgatgtaatgcttccagggatggatgggattgaggtgtgtacacggctacgtcagactaaatctacacctgtaattatgctgactgccaaaggtgaggaagtgaaccgtgtacaaggctttgaagtcggagccgatgattatgtggttaagccctttagcccgcgagaagtcatttaccgggtgaaggcgattttacgccgttcgtctgaaactgcctttttaacgaaagaggcggtaccaagcaatagtattgtttttccgaatcttatcattgagcatgatgcgcaccgggtaactgcgggcgggattgaaatcagtctcacgcctaaagagtacgagctgttgcactatttggcggtgtcgccagataaagtcttctcgcgcgaagaactgctgaaagacgtttggaattacgaattttttggtgatctgcgtactgtggatacgcatgtgaaacggcttcgtgaaaagttgaataaagtatcgccagaggcagcggctatgattacgaccgtgtggggcgtaggttataagctggaggttccaaaataacgtgaacttctggagatcgctggtaggcaagctgtggatcaccatcatttgtcttgtaggctctgtgcttatttttctagggctttttttattgccgtacatcaacagaaattttgcggcgtatgaatcgacggaaattaagcatttgttcacctatacatgcattgtcggatttttattgacgaccttttttgccttattcctttttactaaaatcacacagcctatgcagctgttgattcaggcggcgaatgcgattcgtgagggaaggtatgatactcggctttcgctggtgaccagtgacgaaattggagaactggcgaaaacttttaatcatatgtctacggaactggaagcaacgatccgcagtctgaatgaggagaaaaaccatttatccagcgtactgcgaagcatgtctgatgccgtaatcaccttcgacagaagcggacaaatcatcttgacgaatccgccggcacaaagtctgttggatatctggaaaaagctggagtggcaggagcgtgatctggaggagtttggagcttctgtacctgagcctttgcagtctctgttccatactgttatggacaggggagaggatgtcggagactatatccatgtcaagaagggctcctggtcggtgcagatggcgcctctgtatacggataatgcaatccgcggtgcagtagctgtgcttagagatattacggaagaagtgaagctggagaagatgcggagcgattttgtggccaacgtatctcatgaaatccgtacacctttatctatgatgcagggctacagtgaggcgttgctggatggcatggcgggttcccctgaagaatccgaggagctggtacaggtcatccatgatgaatcattacgcatgggaaggttagtcaaggatctgcttgatctggcccgaatggaggctggtcatacagacatgcaccgacaggaagtggatgtgaatgagctgatcgagcgtgttcaccgtaaatttacggtacgttcaaaggaacagggactgacactcgattaccatgagcaaggccaacgtttactgctgcctgaggcagatgaagaccgactggagcaggtattgaccaacttgctggataatgcattcagacatacacccggcgggaaaaaggttactattgcggcggatcgaattttgggagaacggcatgagttaatccgtattcggattaaggatgaaggtgtaggcattgccagcgaggatctaccttatattttcgaccgcttctacaaggcagataaggccagagtacgtggtgaggataaagggactggtttggggcttgctattgtcaagaacattgtagaggctcacggaggctctgtctcagctgccagcgtattgggagaagggacggaatttactattttgctgccgatctccaacaaaacaaagctgggtctgtaacagaattataagccccagctgatataccccggtttgcaggcatcctcggaagagggtgctttttgttgaaaaatcaacatttatcttgttcaacgtggaacatcctgtttcatgcatgatgattgctttcatgacagataacggtataagagaaaaagacgcctgggtagccaggcgcctctctttattataaaaccatggacttctcaatattgtctggaactaatttaacactacttcttgggcagtatttagttctggcaaaccaacgagttgaatcagcacgtcttttggcacggctttatcgacggtcaggatcatgatggcttcaccgccgacaattttacgccctacttgcatggaagcgatattgacgccgttctcgccaagcaaggtgccaacacggccaataatgcctggtttatcattgtgggagatgagtaggaaatgagcttccggtgccacatctaccgggaactggttcaaccgaacaatacgttcgccatagcctgccagcagggtgccagatacacgttgttcttcgccgctctgcgtcttgagtgtaacggtaatcaggttggtaaaacccttggttgcgggcgcctgagatacgacaagatggatgtcacgtgttttggccagatgtacagagtttacaatgttcacatcgctgcccagatgacggctaagaacacctttcaaaatataccgtgtcagcggctgtgtatccacagaggacaaatcgccagcgtaatctacctgaatttcacgtacagcctgattcgtgatctgagcggcaaagctgcccagcttttctccaagcgagaaatatggctgcaattgcgtcatgacgttggatggtactggaggcatgttgaccgcatttttaaaaggctcatcacgcaaaatatgcagcacttgctcggacacatcgatagctacattctcctgagcttcgacagtcgaggcacccagatgtggtgtgacgataattttcggatgactcaggaatgggtgatcctgtgctggcggctctgactcgaatacgtcaaaggctgcaccggcaacgataccttcatcaatggcttcaacaagagccatttcatcgataactccgccccgggcacagttgatgatgcgcattccttttttcatcacttcaaactgtggacgagcaatcatatgtttcgtttctggtgttaatggtgtgtgtacggtcataaaatctgcgttgcggataatttcgtccacgctcgccagcttaatgcccagcttctcagcgcgttcttccgttagaaatggatcatagccgaggatgctcatgccaaatgctttagcacgtttagccacctcactgccgatacgtcccatgccgaggactccaagtgttttgttacgcagttcgacaccgaggaatgttttacgatcccatgtaccgccaatggttttggcatatgcttgtggaatatgacgtgctagagccatcatcatcgcaaaagtgtgctcacaagtcgtaatcgtgttgccgtcaggagcgttaataacgataatccctcgttgtgttgctgcttcgaggtcgatgttgtccactccgaccccagctcgccctacaaccttgaggttcttacctgccgtcatgatgcgttcggttacccgagtttggcttcgaacgagtaatgcgtcatagtcaccaataatttgaaccaattcatcctcgctgagacctgtgttcttgtccaccgtgacatcgtctgcatccatcagttgctggatgcccaggtcactgatcggatcggatactaacactttaaacatttggtttcctcctcaaagttaacttcttttatggacaggatgtacttcaaactgaaatacattccataaagaacatgaaaaaacttgaaatgcttctaaaagtacaggagagcggtgtaaaatactagtgtgataacgcattgacgcagaaaagggataaaatagtattatgcaccaaactgacgatcaaaagtcttacgcggaggcgctttgcggttttcgggcatcaaaaaaacccccgaatcacatactatctccatagtaagggacgagagttatcgtggtaccaccctaattcgcagccatttcgcaatggactgccttcagcggtcataaaatgaccgaaaggataacggttttctgccgattgcatctaatgccgggaagtattccacagacctcggtgcaataactcaggagcgctgaaagtagttatttcgtcaccggcttccacccaagcaccggttctctgaggacgaaatcaataccttttctccatcattgttgttgtcgctaataattttttcataatgtatcatggcttacatgggcatgtcaataggacatgcgacatgtgtggatagccgtctagatatatagctacagaatgcggaaaattaagatttaagtcttcttgaatccgcccgactttttggctatgatgctaaagaagactatgcagaggactaactaactatgaaaaagcttaaagtgaaatggaaaagagcgcaaattcatgaattgaacgaccgcttgctgctttacaatttgtatctaactcaggggctgaccctgctgattggcgcaatctggatattttttcagaaaagaaatgtgttagaactatttgcattgccgaacactctgcacgtcttatggtggggattgggtttggccgccgctatgttacttgtggatctgttgctgtcccggattatgcctgaggatgctatggatgacggtggtattaaccaaatgctgtttcaaaatcgtccggtgtggcatattatttgtatagcagctatcgtctctatctgtgaggaattcttgttcagaggtgcaattcagtacagctttggtccttattggacaagcattttgtttgcggtgattcatatccggtatttacggcattggattcccactggctgggtttttcttagcagttatggattgggctacatatatgtgcagaccggtagtctgtgggcaccgatcatttgtcattttgtgattgaccttatatctggcttagcgttacgttttcggaggtatgaagaatgaatcaggaacttagcagagtgcagacctatggtagccgtcgaaatggtcgcaaaggcaaggaggaggacaggtcaaaatctaaaccagttcgctcccgtgcttcacggcccgtgccagaattggctcacgttgccgctgtaccagaagttgctgtgacgatggaggatgatactcctgccagtgagtaccgaacgcgggcagaaatgtttccgtcccgccgtattcgggtaagcaagtggtttttaaattttttgagtactctttttgtgctgattactgcagcgttactgtggtggggcatcaagggtgcaccacccatcagtgaaatgctttggtaaaggcgcaaaatgatacggtaaaaaggcctccgtctccgcatgaatagcggagagtggaggcctttattgcatcatctacagttaagactgagtatacgcaagtctctatttgctggcaggaacctcaatgctttgaggatcaacaaattggtaacccttttgctcgaggcgtgtcaatagactgtccagagcctcagctgtccatggcagttcatgcatcaaaatattgctgcctggatgaagttgttccgttacgtttttgagaagtgcctccgttttattaggctgattctttttcattgtccagtccagagaaccgacggaccatgtcatgtataggagaccgttttccttagcgaccttgcgacctacgtctccgccggcaccatgagggggacggaagaatacgggggcttgacctgtaatgtccttaacaactttttgtaccgattcaatctgttttttgacctcaggctcagatttattcttcagcacgatgtgatcccagctatggttgccgatgggctgtccacggtcatggataagcttaagcaactcaggatgctcttttacacggtaaccgtttacgaagaaaatcgctttcgctttgtgtttatcgagtacatctatgattttgttgatcatggctgcttccttaggaccatcatcaaaggtcagtaacacgacttttttttcggtaccttgttggttagggattacattgtaggctttgttcaagtgatacattttgttattggtagttgccgatgtcgcagctcctatttcgttgctttcgatggttttatcattttgtgcattggttttacccgctgaattatgatcatcactgcctgcttgcttactgctgctttttggggaagagacgctgctctgatctttggcgctgttacttgagtcagacgctaccgaatcctgctggttgcttgttgccgcagattccggcttgtttgcagtgcaagcactaagcagcagacatgctgtgaacaaaatggctgctgtttttgtacccattatttcatctcaccttcctgtattttataccgtatgagtttgtcattactgacgaacactatgcttgattctaccacaaagggaggttctaattgtgaaaacatcttcatttttcctgggaatcgtcttgggcgctgtcgcaagctctttgatctcccgcaaccgcaacatgttgggcttatccatggatatgggtggaaaaaaaagcggcaatttagtgcagaaagcccgtactaaaatgatggacgcggcattccccggaatgggcgagataacactcaataaagaagacacccataaggatcaagaccatcattcactaacagataaaaccgctcataacgcccataccgccaagaacaaagaagagaatatgaagttgattaaagacttcatcagcacaagtcccgatgttaaacgtgaggtcgagcaaattttgaaagaaactcatacagccgtaccgggattgtaacccagaaacctttattccgaatcattttgcggcttttttataaaagccgttcaaatgattctttttttatctttttattgcgtgcatttacgattataaaatgataacatgattacatagaaccattttcatcacaggcatcataattgcatcataatctgttaataacactcggctgccaggaggagggtccagtatgaaaatagaaagattaagtcaggacaagatacggattttccttacctttgacgatttgagcgaacgcggtattcaaaaagacgatatgtggcaagaaattccaagagttcatgagctgtttaccgaaatgatggatcaggcgtacagcgaactgggcttcgacgccacgggaccgttagctgtcgaagtctttgcgcttcctgctcaaggaatggttgttatcgtcacccggggaaaatacgaccatcaacagtatggttcgggtcccgatgaggagcttccagaggaagtctacgaaatggaagtcacgctggagcatagcgattccatcgtttacgcgtttagcgatttcgaagtactcatagaagcggctcatatgcttcgtagtaacactacggaagcaggtaagctgtatcattatagaggaaaatggattctgcacttggaaccagaagaagtagaggagtccaagcttgcggctttaattgcggttcttgctgaatttggagaaggctcatccgttacaccagctatgttggaagagtacggcaagctggtcattcctgagcaggcagttgctgtcatctgcactcattttgacagccgttcttgattcgttttatcgaaagtgatatcgaagtgaatttgtcggctctgcgctaaaagcagggccgactcatttttatggagggatgatcggtgcttctgttttcggttttagcggcagccacagcgccgggtctcgccttattgatgtatttttacttgaaggacaggtatgattcggagccactgcacatggttattaaagtgtttttgctcggttttttggtggttcttcctgtcatgatttttcaacgcgggctgctgctttggctaggggatcacacgttaatccaggtgttcggcatttcagccggagtggaagagttttttaaatggtttctgttgtatcacatcatctataatcataccgagttcgacgagccttatgacggtattttgtatgcggccgcagtctcactcggatttgcaacagttgaaaatctgttatatgcgtgggcgggccatgcttcgattagcatgatgctgatgagatcattactaccggtatccggtcatgcgatgtttggtgtaatgatgggctactacatggggaaggccaagttttcagagggcttgaggagcaaatacatgttgctgctgtcattggtgcttccatggttctggcacggagtatacgatttgattttaacgaaattttcgcatgactggatctggtttatcattccacttatggcatttctatggtatggaggaatggcaaagatcagtcgagctaataaccgttctccttttcgtttgttaaaacgggaagaaaaggttaacatgtaacaaaatggggcacactgatctgacaaacctgttagagaaagaggtgtcttttttttgcgtataaaagtaagaattcattgtaaaagatgtggggaacgttttgtgctgagaggacgtatagagcaaggacagattcagaccggctttaaacgctgcatttgcgataactgtgagtttattgttgaagtcatggaaaaccatgcataagagagcattcttcttgtcacactatcggtagtgtacttgaagaaaggagactcccaatatgtataagcgacttagtgccgtattgttcccggtggttaccctgatgatgataggagcatttgtgtggggttatcagcaaagccagatgagaaaagaggtgtctcttcaggcaaatagcatgtcgataaaagcggaaaatcaataccagcgtgcgtttcacgatttgtcgtttcatatggatcagctgcattctcaactcggtaacgcggttgctgtccataatacttcacacgcgatgcaccgcaaatgtttgatgaacgtgtggaggattgcaagtgaggcccaaaatgaggttaatcagttgcctctgaatgtaatgccttttaatcatgccaaggatttactgtcacatctatccgcgttttcgtatcagaccgctgtccgtgatctggatcacgagcctttaaacgagaaagaaatttcgaacctaaaaacgttatataacaattccaaagaaatttcgaaaaacatgcaggaagtgcagcaaaaggtccttagcaaaaatttgcgatggatggatgtagatatggcggcaggttcgcaaactggtccgaaggacaacaccattattgatggctttaaaaccgtggacaaaaaggtggaaaactacaaggagctggattggggaccgtctgtagccagcatctatgataaacgctctgtgaaaaaattgagtctcccggcagtgaatgcagaacaaattaaacgaaatgccgctgaatttacaggaaaaccggaaagtcagatccgtgtgaacgaaaacggtaaaggaacggaatgggcatcttatacagctaccctgctaaataagaagcaacccgtggccagtatggattttacgaaaaaaggcggcaagcttatttcttatcatgacatgagagcagtaggccctaaaaaagcaacacgtaatgaagcgattcgctatgctagtgaataccttgaacaaaaaggttacaaaggaatgaagccagttgcgtatgatgagagcgggaatttagctaatattacatttgcgagccaacaaggggacgtgattatctatccagaaaaaatcacagtcagatcaggccttgataacggacaagtgatcggttttcaatccagtgattatgtgtatgagcatagtcatctccgccgcattccgcaagcgaaattgaatttgaatgcagcacgagcaaaattgaatcctgaatttcgtgaaacttaccaccgtaaagctttaattgaaaatgaactttcgaatgaagttctatgttatgaatttggtggtaaaatcaatggttccgtctaccggatatacattaacgccaatacgggaatggaagaaacgattgaagaggttaaagattcagatgaacctcaggttactgcaagtaatgcgtagttgattacatgaaaatgaatcaatagtcactctaaacctccttcgtgaaggaggttttttgtgctttagtcatagatcgaacaaatataatgcttaatataggcacaaagtcgtggtattatataccttaattagagcttttaatggacaaggatggtggatcatttgtttcccaaaattaatgatgtgttatacatacaagtggctggtagtgaccataaggacgagatttttgaatttaagtctcgtattgcagaagaggagtcacagaacttcctaattgaaattcctatgtcacaaacaagtgggcatttgaaaaaattgtttctaggggaagaactgtctatattttttatgagcgagggtgggattaaaaattattttaatacccacgttacgggttttaaagaggatgttctccggatggttcgtatccacaaacctgctccagacagcatcagcaaaattcagcgccgcaactttcttcgggttaaggccaacttggaaattgcagtaaagcatggtgcgaacgagtccagatttgtagcagagacacatgatgtaggaggcgggggtgtttcttttcacacccagggaactcatcatcttgaagaaggagaatcattgtcttgctggattttagttccatataaaaacggtactcaggagcatgttccgttccaatctgaaattgtgcgcattcagcagatggaaaacggtcgcaaactcattatgctgaaatatgaggaaatcgctgatcaggagcgccaaaaactgattaaatattgctttgaaagacagctggaattccgggggaaatcttaatcatccgaaatttttcttttatagtaaacctgtcgcttattttgcatcgcctataaatgtgtggtataattttcacgtcgcaggcaatgcctgcttttttcttgaggttaggttaggaggaattccctgttggcaaggcaacatgtatcttcaagtaacaaaatcaatgtagccattgatggacctgctggtgcagggaaaagtacagtggcccgcctggtggcgaaggcactttcttatgtatatgtagataccggcgccatgtaccgagctgcaacgtggtacatgatgtgtaaggaaatacctgcagaaaatgtacaaaaagtgcttcaacatgtacctgagctggtgattgaattagtaccggaccccacaggccaaaaggtttattgtaacggggaagatgtaaccactgtgatccgttcgatggaagtgactagcaacgtgtcacagtattcaagtattgccggtttacgtacacgtttgactgaaaaccagcgtgaaatggctgcgcgcaagggtgtcgttatggatggtcgtgatattggaacaactgtacttcccgatgcggaagtcaaggtgttcatgaccgcaagtgttcaggaacgtgcctctcgccgttttaaagaactgagcgaaactgatgatatcactctggagcagctagaacgtgacattgcggcacgtgacaagcttgacgaggagagggaggtatccccgcttcgttgcagtgaggacgccatcgtgcttgatacgacccatatgggcattcaggatgtcgttgatacgatcgtatcttattgcttaacggagaaggatggagagatcagccaatgatatatactgtatgcgccagtattttgcgtcttatttaccgcgttctgtttagacttgaggcggtaggcagggaaaatgttcctgccgagggcggagtgctgttgtgttctaatcatattagtaatcttgaccctcctacagtcggtattttgctgaagcgaaaggttcactttatggcaaaagccgagctgtttaatgttcctgtactgggtccactaattgggaaactgggagcttttccagtcaaacgcggtggtgtaagtaaggaatccattaagctggcattgaacattttgcgtgatggtaaggttatggggatctttcccgaaggctccagaggagctgggggaatcggtaaaaagggtgctgcaagctttgcgctacgcagtggagcggctgccgttccggtcgccattattggtgattacaagcttttccgtaaaacgaaagtgttatacggtaaacctgtcaatttggacgcttaccaaaagggtgccgatatcgaaggagatccgctagaacttgcaacagaagcaattatgtctcgtattcgcacgatgaaggaaacgggtaagcctacgaataactgaaaggcttgcatgaattgtgtctaagctcggaaaactagaacaaaagtttatttatgttttgaactctgccatgcgcaggtttaaataaatggttttttttgaattgaggagggtattgacatgtcggaagaaattaaaaatcaagaagctgctgaagcggcaaatcaagacgagctcgatcaaatcgtctccctgaaaaaaggtgacaccgttaagggtacaatcgtgaaattggaagataaccaagcggtagtaagcattggatataaatacgatggagttattccaattcgcgagttgtcttctggtttggataacgcagaagaagcagtacaagtaggccaagaggttgaagctagaattatcagcattgacgatggcaaggaaaaacttgttctgtccaaacgtgcaatcgacagtgaaaatgcttgggaaaagttggagcaactgttcgaaagcaaagaagtatttgaagttgttgtgaatgatgtcgttaaaggcggcatcgtggtagacgtgggtctgcgcggattcattcctgcatccatggtagaacgccacttcgttgaagatttcagtgattacaaaggccgcacattgcgtgttgttgtaaaagaactggatcgtgaaaataacaaagtgatcctttctcaaaaagacgttctggaagcagaattcgaagccaacaagcttaaagtaatggctgagctgaaagaaggccaagaaatcgtaggtacggttcaacgtcttactcagttcggtgctttcgtagatgttggcggcgtggacggtctggttcacgtatctgaaattgcttggactcatgtcgataagccttctgatgcagtttctgaaggagatcaagtgaaagtgaaagtcttgaaagtagatcctgaaaaagggaaaatcagcctgagcatgaaagctgcacagcctggtccttgggaatcggctgctggacaattcaacaacaatgacatcgtaacaggtgttgtaaaacgtctggttaacttcggtgcattcgttgaaatcgctcctggcgtggaaggtttggttcatatttcccaaatttcccacaaacacattggaactccacaagaagttctggaagaaggacaagaagtgaaagttaaaattcttgaaatgaatccttccgaaaaacgtgttagcctgagcattaaagaaactgaggaagctcctgaagctgctcctaaagcagaaagagcaccacgtgcatctcgtgcacctcgtgaggaactgaataatcctaacgtttccctcaataattccggtctgagcattacgctcggcgagcgttttggcgataagctgaacaaatttaaatgagtttaaatcaatacattttataataagcataacgtacaccatcggcggacccagagggttcgccgattgttgttacgtgaccatatcgccaataggtatgttttttgctatgatgatagcggaagaattgacaggaggagtgaatttatggcaagacccgttgtggctatcgttggtcgtccgaatgtgggtaagtccactatttttaatcggattatcggggatcgtttgtccatcgtggaagataaacccggaatcactcgtgaccgtatatacggtatatcggagtggaatggtaaatccttcagtattattgacaccggcggcattgagattgatggtgaggatgtcattttaaaatccatccgtatgcaggccgaacttgcaatagaagaagcagatgtaattgtattcatgagtgatgcgaaagcaggaattacacagtcagatgaagaggtagctcaaatgttatatcgttcgggtaaaccgatcatcgtagctgtcaacaaggtggacaacctcagtcgcgccgatctgatttatgagttttattcttatggatttggtgatccaattgctgtttctggtagtcatggcacagggataggcgacctgctagatgccattacgtctaatttgcctgagctggaagaagatcactatgatgaagacgttattcgtgttgccttgatcggccgcccgaatgtgggtaaatcttcactggttaacgccattctgggagaagaacgggttatcgttagtgacattgcgggcacgacgcgtgatgcaattgatacaccttttgaaaaagacggtcaaaagtatgtgctgattgatacggcaggtatgcgtaaacgtggcaaagtatatgaaacgaccgaaaaatatagtgtaatgcgtgccatgcgtgccattgagcgtgcagatgttgtactggtcgttattaacggcgaggaaggcattattgagcaggataagcacattgctggctatgcttatgaagcgggtaaagcgtcgctgtttgtcgttaacaaatgggatgtcgtggacaaggacgataaaacgatgcaccagtttgaaacgaaaattcgcgatcactttctgtttatgacatatgctccgattgtgttcttgtctgcaaaaacgaagcaacgcctgcaaaagctgcttcctgttgtacagcatgtggcacagcagcatgtattgcgtattcagacacatttgctgaatgatgtaatttccgacgcggttgccatcaatcccccaccaacagacaagggacgtcgtctgcgtattaactatgtgacccaggttgctgttaagccgcctacgatggttgtattcgtaaacgatccagaaataatgcacttctcgtatgagcgttatctggagaacaaaattcgcgccgccttcaattttgaaggaactccaattcgtatctttacacggcgcaagtctgacgaaagttaggagcgaataggttgattttacaaatcgttgccatcgtactcagttacttgcttggctctgtcagctttagtttgctgtatggaaaattaaaaggaatcgacattcgccagcatggaagcggcaatgccggtgcgacgaatacgctgcgtgtgcttggaaaaggcccagctattctggtactgctgctggacgtacttaaaggggttattgcagtgctaatagggcactggttaggtggagaatcatcctgggtatcgggtttgtgcggcattgcagcgattgcgggccataactggccgatatattttcacttccgtggaggaaaaggtattgcgactgctattggtgtattggcatcgcttgccttactgcccgcactatatgccggaatcattgcgatacttgcaatcgtaatgacgcgttacgtatccttgggatcgctcatatttgtcattttgactccctggatattactcgtgcttggttatgcatggccgttattctggacggctctaatcatttgtctgttcgctgtgtggagacaccgtaccaacatagtcaagctggtacgtgggaatgagaacaagcttggctccaaaggaggagatcgtcttgtctgagaaaatagctgtgctggtcgcggggagttggggaacagccctggcttccgttcttgcggccaataacaacgatgtctctgtctggacgagaaacgagcagcaagcagctgaaatcaatgagaagcatacgaatgagcattatttaccaggctccattttgtctgaccgcatttcagctacaactgatatgcagactgcggtatctggtgctaaagcagtgattatcgtatctccttcggctgctgctcgtcaggtagcacgtagtctgaaagctcattttagcaaggatatgctggtagtgcatgccattaaaggttttgaaactgaaacgcttaaacgtatgtccacggtgatttcggaagaactggaagtcgctgagggcgatattgctgtgctgtctggtccgagtcatgcggaagaagtggtgaggaaatgtcctacaacggttgttgtagcttcctccaatgagaaggctgcgcaagccgcacaggggctgttcatgaactcctatttccgcgtctatacaaaccgtgatttgctcggcgtggaactgtccggggcgctaaaaaatattatcgcattgggtgcgggaatgtcagatggacttggtttcggtgataatgccaaagcggctttattgacccgtggattggctgaaattacccgtgccggagttgagatgggcgctaacccactaacctttgctggcctggctggtattggcgatctagtggtcactgcaacgagtcgtcacagtcgcaactggcgtgcagggtcactattgggacagggccaacagcttgatgctgtgctggaatctatgggcatggtcgtagaaggtattcgaacgaccaaagcggcatacgccatctcccaaaaattaggtgttcagatgcctattacagaggtgctttatggagtgctgtttgaaggacgtgacgtccgtaaggctgttgaggcgctgatgggtcgcgatcctaagaccgagatggaagtcatgccacttcaaacttgggagcaatggcattcttaagggctcggatgagctttaataatataaaggctgtctcatggtagattttttctataatgagatagccttttttagttaggcgtttggcatgtcttatgtatgcttaatcaccttttgtctctgccactcatagactgagttgagcaatggcggaggaggggagattgtgaataaaaactttccgaaagatgcattgaaggccattaacaaaaaaggcggcaaaaacatatccgaaaatgcagtgaaaaagctggcaggcacggtaaaggcggacacgcttcaaagcgaagcgcaactgcgtcagcttatcaagcaggtgtctgcgatggccaacattccggtgtcggaagatacagtaagggatattgttggtgccgtcaaaaagagcggaatgaatccttccaatatggaagcgttgatgaaaatgatgatgaaaaaatagaccgctggccgcacgccagttagtattattcaccgtgaaccgggaaggttcgcggtttttttgtattttggagtaggtaacctctttttcagtacacaaaatatcgaactgccctgtcgaacatgttataatgatgcccatcaggaaacggaaggaaagacggaaaaggaggcaataatgttgaaggaggcaatatcatcagtgttagtagacaggcttcctcacaatctggcagttgcgctgagtagcttggcagagagctggtcaacagtgtcggttccgtggatgctgggcgggagctgttcactacttgtgcaagaagttgaactggatcgcctgcctcgggacattgatatttatgcggatattcatgccgcaaagcagcttcattcgcaccccctgggtatgagtatagatcgacagcaggttgatcgtagcggctcttacgtttcattgctgagccactatgatctggagggatttccagtcgagttggtgggaggatttgaggtattatgtggcggagcgttataccgcttagagatcgagcgactactttggtcgactggtgttcagcttgagctggggagtgcttcactgcgtctgatgccgctcagtcatgaacttttattcaatatattgcgaaatcgacccgaccggtacaaagcgattgcagatgtcatgaagcgcgacccgcgacgtcatataattgtactgaagcagttactagtcagtaatatttggaatgaggagcaattggacaagcttgcagaacttctgccttggccagagttgcattctgtcatccagatgggcaatgaagtataagctgtgtgtgttaggagaaagaggactggaggaccgttcatgaatgtgcagattacgttcaagccgtcaggcaggcgcgtacaggtcggtcagggtacgtcattgcttcaggctgctcgtaaagcgggtgtatatattcccactcgttgtgacggaaaagcagcctgtctgatgtgtaaggtacaaatatcaccgggatgggctgaattcgcaggtcaacccagcgatgcagagcagcggaagctgggacctttattggatgaaggaatacgcttatcctgtcaggcccgtgtccaaggcgatatggaggtaaccataccggaggacaagctcaaggcggctatcaggcggcaactggagcgtcaggcgatggatgatgaactgtggtaatgccgattatatcaggagaataaaaaaaggatggtttccgacgactctaaacagtcaggagaaacatcctttttttatttagtctagcgactaagtcatgggagagccttgctccgcatatattaggtgagtggacccaaacgtaaaatatcgtttctgcaatgatcgctctgtcgtaatctatttttcaaaaaactaaacatattttacggaggggatacatatgatggtatcagtccaaatgcatgtacgagtttacgccgtttcgccgattccatcagtctcctgaatctcggcggcggacgacttccgggcattttaaaggctgttctgccgcatctgggatcaagcagttggttgaacacgaagcggatgctctttaagcatttttccttcggagacttttgaggaggggatttcattggagaaagtggacatttttaaagacattgccgaacgcaccggaggagacatttatcttggggtcgtcggcgcagtccgaacaggaaaatcaacgtttatcaagcggtttatggagacgattgttctgccaaacattacaagtgaggcggaccgtgcccgcgccgtagacgagttgccgcaaagtgcggcaggcaagacgatcatgacgacggagcctaaattcgtaccgaataatgccgtccagatcaaagtaacggaaggactggatgtgaatgtacgtctggttgactgtgtaggatatgcagtagaaggagcaaaaggttacgaggatgaaaatggtccgaggatgatctccacaccatggttcgaagaacctattccttttcaggaagcggcagaaattggtacacgcaaggttattcaggagcattcgacgctcggtgtggtagtcactacagacggcacgattgcggaaatcccgcgcagctcttatgtagagtcggaggaacgcgtcattgaggagttgaaggaagttggcaaaccatttgttttggttatcaactccacgcatccgcgcagtgatgaaacactccagcttcgcagtgagctggctgccaagtacgatatacccgtcatgacactcagcgcggcgactatgacggaagatgatgttacaggcgtacttcgtgaagtattgtatgaatttccggtgcatgaggtgaatgtaaacctaccgagctgggtcatggtactgaacgaagagcactggctgcgtagcaattatgaaaattccgttcgcgatacggttaaagatattcgacgcctgcgtgatgtagatcgagtggtcggccagtttatggaatatgaattcattgacagggccgggttgagcgggatgaatatggggcagggtgtagctgaaattgatctgtatgctcccgatgagctgtacgaccagattttggtcgaagtcgtcggggtagagattcggggcaaggatcatttgctacaaatgatgcaggattttgcccatgccaaacgggagtacgaccgcttcgctgaagcgctggaaatggtcaagacaacgggatatggcattgccgcgccgtcgttgtccgagatggcactagacgatccgcagttgattcgtcagggtacaaggtttggtgtgcggctcaaggcaacagcaccttccatacacatgattcgggtcgatgtggaatcggaatttgctccgattatcggaacagagaagcaaagtgaggagcttatgcgttatctgatgcaggattttgagaatgacccaatcaaaatttgggagtcagacattttcggacgttcgcttcattctattgtacgggaaggcattcagggtaaaatcgccatgatgccggacaatgcacgctataagctgcaggaaacgctgggtcgtatcattaatgaaggttcaggcggtctcattgctattattctttaaggctaagccagacccaaaatgtataaggaaataccgtggagagcaatttgctctctacggttcgcagaaaacaaaatattagactgacctccaaaaccagagaggggtagccatggacgagaaaataaagtcctagactacctctatttttattgagccttcgtttctcattgactggctattcattaaacgcgaagttctgacattctgcaggacaccccaaatattcaaatactctgcgtgcaggttcgtctattggtaagtacacttcaattccaggatacatgtggctgcttacagaaagatgaatttgcttgtaacgaatagggacaaaatcggccatggttcccattctggccaaaatgattttggattgctcaacttcatttgctgagtcctttggctgcatattccaatatttattgaggtcgtcgtattttcgaaatctgtcaattaactttttatacccatggtcgtatcgggaaaacatgttattccttctaaaagcttgtatcccataaatagcatgagactcccattgttcgaacgactcagtatcgaaggtggaacggggccgaatggaaaaatcggagttaaaatgaaaatcaactttattcagcttgccattcataaaagaatcataggggatatcaaataactggcgaaacggctcatttaaccccttaatatctaaggtatgagtgacgatcattgccggaaaaggcagattactcatgatctgctgcgcttgctccagcgccagctccagagaccgtccttccaattcgtaatggatcggaagataatcggcggcgaggagaagatcgttgcgctcatctgaagtgcactccagatactcagcaatatggatcatcgtttgccgatccggtattcgacgagaccgtccaaccaatagatttttatatgtaggacaggcctcatcattaagctcctgctgagtaaatcgtttcaataacgggtgagattgctcggtatattcccgctggcgtttcatacgaacagcttcaatctctcccaatacgatttttaatgttttgtgctggaagtcctcatccttgtgcatggtcatctcttttcaatccttttcataatgaggtgtagttctacacttggtacacatgattccctacagtatactacattgtgaaaaaggggagctatttacaaagggttctcaatgacaaacatggaggagatcatatggttcgtgcaattgtaacagatccgtttgcttcaggatattttgcgataaaggaagttgccgccccacaggcccagccttgggaagcgatcgttcaagtacaagccttctctcttaatcggggtgaagttgtagatgcaagaaataatggaggacagatcagaccaggctgggatttttctgggatcgtcgttgagcaggctaaagatggcacgggtccgaaacagggaagccgtgtcgtaggccttctcttgatgggagcatgggccgaacaggttgctgctcctacttcattactggctgaatttcccgatgatattacctttgcccaggcggctactttaccagtagctggtctgtcagcgctctatacgcttagaaaaggaggaatgctgctcggtaagcgaatgttgattactggctcgactggcggagttggaatttttgcacatcagctagccgcgcaatctggagcttttacagtaggtgttgccagaacaacggaaaaagccttacttgttcaagaggctggtgctaatgaggttattgttggagataccgcgattccatcggttgatgcatttggaccttatcatctaattatagattcagtaggtggtgatacgctagctgccttactgcctcagcttgtgccagacggaatatgtgtatccatgggacattcgtcctcaccttacgcaacgattaatatcaggggcttaggtggtagaaccttgtatagcttctttttaggagaggagataaatcgctattcgccggcggaagatctgaaattattaggtgaatttgtttccaaaggccagttagtaccaaggatcgaagtggtggcatcatggaagggaattggaagcattgcccaactgctagagcgaagttctccggtaaagcagtgctccaaataagttagatgtgatcgtcctcgtatttaaaataaacaaacagaattgtatcatcggactaggctccgccttgatttcaaatttaagcagcaaccgttttccggtattcaatcggggggcggttgtttgttgtgttttggcctataaaaccagaaatttttctatatttaataaaacctatttacatacttggtttaaagcgatatattaagtatcaaatttgaatcattttgtggattgaacgagggggaaatgaaatcatgaatatccaaaaagagctccaaagaaacaaaaagctagggctaggggctatcatgctactggtgctggttttgctggtcactgcatgcggcgtgccgaaaacagagagcggcactcaagggacaagcactgcgggatcgaatacaacaaacggaaaaacggacaatttaaatctaaagggtaaacgggttgcgttgatcatggagtttaacacgggcacattttcgcaacagtatgttcaaggcgtggaagaggaagttaagaaatttggcggtacgctgactaagtttgtggcagataacgataaggctaaaatggcttctctgcttgatagtgcgattaaccagcagtttgatgtcattttgactgatcacggtgatgcattgctggagacagggctgaaaaaagcaatttcccgcaatattccggttatcgtgttcgatgctgccgtcaatgttccgggtgcggtagtgctctcacaggatgaccaaagcatggctgagttgacgctggagcaaatgaaaaaggatatcggcggcaaaggtaacattgtgaaagtatgggttgctggatttgcaccgatggaacgtcgtcaggttgcttatgatgcatttttgaaatccaatccggatattaaagaaatcgcgacttttggttctgctcagaatcctgctttagatacgcaagccaaaatggaagctgtattaaagcaatatcctaagggcgaaattacagccgtctgggcggcttgggatgaatttgccaaaggggcagcccgtgcgatccaacaagcgggacgtacggaaattaaggtctacggcattgacatgagcgacgaggacttgcaaatgatccaggacccgaaaaatccttgggtggcctcggcaaccgttgatccaacagatatcgggcgcgtacaagtgcgctatgcatatcagaagctgcatggggataatccggaggagaaagtcgtattgaaggctgtatatgtgcaacgcgaagcgctgccagataagcaaatttccacatccgagctatcccaatatgtggagggatggggtcaaagtgagcagggatatgaggattggatgaaggaatatgaaacgtccaaataaaatgtttgcatcatgcaaaaggcgcgcttcggcgcgcttttatcataagcaggcgtgagggggcaccatgagttcacaagtatatacattggagatgaagaaaatcagcaaacagtttgctggtgtagatgcgctgcgagcggtggattttacggtgcagggtggcgaaattcacgctctgctgggtgccaacggggcagggaaaagcacattgatgaagattttgtccggtgcgtatcgttccgatcagggagttatcgtagttggtggcaaggaactaaacattagttcaccgtgggaggccaaaagggcgggaatccactgtgtgtatcaggaggttgattcagcgcttgtgcctcagttaaccgtagctgaaaacattgtaatggacgatttgtctgcacctgatggtcgatggtgggctgcgccgggggctatgcgcagacgagcgcgtgaggcattagcacgtctagaggtagatattgacgcacgacgatatgtgtctgaactgacgttggcagaaaaacaacttgtacttatcgcacgtattctgacacagcaagcaaataccatcatttttgatgagcctacggcgccgctcagcgaggaagaaacgcgacgtttgttccgtacaatccatacactcaaggatgagggagttgcatgtatcctcatcacacaccgattgccggaggttatcgaacacagtgaccgtgttacggtgatgcgtgatggcgagcgcgtgttcacgggacctgcttctgatttaagtgtaggcgacatcgttacgcatatgcttgggaaaacatttgaagaggaattcccaaaaacagaggtacctattggtgaaacgatattggaagcaaaagggcttcacaaaggattacgagtgcacggcgttgatttacaggcccgacgtggtgaaattctctctattgtgggtttggttggtgcaggcaaaacggagctgtcacgacttcttacaggagcagacaagccggataagggagagctgacctttaagggtcgctccattcgattgagagagccagcggatgcggtagctcgaggaattgtatccatacccgaggagcgacgtaagcagggggtgctaattgaggagagtgtagaaagaaacctcagccttccgctattggggaagctgagtgtccttggtttcatcagtcggcgtaaagaacaaaataacggtaatgggattgtcgcctctctcggtattaagacgccatcgctccgtcagaatgttaaatatttgagtggcgggaatcagcaaaaagttgcgattgggaaatggctgcattccggagcggatgtatttgtttttgacgagccaaccaagggtgtggatataggggcaaaaagtgatattttccgtatcattggccagttggcggagcaaggaaaagcaatcatctatctaacctgtgaatttgctgaagggattggcattggtgatcggattgcagtgatgtatgatggcaaaattataaaggaatttgcgcggggcgaagtggaacaggaacagcttctgttgtatgccagcggcggtgaagaggtgcattcatgaaggaaaaatggttaaacgtctcatttcgttacggtgccgtagttgtcattataggtatattggcgtttttttcatctacattaccttatttctggacttatgataatttaatggatattctaggatctattgccattgttactttcgttgccattggtgtgacgttgtcacttatcgtggacggttttgacctgtcggtgggagctacagtatctttgacaacggtcgtttcagcttctttgatggtctggtatgagcagcctgttgcggtggtcattattgtgtctctgattgtcggcgctttggtaggactgttaaattcattattgatcattaaattgcgtattcctgatttgctcgcaacccttgcaatcatgtatattgtaagcgggattcacaaaacgtacgctcagggctataccatatacaatcatatgcagtttcccgatggcagcaaggcgccgggggagatatctcctgcatttcttttgctggggcaaggtaaatggttgggtatcccgatttcggttattttactgttactgactgtggcggcggtgcatgttttcttgacctatacaaagcatgggcgtcaaatgtatgtaacgggtggaaatgaggaagctgctcgtctgtcgggcatacgggtaaaaaaagtccgtactctggcctatgttgcttcaggcgtatttgcggcgattgctggtattttgtatgcctcccgagtaggctcaggccaaattgacgcgggttcccctttgctcatggaggcggtagctgcagtattcgtcggtttttcggtctttggtgctggtaaacccaatgttattggtacatttattggtgcggtgttgatcggtgtgttggttaatggactaacgatgatgaatgtgcaatattttgcccatgatattgtcaaaggagtagtgctggtacttgcgctggccgttactttttacgtgttaaaccgtcgtcgtacttgaaattgtctgtggactgtattactataaaccttgttccacgcaagaagggtgccataaaacgccagtttcggcctatattgcggaggttaggtatattctatgtatatttaacgacgaaacggaaacagatgataacattatggaaggcagtacgccgcccgggttattttatacaggcgacctcatatcggtcattaacaccgataaccttaatgctggactacacttgaattgggaggtgaatattatgaataaaacggatttgatcaatcaggtttctgaaagcactgaattgtccaaaaaggacgtaaccaaagcaatcgatgcagtatttgaggcgatctctggagcgctgcaaagcggagataaggtgcaactggtaggttttgggaactttgaggttcgtgaacgttccgcacgtaaaggacgtaacccgcaaacaggagaagaaatcgaaatccctgcgagcaaaattccggcatttaaaccgggtaaagcgctcaaagacggaattaaataagatttcttacatattcccaatgcgctgaaaagaccgtgaatttgattcacggccttttctttttgccctgtttacttcgtggtagatgtgctatggtctgaagaagaggaagctgttctagcgtttcgcgaggcataagcgatcagcaccaggggttcacccgttagctcggcaaattcatgctctagctgttgaagccgttcgatttgggcagggctgagattggcgggaagatagtttttcatcagatccgttcctttctttaatggatgggactgcacggatagtatggctcgggacacgctaattgttgcaggtagctcgggaagcatgtagttgacaaaactagcttgaatctccatcataaaaagtatagcttcggctctcagggaggaaaagaacatggaagataacgtgacgggtagcagtgagtacgtcgtaattaaagcgaaaagcaacggatgtcaggtttttggtctgaccagaggtcaggatacacgcttgcatcattcagaaaaattggacaagggcgaggtactgatcgtccaatttacggatcatacttctgctattaaaattcgcggcaaagccgttgtgatgactaagcacggggtaatagatacggaggattaaaatgcaggcatagcctgcttttttttgttgtagaatgagagtgaggacctttaccgtagcaaacccacattatgaggtagaggtcaggggaggctctgatgaaaccttggattgtattcggtggctccattctcataaccatcgcagcagctgtgttgctaccgtccttacaggtgctggactcaggaaccgcagcagttcgtgagacacaggcgacgatttcgcctcagcaacgggtgctgctgtcggatgacaatctggtggatacgctgaacgagctgccgttgaccacaccgattgcaagcgcaagctgggaacattcagtcctgaccctggatgtcaagctgtccaaggaagaaactgccccactagagatttatcaaaacatggcggagcttgccgcttttagcttttacggaacgacgaatgtacggcaattgctgcttcgggtggtgacgcaggacgaatggtcaggagaacggcatttgctgcttgcatccgatatacgccgcaacgagtggacgaacgaggcattggaacagctgagaagccgggaaggcgcggaattgccagaggatttgaaatcccgtttccgcattacagtaacgcccatgtggcaaaacaggtttaacggtgtatatacagattagatgtttctgccggtaggacctccagtactttagtcgcgaatcattttaaattgtgatataatataaggcattgcaattatttgagtatagcagaaagtcatgtctcggaggcttaggatgaaaccgtatcgcgtaccccaattagcaaggaaatatgtggaatacgacatgattcaacaacatacggaaatgccggcttttcctgacagccgtacccgtttgatgtttgtgtttttgaaccggaatgcgcaggagctgcatgccagtgaggacgaactgtacgcattggtaacctcacttgtgcagatggggctggatacgcatgatatgattgatactctatccggtatacggagcccggaggagatgcgttccagacagctgaaagtgttagcaggggactattttagcagtcgtttttatcagttgcttgcactggcaggccgcatcacggccatttcgaagctgagtgatgctgtatgtgaagtgaacgcagggaaaatgagtctgtactggggaatgaagcaattccgattggatgcaactcagtatttaactcagatggttcgtttcaaaaaggagctttttttatcattcacttcacttgtagcagaacaggatcaggaaatttggaagcagcttctcaacaaatttgccctctgtgataccttggtggaggaatgggggaagcggacagaaccggacaagtcccgtttcggatatatgttctggcatatttatagtaacggggaccggaacgagcaggtattgctttcagagagtggtactgacactgaagcatggcgtaagctggttctgaaatacaaagccgaggatgcgatactggacaagcttcgcacggcagttacacacatccggcagatcctgtcagatgatcaaaatacggggatcgaggaatttgaacgcatgcttgagcctttcctgaagctgctaaatagtccgcacccagttgtgagggaaggttaggtgaacgtgatgggatcaagcgacaccaagccgaaagaacaattcgttcatggcgtgtttgaaagtatagcaggtaaatacgatttgatgaacgatatactgagctttcgcagacataaggcttggcggaaatttacgatgaaaaaaatgaacatgcatcgcggcgatacggcaatcgatctctgctgtggcacatgtgactggacgcttgcgatggcgcgtgcaagtgaaagtggtcacatcgtagggctggattttagtcagaacatgctcaatgttggcgagcgtaagattacatcagaatcccgtgaaaagcaaattaagcttgttcagggcaacgcgatggaactaccttttgaagataattcatttgattatgcgacgattggtttcggtctgcgcaacgtgcctgacctgcgccaagtgttacaggagatgcaacgagtcgtcaaacctggcgggcaggtcgtatgtctggaattgtctaaacctacttggcagccgttcaaggggatttactacacatattttcaacacatcttgcccatgctcggcaaattgttcgccaaacgttatgagcagtataaatggctccctgattcgttggcgctttttccaggaagggatgagttggctggcatcttccgtgaagtcggattgaaggatgttcaggctcattctctcaccggaggcattgcggcattgcacattggaatcaaggagagtcagcatgtttaagaaaattgctatttttttggaaatgattaaaattgaacatacgttatttgcgctcccatttgcattcatgggggctgtattggggtctgttgtcgtgacaggcaaccttccctcctggccgcagatcggctggatcctgctagctatggttggcgcacgtagcgcggcttttggcttcaatcgtatgattgaccgggtgattgacgggaaaaatccgcgcacagcaggacgcgctatcccggcggggttgctcaaatcgagcgaagtggtgattttcattatcgtcagtttggtgttgttattctgggcatcattcaagttaagtccgctggcgttcaagctgtttccgctggccttttttatgctcgttttttattcttacaccaagcgtttcacttggctttgccatattgtacttggtctgaccattggtttggcgccactaggtgcgtgggttgcagtaacgggacaaatagatctgaccgctatcgtactatatctcacgattgcattttggacggcgggatttgatgtaatttatgcttgtcaggatatagattttgaccaaaacgaaggagtttattctattcctgcccgttttggtgtagcaggtgcgctgaacatcgctcgggcattccacgtcattacggcgatcggatttattgtattgttctttattgcagatttaagctggtggtatctggcgggcatgattatttcgtacattattttattttatgaacactatatcgtatctccaaaagatttgagtcgattgcagacggcattctttactatgaacggtgtacttagcactgtcgtatttgcctttacactgattgatttggtggtgcgtcaatactaatgaataatcaggtgagcggacatcaaggcaaacgaatcgttattggcattacaggcgcgagcggaagcatttatggtgtgcgactggtagagactctgctggacttgcaatacacagttcacctgatcgtttccaatgctggctggcgggtgttgaaagaggagttgggctggaatgtgactgaccgggaaggggctttgaatgaacaattcggaggccgtcccggttctcttgtataccatccgttcacagatattggagcttcgattgcgagcggctcttacttggtggatgcgatgattatcatgccatgctcgatggggacgttgtcagcagtggcacacggttcgtccgataatctcatggcgagggcagcggacgtgatgatgaaggaaggtcgtccgctgatccttgtgcctcgtgagacgcctctacatgccattcatttggaaaacatgcttaagcttgcgagactcggcgtcaaaatgattccggctatgccggctttttactttcatcccaagacgctggatgatattgtgctgttcctcgtaggcaaagtattggacagcttgcgtatagaacatcaattgtttacgagatggggggattccgatgccgacaccggacaccaagacaatcacaatcggaaaaattaaatatacaaacgcttggcctatttttcatttttttaatccttctaagcttctccattcggcggagatggtatctaaagttccggctgaattgaatcgaggtatgctgactggaagtttggatattagtgcgatgtcttcctttgcgtatgcatcgggtgctgaggaaatgctattgttgccagatttatccgtcagtgcagatggtcctgtgcaatccattttactattttcacgcaagccgctggacgaaatcaaaaacggaaccattgcacttacgaatacgtctgctacatccgtgaatttgttgaaaattttgatgcaaaaggcatgggaaggtcaaccttcctattttgactgtgaaccggatcttgacttgatgttggaacaggcagatgcagggctattgattggagatcacgcgattaaggcatcttggcgaagtgaagatttgtatgttacggacctcggagaagagtggaagcgctggacgggctacagtatgacttttgctgtatgggcagtacgacgtgctgttgctgctcagaatcctgccgcggtggctgaaattgcgagtgcgttccgcgcaagcaagcagcgtagtctgtcggacctgacgcctgttatttctgaagcatgcgaggaaattggaggtctgcgagattattgggagcgctactttactaatctgtgttatgattttggagagaagcaacaacaaggtttagagctttattttcagtatgcgcatgaactggggctgcttgaccgacgagtgaagccgcttctctggagtgacaatacgctgacacgggtgaaagaatgaaacgattggatttgtttggtttattaaagaaggatatgaactttatagaagaagagttgtaccgcagtatcgacagtacggagccgttgattaatgatacgtcgcttcatttgcttaaagcagggggcaagcgtttgcgtcccgtatttgtattgctgggaggcaagtttggagaatatgatctggacaagctcaagcgtatagcggtacctctggaactgattcattctgcctctctcgttcacgacgatgtgattgacgatgcggaaatgagacgcggtcaacccaccgtgaagtccaaatgggacaatcgggtggctatgtacaccggagactacatatatgcacgtgcgctgtctattgctgctggactgccgaatcccgacattcaccgggtactgtctaaagcgctggtgcagatgtccattggtgaaatggaacagattcgtgatttttttaatgtggatcagagtgtgcgtaattatttgcttcgcatacggcgcaaaacagcattgttgattgcggttagctgccagttgggagctatggctgcaggggcgcgagaaagtatcaattccctgctgtacagctatggctataacgtaggtatggcttttcaaattcaggatgatctgctcgatctgtgtggcacggaaaaaaagattggcaagccgccgggcagcgatatgagacaggggaatattacgcttccggtgatttatgcgctcgaacagcctgagctgcgtgcagatctactggctgaaatccgccgcattcaggatggggatggacaaggagatgcacgcaaagcggtggatatgatcaaaaaaagtgaaggaatcgctaaagctgaaattctcgccgaccgatatattaataaagcgctaaacgcgctggacttactaccggatgtcaaaacaaaaaagacgctacgcgatattgctcattttgtaacacgccgctcctactaaagttgtgttttgggtttgctgtgacaaaatactttaaccgtttccaagctttctgttacaatacagtttagtactgtataaatacattagattggattgggagtgagccgatggatcgtacttttttgatggttaaaccggatggtgtacaacgtggactgattggacgtatcatcagtcgtctggaagacaaaggcttcaaaatggcggctggcaagcttgtgcaagtatcaagagaacaggcagaacggcattatgcagagcatgtgggcaagcctttttttgaagagcttgtaggctttatcacatcaggccctgtgtttgctatggtatgggaaggggataacatcgttacgctctcccgcttgttgattggtaaaacacaagtaaccgaagctcttccgggcacaattcgtggagactttgcagcacatacaccgtttaacctcattcatggttcagattcaccggagagcgcagagcgcgagattgcaaattttttcctgccggaagaatccgttcggtatgaaaaaagtgtggcgacctgggtataagtttaattacgtatgaagaaggatggtagcatgacggatatggaactgggtcagacggaccccgattacacagcgtttatccgcaaaatcaaggacagcacaggtattgatcttgcacaatacaaagaagcacagatgaaaaggcggttaactacgcttcgcaacaaaaacgggtttcccagttttgtttctttttatgatgccatgatgaaggaaaaacctctattctatgaatttctggatcggatgacgatcaatgtttcggaattttggcgaaatcccaatcggtgggaagtgctgcgggatacaatcttgccacaactgcttgtaggaaagcagaagcttaagctgtggagtgcggcctgctcgactggtgaagagccttatagcctggctatggttctcgacggaaaagggattttggggaattgctccattacagcttccgacattgatgatggtgcattggcaaaagccaaggaaggtaaatatttggagcgttcgctcaaggatgtacctgagcaggtagctagcaaatatttcaagccggatggtgcgatgtatcgaattgatgaccgtttgaaacaagccgtgaaatttcaaaagcaaaacttgctgctggatcggtttgaggatggctatgatctcattatctgtcgaaatgtaatgatttattttacagaagaggccaaacatacgttgtatcaaaagtttgcagccagtcttcgtcccggcggtgtgttatttgtcggtagcacagagcaaatcttttctcctaaccaatatggtctggaatcgacggaaacctttttttatcgaaaaaaagcataagcctgcgtatatcatccaaagttttgtaggaacttatttatatctttgagtaattgatggttggcttatcagcaaagcacgtcctttagcccctttggctaagaggcgtgtttttgtttatctgcatacacgtggcttttcttgtcaaagaaaggtgcgtatactataatgaagcacagttaaagattttagcgatgcacagtttaacagtttaaagggggaacgcgtcatgagtttacgttatttaaccgcgggggaaacgcatggtccccagctaactgccattgtagagggtatgccgagcaatttaaaattggattttgaggaattgaattttcagctgcaccgtcgtcagaaaggatatggacggggtcggcgtatgcagattgaaaaagatacggcgaaaattgccggaggcgtacgtcacggctacaccacgggtgcaccgattgcgctggttgtggaaaataacgattggaagcactggcagaacattatgaatattgagcctattgaaggcagtgatgaagaaaaacgtcgggttcaccgtccacgtccgggtcatgcggatttgaatggcggaatgaaatacaacctgaaggatcttcgtaacgtgctggagcgctccagtgcacgcgaaacagcaattcgtgtggcatgcggcggtttggcccgtcaattgctggctgagttcggaatcaaggtggcaggtcaggtcatccgcattggggaaatcgaagctccttaccgtgatctgccgattgatgagctgattgccgtgacagaagcctcctcggtgagagtaaccgatccagaaaccgaaaagaaaatggaagcatatattgatctgatcaagcaagaaggtgattcagtcggtggggtagtggaatgtattgtagaaggtgttccgattggtctgggcagtcatgtacagtatgatcggaagctggatgcacgtatcgcacaaggcgtcatgtcgattaatgcatttaaaggcgtggaaatcggcattggctttgaagcaggagaattgcgcggttcacaggtgcatgacgagatcctatatgatgaggaacgtggatatcaccgtcgtaccaatcgtttgggtggttttgagggtggtatgacgaatggaatgccagttgtggttcgtggcgtaatgaagccgattcccacgctctataagccgttgcaaagcgtcgacattgatacaaaggaagcgttcactgcacaggttgagcgttcggatgcatgtgcagtacccgcggctagcgtagttatggagcatgtggtagcttgggagattgcgaaagctttgctagaaaaattcggcggggattcgattgaagagattcgtgcgaatattgcatcctacgaagaacaactggggcggtactaagatgagtacgctgacggtacagcttggggaacgttcttatcctattcatatcggacgagggctgttacatcgagccggagagttgttgaaggaacgaggaattgcgcaaaaaagcccgttgttgattgtttctgatgaaaatgtagcgggattctacttggcaacattggagagcaatcttcaggcatctggctacaagacagtgtcctttgtcgttaagccaggtgaaacctccaagtcgctggctgtatttgagcaggtcataacagcagccattgagggcggcttggatcgcaattcagccgttattgcacttggtggtggtgtggtgggcgatttggctggatttgtggcggcttcttatatgagaggtgtcaagtttgtacagatccccactacgatccttgcccatgacagtagcgtgggcggtaaggttggcatcaatcatcctttggcgaaaaatatgataggagccttccatcaaccggaacttgtgttgtatgacgtagatacgttgtcaacattacctcctcgtgaggtatctgcggggcttgctgaaatgatcaagcatggcttgatctgggatgctgatttcgcccagtggtgccgtgaccatgcgactgatttacttgcgctggatgcgacagctctggagtacggtctggaaaagggatgttccgtaaaagccgaagtggtgtcgcgcgatgaacgagaaaatgatttgcgcgctattctaaacctaggtcatacgattggtcatgcgattgaagccattgcgggatatggtgagtttttacacggggaagccatttctattggtatggtcggctccgcacttttgggcgtgaagctgggggcagatccttctttggtagatgaaacgaaggatatgttgtcttcgctacggctaccgacctcccttccgtcacatctcgatacagatcggctactggacgcgatgatgcatgacaaaaagttcaaagaaggcagcattacttttgtcgtcccacgtagcatcgggcacgtggaggttgtgaaggatatttccgtctcttacatccgacaagttattgaacagttaaaagagggggcgtaacgatgtacaatcggggaattcgtggcgcgacgaccgtagtgaataatgaagaaaacgaaattttggaagcaacatgccaactactggaggaaattgtatcctacaatgaaattcagccggaggatattagtaacgtatggattacggtgacccatgacctggatactgcctttccagccaaggccattcgtcagcttgatggctgggatatggttccgctcatgtgtgcattagaaattcctgtggcaggcagtttacccaagtgcatccgtttgatggtacaggtgaacaccgataaatcccagcgggaaattaaacatgtatatttgaacggagcgcaggcgttaagaccggatctggcttcccaagggaaataagcgcccgtttttaaagttgatggttgccaaagtaacatcccatgagatatagtgtgtgtagcagagttaagtagagtagagttagccagagacagagttgagatgagaagagtgcagccttagccaattccatatgagattacagagaccggcggtagcaggtaagcttttgtctatgaagagatattcttctacagagaagcttatttgaaggaacctgcgtgtttatacaaaagggatgagtgtatacttatctatttgctgtagtcatttacatatggagcattcttataatttcaataactgacagcctctaccttaccggtagaggcttttttatattctctcctatggttctgcgccaatttggaaaggaagtgatctcatgttaacgccgcatgtggagcaagtgataacgatggcgaatgaatttaacctgattcctgtgtacaaaaaagtgctggctgatatggagacgccgattcggattttccgtcggtatgccgagcgggaccgtgcctttctgctagagagtgtagagggaggcgaacagtgggcgcgacattcattcatcggtacagacccgtttctaatggtctcgggtaaaaaaggacgtttaatattggaacaacacggtaaacggcaaatattaaacgacaagccgattgaagcgctcaaagcattgcttcgtaaataccgtagtccgaaactgaaagaaatgcctccatttacaggcggggctatcggattttttggatatgacctgcttcaatattatgaaaagctaccagagcattcggtagatgatttgaatatggatgatattcgttttatgttctgcgatcaagtcattgtttttgatcatgtgaagcagcaaattttgctggtcggcaatgttcatgtaggcgaagggttccgcgatgaggacatccgtgctgcttatgctgacgtggaacgcaagttggaggaaacggcacagtatttgcgcaagcagtctcagcctgagcgattaggatcagcctccattcctgatgatgtggaactgggtgagatccaatccaatgtgacgaaggaacagtttatatcaaacgtagagcaggcgaaggagtatatccgctccggtgatatttttcaggttgtactatcccagcgttttcacattgatacagaggcctcacctttacaggtataccgcgtgctgcgcacgatgaacccgtcgccatatatgtattatttgaaaatggatgacgagatcatcgtaggcacttcgcctgaggcactcgtcaaggtggaaaacggccgggtagaaacccgtcctattgcaggaacgagaccgcgtggggtaacggagacagaagatgtggcacttgctgaagaactgttaaacgatgaaaaagaacgtgcagaacatctgatgctggtcgatttgggaagaaatgatttgggccgtgtatcacagtttggcacagtcaaatgcgatacgttcatggagattgaacgctattcccatgtcatgcacattgtatccaatgtgtcaggtgagctacgggaggacaaagatttcttcgatgcttttctgtcttgtctgccagccggcaccgtatcgggggctccgaagctacgagccatggagattattgctgagttggagcgggaagcacgcggaccctatgcaggggcgattggatatttaggcttctcaggtaatatggacgcttgcattacgattcgtacgattgtgtttaaaaagaaccgggcctatgtccaggcaggcgctggaattgtgtgggactcggttccggaaagcgagtatcaggagacggtgaacaaagcgaaggcattgctgaaggcaatccgtactgcagaagtgatgttcccggcaacgacgcagccctataacagcgtcatcaaccaggattatttgtacactccgtaacacacaaaaatctgattttgaggaggagacgacaatggaacgacatgacatgatgcaagtggggttaagccagatcattgagggacagcacctttcgcgtacggaggcccgtagcgtaatggaacagattatgagtggaagtgctacacaggcgcaaattggcgggctgctgacggctcttcgcctcaaaggggaaacggtagatgaaatcactggttttgccgaggctatgcgtagctacgctagtccagtgcaagctgaagaaggcagcggtcgtctgctggacacatgtggaaccggaggttcggggattcacaagtttaatatttccacgatatccgcgatcatcgcagcttcggtgtctgtacgggtagcaaagcatggcaatcgttctgcaagtggccgtgccgggagcgctgatgtcctggaggcattgggagtcaacattcatttgacgagtgatcaggctaggtcatgtctggaccgaatcggcatctgctttttattcgcacagctgtatcatccgtctatgaagcatgccgccgcgccgcgccgcgagctgggtgtgcggacggtattcaatatgctaggtcctttgacgaatccggctggtgcggatcggcagctgttgggtatttatgacgccaacaaaacggaagtcattgccgaggtattgaaccagctcggctccaaacgggccatggttgtcagtagtctggatgggctagatgaaattagtatttcagctccgacacgtgtatccgaactgaaggacggcaaggttcacacgttcgagcttcatccgtcggatctgggcttgcagacgcattctcttgatcaggtgctgggcggcgacgcacaggttaacgcagatatcatacgacgaattttaaacggagagcatggagcttatcgggatgttgtgttagcgaatgcaggagcgtgcatttatgtatcaggtgcagcggctaccttgacggacggagtagcacgagcggcagaagccattgactcgggactggcaatttccaagctggatcaattaatacaggcaacgggggaatatcaatatgtatcttgacaaaattgtggtgacgaagcgacaagaagtggagcagcttaaggagcattttcaaataagtaaagctgaacgattaattgctgatttacctgcgacgagaggattcgaaaatgcgatcgcgagcagacgcaatcgtccgctcggactgattgctgaggtgaagaaggcttccccatccaaagggctgattcgaccggatttccatccggtggacattgcacgtgcatatgagggagcaggagcggattgcatttctgtactgacagatgtgacgtattttcaggggagccctgaatatttacagcaaattcgcgatcaggtgaagattccgctcctgcgaaaggattttatcattgatgaacggcaaatatatgaagctcgtctgctgggagcggatgcggtgctattgattgccgctatcctggaaccccgtgtattaggatcctttttacagattgccaaggacctcgggctggacgcgttggtagaggtgcatgacagtgaggagcttaaagcggtgctggagctggggacagcaaccttaattggcgtaaataaccgaaatctgcggacattcgagactcgtctccagacgacagaggagctgatctcactaattcctaaaggggttacgtttatcagtgagagcggaattgcgggaccggaagatgttaattatctgcattcggtaggtgcacacggtatcttggtgggggagcatctgatgcgcaaggaagatgtaggacaggctgtagccgaattgatggacggggttaaagcatgaacaaaacgggcataaaaatttgtggacttcaaagcgttgaagtgctaaaatctatggtaaacttaccggtcgattatataggttttgtgtttgctgacagcaagcgccggattgacggcgtacaggctggaaagctgcttcgcgtattagatgaatggacctcaggtagcagaccgcgcagcgtgggtgtatttgtgaaccctggtgatacactgttaaatgatgtgatggagaaagcacccttggatgtcatacagctgcatggacaggagagtccgcagcgctgtcgggagattagggggcattttggtatacaggtattcaaggcatggtctgtggacagtcaaggacaaacagaacgctcggcggacgaattggatgcctttgtcgggacaattgacgctttattgctggatacatacgatcccctgtatggcggcggctccggaaaaacgtttgcgtgggatcgaattcctgcctatcaggcttggacccatcaacatggaattcctttgtttgtagccggcgggttgactgccgataatgcggaaaagctggttcatgagtatcatcccgatgggctggatgtatccagcggtgtagaaacgaacggagtcaaggacattgcaaaaatcacagcatttgtagaaagggtgaagcaggcatgacacaattacctgataacaacggacgttttggaacatttggaggacgttttgtaccggaaacgttgatgaacgcactgattgaattggaggaatcctaccgtaagtacgcggatgatcccaagtttaaagcagagttgaacgggctccttaaggactattctggtcgggaaatgccgctttatcatgcggagcgtctgagtcagcatttgggcggagctaaaatttacttgaagcgcgaagatttaaatcataccggtgcccacaaaatcaataatgcattagctcagggattgctggcgaagcgtatggggaaacagaaggtcattgctgaaacaggcgcaggacagcatggtgtcgcgacagcgactgtggctgcgttgctcggattggaatgcaaggtgtttatgggcgaagaggatactgtgcgccagcagctgaacgtctttcggatgcagcttttgggtgcagaggtcattccggtgacatcaggtacacgtacacttaaggatgcagggaatgaagctttgcgttactgggtcagccatgtccatgatacgttctatattttgggttcagctgtcggcccacatccgtatccgatgatggtgcgggacttccaacgcgtgattggtgatgaaacacgtcgccagatcctagagaaggaaggcagacttccggatgtcatcgtggcagcgatcggtggcggaagcaatgccatcggaatgttttatccttttattgaggatcagggtgtcgcattgattggcgtggaggccgctggaaaaggtgtcgaaacggaattccatgcagctacgatgaccaagggaacacaaggggtcttccaaggctctatgagttatctgcttcaggatgagtacggacaagtgcaacctgcgcattccatctcggctggattagattatccaggtgttggaccggagcattcatacctgaaagatattgagcgggccaagtatgttccgatcacggatcaggaagcgctggatgcgcttcagctcctctgccgtaccgaaggaatacttcctgcattagagtcggcacatgcagttgcgcaagtcgtcaagctggcaccttcgttgacggcagatgatattatcgttatttgtttgtctggacgcggggataaagatgtggactccattatcaagtatttgggaggaaatccgtcatgaatttaattgatcaggcgtttggtcgccttaaaaatgaaggcaaaacggcattaattccttttctgacggtaggcgacccggatgtggatactacaatagagatcattcggcagttagagtcggccggagctgacatattggaactgggtgtaccctattccgacccgctggctgacggtcctgtaattcagcgcgcgtctgagcgtgcactgaaacggcaaatttccattcgcacgtgcatggagacagcttctctggccagggcggcaggttcaagtctgccttttattctgttcacgtattacaaccctgtattacagatgggcatggatgctttctttgcaggcttgcaggagcacggtatcagcggtctgattattccggaccttccgcttgaggaagcggaggagctgggaggacgggccgcagaggtgggtgtgcatctgattcctctggtggctccaacttctgaacagcggatcgaacgaattgtccgtcaggcccgtggatttgtatactgtgtatcttcgctgggtgtaactggggaaagagcttccttttttgaaggtatagagggctttatcgcgcaggtcaaacggcatacggatattccggtagcggtcggttttgggatctctactcaagagcaggtagcccggttttcaaacatttgcgatggagttgtggtcggcagtgcaattgtacgtcaggtggaggaggccattccattgctgaatgattctgtgcgcaggcaagaaggtcttttgcaaattcataattttgtggcacaattaaagcagtaactgtcaaaatagaaagtaataaatatgttctgattggatagaggaggtaggggcatgcaacctaaaccgcatattgtacatttgccagtatatcagcccggtaaaccgattgaagacgtaaaacgtgagctgggactcgatgaagtcatcaagctcgcctcgaacgagaatccgtatggtagctctcccaaagtgttgcaggccattcagcaggagtttgccaacattagtgtatatcctgacggaagtgccgtagctttgacacaggcactagctaaacggacgggtttaaaagaggaacagtttatctatggatgcggatctgacgaaattattgcgttgattacgcgcgctttcctccttcccggagaagaaagcattatggccgatcagacattttccgtatacaaaagtaatgtggaaattgagggagcggttgcagttgaggtgcctttgcgtgacggtgtacatgatttggatgctatgctgtcccacatcaatgaccgtacgaaaattatttggatctgtaatccaaataacccgacgggcacgattgtacccgaagcagagctgattgcgtttttggaccaagtaccaaagcacatcatggttgttctggatgaagcctacgccgagtttgtgacggatcgctcgtatcccgacggcattggtttgttgccagcgtatgaaaacctggttgtactacgcaccttctccaaaatctatgggcttgcttcgctgcgcattggttatggtatgggagccgagtcaatcattcgcttgataaatcaggttcgtgaaccgtttaatacatcacgggtagcacaggctgctgccattgctgccttggaagatcaggaatttgttcaagaatgccgggatcgtaatgcagagggcagagtttatttgcaaaatgaactcaagcgtctggggctggagtctttcccggcacatggtaattttattatgctggatgtacgtcgtccatccggtgaggtattccaggagttgcttcgtaaaggtgtgattattcgcgcaggtcatcataaatatccgacatatattagggtgtcggttggatcacagccgcaaaatgagttgtttattcgtgtgctggaacaggtcctgggggcggaagcggcgaaagtacgcctataatttccgcagatgggatttgataattgatgaagattgccattttcggcgtgggactgattggtgggtccctcgcactttgttttaaagggaagccggatattactgttgtcggccatgcccatctccctgaactgatggaaccgatgttaagccgtggtgtcgtggacaccgcgactctttcggttgaagaagcggcagaggatgccgattttatttttttatgcgtacctgtgggcttattggaacattatctcgaactgttaagcaagctaccgcttaaaacgggttgtattattactgatgtaggcagcacgaaatcggcaattgccaaaaaagcatcagaaatttctttgcgcaacgcttactttatcggtggtcatccgatggccggttcggagcgttccggtgtaaaggctgcttccgcattgttatttgaaaacgcatattatgtgctttccccagcagagggtgtgcctgaggaagcatacagttcactggaacgtttattaaaatatactagtgctcatgttgtgcgtgtccaacctgatatgcatgatgatattgtcggtgcgattagccatcttccgcacattattgcagcggcgctggtgaatcaggtgcgaaagcacaatgatgaaaatccgttgtaccgtacattggctgcgggcgggttccgtgatattacacggatagcctctagtgatccggttgtgtggcgggacatcttactgagcaatcgtgaagttttactaggcctgttggaagaatggaacggacagattgagcgttttacccatttactgagaatacaagacggtgagggaatcgctgacgagtttttgacagctgggcacttccgcagtgaactgccagagcgtcgcaaaggagttatcgtctccacgtttgatctgtatattgatgtaccggataccccagggattatcgggcgaattgctatggaactcggtaatcacagcattaatctgagcaatatgcaaatcattgaaagccgggaggatgtcccaggtatcatgcggctttctttccgtcaagagcaggattgggagcgtgccaagaccctgctggattcgatgggctataaagtggtggtttagaaaggaaagtgtgtgtccgttaaggagaccgtttcgcgattcatttgatcttacgatcgctgttgcaagggggggtctctggactttttaaattatctaaaggtaagaatccccctgcaaaggcgaacgctacgcttctctagattcaaatggatcgctgtgctacggatcgccttaaaagtcactatgctttctgggagtgaaataataggaaaaatttttaaagcgggtgaagaaactttcgcccgcttttttgttatttaaagaacaaatgagacaatccttctcactaattattattaaagaaaacaaaaaaagaccacccgggtaaagccccgggtggtagctacttttagtgaagtagctgagtaggataggagtggagagaaaccatactgtacttttattatatgtatacgttttcattttgtcaataatttttttgaagcgttttctttttgcgtatttatccttattggtgcatttgaatagaatactttcaatgggtttgtcatttaatcttgaaaaaatttaaaatcccctgaaaagctgtataaatgaatcaggtgccagcgttagggaggcattgatagaaatcgtggggattttggacttttttactgacggacattttgtggtacaatgggtaagtccattttggatgttgaatattgttggggatagcaccgttaatattggcactacatagggtaagaaaataacaaatgttccatgatgctgtttcatccatttgcgcagagggcgcaactttttttgacctgttcggtatatatagacagaatcgaacgggaaaacagcacatgtatgggcgaggagggtctcactcggatgatgacagattcccagatgattcaggaaatcaaacaaggtaatgttgaggtttattcagaattaatgaggcggcaccaacgtaaaattttagcttttgtttatcatatgctgaaaagttcgaacctggaaatgattgctgaggacttgtgctcagaaacgttttataaagcgtatcggagcctgcactcttttcgcgaggtagacgcatcgttttccacttggttatatacgattgcacgcaatacggtgctaagtgagcttcgcaagcaccgtagcggtcaggttccattggaggagagcggttatgtaccggtagctccatcggatgtcattccggagcaggccgtccttcgcggtgagaaggtagagatggttcgtgaagcgatcaatagattgcctgagaagcagcgatctgcgctgattttgcgtgaatatgagcaattggattatcaggagattgcgactattttaggacagacggtcagtgcggtgaagtcattgcttttccgggcaagatccagtgtgaagacgcagttggagccttatttttttgagcctctctatgaggaaaacgaagggatgagcagccaatgaaatccagggacactgaggatttgttcgctacaggcaaaaatgtatcgaaacaagactcggagcgcagacgggccaaaagctcgtctgctgggtgggagcatggttcggaagaaaaagagtggaatttgtcaaaagaaaatcggtccgatattcgtgatatttcctttgaaataacagatgaaaagctagaggcaatgaatcgcagagtcatggatcgaatttatgaagaatcaccgtggcttgttccgggcgagcatcgacgtgcgcgtgtgaacccagcagcccgtaagtatatgtctgtatggatcgccggcttcttggccgtatttttatgtagcttcttgtttttgaactggaacggaagctcctctcaggaaaatccccctcaagcagctcctgtcatggacacaggtattttaccgacaggcctgttgaaaactacaagtacatctccacaatatcaataccacattaaagatgtgaatagtggcattatggacccgctggttgctagcattgttcctacttatccgcaatactggatgttgttgtctgtattggcacttgcgcttgctttattttctctgggctggatccatcgggcgagaagggtcagaaattagcaggacagctgggctccaatatgaattcataacaatgcctgaataacaaaacagcggaggaaacgacacgatgcttattggcttgatcagacatggattgacggattggaatgcggtagggaaaatccagggtcacagtgatattcccttgaatgaggaagggcgtcggcaggcacgcttgctggcagaacgattaaaggaagaaccttatcattgggacgggcttattacaagtagtctctccagagcgaaagagactggggagattattgcttctgctctgcatctcccgttgttagagcctgatgatcggctaagagaacgtgcttatggtcaggtcgagggcatgacccaggccgagcgtgaagagaagtggggagtcgactggcatctgctggatctagggcaggaaagcgatgcggatcttcagcttcgcgggctagcttttatggaagccatttggacggaaaatcgggacaagaatctgctggtcgtttcccacggcggttttttggctaatttgtataaggctctgtatcaggaaaaattcacggaacgaatcggcaatttgtcacttagtgtactccagcgtgaggatatggattgggcaccacttttgtataattgcacgaagcatttgcaagagaaaagtgactgtaactcaaaaagttagtaaaagaccaaggcttctacttatcgtaggagtcgtggtcttttttgttttttaattatacctttgcaaaaaaagaggtttagagtctgaacaatccgtcaaagctgtgggtacaacaggtaagaatcaattccggatgacagtccagtgacgaggcgatggaacaatgaatctggcggatatgctgacatttgcggatattgtgcatttgaacagaatcgcggtgtattacgattgtgactgtaaacctaattccaaacatgagttgatccaggggattttgacgaagctcggcagcagtagtttttttgagacgcaggtcaaggagctgaggttgtcagaggtaaggtttttgaacgcgctgctgttcgatgaccgaccgtatttcagcatggaggaattggttgcaatagccaaacagtctgttgaggaggacaagaatcctggtgagcggccaagggatattgtgacccgtctgcgttctagtggctggttgttcaatggttcgacgcacaatacgaggtatttgttccaaattccgttggatatgaaggagcgctttcgacgtgttatggtacatgacttccaaaacggaatgacccgggtaagcgaaccgtcgtcgtaccgggatgaagggcatctgctggcagaggatttacggcttttccttcaatacatggggcagcatgaggttccgctaaatcccgagggagcttggtatcgtcgcaatcagcagcagctgatggaacatttgcacattgcggagccgcttttgggtaagggaggatggcgtttcgggtatggctcctcttttaagttttatccagaccgaatggcactactttatgattatgcccgtcactccaagtacattgaggagaaaggggaccaagttgtgctgacggcaaagggagaagcgcatcaggagcatacaattgaggaagaaatgatacagctattcaggttttggttaagattgtataaaggagccgttcctaatttgctgtctctagtctactggattggagaatgtgccaggccctggacgtcctcagagtcgctttttgtacatatcggcccactgattcgaccgttttactatgatacgccccgttcggtctttgatcagaggattatacgaatgatgcttcacttgggtatgcttcgtcagggtgaacattcgacgggaccatctgtacagatgacggcctgggggctgaagttggcgggagagtgccgcattggtcggaacgactcgggtatacggctccattgacaagcagcacacatattgatagaatttcacccaaaatgagagggtgaagttgttgctgattcactataacggaaacatgccacagctccattcatctgtctatatggcagaaggagcaaaaattgtcggaaaagtaacgatcggtcaagattcctctgtatggtttaatgccgtactgcgcggagatatggcgcctatcatcatcggtgaacgctgcaatattcaggacggtgtcgtgggacatgtgaacacggatcagcccctgttgctggcggatgatatttcggtaggtcatgctgcaataatccacggttgtacggtaggcaaaggcactttaatcggtatgggggccattgtactcaacggagcggagcttggtgaatatgctttaataggagcagggtcggtcgttacggaaaataccaaaataccaccctatactctttctctcggtacacctgccaaagtggtgcgcgaattgacagatgcagatttgcagcggatgtcacgaacggcactcagctatgtggcgaaaggaaaagaatataggatctcttaaactcatgttggaggtgcatcctatggataaaatgaaggttacttatgaagtaatgttgggcctgtctgctgaaatggttttggacgaggcattacgtaaacaccggagtgaaaaactctacaaggatattgatgaggcgctagcctccggagatgaagtagcttttcgtcatcttacggatgagctgaaagcaatgagttagaacaatcttaggaatcctaagttggatttcagacgaatctttagttcaaagattataatcatcaaacctgactgtagcggcggtcaggtttttttgatacgcttggatatgatatagtctttgtaggatgggacctgtacaaggcaactgtcgtatgaacggaggatgaaggacgtgtcgttatcttatttgtggagccggtcgttcttgacgagccggccttttttgtggctgctgttctggtgtaatctggttggaacggtgtatgggtacatatggtatggggggcagttggaatatacgctaaattatcacccaatgtggcagattgtatttgtgcctgatagtccgacggcgagtctgttttttacgatctctatagcatttttgctctattctccgcgtctcaagagcttgaaggtcattcgccagatcatcgaggcgttggctgttgtcacgagtgtaaaatatggcatctgggcttcagctattattttttggggagttgcgcaggggggacatatgatatggcaggattggatgctggtggcatctcacacggcaatggcggtcgaagcactgctgttcgtgcgttttttcacctgcaaatggactgctttgtgcctagccacactctggacattattaaatgatacgatggattatacatttggtatatatccgtatcttccgaagacgctaacggatgatgtaccacaagtgcgtgcttttacctatatgctgacccttgtcagtattatagcggcatggcttgccatgtttgcgcgcaatcgaatgggagtagaagtggagaaatagagatgaacattgttataaaccaaaaagaatatatatttaaaaaaggaaccgtgatgatcataaaataagaaagagctttaatcatttagctaaacaaagttttggttttgattttgaagcttggtatcaattgggcttttggaatgataaatatatcccttacgtacggcagggcaactgtgatgctacgtatttgttcgcaatgatagtgtgaagaatttttaccctaaattcgcgtttgtttcagcacaagaatatcaatcgaaccggaaagtaatcataaaccacttggacattaaagttgagaaattgaacctggaagagcagtcggatttaaagttactgaaaaataaaagtgctagattaaatccgtattcactttttgctgcggaaagtagtgaatggctggttttattctatgccatctcgttttttaaagataaatttatgtatatacctcaatatgacacgattgtggttgcagattttgagggggataccatttgtcctaaagcaagttctagtctcggtaaccttgccatacagtaaggtgaggagggatgtcccatgattaggggtcaggcgttgcaaattatgatacgtattgtttcgagtgttgttttaactatggtcctgctgctgtccgtctgcgtccctccaggtgtggcagaagcgcgtgatcagtcaaaacccgtaggaaatataaaagagattgaggaactggatcatgcagctgcgatactgtaccgagatgtgatggacgggaacattgaaaaagcgcgcgcggatgtagccgaggtgagtcgatggtttggcactggacaggtgcaggcagcgttatctgtagaggccattcatgctttgtccggcagcatccttgaggtgcagcaagctacacagtccgtccaagcatcaccggatgaatgggtgaaggctgcggccaatttacgacttgcgacagatgcgcttgcacatccgcgtcagcccttatggcagcagtattataagattttaaaagaagatgttagtggcttgaacagccagtttgctaaaggcaacatgaagggtttcaaagctggagccgcggtgctggaggaccactatgagacgatccgtacagcagcattgattcatggcagaacaagtgaagttgtccgggctgattcatggatttcctacgtcaaaggattgggggatcagcaaaatgcagatgcctcagcgattagaggggcgttggatcagggaaatccgacgtttaatgccttgtttggacgtgaaaaagacgccactgccctggcgccatttatcccgcgtgaaagtgagcgccgggcagaattggcaatcggcatgattgttctgctggcgctggcctatgcaggttatcgtaaatatcgagctggtttctctggataacgatgcaaaattcgaatattcgcgtcgttggctgctgagccatccatataggttagcccatcgcccggatttccgggctattcctctttgaacccctctccatgtacatcatgcacatcctgtatgataataaacgcccgtggatcaaccgatttaacaatttggtgcaaacgtcgtatttcctgacgaggcacgacacaataggcaacatgcttggcctgcttggaaaatgcacctacagccggaataatagtaactccacgatccatgtccctaataataatatccgcaatgtccatcgtgtggtcgctgataatcataaaggccttggcagaataggccccttcttgtataaaatcaataattttggacgcgatgaacacggcgactaatgtatatagaattttttcttttggtatgtaaagtagtgaagcaccgataatgacaatatcaatgaccagcagaatccttcccatactccagccaaacttccggtttagaatacgagcgattatatccgagccgcccgtggtgccgccaaagcggaacacaatacctaatccggccccaagcgtaacccccgcatataatgaagaaagtataaaatcgtgttcagtttgaaatgttcccatccatccgaaatgaatcattttttcatacaaccacagaaaaaaagtgagcgacccgatacctacccctgtatatagaatttgcttgcccccaagcattttccacccaattaaaaataaaggaatgttcagcagcaatgtggagagagagggtgaaatcgaaaaagcataattgagcagcagggtgatccctgtaataccaccttccatcagtttactgggtattataaaataaagcagaccgaatgcatagatggcggtcccgagcacaatgggtaaaatcagtttaagctgttccatggacttggatatcttcatatgatccctcgcagtagcagtttaaggaagaacgacttcatgctgattttgctaaatcgcagctccttatatgtagtatacctttttacgaaagctttaaaaggctgatgactgtaagttggatcataagtacacaattaaaaaaaatttgttttaaaatgtgctttacgataacatatgaataaacctgcacatggggggattgcgtgattcatggaaaaatcattagatgaaattcaacgtgaggtagaccaatatatatctcaatttaaggaagggtattttagccctttggcgatgttggcccggatgtctgaggaagtcggggaactggcgagggaagtcaatcactcctttggcgagaaaccgaaaaaaacggatgaggcggacaattcgattgagctggagctgggggacattttgttcatcacagtttgctttgcgaactcgctaggtataaatttgaccgaggctcatgataaggtcatacgaaaatttaacacgcgtgacgcgaatcgctggaccaaaaaggacaccgattaggcgttttgtacatatgctgtaccaaaccggttacccggaggtgcagtgtcatgaaggcggaggaatacgttcagaaagcttatcagtgcattttgcagaacgattttgagcaggccgtggaatggtttgaaaaagcaatttcagctcagcctgatcatgcggagcattatttccggtgctcggttacctatgctcgtagtggtcgtttggagcaggctctcgcatatgcagagcatgcggttcgtctcgctccacagcaggatgaatatgttctccatctgcatgcgcaggaagccaggcagcatacggagaaggccagaaaaatgctggatgtcgacagagctacgccacaggtgcgtcaggatgcgattttgctactggaacgagcaatagccctcgatccgttatgtggggatgcttttttgttgctcgcattgatttatgatgaattgaatgagtataagctagctgtgcaggctgctcgcgaggcggctgcactgtttcctcacaatgtgcagcttgccaacctcatgaagaagttatgccagcagatgaatgaacagatctaacacaaatggatgcataaggagttgtagggatatgtcagaaccaataaaagtggctgttgtaggagcagcagggcgtatggggcgtgaagttgtcaaattggttcttcaggatgaggaactacagcttgtggccgcagtgaacagaacacatgccggcagtgatgccggccttctcgtcggattaccggaagcgggtatcgctattgtggaggacgtggagcaggctttactggatagtcgagcggatgtcatggtcgattttacggggccgcgttttgcgtacgcacatacagcgcttgctatcaagtatggagtacgtccggttatcggaacgacagggtttacccccgaacagattaatgaactggacaagcagtgtcgtgagcagcaaattggtggtctgatcgcgccgaacttttcgattggagtcattttgatgatgcggtttgcggctcaggcagcgaaatacttcccacatctggaaatcattgagtatcatggtgaccaaaaattggacgcgccatcgggcacagccattaagaccgcagagctgatcgccgaacagcgtgaagagctacgacagggtaacccggaagaggaagaaacgttagaaggatcacggggggggtactatcaagggttccgtgttcacagtgtccgtcttcccggtgtgttcgcacagcaagaagtaatcttcggagggtttggacaatctctgaaaattcgtcaggattcttatgaacgagcgggctatatgccgggtgttaaaatcggtattcagaaggtcatggagcagccagggcttgtgtatggatttgagcattacatcgattaagaatacgcgaatgatttgacgaacgaaattatagaatgaggcaggaggaactttgaatgttaaagattgcatttatagcgcatgaccgaaaaaaggatgaaatggtaaatttcataacggcctatgagcatgtttttacagatcaccagttattttcaacaggtacaacaggtctgcgcattatggagcaaaccaagcttcaaattcaccgtttcatgtctggtccgcttggaggagatcagcaaatcggggctatggttgcacaaaatgacatggacttgattatattcttgcgtgatccgcttatggcccagccgcatgagccggatattagcgccctgttacgtctgtgtgatgtacaagggattcctctggcaaccaacgttgcaactgctgaaatactggttaaggcgctagaccgtggcgattttgcttggcgtgagctggtacataaatataaaccggggattgaccagcaaggtgatataaaatgacactggacatcttgattttcggagcccatgccgacgatgcagaaataggaatgggaggcacgattgccaagcatacagccgctggtttaaaggtgggcgtttgcgatttgacgcgggctgaaatgtcatctaatggtgatgtggatactcgtatggcagaggcagaacacgctgcaaaagtactcggacttgccgtgcggacgaatctaggtctgccggatcgtggattatatgtaactccagaacatgtagctgcagttacagcagaaatacggcgccatgcaccgaaagtcgtatttgctccttattgggaggatcggcatccagaccatgtcatgtgcagtaagttagtggaggaagcggtatttaacgccaagttgcgacgttttatgccagaaaatcctgcggtacaggtagagcaattatatttttattttattaatgatattggcagaacggatttgattgtggatatcaccgagcattatgaagccaaagaacggtctttgttgagttatgcttcgcaatttcaggcagcacctggaaaggatacagtatccacacccttaaatcagggatatgtggaacgcgtaaaagctcgcgactcgttgttgggtcaacgcaaactgatttcgtatgcagaaggctttgcgtccaaaacgccatatctggttaagctattcacataagaattctatactggagcattttgcagaatgttaaaataaatcggcaggaaagttatcactgatgagcggaaggaggcagcttagcttgaatgacaaattgaaaattggaattacctgttatccgtcgttgggtggctccggcgtagtggctactgagttgggtaagttgctggcagaaaaagggcatgaggtccatttcattgccaatagcattccgttcagattaggcggggcgtttcagaaaaatattttttatcatgaggttgaagttaacgattattacgtgtttagatatccaccctatgatttgtcactcgcgaccaaaatggcccaagtcgcacaaatgaagaatttggacgtactccatgttcattatgcggtaccccatgcagtatgcgcttacttggcgaaggaaatggtgggtgatcatctgaaggtggtaaccaccttgcacggtacggacattacagtgttggcacaagatgagtcgttgaaggacctgattcggctggctattaacaaaagtgacgctgtgacagcggtttccaaggatttgattcgggagacgatagatgcgttggaaattacacgacctattgatttaacctacaattttgtagataaacgggtatattatccacgagatgccgcggcgcttagaagagattttgcccaaccgcatgaaaaaataatgatgcatatttccaatttccgtcctgtcaaaagggtgggagatgtgctggatatatttgaaaaagtgcaacgtaaagtacctgcgaagctgctgttggtgggagaaggaccggatcttccaaaaatccgttgcaaaatcgagaatttaggcctgcaagataaggtcttctttttaggtaagcaggatcagatcgcagaagtgatttctatggcggatgtgctgctgcttccctcggaaaaagaaagttttggtctggttgcactggaagcaatggcttgtggagtgccgacaatcggttctcaggcagggggagtacctgaactcgttgtgcatggaagtacggggtatcttgctgaaatcggtaatactgaggcaatggctgattatgcagtagagctgttgtccgatgaagcgatggcggaacgtttccgtgaagcgtgtctgacccgcgcccgtaccgttttttgtgatgagctgattacccgtcaatatgaagagatatattaccgtgtgttaggacgcgaggtgccggatcttaaaccgatcagcgtttaagagggcggactcgcgtccgtttttttatattgaatacttgcaaagggggaaaccctatgaatacaaatacttggcaatatgctgaccaagagatggcatttcatggcagagaggtcatacatacactaaccgcagcaggccacgaagcctactgggtcggtggctgtgtgcgggatgagctattaggaagagccattcatgatatggatttgactacttcggctgagcctgaacaggtcatagcgctattccctcacgtcattccgacaggaattcagcatgggacggttacagtcatgcagggtggccatgcgttcgaggtaaccacttttcgaacggaaagtggttatgccgatcaccgccgtccaacggaagttgccttcgtaaaggatatccgtgaggatttgatgcgacgggattttactatgaatgcgattgcgatggcagaacacggagagcgggtggacccatttggaggagaagccgatttacgagccgctctcgttcgttgtgtaggccgagccgaggaacgttttgaagaggacgggttacgaatgctgcgttgcatccgttttgcctctgtgtttcggttccgggttgcttacaacacctggaaaggcatgattcggcgcaaagagggacttcgttacatagccatggaacgtgtgcgggtcgagctggaaaagatgctagcgggccctgaccctttacgtgggttggagatgctgagccgtagcggattgctcggttgtacgaaggttccggttccttgggaacaatgtgaagcatgggcgctcaaggggatcgttcaactgcaagaagaactgcggtggggcctgctcttaatgtcttgtagacttacctcagaggcagcggacgagctactaagagcttggaccttttccaacgcggtacgacttcggctggttcatctgctggaatgggagaccgaattaatctacagtgctggtgccatagctggcgattccgttccggggaagtctggcattgtcaacgatgaggcgctgcgtcgtagctggattcgtctgctaattagactgggaaaagatacagctttagactggcttgatctttacaagacactgcctgcttcattccgcggattaccgccgtgggtagaaaagcatgtggcgaaaacagccgaattggcaagctcgtggacaaagcaggctgtagtcgttcgtatcaaagatttaaatattacaggaaatgaactggttcaggcgataaatcgaccaggcggaccttggctgggtcagatgatggaacagcttttacaagctgttgcctgcggagatattccgaatgaaacagaaacattgcttcaggaagcgaaacgggtgatgagtagtgaataatcatgaaagattgttaggcatactggaggaaggtacatccgattacgtatcaggggaggaaatcagccgacgcctctcggttagccgaacagcagtatggaagcagatcaacaaactgcgtgagttgggctacaacattgatgcctcctcgcgtcggggttatcaattgatatcccgaccggatcggctgcaagtctccaaattggccgatatgttaaatactcaatcgtttggccagcgtattgttgtactggattcgacggtttccactcagcaagatgccatgcgtttggcagaagaggacgcgccagaggggacagtagtgcttgcggaggaacaaacggcaggtcggggacgtttgggacggaagtggtattcccctcgtggcaaaggagtctggatgagcattgtgttgcgtcctacccagcccttggcttttaccccccagctaacgctacttacaggtgtagcagtgtgtagagccattcgtcggctgacgggtgtggaggctggtatcaaatggccaaacgatctgctgattcatggtcgcaaaatatccggtattctgctggaatctgcaacagaggatcaacgggttcgatactgtattgcagggattggcattgatgtgaatttaaataaagaagattacccagaagagttatcgcaggtgggaacgtccttgaaaatagaagcagggcgtgaaattgaccgtactgtgctgatcgcctcagtgctggaagagatggaacagctaagtaagttgtatgccgagcaggggttccagcctatagccatgctatgggaggctctgtccgtgactatgaaccgtagcatacgggcacataccggacaagggataattgtagaaggtacagctgttggcttggacccttccggagcgctcgtgatagaaacggatcagggagagcgaattcaggtcatttcaggggatatacaattgtagaagcaaccctagctatgaaaatgaccaaaatcgttctattccctgtgcaaaacttcacgtgaaaaagctgatgttttttgttatactgtgcaggaggcggcatcggacggtccgagctgcactccaggggcacatgctctactttagcaagtttgtaagaccatcataacttcatttgaaggttacgttggattctgctctgagccgaacaggaccgagacagaagggacgatctcaaaatgagtgtcttttttggctgttcggaccttttgatgacgcagatgtacaggcgttcataaaaggttattttttgtgccaaaaaaagatggaagggagccatttacaatggcaggaaaacaagcactgaatattgtgaaaatgaaaaaaatgaagcaagagggcattccgctcagtatgctgaccgcctatgattatccatcggctaaaatagccgaggaggcgggaattgacatgattctcgtgggtgactcgctgggtaacgtagttcttggttacgattcaaccatccctgtaaccttggatgatatcgtgtaccattcccgggcagtcgcaagaggcgcggaacatacatttatcgtagcggacatgccttttatgacatatcacagcagcgtttcagaaagtcttcagggcatccgccgtctgatgcaggaaggacatgtgcatgctgttaaattggagggcggagctgaaattgctgatgttgtaaaagcaactgttcaggcaggtgtgcctgtattgggacatatcgggcttactccgcaatcggttaatcaaattggcggctatcgcattcaaggcaaggacgaagcggacgcacgccggttaatggcggacgccaaggcgctggagcaggcgggtgcttttggcgttgtattggaactggtaactgaggaagtggcaacagcgatttctaaagagctttccattccaaccattggaattggtgctggacgtggatgtgacggtcaggtactcgtttatcacgatctgattcagtacgcatcgccttatttcagcaaacgctttgttaaaacctatgccgatgtaggcggcttgatccgcagcagcattgagcagtatgtgagtgatgtaaaagggcgggcatttccggccgcggagcatgtgttcagcgcggatgaccgcgttgtggaatccctgtatggtaaggcaaaaggacagacacaggaacaagctaaggaaaaggtggaatcacgatcatgatcatcgttagggaagtggctcagctgcgtaagattattgctgaacgtcggcagcttgggacaagcggaacaaaaaaggtacacggttctacctctttacagcaacataaagtcggctttgtaccaacaatgggatacctgcatgaagggcatgcgagcttgatgcacaaggcgcgtgaaatggcggatacggtggtgcttagcatttttgtaaatccgattcaatttggaccgaatgaagatctagacagctatcctcgcgatgaagctcgtgatttggaggtagcgcggcgcgaaggcgtggatattgtttttttgccaactgtagcagaaatgtatccacaaccaacccaaaccaaaattcgtgtatccggtttgacagatcgtttgtgcggtgcttcccgtcccggccattttgatggtgtgactacggtggtagccaagctttttaacatgataggtcctgatttggctttctttggaatgaaggatgcgcagcaggttgctgtgctccagcagatggtgactgatctcaatatgaacgtgattatcgtaccttgtcccatcgtcagagaggcggatggtttggccctcagctcccgtaatgtgtatttaagtgcagaacagcgcgagcaggcgttggtgctgtctcagtcactgcgtaaggtgcaagaagtgagcgaagatatagtaacaaacacaattacgattcgtcagctacatcaaatggtggagtccaccattacttcctctcctttagcagacattgattacattgaaatattaacttttcccggtctggagccccttcttcccgagcagcggctatgtgatgttcaggaagacgtcatcgtagcgctggctgtgaaatttggcaataccagactgattgacaatataagaatacagaatgcggaggtgctttcccatgtttagaaccatgatgaaatccaaaattcaccgcgctacggttacggaagctaacctgaactacgtggggagtatcactatagatgaagatctcatggagacatcggatttgttggagaatgaaaaggttcaaattgtaaacaataacaatggagctcgactggaaacctatgttatccccggaccgcgtgggagcggcgtaatctgtctcaatggtgcggcagcccgtttggtgcagcctggtgatacagtcattattatttcctatgcttccatgtcgaatgaagaggccaaaacatacaaaccaacagtggtatttgttgatgaacataataaaccagcccaaacgatgaacaaagaagtacacgcgacgatcatgtaatgaatgggagtgcggatgaaacccgtcttttaagcgaaaaatgtgagtgtattaatccatctttcataagggcgggatgcacatgttccagcatgtattcgcagaaatgaacagcatgttagatgatatcgtgaagcattacccatcagcccagggctcccgcaggcaggagctgctacagcactggagtctgctgcggagaatgagtgacggaattatggatgagtggctggcctttgaggaaaaaatggtttgcctgcgtgcggccgggttttccgcggagaccgatatgtctgacacggagttacctgaaaaagagctgccagcttttaatcgggggcaagggtattatcgattactcatgtaccctgaggcgatccaacaatttgagcaggtactacagcattttccgaacagctggcagagtcgcatgtatatgggaatggcctattttcaactagatgatccagcagaggctgtatgccattttcaggaggtgctggacctgactgagcaggcaggactgaaggcggtcatctataatgcgctaggctgtctgttggcaaagcaggctgacgtagaggaggcgcaaaaatgttttgctctcgcacatcagttcgatcctgcgttacccgagccgctgcacaatatggaagcctgtctgtccggtaccgaaaagcttcgatacgacagctccatgatgacgtggatgtagttgtcagacaccgagcaagacgatgcatgcccacctctcaggcggcgtgtgcatcgtcttttttggctgtcttaatttccaaacaggcgatcttctgctatgctaatatacagagttattatttttgtaagtgtcataagaaaggattagcccgaatgaaatttgcggtattggattttgaaacgacaggcacccagtccgcggatgacatcattcaagtcggacttgcaattatagatcatgataacagcatttcccgtgtttacggctcttatgtaaaccctggcagatctattcccccttttatcaccggattgaccggaattacagacgatgacgtcaaggatgctcctgctcttgaagaaatgatgatggagctcgtgcctatgctggacgatgttgtactggtcggtcataatgtggcgtttgattttaattttttgcaaaacgctctggatcggtgcggatatttaccgtttagcggaagaatcttggatacaatggattttctgaaaattatgtttccatcgctttcttcttatcagttgggttttgtgtcttctgagtttgggctggcgcatgatcgccctcaccaagcagacagcgacgcgttggctacggctgaggtttttttaaagtgtctgggtgagcttcaagcattacctttgataacgatacagcggcttagcgatttgtttgcagaggaagacagtgaccttggatggtttcttgatggggtgcgtgaagagaaagagcttgatcctattcaggatctggagggacatcagttttttcgtcagcttgcgctaaaagtggaagattggacggagctagctgctccgcgtagagaagatgacccgaatccactgtcgggtgtttcctttgaggagtacatggatgatgtgcgggacaatttgcgttcatccttgagccaatatgaggagcgcgaggcgcagatacagatgattgagggtgtaaatcaggcactgagtgaagacaagcatctactgatcgaagcaggtacaggaacagggaagtccctcggctatttgctcccatcgctgtatcacagtgtgaaaaaaggacagcgagttatggtaagtacacatacgatcaacctgcaggagcaattacgcgagcgcgacattccgatgctgaccaaggtgattccgtttccgttccgggctgctattttcaagggtcggggacattatttgtgtctgcgtaagtttgaacataaaataaacagaagagacttcgcgacaccaaaggaagatttaattacagctgctcagatgatcgtctggttgacgctaacagaaaccggtgatgatgaggaactgaatctgagcaaccgtggtggagatttctgggaaacggtggcgagtgattcagagtcctgtcttggtcgctcttgcccatggttccgcaaatgctattatcatcgtgcacgccatgaagcagggatagcggatgttgttattacgaatcactctaagttgtttacagacgtcaaagctagtcaccagttgttgccgagctatgaacatctggtgattgatgaagcccatcacctggaggaagtagctggtaagcacctaggtatgcatatgaaatatttcacactcgtgcatacactgacgcgactgttcaaagacagcaagaatggacaactgccttcacttcgtcaacagttggcgaaatcggggcacgagaagtcgacggattgggcctcaaccatcgatcagatgtatccgctcgtgttagaggttaaggaaacttgggacctgctaagcgacaagctgtttggcatgttgccagaacgaagcgatgcgacaccgggtgaaacaggacagttttcttcccgtctcaaaccttcagccaagcctgcaaagtgggatcaggcgggggctttggaaaatcagctatatgtaacgatgagtgaaattttgcgcaagggcgacaagctgatgctggacgtcaaggaagaacatgacgattatgcggcggatagccttattacagatatcacgggtctgctcaaggatctggcggggattcgagaaaatttgcgcttttttatgcgactcgatgatgaaacaaccgtatactggctcgaagcgagtgggcaattccgcagtaaatcattacaattttatgcggtgcccgtcgatgtgagccgccagttgaaagaaatgttttttgacaagaaaagaagcattattctgacgtctgctaccttatcggtagataagtcgtttcagtacatgatcgatcagctcggcttgcaggaggccgcagatcaagagcggctgatgacttcgcagctcccgtcaccctttaattacagggatcaggtgctgctggtcattccacgggatttcccaagcgtgaagggcagtgtaggagatgcacactttgtagatatgctcgttagctctctaggagcgactgctcaggcgacgcgggggagaatgctcgttctgtttacttcctatcggatgctccggcaagtgtatgagccgctgaaagaggccttagcatccagcgaaattactgtgctgggacaaggtgtggacagtgggagtcgcagcaagctaacccgccgttttcaggaagccaaagcttctgtattgctgggaaccagcagcttctgggaaggcgtcgatattccggggaaggctctgacttgtctggccattgttcgcttgccatttcaaccgccgaatcatccgttgctggaggcaaaaagcgagctgctccagcagcagaagaagaacccatttatgaagctgtctgtaccacaagcggtcattcgcttcaaacagggatttggtcggttggttcgtacagcgagcgaccacggggtcgttatcgtttacgatacgcgtgtgatcgaatcctattacggaaagcactttttgtactcgttaccgggaccaaaaatggagcatatgccatcggagcaaatggtgccccgcatcgccgaatggctccaatccgccccggagaccgaggcataacggacggacactaagtatgttcgttacaattagggggagcaagtatgaaatcagataaaatttcagaggctgtcgtacggaggttacccgtatatttacgttatctgaatgcacttcacaaacgggaggtggctacggtctcttctcaagagttgggacagaggctagatttaaacccggcccaaatccgtaaagatctcgcctattttggagattttggtcggaagggtatcggttatgatgtttcttatctaattgagaaaatacgccatatcctgaaaatcgatcagcaaattaatgtagtattggtcggagcgggtaatctggggcaagctctttcgaattataacgcttatttaaaagacaatatgaagattgtagcggtatttgatgcgtttccggataaggtagggaccaagatcaatacattggtcgtgcaaccgatggatgaactggaagcgactgtgaaagaaaaaaacattcgaatcgggattattaccgtacctgattttgaagcacagcacgtggctgacaggcttattgagagcggaattggagcgatccttaactttgcaccgactactctcaaggcaccggccaacattcggattcatgccacagactttacaactgatttgcttagcctcgcttattatttggaggacggaaaggaagaaacacaatatgacagtgaataaatggatgattaaaaatggctcttttgccgtaaatggaccagaatctggggtaatccatggttttatgattgtggaagatagccgcattacttacattggcgagactttgccttcgggtgaggaagagacggaagcgatcgatggtaaggggcttttgtttttacctggtctgattaatactcatggtcatgcggcgatgtctctgctgcgtgggcatggagatgacttggcacttcaagtatggcttcaggaaaaaatgtggcctatggaagccaagtttacatctacggacgtgtactggggtacgtcgttgtctgtgctggaaatgctgaaaggtggtacaacgaccttcctggacatgtacgatcatatggatgaggtggctcgtgtagctgaagagtcaggtattcgtgcaagtctgatgcgtggagcaattggactatgttcggaggaagaacagcgaatcaagctggctgaggccgtgacttttgcgcgtaactggcatggtaaagcagacgggcgtattacaacgatgatgtcaccgcatgcgccatacacctgtccacctgcgtttattgaaaaattcgtacaagctgcgcatgatctggatttgccgctgcatacacacatgtctgagacgatcgccgaagtggagcaaaacgtacgagactacggttttcgtccagttgcacacttggataagcttggctttttctcccgtccttcgcttgttgcccatggcgttcatttgaatgacgaagaaatagctttactggctgaacgtggtgtagcggtttcgcacaacccaggtagcaacttgaagctggcaagtggtgtggcaagagtgcctgaattgctgcgtgcaggggttaccgtttctctcggaacggatggtcctgccagtaataataacctggatatgttcgaggaaatgcgtctggcagcacttattcacaagggtgtatctggtgaccctacggcagttcctgcgagtgaagcgctgcgtctggcaacagaatacggtgcaaagtcaattggtttaaaagaagtaggagcgttggcagcaggcaacaaggctgactttatcgcgctggatctgaatcaggcacatttcttgccgcgtacagatcttatttcccatgcggtatactcagcaagcgccaaagacgtggttcacgtatgggtagacggtcgtcaggttgtgaaaaacggcgaatgcctgactatggacgaggaacgcatcaaacatgaggcacaagccgcctttgaagggctgctgtcgcgctaattcaggtgtcacatccccttagagaggaagcacgggtttgaaaaataagaaaaagtggatagcggtcgccattttggccgtaatactgatcctggtcagcattttctggtattattcctatgttactcaagaccaggtgactgagaaaaatgccgctatcattaaggccaagcaatcaggtggtctggttagcacgactcaaacatggaagtctgtgtgggatcaggtatattgggtggttcaagggaaaaatgcacaaaatgaaaatataatggtgtgggttccttttcaaaaagtggaaggacaacctaacgtacctgccgcagataatagcggtgttcacaccgaactgctgaagaatggagtcgatgagcaaaaaatgacggcaataattcagcagcagcttccaggtgcaaaaattgtaaggcttcagccgagtgtgttcaatggcgaatatgtgtggcagttgttttacgatgatggaagtcatcattactacaccttttatcgtttctcagatggggtagcgacgggtgtaaaatatactttgcccaataactgagctggttgaggattagcagatgtggaatgaatgactagtaaataattgaaagcttaagaaaaagacgtaaatgcgatgagattcgtatttacgtcttttagtcttgctatgccgtaaaatgggctgaaaaccagtgaagcatctttacctatccatcttctctcctagggcaaattcatctttatggcgggcagtacggagtggaggatttgaatctggagaagcggagcgttcgcctttgccgccggattttctcggtaagaatataatcgagaaaaattgggtggcaacagcgatcgtaagatcaaatcctacgctcagcgtctcgcctccaccttaaccaaagattttgcctcatcacaactcctccacacattgccttcgatattagatatacgttatgatatactatgttttataagtgatagacaaaaatgatagaaaaaagaattgctgatcgctgtaagatcatgcaatttggttgtttgttgacattcgtcccgtttcttctgggttttacattttgagaggaggatgttgtttgaaattgcgtgcagttcctatcgttgtggcggcagttttggcagctttgctgctatttgggggatggttcatttaccgtcaggttacaatgcaaagtcctctggaaaaactggtttctcaatatccaggcgtgacaagcgctcaaatagatattaaacaggatcaggttgtattgaaactagatctcaaaccgcaggcggatgtggccggattagtcgatgtggttaagcaaaaaggacaaaccatcattggcagccgtaccattaagctggatattgaagatcgttccaattcagcactaaatcaatggtggtctgaggctatgtttcctgtagccgaagcgatggaaaataaaaagtatactcaaatttcatctacagttgagcagatgaaaaagaaaaagacgggtatcaaagctgataccgacatggattcgaacaatgtctatatccgactcagcgaaggtaaagcgaccaagtttatcgttttgccacgtcaatctcagcaaatgggggtatggcctaatgcctagatggatcaaggaaacattaatcggcatagtgccggtgactattatatttctcgtttttattggggtgaatattatccctcttctagttgctggcgtgatgctcagcggcttgttaatgctcatgcatgcgcgtggtggcttggccgtaggtgctgggcaagaacgtaaacgcaaaaaaaatggtccggacaaactgacttttgaggaaatcggtgggcaggaaagcgctaagcaggagctgcgtgaggccctggactttttgaatcgacatgatgaaatttccaagtttggtatccgtccattaaaaggtgttctgctcacaggtcctccgggaacagggaaaacactgatggcgaaagcagccgcacactatactaattctgtatttgttgcagcctcaggtagtgaatttgttgaaatgtacgttggtgttggcgcgggtcgtgtccgtgagttgtttcgggaggcacgtactcgtgcagccaaggaaaagaaggaaaatgcgattatttttattgacgagatcgacgtaattggtggtaaacgtgagggtggacagcaacgagaatatgatcagactttgaatcagttgctgacagaaatggatggcatttattcggcagatacaccgcggattttgatcattgcagcaacaaaccgtaaagaaatgttggacagcgccttaacgcgtccaggacgttttgaccgtcatattcaagtggatttgcctgataagaagggccgtcttcatattcttaaaattcatgccaaaaacaaaccgattcaggaagatgcgaatctggacaaaattgctgaggaatcttacgggttttccggcgcacagctggagagcgtgatgaatgaagcggcaatctatgcgatgagacaggatcagaagatgattgcccagaagcatctgtcgatggcaattgacaaagtaatgatgggtgaaaagacagatcgagaatcgacgttggaagagaaaaaacgtgtagcgattcatgaactgggacatgctattatggccgaaattgttcgtcccggtagcgtaagccaggtagcacttagcccacgtgggaaagcgcttggctatgtgcgccacaatccacagcaagagcattatttatacaccaagcagttcctggaggagcagatcatgatctcactcgcaggggctacggcggaagaaatgtactatggcggtcgcagtaccggctcaagtaatgattttgagcaggcgctgaatatcgtccatacgatgatgacttccggtttgacttcacttggcattattaacatggaaatggtaaccaaagaagaacttatgcgggaaaatggcgagattatggctgacctgcatacccgaactttggagttgctggaaaagcatcgtcctgtgttcgacaactcacttgacatcctgatgaaggaagaaactctgtctggagatcaatttagatgtcaatttagtgaaaatgctttattaccagcataattttttatgctggttatttttttttacttttagtccgtgctaagatattattatctattgggacataaacatgtatttttcgacaaagaaggatacaatatatgagagtgaccaggaaagggtggagtaaagaatcatgcaatttaaaaaaatcggcgtcatcggcggcggcaccatgggacaggggatttctgaaatgctcgcgtccaaaggaatcgatgtgctgctggtagagcagacaccagagaaactagactacgcctacaatatgattgaaacgagtctggacaaacaactggaaaaatgggcaattactcaagctgagaaaaaattgatcttatcccgtattcaaaaagtaatccatttggcggagctcggcagctgcgatatggtcattgagactattacagagaatctggacgagaagaaagcagtgttccaagagctagactatgtgtgtccaagcaatattattcttgcaagtaatacttccacgctgagcctgaccgagcttgctagctcgaccaagtatcctgagcgtgttattggtatgcactttatttatccagtatcccgtattgatcttgtagaaattattcgtggtttgaaaacttcggacgatacatttgaacacactaaaatgttcgtggaagaaatagtggagaaaaaaggagtcatgatttatgaatctcctggattcgtaacaagccggattatctgtctgctgattaacgaagcggcccatgtacttcaagagggcgtggcttccgctgaagatatcgatgacgctatgcgaatcggctataacttccaaagcggtcctttggaaatggctgaccgctttggtctagattccgttttggctgctctggagcgtatgttccgtgaattcggcgaattgaaatatcgtccgtccatcgttctgaagaaaatggtgcgtgcaggtaatctgggcgtgaaatcgggcgaaggcttctttaagtacgacaaggatggtgaccggatatgaaaattctcgtaatcaatgcagggagttcttccctgaaataccaattatatgatatgacggacgagtccgttctggcaaaaggattggtagagcgaatcggtatggattcctccattcttacgcataagccaaccaataaagaagaatacaccgaagttagcgaaattttggaacatactacagccatccgtaaagtgctgaacgcactcacagatgctgaacatggtgtaatctccagtactagtgaaattcaggctgtaggccaccgtgtggttcatggaggcgaaatcttcaaacagtctgcagttgtaacgcctgaagcgaagagtgaaatccgccgcttgtttgacttggcaccactgcataaccctgcttccatgatggggattaaagcggctgaattgaatatgccagatgtaccgcaggttgtggtatttgatacctcgttccatcaaaccatgcctgaaaaagcttatatgtacgccattccaagagtgttgtacaataagtataaggttcgtcgttacggtgcccacggcacttcccatgattttgtaagtaaggaagctgccaaattccttggtcgtcctttggaagacctgaagattatcacttgtcatatcggtaatggtggtagtgtaacagcagttcaaggcggtttgtctgttgatacttccatgggtatgactccactggaaggtcttatgatgggtactcgtagtggtgatttggacccagcaatcgtaccttatgtcatgaacaaagaagaattgactgtcaatgaagtcaattccatgctgaacaagcatagtggacttttagctatttccggtatcagcagtgacatgcgtgaaatcacagaaggtatggaaaaaggcgaagctaattctacattggcattcgaaatgtatgaataccgtctgcgcaaatacattggatcgtatgctgccgcaatgaacggggtagacgtaattgcatttacagcaggtgtaggcgagaactccatcgttctgcgtaagagagtgttggagcaattgacattcctcggtatcgagctggatgaatcgttgaatgctattcgttctggcgagcctcgccggattacaactgcaaattcaaaggtagaagtactgatcattccaacgaacgaagaactggttattgcccgcgacacgttccgtctggttcagtagttcggttcgaaagtataaactttatgcatgcggacttacgtttgatttccgcatgcaccaaacagcgagagcaaacagcctgacccagggggaagggctgtttgattttcggttaagaggagagagacggtcatgacgaataaaagtacgattgcccaagtgggccgccatgtaggggaaacggttacaatcggcgcttgggtgaacaataaacgatctagtggtaaaattcagttcctgcaactgcgcgatggtagcgggtatattcaaggggttatcgtgaaaagcgaagtgtccgaggatatttggaatgacgcgaaatccttgactcaagagagctccctttacgttactggagtggtgcgtgaagaaccgcgtagccaatcgggctttgaattaacggttacaggcattgaaattattcatttgaccgaaaactacccgattacacccaaagagcatggtgtagatttcctgatggatcatcgtcacttgtggctgcgttccgccaagcaacgtgctgttctgatcgtacgggctgaaattatccgtgcggtacaggaattctttaacggcaacggctttacgaaggtggacccacccattttgactccttcctctgcagaaggcacaacagaattgttccacattaaatattttgatgaagatgcgtatttgacacaaagcgggcagttgtatatggaagccgcggcaatggcgctgggcaaagtatattcctttggtccaactttccgtgcggaaaagtccaaaacacgtcgacacctgattgagttctggatgatcgagcctgagatggcttttgtggatcatgaagaatccttgcgcgttcaggagcagtttgtaagtcatatcgtgcaatctgttctgaaaaactgtgcgaaggagcttgaaacaatcggacgcgatgtttcgaagctggagcaaattcaaggcgaattcccacgtattacgtatgatgaggcgattgccttccttcaaggtgaaggtttcgatattccatggggagaagactttggtgctcctcatgaaacggcgattgctgaaagatataacaagcctgtgttcattacacattggccgactcacattaaggcattctatatgaaaccagacccgatccgtccagaggttgttttgtgtgccgatatgatcgctcctgaaggctacggcgaaattatcgggggttcccaacggattgatgatccagcattgatggaagaacgttttaacgagcataacttggctcgtgaagcctaccaatggtatatggatctgcgcacctatggtaccgttccgcattccggctttggattgggcctggagcgtacagtagcatggatttgtggactcgatcatgtacgtgaaacgattccgttcccacgtatgctgtatcgtttgtatccgtaaccgatgaccggatcattcgacaagacatcagcggcagaatgggcggagggagtagcctttgctatggaagccggaatggtccagattccctacgccctgctcaagcattatcggacacttcggctgacggatggtgaaatgctgctactgatgcagttgcttgcctttaaacaagcggaacgtaatgaatttccgacatgggaacaattgcagtcacgtatcggatgcactgcgaacgaaatcgcactctatttcagtaagctcatgaaagaaggatttttgagaatcgattccgtagaagaccgcagctcatccgtacaattcgaacgttacaatttgacggggctgtaccgtaagttggcagaatgtatgatcgctgaacgtaatgagcagcacgatgaagatgacattttgtttgccggaaagccggatttactgaatggaatatcagaatccccgcttacagaagaacggaatttgttcacgatttttgagaaagaattcgggcgcccattgtcaccgatggaatacgagacgatcaccagctgggtggatcaggatcggtatcccgaggagctgattttgctggctttgaaggaagcggtatttgcagggaaagtacatttccggtatatagaccgtattttgctggagtggagccgaaaccgtgttcgtaatgcacaggatgcgaaagaatacgcccagcgattccgtggtggcggacgcaattgatatatcggtctaaataggctttaatgatagaggacacaccattccgtcaggagggtgtgtccttttttaaatattttttttcgaaatatgcaggggaaggaaatttcctggcgtctatagtattgggaagggggagagcgtcattgatatagagagaatcattgaacgaatacggtccggtgaccggcaggcgttccgtgagatcgtagagctgtacagcaagcatgtatttcatatcgcctattcggtactgcatgacagcaaggaagccgaagatgccgcgcaggaggcgttcgttcaggtgtacaagtctctcccccaataccggaacgaaggatttaaaacgtggctgagccgaattgcgctccacaaagcgctggatattaagcgcaaacagggcagacgacccgcagagcttatagacgtggcacaatcccttgtacagctcccttcccgggatgaggatgtgctggcccgtctcatccgcgaggagcaaactgtagaactatcgcaaaaaattgcccagttgccccagcaacatcgggatattattcaagcctattatatgcagggcaaaacttacgatcaaattgcagaagagacgcaggtagctttaaaaacagtagagtcgagactctatcgggcgcggctatggattcgaaatcactggaaggaggaggaatggcaatgactgaccaacaagataaaccgtggattgaagggaaatcgaatgactggcatgcttacattgcaggaacttgcacgatagaagaatctgcccggctggaaaagctactgctggaagacgaacaggcgctgatgttatatcttgttgcactggagcaactggagtcaactttaaaagattattctgcctggatggatacggagcgcttcacagatcaggtaatggccgttcttcccgagatagaagctgaaccgagtcaagttatgttcaaaaaacgccgctggtttgaaaaacctgtgtttcattatgttgtcgccgcaagcctaacgttgatcttgttgtccagtggagcctttgacaaaatgatgccgcaaacagacggaaagccgattcctccaaaagaacgcgtttcttacagtgaagaggtcatgcgagctacaacaacctggctcgataaattaaagccctaaatcatcggataaaggctgagatgaaaaactcaaaaataacaaccttcaattgggaactttatcaaaatcccataaatagaaaggaagtgtagcgatgccttatacggaaagaagcaagctcttggcatttctattgaacattattcccggtgtgggacactattattggacacgaaaagccaatgtgtttgtatacaccattttgtttttcggatgtctggcaggaggattatttcttgcattcgtagtaagagacgaatcgcctttattattcggtatgtttgttgccgcccttttttggggactcagcatgttgcatatcatgattagcttgttgcgttatgatcctcgtgcagtcgctgctccatacccccctcatgcagggctcaatccatatgatttttactcgcaaaatggaccttatggacaggctggtttaacaggggaggtaccggagggggcaacacacgcagatacggatgtaccgggagcaggaatgggatatggcccgggctataataaccattatcaacaaggacactatggtatggcaggatcacctgcttttcaaagaggatcggagaatgaacgcttttttacgattttgctgtcgttcattcctggattgggacaccttcatttggggctaatgcagcgtggtttgtcttttttactgtccttctttggctttggtgcgattcttatctttattactagcattactaacgaatccggatttttggcctttgcgggcgtgttgccgattatttggctgtattgcatgtttgatgcggtgcagcatgtacatcgcaaacaagctggagaaattcttcaggaccggactttgtttgaggaactggagcatggaagaatcgagggacgtcgaagtaaaatgctggctaccattttatccgtatttcccggtgccggacatatgtatataggtttgcaaaagcgcggactccaactcatgcttttgtttttaggaggcatctatgtactggatgtgctgcatctttcactctttttattcttgcttccggtggtttggttttacagtttttttgatgcattgcagcaagtaagccgttatggacgggagccgctgatcgacaaacctgtgatcggtatgtttgcacaatatcaccgctgggtaggcttggggttactattgctgggcgcctattacatcttaatcaacgtactagttcctactctggatcgtctgtttccaaacagagagatttataatttggttgacatgtatctacggacgattatcgtatccttattgttgatcggcggtggtatttggatgatgattgggaattccaaatctaaacgagtaaaggagaagcaatagaatggatactgaattttcaaagagtgaggctcccttaaagggagtccatcatcctcatagcgatggaggaggtgccacaggtatattgggtacatcatctaacaaaaatagctcctctaaagcgtcaaacactccggcaggggtgtggaaagttggaaggctgtcaatgggacttttccttgttctgctggggggcgtaacgtttgcctccaagttttggggagcgggcattctggaccaggcgttaacctggtggcctgtcgtttttgttttgctgggattggaaattttaatgtatactgcttggaaagggacgcgtgagcgcattcgttatgatttattcagtatgtttattacggcggtattggttttttgctgtatcggatttgccttggtcagttcatttgggatcactccgcaagtcagagaaataatgagttcggttcaggaaacaagggttctcccagactggcatgaaaaactgcctgccgaagtgaccaaggtgattgtacagggagaagatccttatgcggtcaaaattgacgcaaccacctcaccggaggtgcatgtgttcggaagttatgtatacacaggtaaagaggatgaaataaaaggacaagatttataccagaccaagcaaatcggcgatacattgtatgtattactgggtcaaattccgacacgttttatgcagactcagcagcagcttgatgttacgattgctgtacctgagggaattacggttactgtgcgcgatagccgaggaaatataattgaaaaatagggagatcttccggctccaactttacatttcgtatcattcacgcgatactggaagggaagcctgagatgtcatccatgttgctagctaatggtgtatttgcttatcaggcgaaacttgatgatgtgcagtcgaatagcgattgtgatcgaaaatgagggagaaaaatgatttcgttgaatcctgatacgcttacagggcgtgaaaattataagctgttgaccggaagtatcatcccaaggccggtagcctttgtaacgactttgagcagcgaaggggtgctgaatggtgcgccgttcagttatttttccatcgtagcctctgaaccgccactgctgtctgtatccgtacaacgtgtcgatggagtatccaaagatacagcacgtaatgcgatggagcataaggcatttgtcgtacatatcacagacgaggacaatgtgggagcggtgaatgtgacggcttcccgtctgttgccgcaggagagtgaggttgcactggcaggccttaccccggtcaaaagtacaaaaatcgaagttcccggtgtggcagaagcgaaaatacgcatggaatgtattctggaacaagttataccgttgggaggcaaggaggactcacctgcctgtgatctgttaatcggacgcgtagtgcagtatcatttggccgagggagcataccaaaatacgtatgtgattgctaaggagttgcgtccagtaagtcggttggctgggaacaactatgcgaagctaggagagcaattcacgctggagcgtccccaatagggggcgtttttttacagcatgcctaagattttaagtggctagtagaatagaataccctaattataaaaaagagaacgttcctgtgctatcgcttaggctccgttctcgatattcaatggccacttttacaaataatgataagcatctttgatatttatgagtttatttacttcaaagttttcagtagcagggagcgataggtcgtttcaaacaaaaattcaaacgcctccaaatgctttttagcctcaaatacatcacggccccacgcataaatgccgtggttacgcaataaaattccaggcacctgatcattcagcacaccgggcaccagcttggcaatcgaggcaatatctgcgtaattaggcagcacaggaatatcaatcgcagcattttcgtcccaaatgttaaaagccttgatcagctcaataccttggataggtacagcgccttgctcaccgtaatattcggaaatcagattattaaacacggtatgcacatgaaaaacggctccgcagcctgtcaggcggtaaatttcgcaatgtataagcgtctctgcgcttggcttgaggtttgtcgcttctgccgcttttccgtactggtctacgaacagaaaatcttccggagtacgcttggttttatccttaccgctggcggtcactgcaaaataaaattgttcgggatgaaagtcaccgattcggatcgacaaattgccgctcgtgcctgggaaccagttgcgagatgcgaatagttctttgacatcagcgagttcttccagtgtacggcgtttttcttccaatgaaatgtctgccaagttaaaactcatttacagcaccccttgctcctgtttttgctttaaatcctcgataatgtcatcaaatgtttcaaagggtacatgtggtacgccaagctcttgacactttaaagtcagatgcgaacgggagtacacaagatcggcaattttagctccttcaaaatcggttaggctgtcgccgatcaaaatccgttcgtattgttcggaaggatattgacgaatcacagtcgttttacacatgccacaatcatttgtacacggttcctcacatggatgcggccacgtaatctggatgcgctccccggaaaaatccgcttcgttgcaatagacgtggtcgtttggaatgtcaaagggttttagcaatggatcaataaaaaaatcaatgccgccactagtgacgaaaaattgaatctgctgctctcgtacatagtccaaaaagcgtgcaaagccctcgcgtataccagcttgtccaagtacatatgagataatttcgtccttttgctccgaaggcatcagggcgaacatcgcacctacgccttcacgaatggatgtatgcccatttacgatttgatgcatgatgggctcacagcctgtaggctgaaaatgcttcatgatggcgacaatattgtcgctgctcgtaattgtcccgtcaaaatcgcaaaaaatgacgggcttctttgctatactcatcgttcgcctccccatgtgtcgagcgcagattgcagctcggggtgaatacaggcgtattctgccagtggggcattctgctgaaccgcttcaatcgcctgcacaaaggcgcgcccaccagcttctgtacccagcggatgtccgtgaatgccgcccccagcgttgaccacgacgtcggtaccaaagtcacgtacaatgagcggcacgaggcccgggtgaatccctgcggaagggacaggcatgctggccttcagtggtagatcagggttgatcagctcatcgcggattgccatgttttcgtcacgcggcatcgtcactgagccgtagggagaagggaagagcacgaggtcagcgccagccagccgcataagctgaccgagcaggacggacgccgatataccataatgcggcgatggataagcagcacccgctaacgaaggatgggctgcaatcggcaccgagaaggcgggatcgctgctaagttcatgcagcacatcataaccgtaggccaacacgttaaacagtaacgcgttggcacccgcatcaatggccttgagagcttgcgtcttaagctgcgaggttggccccgttaaattagcggcatacagcagctttttaccggtttcacgctcagccgcttcagcggctttgatgcaggcttcgacacgtttttcaatcggcgtcagcgcgttttcaaataagatctcgtcgtccttgatcagatcaacaccaccgagagcctgccgggtaaactgttcacgaagttcgtccaaattgaggccaattacagatttgaaaatgctcatgaggagggggcgatcatacacgccaagctgctcgcgcaagccgctgataccgaatttcggtcctggaaaagcagagcggaatgcttccgagaaacccagcttcgttagcttaattcggccgtccatcgaaattttgccgaagaccgtgaccagcagagcgggaatgtctcggctgaagttgacatccgggtaagcgatggtcaggtccgcgtaccgttcaccgggacctccatcgtgaatatccacagaatgaaccgagccaagatgcttttgcatcgcgtcccgtttggcttgcgggagctcagtccagctgcccaccgtcatgccgatggcaattgattgggccttttggttaaaatcggctttgtcatcgtatatccggtaggtcgccaagcaatagctcattcaattccctccttgagtacagctcccatctcgcgggatcgttcggcacaacgttgcaccgccgcaatcaccgtttcgtagaagtcacctttgtccagcgtttccaatgcagctactgtggagccgttaggcgacatgattttatggcgaagggcagaaggctcctccccggtttgctgcaccatgcgtgccgctccaagtgcggtttgcaccgttagttcgtgcgcttgctcaggggtcaagccaccacggattcctccggcaatcatggcttccatcaggtagtagacatacgcagggccgcttccagatatcccggtcaaaacatccattttctcttcttctataaccgttaccgtacctacagattcgaacattgtaagcacgtttttacgttggttttcgctgatctccttggaaaagctaatacctgtggctcccagcccaattgagctggatgtattgggcatcgtccgtgcgatcggctgcttgcgacccagcaacgtttgcatcgtacgaatagacaatccggcgattaccgaaatgatcagctgctcatcagacagaagtgggccgagctgtccaagtgcttgtgcagcatccttgggcttcatggcaagcactatgaccggagaacgacgcagaagctcggttttggcggcatcctcggtttggaacaagactccatattgcttttgaagttcctcaaggcgagcctgattactgcggttgatgacggtaataccactaggtttgacaacagaacgagccgtcattccgcgaataatagcctctgccattgatcctgccccgaaaaatgtaatttgctcattaattaaaacctttgtctgtgattcacacatagattcataacctccaaggatacagattgatttaagttattattccctgatttgtccagtaccgtacacgcgatatttggttgaagtcaaggcaggcaatcccattggaccgcgggcatgtaatttttgtgtgctgattccgatctcggcaccaaacccaaattcgaagccatccgtgaagcgagtggatgcattgtggtacacggctgccgcgtccacttcttgcagaaaacgctcgacatgggctttgtcctcggtgacaatacactctgaatgcatcgtaccgtagcgggcaatatgctccagtacttcgtccagattgtccacgacctttacgttcataatgtaatcattatactcggtgccataatcctcttctgtagcaggaacagcccaaggagccaattctcgtgtgcgtgcacagccgcgtagctcaacccccgcatcacgaaagcgttctgccaattctgttaaatgtgcttttgcataatccgagtgtacgagcaatgtttccattgagttacacacggacggtctttgcaccttggcattcagtgtaatcgcttcggccattgcggtatccgctgtagcgtccaaaaaggtatggcatacaccagctccggtttcgatgacaggtacggtagcgttctgaacaacattttgaatgagtgaacgtccgccgcgtggaataattacatccagcaagccgttcaaggtgagcatttcgttgaccgaggcacggtctgaatcttcaataagttgaagcgcctcgcgtggcacagcggttgcgtctagtgcctgctggagtacttcaataatcttgcggttggagaagagggctgccgaaccaccgcgtagcacaaccggattgcctgttttcaagcacaggcccgcggcatccacggttacatttggacgcgcttcatatatgatgccgatgacacccagcggtacacgtatcttctcaattcgcaggccgtttggacgttcaatttgctcaagggtgtcgccgaccgggtcaggcagtgccacaatttggcgtaatccttcggcaatagctccgattcggtcctcggtcagcttgaggcggtcgagcagcgattccgatgttccctgttcccgtccacgtttcaggtcattatggtttgctgcaatcagctcttcagtatgatttactagagcttcagccatagcaagcaatgcttcgtttttctgtgctgtagtcaggcggttcatgaccccggcactttttttagcaagattcgctttggttcgtacttcgctaaactgattctcctcggttgcagctgtgttagtcgttaaatcactcatgttacggcctccctacatacataatgtaatccattcatccctgtggatcacctcaagccggtgaatgggaccaattttgcccacaacctcgccgctgggtaatccttgtacatttcggagctgttcatcgtcataattgacgatgccgcgtcctaacactttattttccggtccgagcacctcaacgacatctccggcatgaaagctgccctcgacacgtcgtacgccaaccggaagtagactgtgtcctccgtgaaccaacgcttcctcagccccttcgtctacatgaactgcgcccagaggggtggacataaatccaagccactgttttttcatcggaagtgaagataggtgggtgtcaaaataagttcccggtccgtgtccttcgacggctgcgtctagatcaccattcgcgcttacgcgtcccacatatacaggtacaccgccgcgtgtagcgactttggcagcttcgatcttggatcgcatgccgccagtacctacagacgatccagaacctccagctaatgcataaatctcctctgtaatttcttcgatacgttcaaaacgtacggcattcggatgcttgcgcggatctgccgtatatacgccatcggtgtccgtaatgataatcagatgctgagctttgaccagattggcaaccagcgcggacagcatatcgttatcgccgaatttcaattcgtcaatcgatacagtatcattttcgttaaagatcgggataacctgctggcgcagcaattcttctacggtcattccggcattattcatccgtttgcggctcaaaaagtcactacgggttagcagaacctgcgcgatcactaggtcaaaatctttaaaagcctgctcataggcctgcatgagaagagcttggccaacagctgctgccgcctgcttttcatgcagtagcttagggcgaaacgggtacccaatctccctgaatccggcggctactgcgcctgatgtaaccagcagcacttcatgaccttttgcacgaagcaagctgatttcccgggcaaaataagcaatggcttcccgattcaagccaccttccactccagtcagagagctgctaccgattttaatgacgattcgtgttgacaagacgtccacttccttaattttactctttttaatgcaaaaaaacttccatcctttgtatgcaaaggacgaaagtctgtgcttccgcggtaccaccttcattgatgattcatgatcatcccacttgaaacctgttaacggcagggaccgcctgattgcgcagggcgctcggggataggagttgggagagagtccaggtaaattcttgcagcctatcggaatttactctctgaacaggaccgagtctctcttaatagtcccttcaacgcgctaaatgatattggatacagaataccacgaaaagaccaggtttggcaaagaagttgtagctggaaaatacggcttaaccaaacaggtttagcttgccaattcgatcagccgcctcggtcagtcgagcttctgagctcagcagccccgctcgcacatatccttcgccgccgctcccgaagccgatccctggagccacagccaccttggcttcccgcaacagaagatcggcaaaagaagccgaactatagccctgcggcacaggcagccaactgaaaaaggagccgcttgggcgcgtcgccttccagcctatttgcccaagtgcatcataaaaagcgttacggcgtgattcatagcgggctaccagctcgcctacgcagttctgcgaggccgtcagggctgtcgccgctgctgcctgaatgccgccaaacaagcttacataaatatgatcctgtagcagattaatcatcgagacaatttcggcattaccgagcgcgaaaccaacacgccagcccgccatattgtacgttttggacaaggtatagaactcaatccccacgtctttagcaccctctgcctggaggaagctcaccggacgttcgccatcaaatccaatagcgccataggcgaaatcactggcaaccacaataccgttacgttgcgcgaattcaaccgtatcctcgtaaaaagaaagtggagccgttgccgaggttggattattcggatagttaaggaacattaacttggcgcggcggcggcgttcctcggaaatggcttcataatcgggcagaaaacggttctcttcctttaatgggagaaaagacatttccgctttagccaaggctacgccagaccagtagtccgggtagccgggatcagggacgaggcaaacatcgccgggattgagtaagacttgcggcagctgaaccaaacctgtttttccgccaaacaggatggcgacctcggtttcagggttgagcgtcacaccgtaatcctcctgatagcgctgggcaacggcttccttgagaaagctgtaaccgcgaaatggcgaatatttatgatacagcggattatccgctgattcctgcaaagcttttacaatatgagaaggagtgggggtgtccgggttcccttgtccgagattaatgacatcatgtcccgccgcaatttcacggtttacattttgtacaagtgtggcaaaaaattgagtaggtaactgtttcatcacgtcagcggagggaatagaaaaatgagtcatcaatacacacgaccttttggaatagtttaagaaataatctatcacgattttaccgagttgtataggaggaattaagcttgcatagttgcgtaatccagactgatcgggctatgatgggggaaaataccggataatgggtcgcgggaagctccggctcacaaggaggatgaaggattttgacgtatcaggaagctcagccgttcagtgttgcactcatacaagctcatatagagataggaaatcccccggaaaaccgcagtcatatccgagctttaatggaacaagcgatgaaaaccgaactgaagccggatctgattgtcctgccggaaatgtggaatacgggctatgccttggatcgcattcatgagctggcggacaaggaagggacggagactcgggcatggatagcagcattcgccgccacccatcaagtgaacgtagtagctgggtcaatcgcagagaaaaaaagcgacggtcatgtgtataatacgatgctcgtttttgaccgcacaggcagagaggttgcttcgtattccaaaattcatctattccgacttatggatgaagaaaaatatttgcagcctggcgaagaaaaggttttattcgcactggatggcggtattcaggcaggtgcgtcaatctgctatgatatccgttttcctgaactagcccgaagtttggccttgtcgggcgcaaatttgctgatcgtacccgcggaatggcctcatccccggcttcatcactggcgtaccttgctgaccgcacgtgctatagaaaatcaaatgtatgtcattgcttgtaaccgggtaggtcgcagcggagatactgatttcttcgggcattcgcttattattgatccatggggagaaatcattgctgagggcggagagcaggaggagattctcacaggaacaattgagtctgtcttggtgcaggacgtgcgtggtcgtattccggtgtttgaagatcggcgtccctcactgtatgaccgataatcagtgcagaaaggaatactccatgcttaaggaacgcattgattttttgtgtaaaaagaaaaacttgtcccgtaaagagctggtaggcgggctggtgacacccgcacattttgcgaatatactggctgaccgttacccgttggcagaggatctggccgagcaaattgctgggcgtttaggtgtaaacccatcctacctcttgcgtgcagcggcagaggatgaggggacgctggctacagcggataagattttcacagagatgtccaagctggctaatcctgccacggaaagctatgtggatcagctggaggatcgcaacgattcgcttgtggtggaaatgacgacttatttgatgaaggccgtatattaccagcaattaaatgacccaacggcctatgaatatttacatcagacaaaattaagcttcagtttaagctgagtgtaacgaaaaacaaggcgatacatttaatgtaaccacgcaaaaggatgttttttcttcccaactatccaaactgcagcagggaagtattatagaggtcatttattcacctcaagatccttcaaaattagtctttaaaacacaagtgagtgaagccgaggtacagcaagcatttggttcttctcgataataaaaaagttttccgatatctgtttcagatacagcccataggtgtattataatagtatcccgacaccaggaggttgataacgatggataaccaaagtagatccgaactggcgaatagggatggcctgtcacggccgagaggcttaaatagacaggttgtcggaaacaattatgaaatgggctatgatcaggataaaagtccaccagatttagggagaccctgatcacaaaaaggcgaggacaggcactttgggatcacacagcacattggaactgaggtaggacactcttgggagaccaaggctagagaccttaaggaaagaagtgatgcgggatggataaagtggagtttccgagcaagcgtaaagtaatcaggcgaggctgacatgaaattcaaatgaacatgaaatgtggttcgttgaagacagatggaagcaacatcgcaacagtgtaatcgaacccgtaaagtaaatgaagtattgaaagtatagggggaagccccgggaccgccttcttctctggctttggctagggaggaagacggtccttttcacattcgaagctacttttgagaaagttgctcgaccgtttctcggaaggtatcaataaaggcttcggcagctttagacaaataacgtccgtttcggtaagcaatggccagggtacggctaggggtaggttcggcgagtggcaataatgctggaacaaactcgctgctggcggcccgggcgataaaacgggggacgagtgtcactcccatacctgtcgctacgagcgattggagcgtctccatattagtgctctcaaacaccacattaggttcaaagcctgcttgatgacacaaatccatcgtcagcttgcgaaagccttgcccttttttcagcacgacaaaaggctcatctttcagttcttccatatgcacaggctgcggatgccctccttttttacgcagggctagggggtgacctggaggaacggcaagatcaatccactcttcaccgatgggcacataggaaagtgtaggttcaactaatggaagagatagcaggctgagatctgtatccccactggcagtttttttctccaaattcatggatgaatcctcgactaacacgatttcaatgtccggatgagccttcttgaatacaggcagcacatgcggcagcaaatgagaacctgtgataggcatactgccaaccacaaccttcccttttcgcagttgagaaatgtcgtccatttcctgccggagctgctcgactgcatcgactattttttttgccttttctacaaagcttgctcctgcatgtgttaattccaccgtgctggtgttgcgttgaaataaaagtaccccaagttctttttccagtttggataattgttggctcaaagagggctgagcaatatgcagtttttctgctgcgcgtgagaagtttttttccgctgcaatttgcagggtgtactgaagctgtctgaattccatcgaattttgcgccccttgtcttataagctttacctattacatcatagactgattatacaataataaaatgaaattcccaatcttaacgaatcccatgtgtcacaagttttatatagatgaagcgtttttatacaaatagagtcttttaatacagataagcaattcatttaacattctcctgataaaacgtgattaatcttagttctggttgtacaaaaaagtgtctgggaggaaaatgaatgctaaaatgttgggggatacatacgaagaaatcggtggctgcactcgtagcgactatgatgctagccgtaagcggtgggacggcgatggcagtcgaaaaggacacgtcgattaaaaacgtaattattttgattccagacggtatggctaatgacgccactgcactggctagatggtacaaaggctcctccttaacgttagacagtatggcaagcggcatggtgcgtacgcattctgcggatgctccaattgccgattctgctccagcgggtactgcttttgccacaggacataaatctcatactgggtatgtaggtgtccttcctgatgaagcgacaatgcctggacaacaacccattgcagcgggtgacgccaaaaagcctgtagcttccattcttgaggcttccaagctggcaggaaaatcgaccggaattattgcgacttccgagattatgcatgcgacaccagctgattttaccgcacattatcctgatcgtaaaaattatgatgcactcagcatgcagcaagcctacaacggggttgacgtagtgttaggtggaggcggcaagtttttggaggcagcagggcgtaaagatggccaagatttggtagcccaaattaaagaccagggttatgactttatcacgacacctgaagggttgaaaaaatcgacctccagcaagctctggggcagcttttctcccgaagcccttgcgtataacctggatcgcgatgcatccaaggaacctagtctggcggaaatgacatcgaaagcaattgatgtgttgtccaaaaacgataaaggcttcttcttaatggtagaaggcagtaaagtggattgggccgcccatgcaaatgatccaaccggaattatcagtgacgtgctttcatttgacgatgcagtgaaagttgctgtggattacgccaaacaaaaccaaaatacagtcgtcgtagcagtgacagaccacggaaatggtggattgacgattggtagcagcgatacaactagcaattatgataaaacacctttagcttcttttatagacccgctgaaaaaagcgaagctgacgggtgaaggcttggaagccaagctgaatgcagatcgcagcaatattaaagaggtgctttccacatattttggcatcaccgatttgacagacgaagaagtaaaaaccattaaagatgccaaagaaggcagcatgaactatgctgtcggaccgatcattagcaaacgtgcgaatattggctggactacaggcggacatacaggaggcgatgtcgtgttgtacacgtatgcgccgaacggagaccgtccaaccggtgtaattgacaatacagatgtcaataaatatatgacacgtgtgcttggactggatttggatacggtcagcaagcagttgtttgttcctgcaaaagctgcttttgaagctaaaggagccaagtttactgcggacacgaaagtcattacagtgaccaaaggcagtaacaagctggagcttccagtatacaaaaatatagctacgctgaatggtaaaaataccacgctcaacggtgtagttgtatttaacggcgttgattattttgtaccccagcaggcgattgatttgattcagtagtaagcagaaccatcgataagggctgtttcttcctttagaggaagagacagcttttttgtgtgttgatataaatgtgtattttttggggcagaagttggaggtggtttttataagatgggattttttgtgaaactaatcacgttacaacctctccgatattgctagaataatacatgtacggtacaagccgctgatgatgtgaagtccggatggacgagggaagaagggatgagtcacggacgaattattactgcgtctagctgacggcaaggaatggacgcatacggaaatgatggagctgctgacacgtctggatgatgagccgacgctgcgggctcaactgagacacctggcagctcgcaccaaattggagcgctatggcaaaagtgtttttttacggggattaattgaattctccagtatatgtcgtcaggactgcatgtactgtgggctgcgcgcttcgaataaacaggcagatcgttaccgtttgaagccagaagaaattctggcctgttgtgcggaggggtatgaactcggttatcggacttttgtgctgcaaagtggggaagattactggtttacagcagcccggctgacgaaattgattcgggaaattaaaagccgttttgcggatgtggcggttacgctgtccatcggtgaacgggatgatgaaacttatgagcaattatacgaggctggcgcggaccgttttttgctgcggcatgagacagcttctccccatttgtacgccaaactgcatccgacgatgacgatggaaagcaggcgcagccgtctgctggctttgcaacgaatcggttttcagatcggggccggatgtatggtggggttaccaggacaaacgaatagtgaattagcagacgatttggtctatctacacagcctgtcaccagatatgatcgggattggtccctttttaccgcatagcaacacgccgcttcgggatgccagtcaggggagcatggaaaaggcactcgatattatttcgttatcccgattggtcgttccagatgcacttattccggcgtctaccgcaatgggaacgattcatccccaaggcagggagaaggcgcttcaggcgggagcgaatgtggtgatgcccaatttgtcgccactggcggtgagacctaagtatgcgatttatgagaataaaatatgtttgggcgatgagtccgcccaatgtcgacattgcctggaactgcggattcgcggagcgggatttgaagtcgatatgggacgcggcgatagtttgagggtgcaacgacagcttatgagacaggaaactttgtgaggccataacggaaacattgcagtaaccataaataaggagatgggtatacgtgagtggagtacgagagaaagtgtcggcggattttattaatgaagcagagattatggcggcagtggagcaggggaaacaagaggcaacagatcgacaccgtattttagaaattttagaaaaggggagagcctgccggggactgagtgcgagtgaagcggcggctcttttgcatgtggatgatcctgaattattggaagagatgttcaaatcttcgagggcagtcaaagaacaaatttatggcaaccggattgtgctgttcgcccctttatatgtaagcaaccactgcgtgaataactgtgaatattgtggttataaacataccaatgacagctttactcgtagccgtctgacaccggaggaattggtggaggaggttagagtgcttcaagaactgggacacaagcggctcgtgctggaagcgggggaagacccagtccattgtcccattgactatatcgtcgattgtctgcgtcagatctatgaggtcaaggtagataacggcagcatacggcggatcaatgtgaatattgcatccacaaccgaggaggactatcggaagctggcagaggtaggcattggtacgtatattttatttcaggaaacgtatcatcgggaaagctatcgtaaattccacctacagggaccaaagcgggactttgattggcacactaccgcaatggacagagccatgcgtgcgggtatagatgatgtggggatcggtgtgttgtacggcttgtatgatttccgctatgagaccgtcgcgatgctgaaacatgctgagcacttggaagaagcctttggctgcggccctcatacggtttcagttccacgattgcgtccggctgaaaatgtagatctggagcgatatccgtacctggtcaacgatgaggattttatgaaaattgtatccgttcttcgactggctgttccttatgctggcatgatcctgtccactcgcgaggagccagaatatagagaccgcgtcattggtctaggcgtgtcgcagattagtgcaggttcagctacaggtgtaggagcatatgcaaaacaggaaactgatgataagcctcaatttgaggtgggggatcatcgctcaccatcggaaattattaaaagtttgtgccgtggcggatatatgccgagctactgcacagcttgctaccgtgaggggcgaacaggagatcgtttcatggagcttgccaaatcaggacaaattcataatgtatgccagccgaattcgctgctgaccttccaagaatatctgctggattatggggatgaggaggcgcgtgaactgggagctgccgctctgcgagagaatctggagcgtataccacgtgaatcgacgcgccgtttgacgcttgacagactggaacgactggaagcaggcgaacgtgatttgtatttttagcaatttatattattcgtagtatcatttcacgctatgaaaattctcatggtttataatagaacttgaaaatgaaaagcagtcgcgttggaatcagcgcgactgcttttgtgtgtctggaaaaaaatattaatgatgagatgaggttttttaggaataactgccggcttctacagcttgctcccatgccagcatagcagatgggaagcattcaatagcacggggaaagaccccctgtacataagcgatgaaaataccatagttcacaatcggcaccccggcagcttttgtttccgacattcgatgaagcatcgtacgccgattgagcatgcatgcaccgcaatgaataaccagtgcgtattcgctcagatcatcagagaagctggagccggatgcatgctcgatgatgagacgtttgcctatcgtttggcggagccagcggggaattttcactcgaccaatatcgtcagattggcattggtgagtgcaggcttcggcaatgagtacacggtctccatccttgaggcgatcaatggctcttgcacctcgtaccagttcgtccagatcgcctttatgacgggcaaacagaatggaaaaagaggtaagaggcacatccttgggcgtgtcggccgctactttcataaaaacctgtgaatcggtaatgaccaagcgaggcttgcgtcccaatctctccagcgtcaatcgtagttcatgttctttggtcactacagcgatggcatcactctctagtgtatcgcggattgtttgctgctgtggcaggatcaatcggccttttggtgcagctttgtcgatgggaacgaccagcacaacaacatcgccgggtgacaacaggtcaccgacgatacggaaacgatcctcgttttgagggagcgtattagtaatagcttttttcagttccgtgtctccccaaagcaaagatgcactgaaaggaatcagggtgagatccagttcagttgccagctttgtagccgttttatctgattcagtaagtgtatctatcttattcaataccccaataacaggaatctttttggtgcggagcttttcgagtagctcatgctcgaatggtccgacaccaacggtggcgtcgataacgagcagggctaagtctgtactattaagtatttcgagcgttttgttgcggcgcagctctccgatctcaccctcatcgtccagtccggcggtatccaccagaacaatgggacccgcagggagcagctccattggtttgaaaacggggtccgtggtcgttcctcctacaggagataccacagcgacgggctgaccagtcagggtgttcagaatgctggatttgcctgcgttgcggcgaccgagcaggacgatatgtggtcggttgctacgaggggtatcattcattcccatggtgagttccttcttcctgtcccggaattccgggcttggttactgtatagggatggcataattggtcaatccgcgaacgggtcagtaggccgcgatcttctacaatatcctctggtgcgcgaccttgcacaatggctgcagatgcaatagaggcagcttcatcatagccaagctccgcgaccagcgcagaagccatcacggctgagttacgcagatttgtagtacagcgttcctcacgcacgatcaggccgcgcacacatcgctcctcgaatagtcgaaccgcgctgttcagaatatgtagcgattccagcagcgattcggcaatcagcggcaggaatgcgtttagctccaactgaccggaggcagcggccatagtgatagccgcatcttcggctatcacacgcatggctgtgagtcctgccatttcagctattaccggattgaccttgccaggcataatagaggatcccgcctgaactggaggcagcgtgtattcgccaaaaccaccgaaaggaccagaggccagtaggcgaaaatcgccagatattttgtacagattgacggcagctgatttgagtagaccggacacctcgacaaagacatccatattttgaatcgggtccatcgggtggtcactgcgactcagtccaaagccagtctcatccgccagcttttcgaccatccgatagctgtatgcgcggggcgcgttcatacctgtgccaatcgccgtgcccccaatagggatttcccgcagccgctcttcagctttatagagacgccagcggtcgcgcgctatagcctttgcgtaggcaccaaagccctgcccggccatcatgggcagagcatccattagctgagtgcggcctagcttgagcaagtcggcatattctgtttctttgtgctgtaaagcatcctgtaacgaagacatcgtgtcacataaaggccgaagcagccgtatcgctgcaattcgtagcgctgtcggatagacatcattcgtagactggcagcagttcacatcatccagcggatgtaaaatctcatactgccctggtctgcctcctagctgtacgatggccaaattagcaatgacctcatttacattcatatgggtactggtgcctgcgccgccttgcatggcatccacggtaaacatatgttgatgcctccctgcgagtatttcgtcgcaggcatttacaatggcagaggcccgttgggcaggaattcgtttctgctcaccatttacttgagcggctactttttttaccaacacaagagcgtggatcaagttttggttcacgggcctgccactaaccgcaaaattgttcatcgcgcgtgcagtgtgaataccgtaaaaggcatctgcgggaatttccatctctcctagcgcatcccgctcggttcgcgtatttgtaggcagagaaagaccttcagtcatagacccgttgctggaatgcgtgtcatatgcagtagctgacgtgcacttgcagcgcgtttttcctcaacacgggcgtgaaccagatctggttcgaccagcttgagggcttgtgttggacatttaccaatacaggccggaccgccgtccacgccttcgcacaaatcacatttgctggcaatcatgcgttctttgggttgcaaacgacctgacatattggtatacaatccgtcctgcactacaggctgcccgtttcgatactcgggtaccatggtaatcgcgccgtaagggcaggcgatcatgcaggttttacagccaatgcagctttcactattaatgagaatgcagccatctgcattcgtaatggagccgttcggacaagcgttggcgcatggggcatcctcacagtgacgacactgaacgggtgcagtgactccaaatgatttgataaccttcagacgagggtgaaaatgaaactcatcatctggtgagataaaagggttctccgctgaatgtgcgatgacacatgcgatttcacaggtacgacagccgatacactgatcgggatcagctaaaacaaaacggttcatacaattcgactcctctctaactaacaacaaatataatgtatacagcataaaaataacttaacgtattaatgaatggagtaacccgtatcccctttggtggaaatagtgctactgtggctttgcttgccgggtccccgttgttggaaggtcgtgtgcagcagatgatgcgacacatgacccagcggctcacctagaaattcatcataaagtttgatgatgtgagggttctcatgcgattttcgtacctggtgtgcagcatcatgtccatagatggaggatttacgtgcccgataagcttcaattcgatgcttttctaacatgagcttgggttgtccccctccgctgatacatccagcagggcagcccatcacctcaataaaatgataatcacattcgcccgcctggacacgatccaatagctgataggcatgttgtagcccggcgacgaccgctaccttgagctgcagcttgcctacctgaacctcagctactcgaatgccttcctcaccacgaacaaaatcgagttggagcttcggcagtttttcatttgtcagcagctcgtaacctgtacggatggcagcttccatgactcctccggtgactccaaaaatggagcctgcacctgaatattgtcctaacggtgaatcgaattcttcatcaggcaggttcgcaaaatcaattccgcgctgcttgatccagtatgcaagttcacgcgtggtcagtacctcatccacatcacggtaaccgtcagattccatttcgggacgatcgcactcaaattgtttacaggtacatggcatgatggcaacgctgtatatattcgcaggttccacctcgtctagttgtgcgccataagatttgattaacgctcctaacatttgcatcggagatttgcagctggatagatggtctagcagatcgggatattctatttctgcaaatcggacccatgctggacagcaggatgtgaacatgggtaagggaccgccttcggtcacgcgacgaattaattcagtgccttcctccatgatggtcacgtcagctccaaagttggtgtcgtatacccgatcgaagccaaggcggcgcaaagcagcagccattttcccaggcgtcaaggtgccgaaaggcattccgaattcctccgcgagtgaaacacgaatggcaggagcacattggacgatccgaaactgtccaggtttggtcatcatatcggctaccttattcaagttgtagctataataggcagcgaatagcggctctctgatgtcggcaggcatatcgcgttcttggatacgttccagccgtctagcggcgccttcctgtgaagatgaacctgcccagtcagatgcgtatacgctgcatatttgtacacattgaccgcaaataacacatcggtctgcattaacggtttgcggttctccgggcagtccctctatggcatctactggacaaaccccagcacaacgtctgcatcccgtgcagagcgtagggtcaatatgaatgacagggtctgtgcaatcagtcgtcttcatacaaggaggtgaagagatcttgtctattgtggttgacatgtttttctacctttctgcggctgatttttgaccttataggcgtgggaaaaagacttcccgccgaggctctgcaggtgagtcggatatacctttggccagccgtaggacatgattcgggcaggcctctacacatgcaggctgtccgttctctgtttccgcgcacagatcgcatttgcttgccgcggtgcggggaagggcgactcgatttgcacggtgagtcaggccggactgtgttacaacgtgtccggcccggtagaccggagacacctcaattgccccgaaggggcaggccaaaacacaggaggtacagccgatacatcgttcctcatctatcataacgacgccgtcctcctgacgaatggcctgtaccggacaggcatgtgcgcagggggcattttcgcaatgccggcattgcaccggcacatacatctcccctgtacgtacaacatacaccttgggtacaacaggtacgctgacggttccgaccgaagctcctataccgttagcctgactgtgaacggcgaagcacgccagttcacaggctttgcagccgatgcactgcccggcgtctgcgactacaaaagaagaagcaacagcgcttgttctactggctgctcccattctactcgtcgaagttgaccggttttctgtcggacggtgcatcatattccctgtgccgctcatctcgtcaccttatcagccaaaacagcttcctggacgttcatctgtctgcgaatccgttggtacgattcatgtacatcacgttcggcctgcacttggtcggcgatccgttccagacggatggcacagtattttaattccggggttttggataccggatcgagaaaatcagcggtcagctcgttacatgctccaacccaccagtgataggtcatgtaagtcgcaccttgttgcacacggtcactgatttgtgcccgtgccatgatgcgtccccgacgggaggatatggcaacaatttcgccatccagaatattcagatctgctccgtcttctgggctaatctgaataaagccaggctcatcagacaactggcgcagcgcgcggcaattgccagtcatggtacgcacggaatagtgacctacctcacggactgtggataagacaagcgggtattttgcatccggttgttcttgtggcggacgccattcgcaggcgaataatctgcctttgccactaggtgtcgagaattgatttcccttatacaaatacggtgtacctggatgatcctcggtagggcaaggccattgaacgccgccttgctgctccattttttggtagctggcacccgagaataatgggctaaggctgcgcatttcatcccaaatttcctctgtgtttgcataggacatagggtagcccatggcggtagcaacctcgctaataatggcccagtctggcttaacatcaccctgtggctcaacggccttacggatgcgctgaaacccccgatctgccgaagaatatacaccgtcatgctcgccccaggcagtagaagggaggatgacatcggcgtgcagcgctgttttgttcatgaaaatatcctgaaccacgacaaattccaattggtctagggcttcacgcaactcagcggcgttcggatcactttgtacagggtcctctccgaaaatgtaataagctttcagcttgttctccttcaggatgaggtgcggtacctctgtaagtggatagccttttttacgcggcagctcaacaccccatgctttttcaaactttttgcggactgtgttgtctgttacatcctgatagccagggtacacattcggcaaagcgcccatatcacaggacccctgtacattgttttgtccccgtactggcccgataccgacattcggcttgcccagatttccggtcaacagtgcaagggaagcgagcccctttaccacatcaacggcctgtgaaaattgacatacgcccattccgtacaaaattgtagcggtaggggcctttgcatattccctcatagccgcccggatatcggccgccttgacccccgtaatgccttccgcatattcgggagtatattttttaatgctgtctacgtattcggcaaagccttctgtgtttgcttccacatatcgtttgtcgtacagtccttcatgcacaagtacatgaccaaaagcgttcaccaaagccatgtttgaaccgccctttaggggtagccacatattcgaaatacgagctgtttcggtcatgcgtggatcgcatacaataattttggcgcctctttgcttggcagctacaatgcgtcttgcgacgatcggatgtgtttcgggtgcattatatccaaacacgaaaatgagatcagagtgttcaatttcaggaatagagttggacatagctccatctccgagcgagtaagtcaaacctgccacagaagggccgtggcatacacgagcgcaatggtcaatattgttcgtgccaatgaccgcccgcatgaacttttgcatgacataattggcttcatttcccgggccgcgtgcggagcccgttcccataatggagtcgggtccgtatttttccttaattgctgacagccgttcggcagtatattgaatggcttccttccactccacttcctccataactccatttttgcgaatcatgggcttgcgcaagcgtgcagtcagaatttgtgggtcattcaaaaaatcccatccatagtgtcctttaagacacaacgttccttcattcgtacgaccaccagccggctctgcgccaattacctgtcctttttccaccagcaaatgaagctgacaaccgctcccgcagtagggacatacggttaataccttgtctgccataagtgcagcacctcttttatatgaaatagatgaaactcgtaacataaaaaaagccaatacaaaaatgccgctttacgctgcatcctgtactggcttatccgcgagcgaggagacaagctccttcccgctaatccaaccggtgtatgtgttgtagttctagagaaatgataatgtgtccgtctccatggacggaggggcagacctcccaagtataagtgaagggactgccgagtgttttttcggcttcgttcataaactccttttccagatagggacgaaggacgttccaatattccctgaccttgtcctcggccccttcatgaacgagaatttcggacaaattagacaatgtacctcgaatttctaccgtaatccggagcggcgaatccagtgaaaccttgacgttgtccggtccttttccacggtagtgcttgacaatacatacggccaacttcctgatgcgctcacggtattccaattcggtattcaacatctggacactccgcttcgaatcaaaataaaggcgtacttgccgcgcatgccagacagcctgtgtagctggttttagaacaaaatgtaaccgtcccgacccaagtggtctgcccagcacggcgtatcacccttctatggtagaacaggttgacccggaaagatgtgaaattcattacactgaaccaaaaatttacatagattagaccactcttgaagtagctatacctctatggtttgtatgatgcttctcattccgtcgtgttgtttgtacagctccaatacaaaagaagttgaatgacatactatgggctgagattagtaaatggcatactcaaagccctctatactgaaatagctcagtgcgaatctcagagatttatagtaaattattcatttatatgatttgcaatatcaatttattattattacattggatggaaatgctagtcgaactccagaaggcatagatatgttatccaaaatggtgtaaagtacgggttcaagatgtagaatctatgcgatattcagtttgtagaagggcaacgtcaaggtcgccaaatgaagacttagtaggaattactgcaacgtgtggctgaacatgaagccgcaagtcaagccacgttagaataaagagaagaggtccgtgctaaaatgcatggacctcttcagacctgtaataattgattttttatgaaactttactgtttaaccagaacggataaatcgccttcaaaaacttgctcctctttcttgttgaaagtcgacagcaatacagtaacgagtcctgttccattcctcatctcttttactccaatcacttcaacaatggtgtacaattcgtcgcctggatatactggtttaataaatttaatattattcatagcagttccagcaataacctcatcaccgtaactgcctgtttcaacccaaagcttaaaagaaacagctaatgtttgaattcctgaagcgataattccattaaatctgccttgtaatgctttctcttcatctaaatgcatatattgcgggtcaaactcccttgcaaatctggtaatatcctctttagttaattttaaagacttggttttaaatacttgtccgatataaaattcatgaaaccgcattattacacctcttgattaaattatttgcttatttatagagtagcataatatcaccaatcaagttaagctgcccgttagcttaatgacgtattgtccgtctacaactttatattcaccgaacaatatttccctttaaaactcgtagcgttatagcagcaaattaatttaagatacaagtatgaaaagcctctgataattcagcggatttttgtagtcccactcagtaagtaatcctccgtacttttgtacagtcagatcaatgtaagtgtctgttttttgaaggattatatttccattaccataagtctcactggtaacagtggcaaggttatttgacttcaatgcagagtgactctttggaactgcttattttatatacttcgacattcgatacaaataaataaaaattattgacaactgttaaattatggacaacaatagaatacaataatatataaatattggtacttctgtatgaagggtggtttatctatgaaagttacacccacgattagagcagaattggaacaatatctaaaacaagaaggtttgagcatgatggagtttgggcatatagcgggcatgaatagggggatagtaagtagcatagtgtcaggcaataaatctatgtctgttaaccagatagatcgcattaccgaggctatgggtttaccagaaggctacttttacgacctatttatagaaaactacatcatcgacacccccccgaatatgagacgaatagagccatttttgtatcgttgtgcggaattggacaagctggatgcgatccgtcgagtggtaggaaccattatggacaacctactctattcgcctaaactatttgatatggcagaagtgctattagcacagggacgacatgatgctgcgttgctgttctatgagggtgtagctgaaacggagaagtaccaacattctgaacgattggcgatctgtcagtatcgaatgttcacgattcaggttggggacgatcaaagccgcaatctcaaggcagctacgttgttcgagccttacattgaacgtctggatgaaatggaccaacttgacgcattgaaggatttggctaatgtgtacaggtctttgcgtaagtgggacaaggttgaggaaatggcaaggcaaatgagagggaaagctgaagtacaatattccataaagcatcagcagaagaatcgaaagaacagggagcatgaaaaggaaaccagaaatccgttatttggatacattgcttacgccgatttgttgtgtgctagtgtttgtgaagcccaaggcgattatcaacaagccctactatatacatacgcctatgcgaatttagattgggtcaaagagactgatgaagatactcaacactgggtaaacttgttcagtcagtgggcagaaggtaacacgtacgtcaataaactcctgtctggagatgttagcgtgctgccagactatgttgaatatatagcggcaacatcaaccgctaatgaaaatgagaaactctcaaagctgttgaacgttatgatagcggctaaccgatatgaaatagatgtggatgatgtcctttcacgttttgaaacaaatattaattcatttgctcaactcccaacatcatctgatatatatacccaacaagtaataccagactatttcgcatggtttgcttacgaaatggctcattattatttacatcgggtgaaatacagtgatggctttaaatacttgatgtatgcaatggcaaagtcacatataataactaatgaaacaaactttataaattgtattggtctgtttatgcgttttcaagtccatgcgactcctgaaatcaaaacagagttctccaatctaattgaaaaggtgtggttaagtaatgttgaaaaaaatggcattgttaattgttgcgagtagctttttgttttttataactgtacccgctcacaatcatgagcagcttattcagacccttgtacaaattgggggattctaaagctaaagaaagctctgccgaccataaggttagcagagctttcttcagtgcaggaattaccacagaattcaccgaatgactatcttgatgtgataagcataaactgtacatatgagtagttatatttggtctagcttgtggtatagcgggctggatgataggtgactatatatttgggaatttaggcgcttctgttgtgttcgcaattatatctggagcattagggctaacgataaatatgataggctgccctagatttacttcaaagcgtttagcccaagagttttttgataaactttaaaatatttagagagagcaaaatttattttttagattgaccatattcttgaataaatttccattgaagaagctattaaagatggaattactacccttatgattgataacctgcttaaagcgtccggtatgcgagcagttgaaaatatgttgatatccaaacaggagctcatgttgtttatgaccctaataataaagtaatagccattttggataatagtttgaatgctgtaattacaattttatagcgataacggtaagtggcgctttttactgaaccctcaaggaagttactacagacccgtttttccaagtcacatttgtagtctcagcttttgtaactgtagggaacaatgagaacaccgaaactccaatgaataaggctaacaagatacctcaaattctttgaactttttttaaaacttcctcctaaatttatgtaataaaaaggttgattataaaactgaattaaaggtatttctaaacattaatgtctatatattaaaaaataaagtttaatagtgtggaattgaatctttagtgtagtagttactctctctagtactccataactgagagtttttttgttttgtgacaacatacgcgatatttagacatgactcccaatatagtattgagaagatttaaaatactatggaggtgtcgcatgataaaaggaatcgtaagagaaaagggagttcccaaaaaaagtatatgaccgcgccgaatagccaatggaaatgtgctaaaaatggcgcaggtgcagatattcgatacataagctttagtgataaccggggaacaggatcatgggtaagtcatgagttagataagtaaactgatggtacaaaggtaagattcatagtgaaataaggatgagggactttactagcatttggttgttagagtcttttttgtaaccaataaaaaataaatatgcaaatatctagattatatttatagatcagcaagtttatgtttagacacatttttagaattaatttaccttagtaattgttctacaaaccttagtaggaggagttcttgtgaagatatattttatgaaaaagataagtattttgttaggtgttttattgtttggaacgagcttgattttaaattcaaatacgtatgcagcgtcgatcggtgagagattaacttcccccgaagaaggttggaaaagatatgacgatatgaatcctgccattaagtatgaaggtagtgggtggggatatgttacaaatgaacctaatagtgtttatgcaaaaacaggccactatatgaaactatctggagcaacaacaaattccataaaattcaaattctacggaactaaattgcgaattattgatttgtattggaccaatagggtaaacaatgtgtccatagagattgatggcaaagtttcgacatacaatccaaataatcctgcaaatctgtatcaagtacttgtgtttgaagtcttagatctaacacccgctgttcatgaagtaaagttaactacgaatagcacaaacaatacattttcgcttgatgcaatagatactgatggagaattggttgatatctacactcccatgaatctagtagtctcccctggagacggtcaagttacattaaactggggacaggttcaagaagctgacagttacacagtcaaatatggaacggaatcaggcaaatatactgaaactgccacagccacaaaagactcatatggaaactttattattcccggcctaaccaacgggacgaaatactactttgttgtgagttctaaattgaatggagcaaattctgaatactccagtgaagcatctgccactcctcaagaaggggatcaaactgaacctgagcaaccttcaggtaaccgtgctttcctggtagtgaccatgacaactggtttagagaaagagttcgatctaagtatgaaagaggtcaacgattttattacctggtatgagggaaagcaagctggaactggatcggcatcatatgccatcaataaacatgataacaacaaaggttcattcagcagcagaaaggattatttgctccacgatcgtatcctaacgtttgaagtgagtgaatactcaaaataaatcaaaagtttagccttaagtggtaatagagtttttcgttgatcagttgaaattagattagatggaagaaggatacacgggcttgagttttttataaccaataaaaaatatagttatatttatagatcagcaagtttatgtttagaataagcatttgatcaccttactatgtttttggattaaattaatagaaaggggattattaaatgaattggattttttcaaaaaaaatcggagttatcataggtgtattcttctttgcatcaattattttttcggactcaagtgtctttgcagcaaaagttggagaacgcttggataagcctgagccaggatggactcggtatgatgatcgatcaccagaattaatttatgggaatgacatggttaaaatagaggatgcagaagactacaacaagacagcgttaggagctgctcataataagccaagtactattaattttaaatttgacggaacaaaaattagactgattatcaatatgtcagattcatatactaaaaaaatagggattagcatagatggtaaagtagaatactttagtgcttatagggagtcttggtcacatcagcggttggcgtacgaaaaagtgggattagaaagaggaatacacaacgttaaaatttggacagaggtaccttcaagcaactatgttgtttatgattatcgctttgatgctatagatgtggattctgatggtaagctgactgattacaatggttctgaaatcaatctaagtgctgaggcaggaaatagtcaggttactctgaaatgggagcaaactaaagacgctgaaagctatacagtcaaatacggaacagaatccggcaaatacactgaaagcgcaacagctactaaagatgcttacggcaatttcgttattccgggtttgaccaacggaacgaaatactactttgttgtgagtgctaaggtgaatggcgttgattctgaatactcaaatgaggcttctgccactccacaaggaggagggagtcaacctgatccagagccaactactggagatcgtgcaatattggtggtcactatgacaacaggcttggaaaaagagtttgacctaagcatgaaagaggtcaatgacttcattgcatggtatgaggctaagcaagcaggttctggatcagcttcatacgcaatcaataagcacgataacaataaaggcccattcagcagccgcaaggattacatgctgtttgatcgtatccttacgtttgaagtaagtgaatactctaaataaatcaaaaagctcagctgaccttaatgggtcagctgagcttttttttgttaagaagcccttccttaaaccaagacctcgcatagcctatggagtaggagtaccctaaaataaaggaggcgttacgtgtgggggaaatgaaaagagactacgagggaatcaccggaagagtttggacatcgatagctgctgtcttggcactattcattttgctggtaatcatattgaaattaattcatttataaagattcttaagctccaccgagggatttaatttgtaaagcatagccccattagttcctgaggaacctagaaggttcgctgttcggcccgtccccgaccttaaagaagttgttgaaacaacgttttagacacacaaaatgaacctcagcggcttttccggagaaggtagggtaataaccccttaacgaagcctgatccacgtcggagcggctgaaataaagtagactgattcatgagggtcgcctctttttggaatggttggtttgtgcttaccattagctgaaaaggcgactctttttatcctatttttggttaatcaacaagcttgactttgcttcaagatcttctataatttccagtgcaacaaaatatccgaaaaataatgttaaaatatcctcgtatcgttttcctgatcctcttgctctacttaatattatattttgactttcttgtattttttttttatggaaagatagagaaacaacggatgaattggaagcgatcaaatccatcattagaattgacaactttttctgaaactcttcaatcggaaagtcattattttctttcgaatacagctgcatcgtttcaggtggatctttaaatgaagtttgatattgagtattgaaaacaccttcattagctattttgtcaacaattaatttaccaaaaacgatccccgatgcgaacgcttgcccagggattcttcctataccatgatcaccattaaattgagcttctccagtagcaaaaacacgattcaagtttatagcctcggcagtagcattgatttcgattcctcctgaagaatagtgcatcgttggtgtaattttgattcttttatttttaactactttaggactaaatccatatgttttgaatttttcatttaacacattttcatcagcatggctcatatccaagtacatgtcctttttttgtttgatgcattctagttggaattttaaaatctcatcaatcatttcgtggtaatcatctcgggcaattgcatcacaaatatactcatcttctaataattgaactccttcctcatctattatttttccttgactcaaagatacaaccccgcccaataaaatttgtcttccgttatatatagaccaaggatgacacattactgtagacatcccctttaatctcgcacctattttcttagctaagattagcgtttcaccagttgaaccgggcgaattatcattgaaacagaattgtcctgcatatccccccgtagctaataccaaataattagtatatattctgataaattgatctgattgtgtgtcataaaatattacgataattccgtgatcgtacttttccaaatgtatcaaaattttattacacatcggttgttcaatatgttgtaataaacaattgattaatttctttcccccatgtgatttaatcatacattcaggcatgataccaaaggatgttttctcataagaaatacccaattcttcgaagaaatttataattatgttggaattcctatatagcgcttcaattacggatcgatctgctccacatttatcaatagtaagattaataatatgattaatttcattctctgagggaacacgtgtatttgctgctgaaagaaaggagttgctttgtttgggtgcactcttttttgttacaatcgtgtacttgatattgttttttgacaaataataagcagcagtaagccctgagatccccgtaccgacaatcaaaattggagtgtagtgttcaacggatattccattttgtttcatcattccaactcccttttaggatgtgaatgttatcttcggctgaatctcgtagtcggttttctatttttttgcaacaaaacgcatcaggatgatatttataaaattcttgctctgttgttaattccctgtgatttatatcaaattatataactatatttcgttttatactttatatagttattaagagctaacaaaatcaaatacaaacagttttgcaaaagtagaggaaaaaaagaaccattatagcaattgctaagatgattcttattacgagttacaatatccttgttaccgacgaagaatggaatctaaacaaaatattttcctgattgtacaattttattccttattttgtcaacaatatctgaaaatatataactgattcagctttcacagtatgaatattcacaaaaattcttaatgtaataactggcgtaccttagaaagggccacagagttcatcgtattcatccgtttgtataacccttttttaaccttcgacttttagtcgaaggtttttactaattaagagctgatagagaaacagtgcaatgaaccgcctatattcaccttctccatccttatagccttaacctatcacttctatagatatcatatcttagaccaatcaaacatcccgtggtatattgttgacattcaagagagagccgttagcttctctccactaggttcgaaaaacacaggggtgaataatgatgagtaaaaagaccatgttcgagaaaatttgggataaccatgtcatctatcaggaagcgggtaagccgagtattttgtacattgatcttcacctcgtacatgaggtaacatcgccacaggcgtttgaaggattacgtcttagcggccgtcaggtgcgtcgtccagagcttacgtttgcaacgatggaccataacgtaccgactaaggaccgttacaatattacggacccgatttccaagcagcagatcgatacattaactcaaaattgccgtgatttcggtgtcacactgtatgatctggatacggttgatcaaggtgttgttcacgttatgggacctgaacttggtctgactcatccgggcaaaacgattgtttgtggtgatagccatacctccacacatggggcgttcggagcgctcgcttttggtatcggaaccagtgaggtagagcacgtaatggcaacacaatgtctccagcaagccaaagccaaaacgatggaagttcgctttgtaggccgccgcaaacctggtgtgacagcaaaggacatgattttgggtgtcatcgccaaatacggtacagatttcgctacaggttatgtaattgagtacacaggtgaatctatccgcgaattgagcatggaagagcgcatgactgtgtgtaacatgtccattgaaggcggagccagagcaggaatgattgcaccggacgaaaccaccttcaactacttgcgtggacgtcaacatgtagcacaaggagctgcttttgagcaagcggttgctgagtggaaagagcttgtcacagatgaaggtgctgagtttgatgtcgtgctggagtttgatgtagatgctttgattccgcaagtaacctggggcactagcccgggaatgggtacagatatttcctcaaccgtaccgattccggcagaactgccaaccgaaaacgaacgtaaagcggctgaaaaagcgcttgaatatatggatttgaagccaggtactccgatcacggatattgcgattgattatgtgtttatcggctcctgcaccaacgggcgaattgaagatttgcgtgcagccgctgaggttgccaaaggttacaaggtttctgacaaagtaacggctatcgtcgtcccaggttcgggtcgtgtgaaaattcaggctgaagaagaaggactggacgtcatttttaaagaagcaggatttgagtggcgtgaagcgggatgcagtatgtgtcttgcgatgaatccagatgtattgcaaccgggacagcgttgtgcttcgacttctaatcgtaactttgaaggtcgtcagggacgcggaggacggactcatctggtatctccagcaatggcagccgctgcggcgattcatggacattttgttgatgtacgggattggaaattcaagcaggaagaagtagtccgctaggatacagaggaggaattacgatggaagctttcacaacattaaaaggaattgtagcccctgtggatcgggtaaacgtggacacagatgctatcatacctaagcagtttttgaaacgaattgaacgtacgggctttggacagtttctgttctacgagtggcggtttgatgaagccggcaatgtcaatcctgaatttgaacccaacaagcctcgttatgcaggagcgtctgtgctgatctctcgcgctaactttggctgcggctcctcacgtgagcatgcgccctgggcgattatggactatgggtttcgttgcgtaattgcaccgtcttatgcagatatcttctataataactgttttaaaaatggtatattgccgatcaagctatctgaagagcaagtagaggaattgtttcagcgtacggcgcagcatgataactaccaattgaacgtagacctgaatgaaaaaacaatcactgacgactatggtctgaaaattgaattcgatctggatgaacatcgccgccagttcctgctacaaggcttggacgatattggcctgacactccagcatgaatctgaaattctggcttatgaacaaaaacgtgctgcgaaacaaggtgcatagggttaattcccagttcagtttcaatacgtagtcatataactagctcattcgttagacagaaagcccgtactggcaattcttttgcctgcgggcttttattatactcaaacaataaattggaaaataaggggttgacggttcgactcagcatggtattgtaaatgtaaattggttgaaggactgtgtctgtgagaaataccaaaaaatacatatataagttaggggaatgaggatgaagaaatatggttgggtgatactagcggctatcttgatttggttatggccgtcctcccctcatgtgaatgcggctggagcagatttgtttttggatggcaaaagagtggaagcgcctgcagatgccaaacctgaaatggttaatggaaaaatcatggtaccgctccgggtggttggggagcagctggggtatcagttcaagtgggaaccacaagcctataaaatctcaatccaaaaaaacagtaccgatatgtctatgtatgtaggccgtacatcggctgatgtgaatggaaaaacagtaagtctggatgcgcctcctgtacttcggggcaattcgaccatggttccattgcgttttgttggggagcaaatggggctgaaagtagattggaataataaaagtaaatccgtaaatctcagtcaaatggctgcaactcaacaagcgaataaacagtctcaatcccaaccatcgtcgcaaacgtcaacacagagtacaactagcaccaataaaacgtcttcagcaacagcgacgacaataaacccagttgaagcagacaagcatactgaagccgcatcttcaccatccaagcagcaaaatacagaacagaccacagcgaatgcgttgcttgtacaaaatattacttttgagggtgaaacgttaaagatttctttgaacaaagatgttacccctaaagtatccaaaatgacggggaatgatcgtattgttgtagatttaccagaagcttcaatgatgactgattttcttcagtcattcccgattcgtagcgatggtacgcgggcgctgacgaatagtaacagtgaggatgtgcaggaaattagatttgctcccacagatggaccgaatgggggcgtacgcattgtcattgctttaaatcaagcacgtgaatacgatctatcaaccaatggcctaggcgatatcacccttcaattgcgtgagcatagtgtgaatccagtagtggtaacaccaacgaatgtcgaaggacggcgaatcgtcgtcattgatcccggacatggtggcaaagaccctggagcaggtagtgtgactgggcgacatgaaaaggaatttacattggcggtagcgttaaaagtcgagcagcttctgcaaaatgatcctgacattcaaatcgtattgactcgcaatggagatacgtatcccacgttggatgaacgaccacaactcgctaatagtcagcaggcaagcgtgtttgtatctattcatggtaatagtatgcaagcttcagataaaggaaaaaccaatggctctgaaacctattatgcacgtcaggacagtttggcactggcaaagacgatgcataaatatcttgtagcggctaccggatttaagaataatggcattagggtggcaaaccatgcagtgacgagaaaatcacaaatgcctgctgtattgctggaatgtggctaccttagtaatctatccaatgaagcagccatgtttacagaagaaacacaggagaagattgccgaaggtattgtcgatgggttgaaggagtatcttggaacgggcacaggagcaactgaatcacttaactaaggatgttagcaataaaagctactttccaccttttaatgaaaattcatgggggtgaaaagtagcttttttagttttttcagctgtgactttggacggaaaacgaatgatctatatttttagtcaaaattcgacaaaaatagttctttggcacgtatatttctgttatgatggaatatattcgcaacttttggtgtgagataacgtctaaaaggttgtctgatattacataagcgcgtatatcaggtcgccgcaccggagcatgtggcaaaaaaattatgaatggaagggtgacgaatgaagaaatttggttttttattgttattatttgtcttcatgtgggcggttccgggttatggacatgcggcttcgagtggaacacaaatctatctcgacgatcaacagttaagtgtccctagtggtgctaaggcacaagtaattggcggaagtacaatggtcccgctacgcgtaatttctgaaaatttgggatatgacgtgacatggaagcagcaggcgcgaaccataacgattgagaaggacagtacctcgatccgaatgataatcggaagtaagacggcgactgtcaatggaagcgacattagtctggatgcttcgcctctgctgcgttccaattatgcccttgtaccgcttcgttttatcggcgagcaaatgggactggacgtaaaatgggacagcagctccaagtccgtaaaattatatacccgcagtagcgggtctggaaacggggaatttacacctcccaagtctggaaataacagtacaggtactggaagtgttactgcaccaacgaacaatgcgaactcaggtgttacacaggtgcagggagttagtttcagccaaaaccgtttaaccatcaccacagccagtgccgtcaagccgaaagcgtttacgatgacaggccctgatcgggtagtggtggatttgccagcgactgcgtttgctgacaattttggagaccagcagaagctggatagcaacttaaatggttcgttggacattgagaatgaagcggatgtgtccggtatccggtatgctttgtttcaaaaggaaccttcaacggtgcgcgttgttattgatttaaaacatgccatgaattataccgcatataatgatggatcgaatcgtgttatcgtcgatttggcttccaaggattcagtgaataccacgccagacgcaacgttaccagatggctcactgccggatgacacgcagacatcaccaactaacagcaatggtaaaaaggtcgttgttattgatgctggtcatggagcaaaagattcaggtgcagttggtgtttcgagaaaaaattatgaaaagaccttcaacctggctatggctctgaaagtagaaagcatattaaagcagaaccccaatcttgaggttgtgctgacacgcagtgatgatacattcttggagcttaaacagcgcgtaaaagtagctgaaaaccttaatgctaacgtgttcgtgtccattcatgctaacagcagcggtagctcagcttccaacggtacagagacgtattaccagcgtagtgcaagcaaagcgttcgctaacgttatgcataagtactttgctcctgcgacgggtctgacagaccgaggcattcgttatggcaatttccatgtaattcgggaaacgactatgccagccgtattgcttgaagtaggatatctgagtaatgcaaaagaggaagccacactgtttgatgaagattttcaaaatcgggtagctcaagggattgcagatggaatcacagagtatctcgacgtaaaataaatcttcaacaaatcgcttgtcaacgtcaagcaaggagggggatatatgaacaagaaaatcgtaattgcaggcctgctggcattgttcgccattgcaggtgcagggtgtgcctctaagcaaacatcggctcctgcgactccatctcaggaaacacaaacttctaatgcacaaaatagtacacccgaacagacgacccctgatccatcggctcagtctgctgagaataacggggcgagtcaaacacctgcatctccgtcaacagagcctacaaagaccaagacggacacggaaaattcaggagatcgacaaacacagcagattacggtgtactatacggatacacaagagaacggcttgaaagaacagaaaaaggaaattacctatccaagcgagctggaaaaattgcaaaaagcgtttgaagctctgcaacagagtggggattctgctctaatcccgttgtggtccgagaaaatttccgtgcataagatcaaattggataacggtgcattgacttttgatatttccctgccggacgaggctcgattgggagctggcggcgaggaattggctatcgatgccttgaagaaaacgatgttccaattcaaggaagtcaaaacgctggatttgctcgtagatgggcaatctctggagtccttaatgggacatgtagatttggatcatcccatgagtcgctaaccgatcagacggtatgaaaatttcttagggatttacacacttttcacgtgcaatctgtgacagataatgataatataggagtgtatttctcgcctatgcaggcagtcatgcacaaatagtattcgtttctttccggatgattatttagagtgaccgtcttgatgcgggctatcccgtatcaagacgttttttttggtaggaggtaggatttccgtgaatgcagcaaccgcacgtcatatattggacaccatcggtacgatgtttccggatgcccattgtgagttgaaccatgacaatgcttttgaattaacgatcgccgtgttattgtctgctcaatgctccgatcagatggtcaataaagtaacggcagacctgtttcaaaaatacaagtcacctgaggattatttggctgttcctcttgaggaactggagcaggatattcgcagaatcggcttgtaccgaaacaaggccaagcatattcataacctctgtcgtattttaatagaccagtacgggggagagataccttcagagcacgatcaactggttaagctacccggtgtcggccgcaagacggctaacgtcgtagtatctactgcttttaatgtaccagctattgcggtagatacgcatgtagagcgtatttccaaacggctcggttttgcagggtgggatgattcagtgcttgaggtggaaaaaaagctgatgaagagggtacctagggatgaatggtctttgacccaccacaggcttatttttttcggacgctaccattgcaaagctcaaaatcctcaatgtcaggtatgtccgttgcttgatgtgtgcagggaaggcaagaaacgtatgaaaacgtctcttatcagaaaagataaggaacgtagagcttaaagacccacagaggtaacaaagggtttaaccatttatgtgtagaaaaggatgaagagtatgaagtgcatttcggtatatacagacaattttgaagcgttctctgatatttttgagcaaattgtaacaacagaatttgctgaaaacgaagagcgcgagcttgagggaatcacggttagtcattccggtgatgtacctgagcattatctggagcgtatgtcacaaaagccagaagtggtcgtaatgaaggacaaatcccgtgggattacgattttacagcatggtcaagtatttgaaattttgctgccagtgcttgagactgcagccaattaagttcaattagcggacgacatgcgttgcatgttccggtgtaggcggctcggctggtttatccagcccgaaggcgcattatacatgaaccttgcagaccatcctgatatggctagagcctattccaatgaagtgtgcatacattttgcaccttgaattatggtatcgcgttccccaggttccaaaaggttaatgtacgtgatgagtaggctcacccgttgtatacatatcttacttcgtcgttgtcctttaagggggctttgatgaaatgcattcggttgccaaaatacttattcctaatgatccgttttggacagaataaaatgaacttattattatcatgtacaaaaaaacagcgttccctaaagccaggtactggcggggagcgctgtttagtttttttgatgtgatgattctcacaacggcttaggaatgctacaatatagctatttggtgcagacaagtgataaggagtggaaccgtagcttatgatgcaaacgattacaggagatgcgggaaagtggttggatacgatagaacagatacagaatacattgcgtaaagccggggacgaagcgggagcgaaggcgataggtgatctgctggaaaaagcatatgtgcaggagctgaccattgccttttgtggacatttttcagcgggtaaatcgagcttgattaacagcctatgtggtaaaaccgtgctgccatctggaccggtgcctacgagcgctaatgtagtgtccatccgttatgggcgtccgagagcgctcattcatccagccaaatcagcggaaaatccagagccggaaatcgtggaggcctccctgtccgagcttgctgagtattgtaaaaatggtggagcctatgaatcggttcaagtgtgggaggatgttcccatattatctagcggaggagtgttgctggatacaccaggcgtagattccacagaccacggacatgcgctggcgacacattctgctttacattgggcagatattgttttttatgtgatggattacaaccatgtccaatctgaaaataatttgtcctttgccaaaagtttgtcggattggggcaagccgttatatttgatcatcaatcaaatcgataaacaccgggagcgagagctttcatttacacgttatcgtaatgaggtggagactagctttcatgcctggcaggttcattatacggatatcctctttacttccttgaaggagcagaatcatccatggaaccagtggaaacagttgacgcacctgatcccgaaattgctggagcgaaaaacagagcttttagcatacagtttagtgtcctctatgcaccatttggtagagcaacatgtggagactgtacaggcagctgaagaagaggaactgaacacactgctaaaagaagcaggtggagaagaagccattttgcgcctggatatagagcagaaaaccttgcagcaagaagatgaacactggaagatgcttccggagcaggagcgtaaacgactgcgtcaagagctggatcatctactggaacacgcacatttgacgccagcggagctacgtgaagcggcaagcgaatacttagagagccgcaagccgggcttcaaaacaggactatggtttgcaggaggaaagactgagcgagaaaaggaaagccgtttggaacggctgacaggaatgctgactgatcaggtggaaggacaattgcttcctcatgtgcgggagttactgaggtcttggggtgacggtcagggtttgtggtccgctgcgatggagcaggagctggatgacatccgccctgtaacggatcggcaactggtagagcagacggtgaaggaaaatgcgttgtcgccggagtatacgttgaactattgcaaggatctacgtgctgctgtgaccgccgattgccgccgcaaggcgcttacgctagtagaccgcctgctggcccagcttgcagtgcgagccgaagcccgccgcgcggctctcgcggatgcgcgcactgcgctgctggcgcaggcggaggcggcgagccgctacagcacccgcgtgc

SEQ ID NO: 32 - DNA, 221043 bp, Unknown
  Kingdom: Bacteria, Phylum: Firmicutes, Class: Bacilli, Order: Bacillales, Family: Paenibacillaceae, Genus: Paenibacillus
ataggcgcacttggccccgaaggacttgcaggagcacttggaccccagggacttgcagggattgcaggagcaattggtgcagctggattggcaggaccaacaggagcagcaggaccagcaggaccagcaggaccagcaggaccagcaggagcagtaggagcagtaggaccagcaggaccagcaggagcagtaggaccagcaggaccggtaggaccagcgggaccagtaggagcagcaggagcaacaggtccagcgggacccgcagggccggcaggtggagtattaggctttgcagatttctttgccttgatgcctcctgataatgcagcaactgttgctcccgatacggacgtaagttttccgcaagatggtccaatcagtgggactgcaattacccgtataaatgcgagctcttttaacttggctacaattggcacttatcaggttttgtttcaggtaggtgtaaacgaaccgggtcaactcattttaacactcaacggcgctgatctggcttatacggtggtcgggcgtgcaacaggtacttctcaaatagtaggaatggctcttgtgcaaacaacggtcattaattcagtactcacagtgcgaaaccctgctggcaatgccgcggcactcacgatcactccattagctggaggaacaagaccagtttccgcgcaccttgttattacgcaggttgcatagagggaaagaaatgcagtatttttcgataataatgccaatatcaacgatagttcaataaccacgaggagacggcagacgatagagtggctgtcgttttctcaactaacgagcaaattagcttaataaatacattgatgccgcaaacgaaaaagaggagtagatatccttagggcatctactccatacttttaacgttaatgttaaattgttggttcttttggcgtaatcaaaacctacgggtgatcttttgaaagatggttagatatcgagtttacgggtaccgatccatttcaccatgtcaggatcgcgatgtgaaaagaacaggctctgtttcgtatctaacgtagtaatcgactccatatcctcctggcttaactcaaagtcaaagatattgaagttttcgataattctttctttacgaacagactttggaatcacaacaacttctctttgtgtcaaccagcgtaaaaccacctgagcaacggatttattatacttttcagctatggataccaatactttattctggaacaagttatttttcccttcagcaaaaggcgcccaggattcgatctgaacattattctctttcatgaattttgcattttcgatttgctggttgaatgggtgcgtttcaacctgattcacggcaggaattacttcattatgaataatcaaatcgatcaggcgatcctcatggaagttactaacgccgattgcacggacctttccttcacggtacaattcctccatagcgcgccaagaaccaaacacatctccatatggctggtgaattaaatacaaatccaaataatccaattgcaatctatccagtgatttttcaaatgtcttttttgtacgctcataacccgtatcctgaacccaaagtttcgtagtgataaataactcctctcttgtcacgccactacgtttgatcgctctgccaacggcttcttcatttaaataagaggcagcggtatctatcagccgatagcctgccataatagcgtcataaacgctttgttcacattcatttgcatcttggatctgataaacaccaaaaccgagtataggcatctcaaccccattgttcaaagttactttttgcatataaaatcctccagtatttttaattattatgtgtaaatcaactacaattcatattcataacagacacccacttcacatctttattatgcaccagatgacaaagcgatcgttatcccgttcgtgccaaatgtttgcctaatcctctcactaccacctatttaacagataaatatggactataatcgaactttaaagaatgacggcacggggaggatcaaatgtctgaaaataatcactaagcagcaaataccccataccctatcccaaaaattctttacatacgcagactacaaattctaccttaggagcgaatctattaaataaataccttcgcatctggaaaacccaacgtaacgattccccactacagcaactcaaaataaatttctcagtttcacggtgtccgtttgtataatctgatcaaacctcgatatatctaaaaatgcctccttgctctctatctaaatttctttctctccatcctctgtaatcttaattcagataaatctgtcgtagcttggttgattgccgatctaacagtatccctctattaggttgaaatcctatataaatcggttgaaaatgttgattttaccaatggacaaggatttgtacaatagagttgtagcgcttacatttccaaggaggttgcggcgaaatgaagagaattcagctgattggcaaacaaatcaggaccccgagatccaaaaggaggccgtgttgatgaaatttaagggaatattggcggcatttttgtttttaaccacagcgtctgtgttgtttgggacgcatacggcagaggcccatgaactatccaatgacaagctgacgattcagacaggcgagcatggcgaaatttcatccatacgtatcaagggagatgctttcccgacagagtatgtcatgaacgcaacggtaacacctgaacagaacaccgcagatcatcagtggctaggggagctgatgttcacgtaccgattggatggaggcagctggacgaaggcatggacgaacaagtcggcagatgcacgtaagatcacaaccagtgggaaccgtgtcactgtcacgtacgagaattctactcatgcagaaggcatacgcaattttaaagtcatcgaaacgtattcggcagagtcgaatggttcggtgttgtggaatatacaggtgcagaatacaagtgggaaaaaattggagattggcgatttcggtttgcctctgccttttaatgagcagtggaccaatggtgatgcgatctacgaaactagagtggtgacgcattcctttgtcggcaataacagctcctacatcacagctgggcgtcccagcggcattggttcttccctgctgctgattcctgattccacaacgggtgcgggctttgagtatcaggatcactggcgggatgaggaacatccgggcagtaaatgggcgtggaacccggctaacgaaggcaaatggctggaaggactcaatgtattttatattcattccaatgtcatcaagtccaccaaccgggggtatttgcccaatacaagcctgatcctgaatcctggtcaaagcaaaaactatggtttcaagtttctggcggtgaaggacgagcatgatgtaaaagatacgttgtaccaagaaaacttggtggatacaacagtcgtaccgggtatgatcgtgcctacgaatcaaaaggcgaaggtggacctgcgctccaagcaggcgatcagcaaagtaacctatccagacggaaccgctattccgcagacggatagcaagcccggaggacattacatttatgaactgaaatttactaagctgggtccaaacttcataacggtagaatacggcaacggtaataaaacggtgttacaattctatgccatcgagccgattgatctcgcgctgcaacggcatgctacatttatggtcgacaaaacccaatggaatgtaccgggtgatctgcgcgacaaggtatttgacgattggatgatgcataccaaatccaaacgcaacatttttaacggctattggggctggggggatgattggggtctgacccacgggcagttcctagctgagaaaaacacactgtctcccgtcgccaaagaggtgcgggcagtagacgattatttggagacggcgatctggacgaatctgatgaacggacatcatgaggattatttaattcatgatttcttgatgccagagcctaacgatacaccgacctatcgagggtatgcttatccgcacgtatacaacacgtatttcagcatgtacaagattgccaaggaatacccggatcttgtcacttacaagcatccaaaggaaacctatttgctgcgggcgtataacattttcaaagcattgtatgaagggccagtcgcgtacaactgggaaacaggtttgatgggcgaactgaccacaccggatattattcaggcacttcatgatgaaggctatgatgatgaagcgaatgatctcaaggaaaaaatggatcgcaaatataacaattttaaaaatacaaagtatccttacggttctgaatatagctatgacaatacaggggaagaggctgtatatacgttagccaaacagaatatagatacagagggcgagcaaagtaaagccctggaaatgatgagtaaaattaatgccaaaacccgtgcggcacgcggtcatatgcccgtatggtactactacaccgatccggtgacgattaccggggagaactggtttaacttccagtacacgacttcgcttgctggatatgcgatggatgattggattcgccatcatgaggacaatcaccgtgaggaacaacaacggttgtcctatgcagctaaaattgccaatgtcggagcgattaactccgggcaaatcagctcggaccctgaaaacatcggggcggtcgcatggacttatcaagcggaaaaaggcaataacggcacgaacggcactggcggtggtaaaaatgttccgctctttaacggctggcgcggcatgagcggtgaggctgatctcggattgttcggtgcgctcaaaacgttaagtgctgatatcgcgattgatcctattttcggattgacgggctacggtgcagaggtgagcaaaaacggcaacgtgtatacgatcaagccgctggacggcctgttcaagcgcatcaatctgatcacggaaaagctgtatatcgagctggaaaaggaccaatatacagaagccaagctggcaacatccaaggattacgtatggctccaactgaaaaatcaaacaccgggtcaagcccattccacgtacgttacatttgacggtttgaaaaaaggaacgtatttggttaaagtaggcggtcaatcacaagggaagtttaatgcgtatgcgccttccaacaagcttaaattggagattggtacagcatcctcttacacggtagagctgacaccaaccacacctgatccgaacaaagcacctgtcgtggatgccggcaaagattcgaaggtaaagctgccggatcagatcattctgaaaggcacggctacggatgatgggcttccgcaaggaaaggtgacaaacgagtggagtctggttgaaggaccacaggacgcgaaggtcacattcagtaacaaaacatcgctgcgcacgaaggtggacgtttccgagccgggaacgtatgtgttcaagctgacagccagcgattctcagttgtcagcggaggctaaagtaacggtggtagctgaaccggcggctccgttacttgaacagcttgcagcttacaagtttgatgaaacaagcggttctgtagttgcggattcatcagacagcggtaatgatgctgccgtgaaggggacggctgcatgggctgcgggtaaaacaggcaatgctgtcagtctgaacggcaaggacagctatgtgcagcttccggcgggtattgtcagtcgggcacagcaattgaccgtatccggttgggttaaagcgaacaccctgagcgattatgtgcggatttttgactttggctccgggacgaatgaatatatgttcctgacgcctaaagcaggaaataccatgctgtttgccattaccaaccaaggcaacgggcagggacaggagcagacgattgaaggccctgtactgccgacaggcgtatggaagcatgttgcggtcacgctttcgggttccacaggtattttgtacgtggatggaaaagaagtgagacgcaataccaacttgaccttaaatcctatcagtctgggtcagaccaaaaataattttatcggcaaatctcagtaccctgatccatatttcaatggtctggtggatgaattccgtatctacagccgtgctttgaatgcaaccgaggtggcaggtctggcctccggtacagcacagaatctggcggcaactgagaaaattaccgcgttaaaagaagtaaatgtaacgacacatgtcggtgaaaaaccggaactgccaagcgtagtggaagctacgtacggagaaggctccactaaatgggtggctgtggaatgggaggatatagcccctgcacaatatgctgctccaggttcgtttgagttgaagggcaaagtagaagggacagagttaaaggcaattgcgaaggtaaccgtgattgaggcaggaggggctgcggctccatcggtaacaccggttagcccggagactttagtaaccccgccaactacgacaccctcggtaacatctgccttaccgcctcggcctatcagctccgctaaatcagcggggggatcctgaatgggaggcaacaacgcatagttatgagtaacctttcccatcgtcactttcctcctgtaaaggggagagtggcggtgggtatccttgcatttggagtgcaaagctgcgaacaaaaatgtgaatgggggaaaaagtatgagcaagattacatttctgggtgcaggtagtacggtatttgctaaaaatgtgcttggcgattgtatgttgacgcctgcattgcagggctttgaactggcgttgtttgatattgatcccataaggctgaaagattcggaaaatattttatccaatttgaaaaaaacaacagggagcacctgtgtgattcgctcctacactgaccgcaaggaagcactgcgtggggcgacctatgtggtaaacgccatccaggtaggcggctatgatccgtgtacaattacggattttgaaattccaaaaaaatacggcctgcgccaaacgattgccgatacggtcggtattggcggtattttccgcaatttacgtacaattccggtgatgctcgattttgcggcagatgtgcgcgaggtgtgcccggatgcatggtttctcaactacacgaatccgatggctgtgctgacgaatgtgatgaacgttcatggaggtgtccgtacggtagggctgtgtcatagcgtgcaggcgtgtataccggaactgtttaaaagcctcgggctggagcaggaaggtgtaaaggcaaaaatcgcaggcatcaatcatatggcgtggttgctcgaagtgagcaaggacggtgtggatttatatcctgagattaaaaaacgagccgccgctaagcagcaggaaaagcatcatgatatggtgcgctttgaaatgatgctaaaattcggctattacattacggagtcgtccgagcataatgcggagtatcatccgtattttatcaaacgggcataccctgagctgatcgagcgcttcaatattcctttggatgaatacccgcgccgctgtgtgagtcaaattgaacggtgggaaacgatgcgtgaggagcttttgggcaatcaggatctgcgtcatgaacggtcaaacgagtatgcctcttatatatttgaggcgatcgaaacgaatcagccttttgccattggcggcaatgtgatgaacacaggcttaattaccaatctaccgaaggaagcctgtgtggaggtaccttgtctggtgaatcgtaacggggttacgccaacctttgtcggggatttgccaccccaatgcgctgcgctgaaccggacgaatattaatacccagctgttaacgattgaagctgcaatcaccgggaaaaaggagcacatttatcacgctgctatgctggacccgcacacgtccgcagagctgtccatggatgatattgtttctctgtgtgatgacctgattgcagcccacgggacatggctcccagcctatgtctaagggaggcagatgaatgggaggccggggtcgtcaaaagttcgtcgggattcctacgatccgtgggaaattcattgtactgacgctggtactcaccgtcattccgatggtggtactgacctttaccttttaccggatcgcggcccattcccttggtgagaagtcggaggcactggctatgcagtcccggcaaatgagtgaaaattacgtcaatgcgacgctctccgatttgaatgatctgaccaattccattctcagcaatcctgatgtgcagtctacgctggagaccaagccggaagatgattatgaatatttacggaacgatgaaacactcagtatggtggtccgtacgcaaacccagaccaagccgtatatcacgtcctctctcatatatgccgccaatggcgggctcaagcattctctctatcaagggaatgtttcggtccgttttggcggccttcctacattagaggaagcacgtgtgtactatcgccgcctgctcgctgagcggcccatgatgtggatggctcattctccgtttgaatcaggacgcgggatggcggaggatcgcatctatgtggggaagctgcttcgaaaaacgactggagattatgcacccctcggatttttgctgctggaaatcgacaaggccagtctgtttcgggggcttgcttttcatgaaacagacggcaatacccagatgtgggtgctggatcaggagggcgagcctgtataccgattgccggagcagggtgttgcggaccaagcgctattgcggcagattgccaaatcggctgtggataggcctgtgcttacgaaggactggagaacatggaacggccgccagacgatgatctcttacggcccgttaaatgaaggacaatggacgttgctgcaaaaagttgatcagtccgtgctgttcgaggatgcgcggaaaatcggcgcctggaccatctggacttttttgattgcattgatgctgggctggatgttgtcttatcggctaagtgacacgattcgtcgccccctgcttcaattgagccgattgatggcggtcgatgggagtgtgagcgctacaggctcagcccaagctttcgaagctcctacttccgttgtttttaatcctaaggatgaggtggggcagatcgggcagcgttttcttcatatgatgcaaaaaaatcatgaattgtacggtcaggtctacgaagcattgctgtcgcgtaagcaggctgagtttcgcgcgcttcaggcgcagattaatccgcattttttgtacaacacgctagaatcactgaagggaatggccttggcgaatgggcaacgggatatggcagaggtaatcggtgcctttggtaaatgttttcgcatttcgctaagttatggccgagagcaaatcagcttgggacaggaagttgagcatgtaagcgcctatgtgaaggtgcagcagttcagatttaggaattcgttcgagtggatttgcgaggtcgaggaggatatttgcggattttatgtacccaaactgatcctccagccactcgtcgaaaatgctatttaccacggcttaaaagggcgcaccgaccgtggctatatcatgttatccggtacaagggaaggggatatgttgcgtttgacggtcagtgatgatgggggcggtattggagccgagcgtctgaacgatatccggaagtcgctggatgcggaacgggggaatgctattggctttgggttgcgcaatgtgcatgaacgtcttcggcattatggtccgcaatatggactgtccgtgacaagcgagccgggtcagtacacctcggttactttactggcacccattcgaaccgaataagaaaggggaggatggcatgtaccagctgctgattgtggacgacgaatatcatattcgggaaggactgaagctgatggtggcggaaagtggcctgtcagtggaagtcagtgatgtggcggaggacggcgcaacggcattacgtttgtatacggagcagcgaccggacatgattttactggatattaatttaccggatatgagtggactggacgtagcaaaaaccattcgggaaaaggatcagcagaccccgttattatttctaacagggtacgaatctatgacatatattcgtcaggcagtttcgcttcaagcggtcgattatttgctcaagccggtgaccagcggggatttcgaagcggcattgagccgggctgaggatcgcattgcgcaatggcgaagaagcgaggaggaagccattcaccgccatcgttcattggagccattgtacagggagcatctactgctggatttgctccagcagcggcgtcctgcagccgacgtcattcgagagatggacgggctgggatttttcggcgagacgagtggaccgccttataccgtactgtgctgcgagctggaggagtcgtcgcagcaggaggcaaccgccactagcaagccacacggttccatgcataaaagcagccatgtattcgccggactgacgggggaggctgcggcagcagccggggcgaaggcgcatggtgcggcggtttcccgcgatcggcgtgttgtgctgctggcgacggcatcttgcagggccgcggagcggacggcacagcagattcgtcaggccgtgcaggaacgattgagccagggcgtgtccatcgggattagccgtcccgttcaacggatggagcaacttcccgaagcgtatgaggaagctgtgcaagcggcggagcatcgggggtgggtgggctatagccagatcattccctatgagagcattcagacggccgagccgaacagcagtcaattactggagaaggaactactgatgattacggaaattcgagccggcaatgatgctgccgtacatgcgattttacaggaatggtcaggacaattggcgggcttgcctgtcaagcaggtgaaaatgatcgtcactcagctcgtcctgttcgtcatgcggatcgtccagagtgatgcatctgtaggacaaacatccatgcaggagcaggacccgttgttggagctgtcccgattacggcatgggcccgagatgattgattatgtatcgcgctattttgttcgggtgggtcgtcatgtccgagaatcacgcgagaagggcattccgcgcaaattccaacaggccaaggaatggattcgcgagcatcttcaggaggatggcgggctgaaccgtctggcagagtacatgaatatgagccccaagtatttgagtgcccgtttcaagcaagttacaggtgaaagcttcgccgactaccagacgcgtgttcgctttgagcgagcccgagaactgctgctggacccgaatcgcaaggtggcggaggtagcggaggttgtgggattcacagataccaactattttagcattgcctttaaaaagcataccggactgaccccgacggagttccgtaaaacatttttgtaaacgcgctgttaaaaaaatcataccaaaacaaagagagtctggagtcgttgggtggtcggctctgggctctcggcgcataataggcttgtaaggagaaaccagttcaggaaggggccggttgatttgctgaaacgaaggttacggacatggatggctctcgtgatgacggcgatgttgacaggactgacggcttgcagtggtaacgctggcgaaccggctaatcccaatgcggtcgaactcaagttcatgtactggggaagcaatgacgagaagcaggcgatggaaaaaatgattcaaagctttaatgcatcccacccgaacattcgggtgaagggcgagcatgtccctggtgactacacgacgaaaattaacacgttaatggctgccaatcagcttcctgatatcgcctacctgggcgattccctcacgatgaaatgggcaagtgaaggcagactcctggatttatcctcttattatgacgaatatcccgaattaaaaaacaagctcaaatcctcctatctctacagcgaacccggcaagtctattggaaattacaccgcattggaagtgatgcagttattttacaacaaggagttgtttacagaagcaagggtacccgtccctccggctgatcctcaaaaagcgtggacatgggatgaatttctggaaattgccaaaaagctgaccaaggatcagaacggcaagcatccgggagacagtggatttgatccgaaaaatattgtgcaatacggctttgccttcggcaatgaccgcagctcctgggggccgcttttagcgagcaacggtggaggtttgactgacaaaacaggcaagaagtacaccctgaacagtcctgagtcggtggaggtttttcagaagttgcaggatctggttttcaaggagcatgtttctcctgatttgatccagcagcaggacatgccgtccaatacgattcggcttcagacaagaaaggtcgccatggtggtggacgggacatggtccctgctcgatttttcgaacaacaagcaactgcaatggagtatcggcgttctgccgaagctaaaagagcccaaaacgatgatcgttgcgggagccacggtcattttccagagcaccaagcacccgaaggaagcgctcgaattttatttgtaccataacaatcccgaaaaggtggatttgttcaagtccggtctgtggatgcctatcgaggaaaaatattataccaatgagcaggccatccagtcatggaccaataatgccgcacatccaccggaatttcaaaaggctggcattgagtatgccagagattatgcgatcaagccgtccacttcgacccttcgcaactggcctgatatcggttccaagctgaccccagggctggatctgatctggacgaacaagaagacgccgcagcaggcgctggatgaactggagcccatcattcagccattgcttcaaggagtatacccggatgagtaatgcggcgggacagctgcgaaaggagaacagcccatgaagcgaccaaaatcaggaatgatgcgcatggagcgaaactggggtctgctattcgcgcttcctgccatcctcggattaatgatatttacaattggaccgatcgcagcctcgttcgtattcagcttaaccgattggacgattggcggacagatgacctttatcggattggacaattatcgaaccattttgaccgaggatgctaccttttcccaatccatgttcgtgaccacatattatgcactgggcagcgtacctctaggcttggcggcagcttttatcattgcgctgttattaaatcaaaaggtgaagggtttgtcggtgttccgtacgatttattatttacctaccattgtgccgagtattgccaacacgatgctgtggctatggatgttcaacccggattttggtctgttaaattcgctgctggagggcgttggactgccagggagcaaatggatttatgacgagagcactgcaataccctcgctgattatgatgagcacctgggggatcgggaacacggtcattatctttttggcgggacttcagtcggttcccacccatctgtatgaagcagctgaggtagacggcggcaataggtggcataaattttttcacattaccattccttcgatgacaccgaccatctttttcaatctggtcatgtctttaatcagcacctttcaggccttcaatcaggcgtatgttatgaccaacgggggacctaacaattcaaccctgttctatgtgttctacttgtggcgtacggcctttacggagactaaaatcggctacgcctcagcgctggcctggatcttatttttcgtcatcatggtgctaacggttctgattttctccacatccaaaaagtgggttcactatgaaggaggggaacgttcatgaatcaggtcacttcttctgtcaatccttcacaaacaccacaacatccgcttccacagcctgaacgctcccgaagtcctgctaccgccgccacccgttccaaaccattcccaatcagccgtgttgtactgtatatcgttttaattataggcagtgttttaatgctgttgccattcgtatggctcattcgcagctctctgatgggaacatcgcaaattttcgtgttcccgccggagtggataccctctccttttcaatggagcaattacccggaagcgctgacttcagtaccgttcggcaggtattttatgaatacgttcatgattgaggtatgtgtgctggcaggagtgatgttgacctcgattgtatcggcgtttacctttgcccgcctacgctggcctggacgtaatctgattttttctctgctgatcgggtcgatgatgctgccttacgcggtgacgctgattcccactttcgtgatgtggcgtgagttgggcgggctgaatacatttctgccgctgattgttcctgcatggttcggtggaggggcatttaacatcttcttgatgcgacaattcatgctgacgattccacgcgatttggacgaagcggcttatatggacggaggtacgcctctgactgtactatggcgcgtcattattcctttatcttcgcctgcattgatcgtgatcggaatatttacatttattgatgtgtggaatgattttttgggtccgattatttacttaagtgacgaaaagcattttacgctagcgctggggctagcgacttttcggggattgaacaataccaactggccttacctgatggcggcttccagcacgattttggctcccatcgtcctgatattttttatcggacaacgctattttatcgaaggcatcacattgacagggattaaaggctaaaaggaagctcagacgcgctggtgtgctggaaaaagagacgaaggagtgggcgcaggacttacgggaaagcggcagcgagaagagcataaattgtgttcaaaagcaagtggagagtgtgttctaaggtatatgccctgaaaagagatgtggaataaggaggcgtacgagtgaaagaggaagagagtcaaaagacaaaaccgttacagggtgttcctggcagactggcccggttacgctcggaattcccggctctagggatagatgcactgcttattacacatgggcctaatcgaagatatatgaccggatttacaggctccgctggaattgcgcttgttacgctgaaagaggcttttttagtgacggatttccgctatatgatgcaggcaacagatcaggcagtggaatattcagttattcggcatgaggcgcaaatctttcaaaccgtggccgatctcacaagtaaattgggtgtctacagactgggtttggagagccggcatgtctcacttcaacagtcgggacagcttcaagccgcgctgggctcgttggagtacgtgcaaacggaggatgtcattgaacggctgcgcgatgtgaaggacgatgaagagattcgcaccattagcgaagctgcgcgtattaccgatgcagccttcacggaggtgctgaattatattcagcctggggttacagagcgacggattgcggcggaactggaatatcagctccggctcgcaggcgcggaatcaggcggttttgcgttcattgtcgcttcaggcgagcgttcggcgctgccgcacggactggccagtgacaaggaaattggtcagaatgagttcgtcacaatggattttggcgcaaatgtgcgtggttatctatccgatatcacgcgtaccgtattcgtaggccagccctcagaacaacatgagaaattatatgccattgtgctggaagcaaatatgaagacgattgcaggacttcgtcccggcttaagcggtcgggagggagacagtctggggcgggatgtgattgcctcttacggctatggggagcagtttggtcacggtctgggccacggctttggtctggaaattcacgagcaggtacgtctgtcccgcgaaagtaagtcggtgctcgtaccaggtcatgtccttactgtggaaccgggcatttatattccaggcttcggcggggttcggattgaggacgatgtgctgatcacagatgacggtgtcaaggttctgacctcctcacccaaggatctgcttttattgtaagaaagtaactttccagttcaattgatctggtctgcaagtcatccaaaaacgagatggaggagatgaaatgaacacgtataaaagatgcaccaaaatatggctgaccgcgctggcggcttctctcattgtggctttgacaccagctattccgggtcaacaggcttatgccgaggcggagttggatgtaaaagtcatcgacatctttagtcggacggtgaacgattatggtatagatctggttgattggcaagggtatctagccaacccgtatgtgaagcttaaagtgaagccgccagcggatgctgcttttccattaacggttacgttaaatgcgcagggcacgtcccggctgatgatggatctgccaagtacgttgtcagcgcaaggtgcaagcaaaacgctgacttttgccaatgcacaggaggaaaaagattttcggctagccatccatcctgaccggattggaggaaacggtgaaatagagaactatacgctgtctatgtccgttgctggaaatgatggtcacacgactactcagtctattccgattcgcgtgctggatcaggacgataataaagagcccaccgttcccctccattttgactatagattcgatacgatcaggccttatttcaatgatgcagctaccaaaaaagccgcagagctggcggtaaaggactggttctatttctttgatctggcgccgttcgatgaggttcctgccaacgcggaggtaaaccatctgccaggagacgattggcaaaatgaaatacaggtgacgaatgacaaaccctataaaggcatgtgggtattcatgagagggctgaacgggccttattctacgggctttccagccacgaacggcaattatcatacacgtaacggtgtgaccgtcccggggaacctgaaccgttcctatagtttgattctggatttctatgatgatgcgattccattcacatccgtggacgatgaagaatggtatcaatccgatctgtccaaggtgacggatgtgcatgggctgatcatgcacgaattcggtcatgcgattgtattcagcgacacattcccgggtgtcaaagtgctgaaggaagcggcgggcaatgacccggatattatggcttatcagcacagaccagccgcgctggacgacagctatcatctctccggggatattgcagaggtcgacagattgagcggtcaaaatggaggctggcgccatctgtttccgacccgccgttggatgaacacgaagctttcgctgctggtagcagaaaaagcaggctggccgctgcgtaaggacctgactcctttcctcgcgccagaaatcatgacgaaggaactgccagcacccgtcaaaggcaaagtgtacacggccaagctggaggccaagggaggcgttccgttttacgattggacggtgacaggcggccaactgcccgcaggcttcacactggaccgctttacaggaacgattagcggaacagcagacagcggagcaggcaacaagacgtatacgttcactgtacagctgcgggattatgatgagctgagtaagcctgtgacacaaagctttacgattaagctgtaaagaatacctctcaaacagattaaaacggtcgaagggaggggaagcgaatgaaacatgatgccgcggatctggtcattgtaggcggtggaatcatcggtacagccatcgcttattatgcggctaagaccggcatgaaggtcgtgctggctgagcgaggggagattgctggaggcacttcgtcccgttgtgatggaaatatattggcaatcgataaagagcccgggtttgacagtcgaatgtcgttggtatcgcaggagctggtggcagagctggctagggaactggaggatgagttcgagtatcgtgcgcctggcagtattctggtctgtgaaaacgatcaggagatgcaagcggctgagcaatgggtagcccgtcagcagcaggaaggacttccatttcgcatgctggatcagcaggatttgcgagaggaatggccgcatttagccaaagatttgccgggcggactggagtgtgcgacagattccactgtgaatccggtgttgatgacgtatgcactggccggggccgcgcgtcggatgggagcgaggctactgccccgcacaccgatacaatctgtccttaaggacgaaggggggaacgtccgcggggtggagacgcccaatggcgttatccatgcaggtgcagtggtattggcggcaggtgtgtggacacgcagcatcggtcattcactcggtttggaccttccgatcatgccgcgcaaaggacatatactggtgtctgcccgaatgccttccattgggaaccgcaaggtaatggagttcggctatctgatgagcaagtttggcggtcagcggagtgtggatgagctttatgaaaaatacggtgtagcgctagtattcgagccaaccgcatcccaaaatattctgatcggcagcagccgtcagtttgtcggtatggacacaagtgtcgatcagcaagtgattcgcttaatcgcccgcagagccattcgtttttttcctgctttagccaatataccgctgatgcgggcgtataccggcttgcgtccatggacacctgatcatttgccgattgtatcagcggtggacgaagtaccagggctgtatatcgcttctggtcatgagggggatggcattagtcttgcggcggtgacgggtaagctggtgactgaaatggtacggggtgaatccacttgtattccagtggagccgttgcgatatgaccgatttggtgaggcttttaccagccacgaggttcacggggaggtaaccggatgagtgtaacgggcagaattactaccattgatacccatacgggaggcaatccgacgcgaacggtcattcacggcgcgcctaagctggtaggtcatacgatgctggaaaaaatgacttatatggcagcacatcatgatgattttcgccgtctgctgatgttcgagccgcgagggcatgaggtgatgtcgggctgcattttaacagaaccttgtcatccaggtgcagatatgggtgtggtctttatagagactggcggctatttaccgatgtgcggtcacgatacgattggagtatgtacagcgctgatggaaggcgggctgattgctgcggataaaaagtctatattgctggacactccggcaggcccggttcaagtgcggctggaggtggatgcgggcaaggtgcgacaagtgacgttcacaaacatcccttcttttgtgtaccgccgtgaggtgaaggtccaggtagagggtatcgggcaagtcacgctggatattgcgtacggaggcaacttttacggcattgtagaggcggcttccatcggtcttgcactggagcagagcaatggggcaaaaattgtacaaatagcagtgcagattcgggaggcagtgaatgctgttgttgaggtagtacatcctgaaaatccggttattcaaggattgacgcatattgaattttacggggagcctgtggctccacaggccgattgccgcaatgtcgtcgtcatcccaccgggagggatcgatcgttccccttgtggtacaggaacctcggccaaggtagcggtgctgcacgccaagggaaaactgggcttacatgagccgtttgtacatgaaagcatcacaggctccatgttccgggctgaaatcgtgggcgagacgcagataggtccttatccggcagtcattccacaaattacaggctcggcttgggtgacgggacatcatcaatttgtgctggaccccgaggacccgcttaaagaaggttttttgctgatgtgagcattttacattattcccgaatgctgaatttgaaaataaagatgggaaagggtgggtgagcatatggcacgttttgaaggtgtatatgtggccttggttacaccgttcacggcagagctggaggtagaccataagcgtctgaccgagctgtgcgagcatctgattgcaagcggcattagcggactggttcctacgggatcgctgggagaatatgcggctttgtccccggaggaacggtcgcaggttgtgcataccgtaattgacgctgcggcagggcgtgtcccggttgttgtcggctcggcggctccgtctaccaaacaggcggtgcattggattcagcatgcgaaggatgctggggctgcgggtgtcatggcactgccgcccattaattataatccactgcctcacgaggtaacggcccactatgaagcattatcggaggtgggcttgccgatcattgcgtataacaacccccatgattacaaggttgacttgactccagatattcttgcggacttgtcgcgaattgaaaatatcgtagcagtcaaggaattttccggtgatgtacggcgtattcacgctattttggcccagacagagctggaggttatggtcggagtagataatctggcgatggagggggcgttattcggcgcgacaggttggatttcgggggtgccgaatgcgctgccgaaggaaggggtagagctgttccggcttgcgcaggcgggaaatatggcggaagcgtccgcgttgtatcgcaggctgctgccgctgttccactatgatgccagcccgcaattggtacagtccatcaaatatatgatggagctggctggatttccggtcggcccgacacgtccgcccagacttgcgctgccgcaggcggattatgaccgcattcgcgaagcatttgaggtggcggttcgtccaagcgaagtatcatcctgaatggaggggaagacgatggagagccgaaattggatcggcggtgagtggctgagcccttccggcgaggaaatggtggttcacaatccttcggtcttgaaggaggaggtgggagtcgtccatttttcagagatgggcgatattacacaggccggggatgcggcacggctggctcagacgggctgggccgcgctaagtcccgcagcgaggggagcttatctgttcaaagcagccgggttactagaggcagcattacctgaattggctgaactggctagccgtgagatgggcaagccgattaccgagatgcgcggagaggtcatgcgaggtgtccatctgctccggtactatgcggcagagggcgtacgttccatcggcacagttatcccttcgaatgagccgggagtgctccaatacacgaagcgtattccgctgggggtaacggctgtcattacgccgtggaattttccggtagctattccgctatggaaaatcgcccctgcactcttgtgcggaaacacggtcatctggaagcctgccgagcatgcttcattaactgcagtgcgggtcgccgagctattcgaggcggtgcagcttccgcccggcgtactgaacttagtcattgggcaaggtaaccgcattggcgatgccttactggagcatccggtactggatgcggtcagcttcacgggttctactgctacaggtttgggcattgcgggacgatgtgcacgccgtaatatcaagtaccagaccgaaatgggcggtaaaaatgccgttgtggtgctgaaggacgcggatgtagcacaggcggtggcgatgattgccagcggagctttccgttcagccgggcaaaaatgcacggccaccagtcgggtgattgtggaacagtctgtctatgagacgttcacggaagccttacgccaagcggtggaaaaaattcagatcgctccggcgcttgaccccagtgcgtatcttggacctgtggcatccgcaggtcagtatgagaaggtcatgtcctatgtatcactcgcccgccgggaagccgacattttggctgaaggcggagccaccgccgggacggagaacgggtattatgtgcgcccactggtggtgactggacttgattcgtcccatccattgattcaggaggagatttttggacccatgctgggtgtggtgcaggcagtcgacttcgaggatgcgattcgattgtgcaatgattctatttacgggttaagcgcctctctattcacccgcgatttgcggctggctcatcggtttctggatgaggcgaacgctggtatggtccggattaatcaggagacggctggtgttgaataccaggctccgttcggcggtctgaagcaatccagctcacatactcgggagcagggccaggcggcgctggacttttattcagcgattaaaacctgcgcgattagctatgagtaaacgggcgacgggacgaagtgagacgattgggagtgcatcaggtcatttgctcgtatgtcgctgcgaagaagtgagtatcgcacagatggagcaggcctgccgcatgggagtggacacggtgcgccagcttaaaatggctacgcgagtgacaatgggagcatgtcagggcagggtatgccgacaattggtggaatcatggttttacaatcaggttcctgccgcccgccgggaggcagagctgttatcccaaaggcctcccgtgcgtcccataacgtttgggcagctggcagaggaaggttctttatgagccgcatgcgtattgtaaatcatcctattttgggaccaaagccggaacggcggcaggtatcttttatttttgacggtcgtcccatgcagggattggctggagagccattggcagcagcactgctggccagcggtgtccgtttgctgagaaggcatgaggaatccggtacggccagaggtgtatactgcgccattgggcattgtaacgaatgccgcctgacggttcatccgttcggtaccgtccgttcctgcctgaccaagctggaggaaggtatggtggtggaaaccggacggcagctttcgaatgaaatcacagggagaattgtgacatgaatgaaatggcgcatctcatcgtcattggggcgggtcccgccggattgtccgcagcggtatcggctgctgagcaaggattgccagtcacggtactggatgagtttacagagccgggtggacgcatgcccgggcaatatcatgaggaaggcagtcaaggctggtgggttggaaaacacgtttctgatgagctgattacccgttgcagggaacttagggtggacattcgctgcggcgtttccgtacatggtatggaatatacgacaacgtgggaaatttccacttcctgtggattgttcactgcggattacgtattgctggcgactggagctgccgaaattcccgttccgctgaatggatggacattgccaggcgtaatgtccatcggggctgcgcaggtgatgaccaacgttcattacgtcaagccgggagaacgcggcatcatagtaggcatgaatgtattgtcgatggcgattgcccgcgagctgtccgttgccggagtgaaggtggcggcgattacactgccgtgcgccaatccgttggctggtgcagccgcagatccaacagcctccgcgaagctgctgcttcagctgtcgaggctggccccggccgcctggatgcgcgccggtggcaagctggcagctgcgatgcggatggagaaactcatcgcgtgctgctatccccacagaggtttccgtctgtgggatatcccgatccgattgcggacggcggtgctgtccgtcaacgggcaggaccgggtcgaatccgtgaccctggtccacgttaaaccggacggctcgcctattcccggtagcgagcgcgtcgaacccgccgacttcgtggcgctgagcggcggcttgtacccgctcgctgagctggcggcggtagccgggtgcaaattcgtgtacagccctgagctaggcgggcatgttccactgcatggtgagcgaatggaaacctcgctcaaagggctgtatgttgccggcaatattaccggcatcgaaagcgggctggtcgcgatggcccaaggtcgattagccgccgcttccatgctccatgccgctggactcggcggaacaggcggagaacagcgggtgcaggaggcgatccgtgaggtccattttgcacggaagcatgcgctgattcagtttcatcccggcattacagaggcgagaacgcagctgtaccagcagtgggggcaaacctctggcagtggcgcgtaacggctcgttgtgtctgatatgcgttttttaacccaaattcgccttaaaggaggaacggaaagtgactcttaaagcaaaagcccatatgaaagcaaggccgttcgcactgaacgaggtggtattggttgaaggtcccttcaaacaggcgatggagctgaaccgatcttatctgttggagcttcaaccagaccgcctgctggcgcgttttcgggaatatgccggacttgcgcccaaagcgcctccatatgaaggctgggaagcgatgactatttccggtcatacactgggacattatttgtctgcttgctccatgatgtatgcttcaacaggcgatgagcgttttaaagaaatcgcacattacattacggatgaactagccgtttgtcaggcggcgcatggtgacggatatgtatccggtattccaggggggaaggaactttttgaagaggtgtctgctggaaatattcgctcgaagggctttgacctgaacggtgcctgggcccccttgtatacactgcacaagttattcgctggcctgcgggatgcgtaccatttgacaggctgtgataaggcattagatgtagagcgtaagctggcggactggctcgaaggaattatgaagccgatgagcgatgagcagatgcagcagatgatgttttgcgaatatggaggcatgaatgaggtattggccgatttgtatgcggataccggggaagagcgctacttgtggctggctgagtgcttctggcacaagctggtgctggacccgcttagcacgcaggaagactgtttgcagggcattcacgccaatacacagattccgaagctgatcgggcttgccaaggaatatgagctgaccaatgatacgaaacgccgggcaacggtggagtttttttgggagcgggtggtggatcatcattcgtatgtcattggggggaatagctttggagaatattttggagcgccagatggcttgaatgatcgcatcgggcctcatacgacggagacatgcaacacctataacatgcttaagctgaccaatcatctgtttcaatggaatgtttccgccaaggaagcagacttttatgagcgaggtctattcaatcatattttggcctcgcaggacccggttcacggaggcgtaacatattttctgtcgctggcgatgggcgggcacaagcattttgaaagcaaatttgacgattttacgtgctgtgtcggcacagggatggaaaaccatgcgagctacggcagcggtatttattttcacgatcacgataagctgtatgtcaatcagttcattgcctccacgctggaatggaaggacagaggcgttacgctaaaacaaaacacttcctatccagatacggatcatacgacgctggagattcaatgcgatcaaccagctccatttacgctactcatccgctatccatattgggctgaacaaggaattaccattcgtgtaaatggtaaggagcaatcggttgtatcggaaccgggcagctttgtctctatcgccaggacgtggattgatggtgatgttgtagaggtgacaattacgatgtcgctgaggctggagcagatgccggataatccgggtcgggcggctgtcatgtatggaccgctggtgctggcaggcgacttgggacccttagaagatcctaaagccaaggatttcctgtacacacccgtattcattcctctaacggaggagctagatgcctggatacagcccgtggaaggcaagacgaatacgttttgtaccttgaatgcagggcatccccgggatgtggaattgtctcctctgtataaaatgcatgaccgtacgtattccgtatactgggacatttttaccaaggaagcgtggcaggaggcggaacaggaatacacagcagcacgcgaaaagctggcgattctggagcagtgcacgattgattttgcccaacccggagaaatgcagccggagcgggatcataacttccagggagatgcttcgactcgcaccggatatgtgaacaaccgaccttaccggaatgcgggaattgacggctggttttcttttgatttaaatacagatccatctgttccgatgctgttggtcattacctacacagctacgctggaaatgcctaactgcggttttgatattttgattaacggtcatccgcttgagcattttagtgaaggttttgatgaggccgataagttttacaacgttaatgccgctattccggctgcatatctggaggggaaggatcaagcgacggtgaccttcaaggccaagccgggacagcgtattcgcagattgtttgggctgaggatggtcaacaaggacgtgtatgagcaactctatcaagctggaagttcaggtatacatgaatgatctttgaaatgtttcgtgagagaaaagtaacgtttgatttttagtccggtatgatttatgatgtaagaaatattggatgatgctggaataatccatgtggtggtctgatctgatatattcatagttttgttgcgcgtgaagcacacgggctgtttcttccttcataggggagaggcagcccttttttgttgatattttgcggaaatataaaactttttaaagagtcagttctatgatttaggggggagggggtgctcaatagagtctatttgtttggaatgctttgtattagaagtttttcttatagattttgtaatagggaaaccctataatatataagttgtatccagtattttccgaaagtggggatgcgataagtttatgagattagagatgatatacatagtttaaagtttaagctgacaaaggggatagagagatgagtatgaaaaaatggatgttgagtttgaccgcagtcacgttgctatggggggcgacaagtacgattccaacgacggaggctgcaagcagcaccaaacccattgaagttttgttaaacgcgaaaaaaatacagtttccagatgccaaaccttttcaggatagtaacgattatgtgatggtgccgattcgttttgtatccgaagcgctaggggctaaggtaggctgggagaaaacaggcggtcaattggctgtgtcgattaaaaatgatgcacatgccgttaacatgacagtgggtcaaaataccgctaccgtggatgggcagaccaaaacgtatgagacaaagattattttgaagcaaaaccgtacttttgtgccgctgcggttggtaagtgagggtctggggcaaacggtggagtgggataaggtcagccgctgggtctggattgggaagaaggaaattgctgcgctggaggatacggggcatcaggcggtgagtattgagccgtataagaaggcgattgcatctaatccctacatcctcaaaaaaccttatggtggagcttacgataaggtaatgatttttaaacattcagacctaccagttaagcttcttgaggacatatattcaatcgaaccgtacaccaacgcaaaaggtacgccttatctaaaggtaagagctaaaactaaatcaacagtaggtgatatattctacatcacaaagtttaacgacacccgctttcgtaatgaagtcagtcaattggcgacagataatggagacggaacgaaaatgctgtattacccgatttattctacgtcagatgagacgtttcaaggtgtgaagaattacagatccttgaaacttcaagatatccaatacattggatttgcttacgctgcggataactatattccgataatggtcaatccgtggaagggtaattaaatacatgaggaagacacaacgcattctggccgtattactggtgggggtactgctgcttttgcagctcccacctttttcttttcccacaaacaaggcggtagccgaaacggaaattacgccgctgtcctattttgcagttaagaatgaccgttactttgttggcatgatgtactttgacatgtggcgaagtactaatggtgactgggtaactcaaaagaaagagccgaacaagggactgcatggggaagctaatttcacatataagttccagttcccaggtagaaaaataaaaaaagtcgaagcttttttatacgatcctataaaaaatgggcaaaacggggattatatcgaatattttgagaaatctaggccagataaatactcccgttattttgcacatattagtcaaggcactctcaattcagatatccgaccgtttcaaaatcaaggtattggttctgatactacggtcattccaatcactgttaacatgatgttgaatgctgataggcctgagaatataaaagatgagttatgtcctacttgtgccaaagaagttgaagcgtatcgaatctaccagcctatcctgttcaaaatcgaactggagagtggtctaatcgtcaagcattttaccactgatggaaaatctcttaacaacgtatttacaccaatagaagatgaactaaaagctgatcaaccgtatgatttcaccccgccaaccaacccgaaatatgagtatgtgggttataagaaaagcacaacaggtaaaccgccaagcggagacattttgccgggaattgtacccggatttacctatgacggttcttttgagcagtttaccgcttatttgtattacaaagaagctcagggctgtcctaagcctggagaaagccaagagggagcaccctcagattgccaagataatgaacagccaacaaaaggtgttgtctgctcccgccccgttccaggtctgcgcttggaaactaccgaactggacccgacagtatctgccgttatcaaagcagatcagcgtggtagcgaacaatttgacgtatccaaaggtattcctacatctgaaagcctatacggtcatgtgcaagcgaagagatacctttttcaacataagtttgtgaacatgacaggccagtgtacatatacggtgaacgtaaaacgagaatatcgattgacctggcggcctaagaaaaaatctcggcggagtgagacggtgaagcgaacctacacttaccaaatcgttcgtcagtattcatattgggcgatagacaatttggaggtgtatggcatcaaggagactacgctccgaaattatgcgttacctaatgaaacaatcaccctgcgtccgcaatcctatacacccccttcctatgttgcagcgactcagggcaatttttatccgccccctgcacccgggacagtggatggcggcagccgtagcaaaaacggtggcagcagcaagccaagtgtgcctgatgaccgcagtgcactgaaatccaaggcagagggggcggtaaaggaaatcgaagtggagaacgatactctgacctttgaaagtaaaatcattatgaatccggagcgcgtcaaggtgaatggccctaagccaggcgttataccctcttccggagcgattgggccggatgtgctgtacagtccgaatcatgtgattgataagcataagataaataagtccaatacgcccagcagcggtgacatcacttacgctattctcaagggaaatatcaatggaggtgcggataaaacgttcccgatacagggaatcaatacagtgactgtccacactcccgtagtgaatctgtctagtgtgtcggacgatgctgctcataatcagaaaacccaacctacgaagggacgatccgcgcttattttggagcgccctttccgggtgacgatctcgacagcaggtccgcatttgaacattcctggctatggtgatcgggagtatgccaaatatgtacgaaccaagcaggtgagatttccgttcgatgtgtacgacaaaggaaagacaatattttatccacgaggtacctggatcgacattccggtgctgcagctcgacacagacttttatttgcccgtatgggtggatgaaggcaactatacagtagagttccgtaccattgccgaaaatgcaccggacgggttcaccgaacagcgccatgccaacatggatatagcccatcatgttgccaatgatgtggtgaatattgaggtcatcggacggatgtacgattttcatatcacggatattgccgattaccattgggagcgggtatttcggcagcgaaaaggaagtccaacgcatagcggtctgtcctattggacggggcttggcaatattgacgggttgcctagagggaacccggagccattcaccttgcccgttcgccctggcagtcacccatatgaaggttatacaaatgtggcggtcaagacaggctatcatttcaagtttgacctcaagaccaaaggcaatatgtttagcgccaaggatggtattcgcatcacgccatcgttctattgggtgagcaaagatgggcgacagcgggaagaggtagatctgtatacacattccggcagtcgaaaatttatccgtttgggatcggcggaggaccgggaaaagcgatatgttattttgaatgaacggctgcgcaatgtgccgatggaggaaatgcaggacacggcagcctaccaatacaagcatgagctgagtgaagcacaacaaagccagttgacactggaacgctatgtttctctgtatgcccagcgtattgcacgcagcaggacctgggttggacgctacgactggctggtgctgcctgcggctgtgcgtaccttgattggtccgaagacagacctgccgaatggggtcaacgtggatcgcgctaatgcgtcgattcagcgctggtatggcgaatatagcctgcctgctgatgtgtacgcagtcaccaaaggcacgaatttgcgcgaggtcagtcgccgtcaggagctaaacgagcatacagatatattcaagaaaacgggctttatcgtcgtccgctttaatgtggagtcactgcgtcagggggacgctgagcatccacatttacagtatataaatggcccgctgttgaaccagtggctactggagggttaccgcagagagataaaagacccgtacgggcatacctttcatttacaggacggggatgtcgtgttttatcatacagatcagtccagccgagacgatttgagttcatttgtccctcactaattgggatatatacaagattaaggatagcctaaacctttccttaacgatattgtacaaacttacaagctgctgtaataatattcatatatttatatatttttatatttatgtatcttgctggtgcgggtgcagtgggagccaataaatgagaccactctgatacttgtataaccagtagaaccagtagaaccagtagaaccagtaaagtaagcccaggaaggaaaggcttagtgtaaagtagacaaagcgagcaagcctggataatcattcaggcttgctcgcttcttgcattgatgttattgggctggcacgggaatcttcatttcgagttccttaatgtatgttttattgccgtttttaaatttcccgtcagctcccttgccttgaccgacaatactccaatttgagggatcgactgtaaatgtatacggtttgatcgtcacatatcggggtttgctgcctacagcaccgtacagttcatcaatatgatacttcgttttaggcttgctatttgagaagccgactctccgttgctgaagcgttttcccctgatcatctacaatgtcataatacatcatggatggagcgtattttcctgtctgcttggcagacgcaggcacttgaccttcgctatccagcaccagccgggttgtatgggaggtaatatcgagctgtttgactgtgtaactgaatttcccactcttttgggttttattcggcttgatactcaccatattaccgtcctttttaacagggactttaaactcaaaaggcttgctgattccggtaacccctacctggatcgtcatttcaaactcgtctggaagtgcacccaactgattgtattcagcttctacggcattcttttgagatactttgtctccaaacatggaatggatgcttttcaatttgttcccgtctaccagaacctcgggggtcttgatatagcccttcttctgatctttctcaggaaccatgcgctttttgaatttttcattggttcctttggggtttattggcatatatgggctcatgactccctcaggtaaatttttgccttcccgttcgatggagaaggacaagcgtgtgccatcatagaacacatcgccaagcttcagcgtaaccccgtcctgcgtcaggctcagattggaagaagcggcttgcgcagattttgcatcagtagctgctgctgcaatgggggagatgaattttggcatcgctgcccctaatcccaatatcgcgaaagccgacgttgtaagtaatacccgttttagaaatgtggattttgagtttgtctgttgcactttagaatatctcctctccggaagccgtgatatccaatctatacattgaatatcacggcgactttgccttgtctgattcgtctatataacactcctggtgttgtacaggagagccctactgcgtaagctctcctgtaactgaattcttttcatgtagagcatcactatacatgaatcactgaaggtctgtctgttcccgctgatcagcactttggcatgattctcaggaacctttgttgacttttttgacagggactttgaattcaaaaggtttgctgattccggtaacgcctacctggacggtcatttcaaagctgtctggaagtgaatccagcttactgtatatagcttctatcgtattttttttggatattttatccccaaacatgccaaaacttttcagtttgttcccttctatcagaaccccaggtattttgatatagccctttttctgatctttttcaggaaccatgcgctttttgagacttttattagttattttggcgtccattggaatatacggacttaagacctccttaggcaaatttttgccttcccgttcgatggagaaggacaggattttgccatcataggacacatcgccaagtttcagtgtaaccccgttttgcgtcaggctaagcttggaagaagcggcttgtgcgggtttcgtgttactagcggctactgcaatgggggacataaattttggtaatgctgctcccgttcccaatattgcgaaagccgatgctgtaagtaatacttgttttagaaatgtaaatttaaagcttgtctgttgcattggataatatgctccttccacggaagtttgtgttatgcgaaatttctgtatttttgaatcatttctaattagttattcaggggaatcttcatttcgagttccttgatgtacgttttatctcctcttttatgcttgccgtcagatcccatgccttcaccgacaatactccaatcagccggcttgacggtcaaggtgaaaggcttaatcgtcacgtattttgtatttggcttaagtgcattatacagctcatccacatggtattttgttctaggcttactgtagaaataaccgaattggcgttgctcaataacgttgccctgatcatccacaatatcgtaatacatcatcgttggcgcatactctcccgtttgctccggggaagcaggcacttcacctgtactgtccagcactagacgagtcgttgttgaggtggagttcagttccttcacggtataactgaagctgccactggtctttgtctcattcggctgaacggcaatcatggtgttgtccacttttaccggaaccttaaattcatacgacccgtcaacacctgtaactgaagttctgaccgtcaaatcaaactcatctggcagggagtccaactgcatgtattcccctataactgaattatttttgcgtgaatcatccccaaacatgaatcgctgagagtccacttttttgtcatttatcagtacttctggacgtttaaggtagcccttaagctgatccttctcaggcactttatgtgcttttacccattcgtcatcgctattttcagttttggcatccataggtatataaggattcatagaggtttccggcatattctcgccttgacgctcaatggagaaagacaggcgtgtaccgtcatacagaacatcgcttaatgtcagcgtaattccgtcatgagtcacactttcattaggatgactgagaatgcccttatctacagcagtctgaatttcatccgagctcaatccataaaaaatactgccaattccgggaatttgcttgagtgtggccgccatcgtgggtgatacaaatccggcgcttaccactcctgtccctaatatgccaactacggatgccgccagaacagcccgttttgcaaatttcgatttcgtcgtctttctttgcagggctcttttttcaatctccttcataatttgatcactcatactgcctctgggcatgactgattcattgatccaattctccaactggtccatttcgcgctcataaggtggtgttggatgtttgtccattaacaagtcctcctttgcttctctggtccagcagcttgcgccgaagccgctcgtattttttacggatggttgctgactttaagcccataatgttgctaatctcctcaaagctgtattgctcaacagccttcagtagcagaatatggcgctcttctggtgtaagataagtcaacagttcttcaataacacttttatgaggggatacctgagcgattgacttttgttccttgacctgctgaaccagtttgagccagcggctgtgtttccttttgatgttcattaagtgatgataggccatcttgtatagccatgccgagaagctggtctgtctgctgtattgatgaagatgctcataggctctgatgaatatgtcctgaaccgcatcctctgtggcttcatgattcttcaaaatatagaagcagtaggtgtacatctgccgctcgaattgtcgaataatgatttcgtaagcctgctgttcaccagccttgacgcgttctacggtcagctcgatctggctgtgtttatcctgttgatccccggggatggttgcctgcaagagctcacctccttgtatttatgtctatataacaatcgcaacgggccgttttgtgacatcatttttgtgaaaccttgataggtatgtatgttttgatcacagctcgtccattttatcatcttatgatattcggatatgttcacttcaactaacatagttggttcaaaaatggaccgttagtagcgggctaatggggacatttcaattgaaacggacaacaacacggatttgtgtagagaaatcctcggatatttaaacgcgtttgggggaacggcaaaactataatagtaaggaaatttaatttatgtaagcgcaatcatttcaggtattagcttgtcatcacaatacaattgaggaggacgacctgaatggctcgagggaaaggcgtgtggcgaaagggaagcttgaccgccgcgttggcagcgatgctggcgatgacggggacgactggaggagtggctgcggaagacttatccgaacccacactgcaggcggaatcagcaattgcagtagaacagaaccgtagcggcagcattcagctggaaaagctggatcgcggattggtagctgcggtgacgcaggaggggatgtttttaagctggcggttattggctcaagaagtgaacggttacggtccaacggggctgacaggagcagactttaacgtataccgtgacggtaagaagatcgcgacggtgactgacagcaccaactatgtggataaggaaggaaccggaaatgcggtgtacagagtagcttcagtcgtaaaaggtaaggaaaaggatcgtagcgctaaagtgaagccatggcagcagggttactatgaacttcctctccaaaagcctgccgatggtgtaacacccgcaggtgaatcctatacttattcggccaacgatatgagtgtgggggatgtggacggagacgggcaatatgaattttttgtaaaatgggacccgtcgaactccaaggatgtatctcagaaggggtataccggaaatacgtatgtcgatgcgtatacggccgaaggcaagctgttgtatcggatcgacttgggcgtgaatattcgatcaggtgcacattatacacagataatggtgtacgattttgacggcgatggtaaagccgagctgatgttcaaaacggctccagggaccaaaacgatttcttttgataagaagggcaagccgaaaaaagaaaagtatattactctgccacgtgaggatcgcaaagcagggattacacatgaggacgattaccgtttgagtcgctcggattattatgagcatgtggtgaacatgttcatgaactggacgaagcatgaagaagtggtcaagggacaatggcctgctacgctggaggaatgctttggcatcgctccgaagtacagttatccgttatcccgaaaggatgcggaaagcctgacagactactttatggatgtatatgcaccatcacggagcgacaaaaacaagctgagagagttcgagggctttattgtcgatggacctgagtacttgacgattttcaaggggaaaacgggagctgagctggataccatccgctatgagccggagcgtcatgacgatggcctcatgtggggtgactatgctatggcccggattgaacccgccaaccgtgtagaccgcttcctggcaggtgtggcttacctggacgggcgcaagccgtacgccgtatttgcacgcggctattatacgcgttccaccttggctacctacacatgggatggtcgccatctccaaaaacattggatggtagacagtggctgggcaccaatgaccaatccatttaacgatagtccgcatgggcgtgatggaacggacccgaaatttggcaccttgaccacacaaggagcgcattctttgagcgtggtggatgtggacggtgacggcaaggacgaaatcgtatacggttccgccacgattgaccatgatggcagcctgttgtacagctcatttgatgtcatgcctcctgaaagcgcaactccgggtcaaaccgccagattgggacatggcgatgcgctgcatgtaaccgatattgacccggatcgccccggcaaagaaatctttatggtacatgaaggtggcacttacgctccatatggctattctttgcgggatgccaaaacaggtgaaatcatttacggcgcatattccggcaaggatacaggtcggggaatggtcggtgacatcgacccggatcaccgaggtctggagacgtgggccatcggcctgtggaacgcagcgggtaaacagctggatacgaagatgcccggtaccaatatgagtatcaaatgggcagctgatatgaccacacaaatcgtaaacggcgcaattgatgtaaccccaaccattgaggattggaaacgaggtacattgttgaccgccactggaaccaaaacgaacaactatacgaaaggaacgccatcgctggtagccgacattttcggagattggcgggaggaaatgctcgtccgcacagcggatagctcagcaatccgtatctatctgagcacagaacctacgacgcataaattgtacacgttgatgcatgatccgcagtatcgcacagatgtggcacgtcaaaataccgggtataaccagccgtcctatacgagcttttactttgcgtccgatatggattgggcgaatgtgccgattcccaagctctacacgccaaaagccttaatagaggaagagagcagtgacgaagcggatgaagtagaggcagcagaggtggatgaggcaaaggcagcagaggtagatgaaaaagaagtcgatggaacggaaatagatggagagtcagcagtcccagtagttcctgtagttccagcagagaatttataaacgactagctgaagcctaagattctacttccgcatataaattagttaatggatttagaaaggcaagcctctgaattttagaggcttgcctttttgtattcaaaagtttaagagtatagacgactctatccatgtaggcatttctggttttagaccacctctaaaatagcagatctgctgaaagcagcggagaggacggaacgattgcgaaaaagcgtcagtggtcgcatatgaccccaaatattaaagaaccatcaatgtcaggaggacttccccaacactgatggttctcattacagaaaatcacatttagttccaaccgtgattttctggtgaaaaagttgtaaaagatcctgtgttgctgctggtaaagccacttagagggacaatactaacgagagcgaatatcaccatcacagatactaacgccttcttcatgcttcaacagctccttacaaagattttgatactgctctgtttgcttatttgaagcatactgccgataaacctcaaatagtacaacaaactttttaaagtccgcatcattaatcatattataagatgttaaaaacagtaaaataagctgtacagaatcttgatacctttgatgtttagcatagtaaatagcccgatgatacaagaatctaaaatagtgagttctatttgtagcatcttcgagatttccaaaatcctttattttttctgagaatttttcaagtagatcatctatattaatcgaatgaagcgaagctgtctccatgatcgtgacgagtccgggcaataactcttccggattatcttctaaaaattgaacatactcaggtagcacgctcaattttccagacagcaaatcattcgtatacagatttgctttagcaaaaaatttgaatcgatcgacttcttcccagccgattttgtccaaccccgaaaaccagcctaattccgaatacttcaaaatatactctctggcctgatcgtacaaaccgagtttttgaagagccgttcccttggccagatagctgaacccgtaatagaataccaaaggccgttctgccttaaagagataaggcaatttttgcaagcttgcttcttgcgcttcgttatacattttctcagcaaggctgtgcaaatgatcggctatggccaatatatcttcccaggcatgttgagagaaccgcaaatgaagtaattcaatacatttatccaatctatgatgatccgttaataaataagtagcgtctttcccttccaaaacttcttccatccaacttcctcccatagtttttttcgtaatatggagtatgtacaccaagatgtgagttccagaaattataacaatctaatacaaatatagtcattttctgtccagtggtcaattttttcttacataaatgctaattttttgtattgtctgatatgctaaaagatttattcaaactacgatatgacctaaaaaaataaaacaaagaagctccagaccgacgacgaaggtctgaagctctctttgttttgatcagctattattttgcgtccgaaggcaatgaaccggctacgccccatacttccacattaactttgtttgaaccaccacggaactgaattgtatatcgtccggaacgcatagcatcagcacttctccaaacagtttcactgtttttgctgattgtctggccgtcaacatacgctttaccagaatcattgtgttctacagtaaaatcaactggggcatttgcatagtttctaatgcgcaatttaacatacccgaaacccttaggaacctcaaagctgcctggtgcagttgcacttccccctacagtaaagttaaaggaatttcccacgctttgaggagttataacatggtcgctagtagttgttgtaccagcatcttggggtgcagtagtggatgtatttgcagaatcagttacagcatctgaatccgcaaagatcgcactgggcacggcaatagctcctcctagtaaacctaaagataaggctgacgcaattaaatgttttttcttcactgattattcctccctatatttgtataaaactaccaccttattatactaaaagattccacttattgtagtgtttcgacaaaaaaatagtaatatagtattaaatatattatttatttccatattaatcctgaatttaattgttcgtatttactcaaaaatctgtttggatttcctggactcatttggctcgttttactccgaaaatccgaacaatttcccagacagtttattgggatgaataaaaaatggaacaatgccttcatattatcagagcatcgcaagagcattaatgagttttattacccaaaacgatgttctccaacctgtattaagctctgatcaattagaagaactaaattatgccgtacttcaatattttgattgttcgttgtgttgtagagattacctattatcggcagaaagctattcatcgcatcactggtactttgataaagtgtgatcttatcagccttagctctacagtatcatgccagtcatcctaattcagattttgatgtttgcgttacaatagttgcagctggagctagagctacaagtggtctttggttgctgcagcgggtgcggcactagagacaggtgacggagtacctcagcacgggtggcttgtagaaggttaacgggatctgttccaggcgtgatgtaatttgggtctccaacaatcctgagattgtcaagatcactgcgtccgaggacgttagcgtgctaatggaggcggttgccccgggagaagctgttgttacggcttccgattcggaaggaagtgcgggatcaatgatatttcgcgccaatgctgacggaacgagtggctattacctgaatttggacctcaatatgaaatcgattcgtctgttctataaaaaagacggccgtttcgaggatcagcaggtgcttgccaaggttccaagattcgttctgccggaaatgtttcatcatattaaaatcgtggcagagggcctgcgcattcgcattgacgtagacggtgagcatgtcatcgacctggaagagggtacgtttaccgagggacatatgggggtgaatgtatttggagggcaggcgttttaccaatatgtaaggatcgagccaatttgaatttcttgtctcaaaaggagagccgtatttacggactctctttttttacgtcttgatgttattgagaatatgaaatgtaaccgcgcacatgtaaagtgtacgatatattacttgacgtaaaaattgacacatatgtgaaatgaggataaatatcagggatttcatggagaagcgaattgactgtatttgtccctgtctctaagatgtaattatattccagacaaaaacagagaattgtgtaagggaatataacgtagagaggagggaatgaatggactctttagctgatctctcggaaacccccttagccttggaaaccctcagacgacatccctgttataacgaagaggcacatcgctattttgcgcgcattcatcttccagtagccccggcatgcaatattcagtgccattattgcaaccgcaaattcgattgcgtcaatgaaagccgtcccggcgttgttagtgaactgctcacgccggagcaggcggcgagcaagacctatggcgtagcggcacagctgatgcaactgtccgttgtcggcattgcgggacctggagatccgctggccaatgcggaggcaaccttcgataccttccgccgggtccgtgagacagttaaggatgtcatattctgtctcagcacgaatggccttaccttgatcaggcatatcgacaggattgtagagttgggtatttcgcatgtcacgatcacgatcaatgctgtagatccagtggtggggagccgcatttatggatgggtctacgatgaaggaaaacgctatgcaggagaggaggccgcgcggctgttgattgatcgccaactggcaggcttgaagatgctggcttcgagaggcgtattgtgcaaggtgaactcggtgctgattcccgaagtcaatgatgcccatctgccagaggtagccagggtggtcaaggagcacggcgcggtactgcacaacattatgccgctcatcatcgcacccggcagtcggtatgagcaggaagggatgcgggccccccgtccccgtctggtccggctgctgcaggagcaatgtgctgaggcgggagctgtcattatgcgccattgccgtcagtgcagggcggatgcgattggactgctgggcgaggatcgcaatcaggattttacatgggagaacattgcggctgctcctcccatggatgaagaggcaagggcacaatttcagaaagaactggatgagaaggtgagagtgagaatggaacgcaaggagggacaatcgcaccacaaaaaaacgtcaaccggggttggatgtagctgcccgttatcggaggataagcctgaagcaagctttacctcaaagccagtcctaatcgctgtggccagtcgtggcggagggaaggtgaatcagcatttcggtcgtgccaaggaattcatgatctatgaaagcgacgggactatcgtaaatttcataggcattcgtaaggtgcaatcctactgccatgggaaagccgattgcaatggagacaaggtcgagacgatgaaggagatcctttccatggtgcatgactgtgcattgctgctgtcgtccggcataggcgaagcccccaaagaggcattgcaggaagctggcgtgctgcctattgtatgcggcggggatattgaggaatccgttctggaatatgtaaaatttctgcgttatatgtatcctgtgcaaagcaataagggaagtaagcgcaataagggagttaagggcaatcattcggatttacccattgaacattttggaggctgagaaaatatgagacaaattgcgttttacggtaaaggcggtatcggcaaatcgacaacctcgcagaatacactggctcaactcgcgaccaaattcaaacaaaaaattatgatcgtaggctgtgatcccaaggcagactccacccgtcttattctgaatacgaaggcccaacagaccgtgctacatctggctgctgaaaggggcacggtagaggatttggagctggaggatgttgtacagaagggcttcggtgacattctgaacgtggaatgtggcgggccagagcctggtgtcggctgtgcaggacgcggcatcatcacagccattaattttctggaggaagagggagcctacgaagggctggattttgtttcctacgatgtactgggggacgtcgtgtgcgggggcttcgccatgccgatccgggagaagaaggcgcaggaaatctacattgtatgctcaggcgaaatgatggctatgtacgctgccaacaatattgcgcgcgggatattgaagtatgctaacagcggcggggtgcgtttgggcggattaatctgcaacagccggaatacggacctggaagcggaattgattacagagcttgcaagaagactgaatacgcagatgatccactttttgccgcgtgacaatgttgtgcagcatgctgagctgcgccgtatgactgttacccaatataacccggaacataagcaggctgcggagtatgaagagctggcaggtaagattttgaataacgatatgctgacggttcctactcctatttccatggaagatctggaggatctattgatggaattcggcattattgaggatgaagaaaccgcaattaacaaagctgaggcgtctgggcagtaggctgtagccagaaggcttaatgacggaatcatcgtgtgatggtgggggagctgaacgcacagctcgcaggagggaggaataggccaaatgagcagtattgtggataagggaaagcagatcgtagaggagatactggagatatatcccgagaaggccaagaaggaccgaaccaagcattttgagatcgcggatgaggaacttgtgaactgcggaacctgttccattaagtccaacatgaaatcacggcccggcgttatgacagcaaggggctgtgcttatgcaggctccaagggtgtggtatggggcccgattaaagacatggtgcacattagccatggtcccatcggctgcggacaatacagttggggtacccgacgcaattatgcgaatggggtattgggcatcgataattttaccgccatgcagattaccagcaattttcaggaaaaggatatcgtgttcgggggagataagaagttggaggtgatctgcagggaaattaaggagatgttccccctggccaaaggcatctccgtacaatctgaatgtccggtcggactgattggtgatgatatcggggctgtggccaaaaagatgacagaggagctgggcattccggtcattcctgtacgctgtgagggttttcgcggggtgagtcagtctctgggtcatcacattgccaatgatgctatccgcgattttctaatggggcgccgggagctaaaggagtgcgggccttatgatgtctccattattggggactacaatatcggcggtgatgcctgggcctcgcgcattttgctggaggaaatgggactgcgggtcatagcacagtggtcgggtgacggtacgatcaatgagctgggaattgcccataaatccaagctcaatctgatccattgtcatcgttccatgaattatatgtgcacaacgatggagcaggaatacggaattccctggatggaatataacttctttggcccgacgaagacgatggaaagcctaagagcgattgctgcccgctttgacgagacgattcaggaaaaatgtgagcaggtcatcgcccaatatatgccgcagatggaggcggttatccgtaaattccgcccacgtctggaaggcaaaaaggtgatgcttctgattggcggactgcgggcaaggcataccattggtgcctatgaggatctgggtatggaaattgtggctacaggctatgaatttgcccataaggatgattacgaaaagacgtttcccgatgtaaaggaaggcactattctgtacgatgatccaacggcctatgagctggaggaattggcccagcggctgaatattgacttaatgggcgccggagtcaaggagaaatacgtgtatcacaaaatgggcattcccttccgtcaaatgcactcttgggattacagcgggccttatcatggttttgacggctttaagatttttgcgcgtgatatggatatgaccataaacagtccagtatggagcctgctgccatcacggcagactgcggaggtgtcggtatgagcgagcgtctgaacattgtcgatcacaatcagttgtttcggcaggataaatatgtgcgccagcgtgaggagaaacgggcttttgaggccccttgctcgccagaggaggttaccgccaccctcgagtataccaagaccaaggaatacaaggataagaatttcgctcgtacagccgtagttgtgaatccggccaaggcttgtcagccgctgggagcagtcatggctgcgctgggcttcgaaaaaacgctcccgttcattcatggctcacagggctgtacggcttatttccgcagccatcttgcccgccacttcaaagagcctgttcctgccgtctccacctcgatgaccgaggatgccgccgtattcggcggcatgcgcaacctcattgacggtatagagaactgcattgccttgtatcagccggagatgattgcggtatgcacgacatgtatggcagaggtgatcggggatgatctgtctgccttcctggccaatgcccgtcaggagggagcccttcccgaggatatgccggttccttttgccaatacccccagcttctccggttcacatattacaggctatgacgccatgctgcgctctgtgctggagacgctgtataacaagtcaggccggacgccgcagcctggtcatgaattgaagctgaatgtactgctcgggtttgacgggtatacaggcaattttgcggaaatgcggcgcatgctggggatgttcggcgctacgtataccattctgggtgaccacagcagtaattttgattcaggggctactggagagtacagctactattacgggggaacgccgcttgaggatgtgcccaaggccgcagatgctgccggcacgttggcgatccagcagtactctcttcgtaaaacattaggttatatgaagcaaacctgggggcagcaggtgtcctccatctccacaccgctgggcatccgggctacagatcggttgcttgaggagattagccgcttgtctggaagagaaattcccgaggcgttgaagcacgagcgcgcccgaattgtggatgccatgatggattcgcatgcttatctgcacggcaaacgagtggctatggcgggagacccggatatgctcatcggcctgattggcttttgtctggagctgggcatggagccggtgcatattgtttgctccaatggggaccggaaatttgagaaggaagcagagcttctgttgaagtccagcccttacggtgcagaagccacggttcattccggtcaggatttgtggcatatgcgttcgctgctgttccaggacccagtagacctggctattggtagctcccacctgaagttcgcggcgaaagaagcgaaaattccattgctccgtgtgggctttccgatcttcgacaggcatcatctgcatcgttatccgattatcggctaccagggtgcgctaaatctgcttacccaattcgtgaataccgtactggatgtcatggaggagcaggctccggatcatagctttgatctagtgcgctaattgctgtatcgcgtagatggaagttgacagcttggcttgtgatttcaatggattctatctgaaataagggggttgtgcggatggagccggctgtgtctaacggaaggctggaggtatcctgcggcaaaaaaattcccaaaagcacgccctgtccccggcctgtgccgggggaggcttcgggtggctgctcctttgacggggcccagattacactgatccccattgcagatgcggctcatctggtgcacgggccgattgcgtgtctcggcaatagctgggagagcagaggcagcctgtccagcggcccggagctgtcggcgtatggcttcactactgatcttggagaacaggacatcatttttggtagtgaacaaaagctgcatgaatcgatccgctacattgtcagccgctttgctcctcccgctgtattcgtctataccacatgcgtcacagccctcaccggtgaagatatcgagggagtttgcaaggctgaatcggagcagctgggaacaccgatcattccggtgaacagcccgggatttgtgggcagcaagaatctcgggacccggctggccggagatgtgctgttccagcatattatcggcagcaccgagccggaacagacaacctcccatgatatcaatctcattggggaatacaatatcgccggcgagatgtggcatatcgagcggctgatgcagcaggcgggaatgagtatcctgtcccgaattaccggagacggtcggttccgtgaggtgggatgggcgcatcgtgccaaggccaatatggtcgtatgcagccgggctttgctgggtctggcagtccaaatggagcgtaaatacggcattccttattttgaaggttcattttatggagcaaaggagacgagttattccttgcgacagatggcttacctgaccggagatcgtgatgtggagcgacgggtggataagctgaccgcacgggaggaaatgaggctatcgctggagctggagccctaccgcaagcaactgaaaggaaagcgggcagtgctctataccgggggtgtaaagagctggtctgtcattacggctttgcaggagctgggcattaaggtggttggtgtaggcacgaacaaaagcactgccgaggatgtatcccggattgctgaccgtatcggagatgatgcggaatacatcccggaaggcggcgcccggcagattctcaagaccgtacggagccgcaaggcagacatggtcattgccgggggccggaacatgtatatggcgcttaaggaacaaattccttttgtggacatcaatcaagaacggcacaaagcctatgcgggctatgacgggctgttatctctggcgaaacagcttgtgcatacgctacagcatccggtatgggaattgaccgccaaattggctccatgggaggaggagacggaatttgccgattaaacccgccacgaagcctgtcagtgtcaacccgctcaaggtaggacagcctttgggcggcgtgctggctctgcaggggatgtatcgctcaatgcctttgctgcacggcgctcagggctgctcggccttctccaaggcgctgctgactcgccattttcgagagccgattgccgttcagacctctgcgttgcaagagatggacgttatatttgatgcagaccggaatctggaggaggcgctggatcatatctggtccaaacaccatccagatgtcatcggcgttatcagcacggccctcaccgaggtggcaggcgttgattttcagtctagggtaaaggcgttcaagcgagaacgggcattgaaggatagtctgctgttttctgtatcgctgcctgattttcacggctctttggagacgggctacagcagtacagtagagtcgctaatggatgccgtactcgggttggccggaggcaagtcccccaaaaaacagcgccggacgcaggtcaatctgctgccggcttcttatctgactgccggagatgtcatggaaatcaaggatattatcgcttccttcggcctggaggttatcacactccccgatatctccacttccttgtccggccacctgctgacaggtttttcccctttgacgagaggggggactccgctggattcagcttgccagatgctggagtcttcctgcaccattgccattggcgcgagcatggagcgtccggcgcgcaggctgactcatgccgcaggtattccctaccacttgttcacgggtctgtctggcttggccgcgagcgatgcgttcatacattttctgcagaaaatcagccgcgagccagcccctgttcgcttccgctggcagcgtgaaaatctgttggacagcatgctggatgcccatttctattattccggcgcttccgctgtagtggcgctagaaccggatcatatgctgtcgaccgcagcctggctggaggagatgggagtggaactgaaacggctaataacaccctgcagcacgcccgcactgcaaaagacagaacgggaagtctggatcggtgatctggatgatgcagaggagagcgcgcagggcgttgatttgtggatcagcaattcgcatggaagaaagggagcggcacgggctggcgcctcattcgtgccggcaggcttgccggtgtatgacgagctgggcgcccacacatccgtaagcgtcggataccgtggaaccatggagtgggtgaacaaagtaggcaatgtattgcttgccgagagggggaggggaggatgaaggttgcatttgcgacagaagacggtgtgcttgtgaatgctcattttgggcagagtcctatgttcactgtattcgaaatccggcactcaggcgtccagttcctggagcatcggcggatagccctggggagcgatgagaacgaggcgggcaagatcgccagccgaattggcctgatcgaggattgtgccttgatctttctggtacagatcggcgcttcggccgccgcacaggttaccaagcggaccattatgcctgtgaaggtggccttcggcagcaccattgaggagcaggtccagcgtctccagaatatgctggctcgcaatccgcccatgtggcttgccaaaatcctgcatgctgaggagggcagcggcaaagccgaatcatgagccttcagtaaggaagaataaccgaagaacaaccagatatggtgtcaagatcctgcggaccgaatatcttaaaggcggggccgcatatggagggggtggagaatggtacagctgctggaagacagtagatacggacgccagttgaagctgctgggagtggaaggtcagaacaagctaaagcaagctactgttatggtcgcaggcatcggaggattgggaggaacagcggccatgtacctggccgctgccggagtgggaaagctgatattggcccatgagggcgtaatccatttacccgatatgaaccggcaggtgctgatggacagcggacgaatcggggaggaacggatggagacggcattgcagcatttgcatcgtattaacccagagacccaacttgagggctacgcccacagaatcacggaaggatcctctggaccatgggtagaagcggcggatatcgtgattgatgcacggtatgactttccggaaagatatgcgctgaacagactatgtgttcgacatagcagaccgatgatagaagcggccatgtacgcctatgaagtatcattgatgaccattgatcccggtaggacggcatgcctggaatgtctctacccggaaggcggacagccttgggagcctctgggattcccggttctgggagctacctccggtttgattggctgtatggctgcactggaagcggtcaaatggattacagatgcgggcaatctgttcactgaccgtatgtaccgtatgaatgtgctggatatgagcagctgcaccatagcagtcaaacgcaacccgtgttgtccttgctgcggaacgggaggggatatagatgagtcagttgcatatttgtgatacgacacttcgtgacggagaacaggctccgggcgttgccttttcggccgaggagaaaactgaaattgccatcatgctggattcggcgggggtggagcaggctgagatcggaattccggcaatgggaaaggcggagtgcaggtctattgccaggattgctgctctcggacttcaaatgaagctaatgacctggaatcgcgcggtgttcacggatattgatgcagctgaatcgacaggcgtcggctgggcccatatttcggttcccgtgtcgacggtgcagatgaaggccaagctgggtatgaatcctgagcaggtgacagagctgatccgcaagtctgtcgattacggtcagtgtaaaggattgactgtttccgtaggctttgaggatgcttcaagggcagatgacctgttccttgagcagttggcgaatcagctctacagggatggcatccggcgcttcagatatgccgatacgctgtctgttcaccatcccgctgcgatagctgcccgtatagacaggcttgtatcgcgcatgccgcaggatgtggagcttgagattcactgtcataatgattatggtctagcgcttgccaatacactggcagctttgcaggcgggagctgtctgggccagtaccacggtgtcgggacttggggaaagagcaggcaatacggcgctggaggaggtggtgatgtcgtggagggacctatatcaaggaacctgcggcgtccgtcccgaactgctgtacccgctggctgcactggtgtccaaagcctccaaccgaatcgttcccgaaggcaagccaattgtgggagacatggtattcgcccatgaatcgggcatacatatcaacggtctgctaaaggagcgcgccgcctatcagacccttgatccaaccgagctgggcactgaccattcgttcatactcggcaagcattcgggcagaagtgcagttcaatatatgctggagcaggaaggaatcgaggcaggctccggtgaaatcaagtttgtgctggagcgacttcgcctagtcggtgaagatcccaagcgtgtcatccatagcacggatttaaggcgctggctgcagtattatccggcagagctaccgaaataaccgaaaaggcgttcccgtccggtaagtgtgaccgtgactggaacgctttcttgtatatcttttaatttcacaaccggagtctccaatttgctggttaaacgaagccgttcagaagggtataataaaatatagtgctgtataaagtgcgtatatatggttttacagcaggtcttgattcatataaccatgacacgctgatctggaaggacggctatgggcaattggaggaatgcttgtgggaatgatgttttcttttctgaaaaaatatcgggttccagccatcgcagcgctcgtgatgatgttgctggaattgacggtagagctatcgcagccatatttgatctctaaaatcattgatgagggcatccgacagcaggatttgtccgtcgtctggttatggggcagtgtactggtggggagtgccgttatcgcttttatggcgggcatatccagctctttttttgcttcacatgcaagtcagggcttcggctatgatttgcgggaaaagttgtaccgtaaagtgcaatctttttcgtatcctgtgtttaaacgttttgccacttcgtcgctgattacgcgcctgaccggggatgtcacgcaagtacaagatacggtgtttatgagcctgcggtttatgacacgggttccgcttgtagtcatcggcagtattgtgatggcactggttgtacatttcaggcttgggctgctattggcggttatggccccggtgctgttcgtgtttgtgctggtgatgatgcggcgaacggtcactttatttaagggtgtccagcgtcgcctggatgacgttaacggagtgattcaggagaacctgacaggaattcggctcatccgggtttttgtgcggatgcggcatgaaatcgaacgttttgcccattatggaggcgaattgatgaaagggacggtgtccgctttacgctggacagaaacgacgatgccgttcattttgtttacgatgaatgcagggattattgcagtactttggttcggacgcggtcaaatttccactggggatgccagtgtaggacaggtggtcgcagtcgtcaattattcactgcggacgattggggccttgtctgccttgtcgggtatcgttgttgtattttcccgagctactgcatctaccgggcggattcgagaggtattggaaacatctaatgaagatgggtcagagatggagtctgtttcaacacatcatacaaggattaagggacaggtggaaatggaccgggtgagctttcattatccgggcagtgatttggctgtactaaaggatatctcttttagggcgcgaccgggcgagcggatagctattatgggggccactggctcgggaaaatcctcacttgtgcagttgattacacgtctgtatgaagaagatgaaggtcatgtgcgctttgacggaaaggacgctcgtgaactggatgcgtccatattacgagaggcgattggctatgttcctcaagaggtactgctattcaccggctcgattcgggataatattgcttgggggctggagaatgccagcctggagcaaattaaggaggccgcacgcatggcgcaaatccataatatgattgaacgcttgccgcaaggctatgacacgatgctcgggcagcgtggcgtcaatctgtctggcggacagaaacagcggctttcgattgcccgcgcactggtacgtcagccggcagtgttgattttggacgacagcacaagtgcgctggatgtagggacagaagcagcactactgaatgcactcgatggtctgtcctgcacgacatttctcattacgcagaagatcagctcgaccgcatcggcagatcagattttactgctggatgagggtcgcctgatggcaagtggaagtcatgagcatctcatggatagttcggatctgtatcggcgtatctatgaatcacaatatggaaaggaggagtcgcatgtttaaggaactcattgaaccgttccgtcagcctacaccgccgtctggtgtgctgcgaaatccggcaggagctgaaggacgccacaaggccaaagcgaagaactggtctggcaccttaggacggatatgggcttatctggctcgccgtaaggccaaactgatgctggtactgttcatggtcctgctcagctccgggctagctctgttgggtccatatctggtcggcgtagcggtggatgattttctcgaaggtccgggtgggcgcacgtggatttattttctcatcggattaggagctgtatatctgctcaactcgctgacctcctggctgcaaaatatctggatgatcgagattgcccaagagacggtgtaccgcatgcgtttcgatctgttttcacatttgcatcgactaccgattcctttctacggcaaacgtcagcagggagagatcatgagccgtttgaccaatgatatcgaaaatgtcagttctacgctgaacagctccgccattcagattttttcgagcatattgacgctaatcggtacactcacggtgatgctgtggttaagcccgctgatgaccctgctgacttttatcgtggtgccgttaatggctgccgggatgcgctggatcacacgtcgtaccgggcccttatataaggaacgccagaagaatgtgggcgaactgaacggatacatcgaagaaacgctgtccgggcagcagattattaaagcattttcgcaggaaaagagagtcatctatggttttggcgagcgtaatgaccgtattcggctgtcgggtttctgggcccaaacgatttcaggcttcataccgaagctgatgaacggactgaataatctcagctttgctattgtagcggggatcggtgggattttggccattcgcggctccattactataggtacaattattgtattcgtagaatatgcccgccagttcaccagaccgctgaacgatttggctaaccagtggaacaccctgctgtctgccattgccggagctgagcgtgtatttgaaatattggatgaagatgaagagtccaaggatgaacgcggggcagtggaagtagggcatgtaaagggggcggtgcggtttagggatgtttccttcggttatgatgagggaagcgctacgctggaaggtatttcttttgaagccaaacctggtgaaatgatcgcactagtcggcccgaccggggcagggaaaacgacactgatccagctcctttccagattctatagccccgacaagggaacgattacgctggacggtcgcgacattattaccatccggcgtgaaagcttgcgttcccgtatggcatttgtgctacaggactccttcctgtttcaggggacgattcgtgaaaatatccgcttcggcagactggacgccaccgatgaggaggttgaacaagcatcgaaattggccaacgcccattcctttatcatgcggatgaaggacggatacgacaaggtgctggaagtgaatggcagcggcatcagtcaagggcaaaaacagctgctggctattgcccgtgctattttggccaacccttctatccttgtactcgacgaggcaaccagcagcattgacaccattacagagatgaagatacaagaaggactggagcggcttatgcagggtcgaacaagtttcgtcatcgcgcatcggctgaataccattcgtcaggctgaccggattctggtcttgaaggatggccgtctggaggagcagggttctcatgatgaactgctggctcacaaaggcttttacagtgatttatattatggtcagttgagaaagcaaagctcttaagcggctcgcgattaacagctttgcaggtatacttaaaaaggactacctaccccggggtggtcctttttaagtatgcctttttataggtacgtactcctaaaggtcattgttctggttttggcatgggaattgggagaagacatgtgacacgggttcacccaagaaagctcctgctaaattggtagaacaaataagaggcatgttacaggagtttgcacaacaggagcccaatagctaggcttaataggtttgtatttttatttacaatggcccctatttcagctaatatggtttacacatagtaaagggttacatagtgtaaatggtcggagggggttacaaatatgagcagcttacctaagtctgctacatttccgcttttcattctgatgctgaatttgtttattgctttattgggtcaaggtatggtgattcccattctgcctgaatatctgaaacaatttaatgcggcaggagctgctgcggggtatcttattgccgcttttggagcagcacagtttattttttcgcccctaggtgggcagctttcggatagatggggtcgaaaatccatgatcatcaccggtctgtttttaaccgtcatctcggatctcatgtttgctgtttctacgacattgcctcttctatatattgcccgatttatcggggggataggtattggactaatggttccttccaatatggcctacgtcgcggatattaccacttctgaaacccgagctaaaggaatgggatacttgggtgcctccatgaatttaggtatggtgcttggtccggggttaggcggtatgatcgctgagtttggcatcagggtgccctatttttttgctggtggacttggacttgtagctacgctgcttagcttgtatatgccagagacactacccaaggaaaaacgaaaacccgctagccaatgggtccgccgggagccaattcgcaaccaaatcctaaattcatttcggacatcctattttcgttatcttctcctcattctgatcatgacattaggtttgatgaattacgaaacagtgtatgctctttttgtggaacgaaaatacggttttgatgccactaaaatctcaatgatcattacggttggtgcaattataggcatcgttgtgcagatatggctgctcgattatctcatcaagagacttggagagatgaagctaatacgtctctctttgatcatgacagccatcgctttattgttaatgataattaagatcaatttaggttatttgctggcggtatcggcactgttttttgcttttaatgccttcctaaggccaaccgtaagtacaatgatcgcgaactcagctggtgatcgtcaaggatatgccgccggattgaatacgacgtatactagcctaggcaatatattggggcctattttagcgggtttgttgtttgacaagcacattcatattccttatatttttggtgcaattattcttgcatctgcccttttcttaaccttacaaaaaccaaaaaatgagaaacggatggttgctaatgactgagaactggcaccaggatttgaaaaacaaaaatcgggaagagctcattgctgctgcgaaggaactttttatgaagcaaagctttctcaaagttaatgttaaggatgtatgcaacgtggctggtgtaagccgggtcacattctataagcactttcagtccatgaacgaactgatctttgaggtccagatggaaatcctggagagcatgaccgaatttgttagaagggcaccttcagccgaaatgagcggtaagaagatgcttacttcgatgcttgatgcatggattgattacgcttggcaacatccggaatacatcaagtttattcttttattcgatctgcattacgaagcttatgattcaaatcaagaactcaaagaacagtacaaaaattttgttagcaggggaaaggaacgacatttcctgatggatgctctggaagctggattccaagatggatcattgaagtctgatacggaacccttaaagaccgctcattttatcttcacgtctatgatgggtatactccagaaaatgagtctgacgtccaaggacgattggaataacgaacttgaggatatacaaattgctaaccgatttgtgggaatgttgattcagtatttaagtccagaaagtgataaatccccaaccttttaggcaggagtcccctaacgtaatccaaaggattccagatcgtccgatggagtgaaatagaagtacatggctcagtctgttaaactgtgaaaatagagcggttgcagatacgttgtcgtgttagccttatctattttgtggaggtgcggggatgaacggaagtctgtttgagccacggctgcgtgacagggattatattccccgtttttttgcttactattacaagcaatggcatgactataccatgtcttaccacgatcatcattctaccgaaattatgtacatgatttccggcttttgcagggtagatgtacaaacgggagagaatgtggaagaaagcatcacgctgcgtaaaggcgagtttattatgctagacgcaggtgtaccgcatcgactggtggtggaaggagaacaaccgtgccggatgctaaatgtagagtttggtttttcggagggagtgagagtaggaccgtctatccgacaaatggcagcagaggagcaggaggtcacgactctcatgtcacgtccgttcccgtatttggtactatcggacccggaagaggtatattatgcgctgaaaagtctcgtactggagctggaccaacgcaaagaacagccgggtgcaatggccgagatgctttttatgcaattgctagtacgaattgcacgtctacgagaagaggcagagcgcagcaacacgcagcaagcggatatgtacatcaaacgatgcattgaatttctccatctgaactatgaccgagatattgtggttaaggacatggcggcagccgtgaatctgcacccaggttatttgcaccgtattttcaaaaaacatactgggcaaacgcttaccgcgtatttaacgatgctgcgaatggacaaggcccgtatgcttcttcagcaaacggacattcccattcaagaaattgccgattatgtaggcgtggccagcaggcagtattttcatatgttgttcaaaaagcacacaggccaaacccctgtagaataccgctcagctgtggagcgcaatgtgaggaactatgcggaggaggataggagctgataataagaagcctctgaaccattgccgatttaaggtcggtatgactcagagggcgtggctaaagttgggtcatttcccaagccacatattttccatctgttcaagtgatctccccttggtttcgggaaccttgcgccatataaagactacgacgaacaacgagatggctccgaataaccagaaggtattggacgggccggccgaactcagcagaggagggaatgcctgcgataccagataatcgccggcccacaatgccatcgaagcgatggctaccgctttgccgcgaatgcggttcggaaagatctctgagatcatgacccatacgatcggcccaagcgatatagcataggaggccacgtagatcaatattaggatgagtacgagcggtccggtggtcaaacccattttgaatgcggctccaataatgaccaaacagcaggtcatcaatgaggtgccgatgatcagcaggacttttcgtcccgctttgtcgatcagccatacggatacgatggtgaacaacacattgatcaacccgatccaaatggtttgggtcaaagaagcgtcagtaccgagtcccattcctttaaagataaccggcgcgtaatacaaaatggcattaatgccggtaatatgctgcataatggcgagcataacaccgataaagagagcgacccgaataccgggagcgaacaattgcttcaatgagttgttctcatttttgaatgattccttgatatcaagcacttcctgcttagcggcttcttcaccgtgaattttcagcaaaatcggcagcgcttcatagggccgattttgtttaataagccatcgcgggctttcgggtatgaagagcatcaagagcataaagatcagtcccggaacggctcccactccgaacatccagcgccaggctgttgagacaccccaggcttcatctcccatgctgacgatccacgaattctgaaaataaaccaggaaaatccctgttacgatcgccaactgatttaaagcaaccaaacgacctcggtatttggcgggagcgatctccgcgttgtacaccggacaaacggtggaagtgattcctatgccaatgccgccgatcatgcgaaagataacatacccggtgaacgtgtcttgaagcgcagagcagatcgagccgatgacgaataaaaatccggcggccagtaataccttttttctgccgatcttttcactcatgtagccggagagagctgctccggtgacactcccgacaatcagacttgaaacggcccaaccaacctgaaattcgctcagcgaaaaacgctgctgtaggaattcgactgctcccgaaacaaccgcgatatcaaaaccgaacaggatgcctccgagcgcagctacgatggataccaacgtcacaaaaagcatattgggtttttctgattgaagcgctttctgtttagcgctttcattattgatgattactgccatatgatcatctcccctccagatctctggaacctcattccgttcttcgaggagaagtataacatgcgcttataaaagaaaggccagttatcgtcttcaataaacggaccttttcatgcacgattttggcttcggttcccgaatcggagatagaggggctgaatctagcattaccttgtcattcgagcttaaaaaaatccatgccgatagtcggcatggatgaatctcactatttttggcctttaaactcagtgggaggaacgcccgttatctttttaaagacgcgactaaaatagttcgggtccttataacccacttcaaagctgatttccttaagagtaaggttgccagccttaatcagagagatggctttatcaatccgcagccgggttacaaagtcgataaatgtttctccgtattcctgtttaaaaattttgctgaagtagtgaggattcaaatggacaaaatcagccacttcttccagcgaaagatcatcgttgaaccgttcctcaatatacattttcgccctacccagcatagtcagtgtttgaacctcccgctgttcgcgtatccgttgcagtgctgacatgacgtacgtctgctgaagcattccattctccgctttgacggcaagcaaagaagcgtttccagcctctgatgacttcagttcgtcaaagtggcagtaacctccatcccgtttgcgtagggtggaggcaaaaacagcttcgaaataggacttgcgaagtccttcctcaccgctatgcagcgatccaattccaatggctgtctttataccaagttgctgctgggtaagctcggagagctgctgaacaaggtgtttaaccaactggcgccagtcgttttcgctagtggcaggcggcttgcgtaaaaaagtggctacatgatggtcgatcaaagagcttacaatggcattcgggccatgcgtttttacatagcttcggaaatgatcgtaaattttctttttatcctgctcgtccgtatatccgtcaaaggcggcaatgatggcgcttccctgatcaagaggaaagtccagccattctgatagctgggaagcgctcgaatccacggtctggtcgaccataagcattaaagccagctcattttctgcgagcggcatcagctgtgagattttatgcctaagctccaattcttccgtacgtgcccgcttctcgcactcaatttcttcaatcagtcgtttcaatgtgccgatgatgagttctcgcttcgccggcttcagaatatattcttttacgcccaaagagagcgccttctgggcataggcaaaataatcgtaggcagtgacgagcacgaatcgggtatcggaaagccgctcctttaattcacgaagcgcttcaagcccgtcaattccgggcatattgatatccagaatggcaatatggggacggtgctcttccgcgcattcaatcgccatgcggccgttgccagcatgaataaaccggaatatccccggcatcgcccgttccactgtcaattccagtccttccctctccaaagcctcgtcatccgcgatcaacaaccgatacatcagtccgctcactctccttcttgactggaattcgtatggttatggtagtacctcgtccgatattgctattgatttcaaccatttcttcttcctttccgtaaaacaactgcagccgcctaaacacattttgcattccaagtcctgttgaactgccgctttcggcttcgcctttaagacggagtacggacagtcgggtttcctccgtcatgccctttccgttgtccgaaatttcaatttgtacatcttcgttcgctctcgacagcgttaacacgataatggctccgctttccatatcttccacaccatgaagaaaagcgttttcaataaatggctggatcgtcagggccggaatttgctgctgaagtacggaagcgtcaaagtgaagatcaaagcgaatcctgtccctgaagcgcgcctgctggatggttacgtattcgcggatatgatccagttcctcctggagagttacgggtttgtccagcttctgcaggctgtaccgtagcagattggacagcgaaacgatcaggtcgctggttttctccgccccttccaggatcgccagcttggagagcacatttaaggtattaaataaaaagtgcgggttaatttgattttgcagagccagaagctccagttccttcacaagccgccgcatttccagactctgtttatccttctcgataaggatgctcaaatcggtggacatttgcgaaatggcgtccgacagtacgcctagctcgtcatcccgtcgcggttggggcctaatattcagatcacctgtggcgattcgcttcgccagtccgacaagtctgccgacagggccagtaatgctgcgcgagacccagattgcaagcaaaccccccatcagcgcgttcatgccgaacaacgcgactccccatccgttcattcgctcattcttgttccggatgttctcaatgattggccggtaataagccagttcagcatcgatcagttgctgaccctcctcatgaatatagctgacggttttttccgcttcaatataatgttcaaaagccgattgtggatcttgtgcctttgcatccagaactgcggcttgtttctgttcaagaaatgtggccaacagattcatgtagtcctcttcggcgaaagaagggtcggtcgagtcggagacttcctgaattctggctttcaactgcattaattggtattctgtcggaccctgcacagccttatcgtctcttggattaagcagataggcatataggagctttaagttgctctccgccgattcggaggtttgctcaatgaggagaattcggccaagcatttcatcgtagctctgttgtacgacctttccgctttggaatacaaaataagcgatgatattggcgaacacaactagaagagggatgaacagaagcagcttcgttctgatcgtcatcgtctgtcatctccggacatgttgtcgggagtgtccgcatgcatctcatatattctggtgtaggttaattcctggggggcattcccctttagataatcattcagcaattttatggccttagcccccatttcctctggctgttgaacaatggtcagttcaattttgccatctctgatggcttccaacgtctcggtcatatcgtcaaaagcgaaaatctgcaaactccgcgcgccgcgccgctccgaggcttccagaatgccaaggccgtccagcgcactgaatccgaccatgtagcggatctgcggataccgggtgagcatgttctgagcttgctgtgctgcctgaagccgtgaaatatttgaggagcgaatctccacaatgcggagctggggatagcgaccgatcacggaacgaaatccagcaagcctgagtcgctgattctcaacacgctcgctactgatcataactccgatgtcgccacgctctccagaggctttcgctaacagcgcgcccatccgttttcctgctccttcgttatccgttcctacgtaagctagtctacgggagcctggttcatccgtatcgatcgtgatgacggggatgccaagtccggctgctttgtcgattaatcggcgatactctggatcttttatcccttgaaccagaattgcatccgccttactggcgatcgctttatccagcagtttgacctgctcggacggattaatgcggtccggcccgatataatcgagccgcataccgtactgttccgcttcctttcgggctccttgttcgattgaccgccagtaataattatccaactcctgtgatatcagtacgacttttgtatcggaaaccccgtcttttggagaaactgtcttcaataactctgcaaattggtgaatctgaaaagaagacagagtgaactgaaagagcagccaggcaaatagcaggaagacggggataaggataaatgtccatttacggtttgacatgtattgctcctttgtcaatatttagagacttaactcattatacagcaacaaaagaagcgtaggcagctatcgtcaacggcaagcaacatttattaatgcgaaagttaggatttttgacacctaaatacgaaactggtcatgattttgataacgctttctacgagcctattgctacaatgacggtatatacccattctaattaccggaggttgaatgccgtgtcatttaaagtagcgtttattggagcaggaagcatcggttttacccgtggaattttacgagatctgttaacggtgccggaatttaatgatattgaagtggcttttacggacatcagtcagcacaatttggatatggtcactgagctgtgccaacgggatattcgggagaacggtttatccatacaaatacagtcctctacggaccgaaagatagctttaaaggatgccaaatacgtcatttgtacgatccgggttggcggtcttgaagcctttgcgaccgatgtggatattccgctgaaatatggcgtggatcaatgcgtgggcgataccctgtgtgcaggaggcatcatgtatggtcagcgcggcatcgctgaaatgctggagatttgcaaggatatccgcgagctaagtgcaccggatgtattgctgctgaactactcgaaccccatggcgatgatgacatgggcctgcaataaatacagcggtgtgcgtacaatcggtctatgtcacggagtccagcatgggcatcaccaaattgccgaggtgtatggtctcgagaagcaggatgtggacattgtgtgtgccggaatcaatcaccagacgtggtacattcaggcgtcacatgaaggcaaggatctgacagccggactgctggaggcttttgaaaaacatcccgaatatagccgcaccgaaaaggtacgcatcgacatgcttcgtcgttttggctattacagcacagagtcgaatggtcatctaagtgaatatgtaccttggtaccggaagcgtccgaatgaaattatggactggattgatctaggcagctggatcaatggagaaacaggcggctatctgcgtgtatgtacagaaggacgtaattggtttgaaacagatttccctaactggatgaaagaagatccattggagtacaagacggaaaatcgcggtgaagagcatggttcatacattatcgaaggtttggaaaccggacgtgtataccgagggcattttaatgtcgtaaataacggtgtgatttccaatttgccagacgacgcgattattgaagcgcctggatatgtggatcggaatggtatctccatgccacatgtaggagaccttccgcttggtcttgctgccgtctgcaatgtaagtatttccgtccagcgtttggctgtcgaagcggctgtacacggagatgataagctgctgcggcaagcgtttatgatggatccgctagtgggcgcggtgtgtaatccgaaagaaatttggcagatggtcgatgagatgctggtggcgcaggaagcatggctaccgcaatatggagcagcgattgccgaggcgcgtcaacgtctggctgcaggcgatctgattccaacccgaccctatgagggagcagcacgacttaaggtgaagacggttgaagaaatgcaactggatcgggatgccgccaataaaaatgcagggcaatccgacaaaggcaaggatcgcgaaaaagtgtagaacaataagagcagagattgacttcactacaataaaagggtgttttcatggtcatgagggcctgaaagcacctttttgctgtcgatagatatgacgatttggcatagttggcgtgctgaagtttatcattgtcgatttaggctgacggaaattaaagaatacggtcttactttttatgaatttgctcttttgccgtcgatcctaaatctcccgaaagcttgttatagcagggatgttcaacaaatgaagaaaccgacttcagaaaaagaggggccgcgatgaaccactagggtggcaattcatatgcctaattaataatgtagtccttaatttattcaatttacagcagatttccagctcactataatctaacataggaggtgacaaaaaggggaaaatgtgagcgcatgcacaaatagaaagcgcttacctttcacaactatgaacgccgctttttttggagagagtaggcgtaactcacatttaatcatgtaacaatcaggtgccgacataggaagattcaacaaaatccacggaaagataggtgaagcaattgaaaacaaagcaagtgcttcgtaaaagcatgaagtatgcttttgcgctatcactcgtcgcaagcagctttctaccaggtgcaggatttacggataaaatacatgcagaatcccatgtggacaatccttaccaaggggcgacaaaatacattagccctgattatgcggctagtgtcgacacatcgattgccaaaattacggatgccaatctgaaagcaaaaatgcaaacggtcaaaacattcccgacagccgtatggcttgatcgtatcgctgctattaacggcggtggaggcaagcttggcctggaagcgcatttggaccaagtattggcgcaaaagaaaggcagcacaccgattacggcggaatttattgtgtatgatctgcccggacgggattgtcacgccttggcttccaatggtgaattgccgctgacccaggcaggtctggaaacctataaaaaggattatattgacaaaatagctgctatttttgcaaatcccaaatataaggatattcgtatcgtaacgatcattgaaccagacagtttgccaaatctggtaaccaatttggatgatccgaaatgtgcacaagccaagtctacagggatttatgaagctggcgttaagtacacaatgaataagctgaacgagattccgaatgtgtacaaatacgtagatatcggtcactctggttggttaggttgggataacaaccgttcagcaacggtatccctgtttacaaccattttcaaagatactagcaaaggtctggccagtgtagatggctttatcacgaatacagccaatacttcaccgctgacagagcctaatttgcctgatccaaatctgaatatcggtggacagccgatcaaatcgtccaagtactatgaatggaatcctaatttcgatgaatcggatttcgcagaggcattgcatagagattttgtcagcgcaggctggccgagctcactcggtatgttaattgatacaggccgtaatggatggggaggacctaaccgtccgacttccgcagtcggcaatgatattaactcctatgtaaactcaggccgtgttgacaaacgatcgcaccgtggtaactggtgtaataacagcggagcaggtatgggaacgccgccacaaacggctccagctggccatattgatgcctatgtatgggcgaaacctccgggtgattccgatggttccagctcactcattccgaacgatgagggtaaaggttttgaccgtatgtgtgatcctacctatacaaccaaggatggcacattaacagatgctctaccgaatgcacctatttcaggagcatggttccatgatcagtttgtgatgctggtacaaaatgcgtaccctgctatcgtgccttccactggtggtgtggacccagcgcctacagctccagctgtaccgtcaggcttaaaggctgttgtgggtaatgctcaagtaacgctgacttggaatgcgtctactggtgccgatagctacacggtcaaacgcgccactagcgaagcaggtccttttacagccgttgcgcctcttgtaacggaaagagagtacacggataagggactgacgaacggaacaacttacttctatgttgtaagtgctacgaatgcgaaaggaacaagtaaggattccgcagcggtaagtgctgaacctaaaggtacaccgacagatccgacggaccctacagatcctacagaaccagcgggagatctggttgtaatgtaccgggccggggacactgatccagcgaataacgcagtcaagcctttctttaacttgaaaaataaaggaacaacacctgtgaagctgagtgagctgaaaatccgttactatttcacgaaagatggcagccaagagctgcaatctgcagtagactatgcgcaagtaggtaatgataacgtgctgcgtacctttactgacaactatattgaaattggtttcagtgcggctgccggcacgcttgctgctggagcgcaaacaggtgatattcagatccgcatgaacaatagcgactggtctaatctggacgaatccaatgattactccttcgatccaaccaaaacctcttatgcagaatggaacaaagcaacgttgttccacaatgataagctggtgtggggaatcgagccttaggatttggtcagaacatgtgcccttgaatgattgaaaagtattaaaagaaggttacggcataactgtcgtagccttttttacgtcttcgaataaagaatttgatgaccaagggaataagcattgaaattgtgtataatgaacaaaagaatgctgttctacagtggagggtcatcatgagcaaaaagttaatcttagatgtagatactggcattgacgacgcgcttgctattgcgtacgcggtccattcgccggaattggagctactcggtattacaaccacctttggtaatatctcggtggaggaggcaacacgcaactcactgattctgctggaaaaactgggggtagaggctccggtcgtgtctggcgctcacaagccgtatactcgggagctgttcaaaccttattcccggcatattcacggcgaagacggtattggcaatcagttgaaaggagcaccttcccgtcaggctgcgtctggggatgccgctgattttataatcggacaggctcgtcgctatgaaggcaaacttaccctggtagctgtgggaccgctgaccaatcttgcgattgcattggatcgctgtcccgaattgccccaattgcttgaccgcctgatcatcatgggcggcgcggtcacagtgaaagggaatgtaactccgacggctgaagcgaatatttacgccgatccagaagccgcagcctatgtgctgggagcgggctttccgcttacgctcgttgggctggacgtcacgatgcaaacactgcttccacagcaggatgtggacaaatggcgtgagcaagggaccgagctgggtgcgtttatggcagatatgacagacttttatatggaagcttatcgcaacttcagacctggtatagcaggatgtgctttgcatgatccactggctgtaggattagcgatagattccagctttgtggagacgcgtccaatgcacattgccgttgaggtgggcaattccgctgaggttggtcgcacccgtgaggtgcagaatgagaacgaaactcaagcactgactacggttgaggtggcacttaaagtcgatgcggagcgatttttgcgtcattttcttagccgggtggtataaaaaaataattcgaagattgccgatgaacctgcatcggcaatcttttgtgcatacatgttttaagggctttcatttagatgcggactcaccgctataaaaatcccatatcatgttagaataggtatagttagaaaaactgccggaccacaaaggaggagattcattgtgttttctgctgctcgacgactgcctttgctggaacatatgtataatcatgccccgacaggaatcgtgattttgtcgagggaagggaagtgcctgtacgtcaatcccgccttttgcaaaatggtcggatatgagcaggaggaattactggatatccggtattaccatctcttgtataaagaggctcaggatcagcgagggttgagggaggcttacgcaggttggctaaaggctacagatcaagtctataagacagaactgcgtttgaaacataaaaggggaacatccgtctggctatcgctggaattaaccatatttgatgatgaggctaccgaacaatcttatttgattgcgtatgcaatggatatcacggagaaaaaagatatggagcaggtgctctcggataatgaggatttgtacatgctgattacggaaaatacgccggatgttatctcatatagcacggcggacggcatactccaatatatttctccttcggtggaaaaactcctaggctatacaaagcaggaaatgctcggcaaaaagcggctccaattttaccatatcgaagatgccgattacatgcgtgtacatggaatgttcaaggaaacaggcatcatgaagcggcgtgtacgtcataaggacgggcattatttgtggctggaagtatcgtaccgtattattcgggatgaacagggcaagatcaagcgagttctatccatcggacgaaatatcacagagcgtcagaagagcgaggagaacctggcaaaagctcaacagttggcgatgttcggctcatgggactgggatctggtcaacgatgttatgcatttttccaaggaatttcgcagcatatttggctatcgtgtcaagtcggttgaaacaagtattgacgcgttcatggcggctgttcatccagaagatacagagcgcatgaaacggattatcaccaacgttatattaaagggaattcacgaagaaaccttttaccggattgtattgcccaatggggaacaaaaggtactgcgttcaatctgggaagctgaaatggacgagcatgcaggcaagcccgttcaagtggttggtatgatccaggatgttacagagcaccgggaaatggagcagcgtctgcgcgaaagtgaaaaccgttataggtcactgtttcagcataatccacttgggatatgcgccgtgaatatggagggtcatatcttgagtgtgaatccgagcttggtggagcttacgggctatacgaaagatgagctgcttggggctgacatacttatcgtggcttcctctgaggaacaggacaaaatcaagcgtcatatggaactggccaagcagggtgagacgcaaacctatgaatcggaattcatacataaggagggggagcgtctattcattaagatgacgaatatcccgattttcgtgcaagaggaaattgtaggctgctacgggattatagaaaacgttacccctctcaaaagctacattgctcaaattgaaaaacttagtaatgagcattcgcttattttgaatgccgtatccgaagggattgtgggtttaagtaacgaaggacatgtccgctttatgaacccggcagctgtcgagatgttcggcattggatcggctaatccgctgaacggcccatgcatagatatcattcgccatgcagacgagattggtagccattttccggacgaacagtcctctattcttcaagcgattcgaagcggagcttcttatcaggcagaggaagctgtattttggaaaaaagacgggtccagctttctggcctcctaccgaatcagccctttgatggataatggcgagcgaaaaggggctgtgatggtttttgtagacaggacgaatgaaaaggagatcattcgggccaaggagtctgccgaacgcgccgatcgggccaagtcagagtttctctctgtgatgagtcatgagctccgaacaccgatgaacggcattataggcatggcagggttactggcagatactgaattggatgaggagcagcgtagctatatagacattattaccagcagcagcggtgctttaatgcagatattgaacgagatactggatttgagcaaaatcgaagctgggaaaatgtctttgctgcacgagtcctttgtgctagatgatgtggtcggcagtgtggctgacctattcatgacacaggctatggaaaaagacatcgagctggaatggcatgtggatcaggaaatgccggggatgctggtcggtgatcatgtgcgtattcgacaggtgctggtgaatttggtgagcaatgcgatcaaatttacggagcgagggcgtgtaaatatctttgtggagagaaaggcttacagccgtcgtaaaaatagatgcctgattgagttcagtgtaacggatactgggatcggtattccagcagaccgccagcatctattatttcagcctttttcccagcttcatccggcactgaaccgaaaatatggagggacaggactgggattgtccatctgtaaaaacttggttaagctgatggggggttccattggtgtggatagcgatgaggccagaggagcgacgttccggttccagctgaatcttaagttgccggaaggttcaacacttgcgaatataaaccgtgatgaaccttatgagtcaaaggaagggtaatgagagatagccgtgatgcatgatgcatcacggctatttttgtaagaaatgtccaaagaaaagattgacaaactgttctaactgtactatcgttaatagtacagttagaacagttaacctatataaattgaaattgagccagtgttggaaggaggaagtccatgttcgagctggatatccgcagccgcaagccgatctacgaacagcttatggacagggtaaaggaaatgatcgtgtacggatcgcttcagcaggatgagcaattgccttctgtaagggcattgtccgctcaacttacggtgaatccgaatacgattcagaaggcgtatcgtgagctggaacgtgaaggctatatctattccgttcaaggcaaaggcagctttgtcacgcctacccagcagcagccgcaacaaatcaagcgagatgagattcgggcggcattgttaaaacaaatgatcgaagctgtccatttcggttttacacagcaggaagtggacggcatatacgtggaagctacacaaacaaaggaaagggggatgtcccttgattgaattaagggaagtcacaaagacatttacagaagaaaaagctgttgatcagctagcccttacggtaaagaagggctccatttttggactgctgggctcgaacggagctgggaaaacgaccttgctcaaaattattgccgggatttaccgacccgatgttggcaaggtgttaatcggtggacagccggtatatgagcagcctgaagtcaagcagcacattctgtttttgccggatgctccctatttcttcccacaagcgacaattcgtcagatggcccggttttaccgctctatttatccaagttggagtgaagaacgctacacacagctaacaggtatttttaagctggacccgaagcgcaaacttcaccgattttccaaagggatgaagcgtcaagccgcttttttgcttgccttgagctgtatgcctgagctgctggttttggatgaacccattgatggtctggaccccgtgatgcgcagaatgatcaaaaatttactgttccaggaaaccgctgcacgcgagatgaccgtcgtgatctcatctcataatttgcgtgagattgaagacatgtgtgatcatgtcggcattatgcaccaaggtcggatgctattggaaaaagaggtcgatgacctcaaatccgatacgcataaggtgcaggttgcttttcgggacagcatgcatgaggaagctgtctgtagccaactttcggtcgtacataaggagcggaggggcagtgttctgctgcttattatccggggtgagcgagagcggattgcagagacaattgaagcgtatgagccgcatgtattcgatttgttgccgctgacgcttgaggaaattttcatttatgaaatggaggacgcaggttatgacatccaaccgattcttctgtagcggcggcgtaattcgccaatgcttgacacagcatggctggatcggtctattgtacttggcgggattgctgtttacagtaccgctgccattgtttgtgagcattggtgatgaacaaccgcaagtggttttaaaaagcttgtttgatagcacaaactcgggtaatgaattgcaaaaattgattttaatgaccgtaccggtgctggcaggcgtgatgctgcttcgttttgttcagcgacaggggccatccgatttgtatcatagcctacctttgcgtagagagcatctattaacggcacatttcattagcggtcttattcttttacttgtacctgtgtggctgactgcgggagtaactgcttgggttaacacgtcaatcgaactgccttatattttccatatcaatgatattggatcgtgggctctggtcgtatccgtccttacgattttcctgtttacctttaccgtgtttgtagggatttgtgtgggacaatcgttgctacagaccgtagtagtgtatgttttgctgctattgcctcagtttctattcatgatgatagggcgttttctagaacgtaatttatacggatatgtgcgggtgcgagaaaccgttgttcaatatattaatggtggggagtttcgcagcaataataatgtttgggaaaacttatcgccgtttgtacgcattatggacaacttgccacagcgcgccttttcctacatggagttactttcctatttaggtatctctctgctgtttgtcgccttgagttatggtttgtatcgtaaacgcttggtcgaaaaggcgactcaggccatagcatttcctttcttacagcctttgttcaaggcaggagtcatactatgcgccatgcttatactaggcgattattttaataatgcaggtacaagaggagctaattggtcgatttttgggtatgcacttggagctattttaggctatatcgttgtagagatggtcattcgcaagacgtggcaaattatgcgtgttcgtgctttagtggaaatggtcgtgtacggtgtgatcatggggctggtactatatatcccggtttcaggttggttgggttatgaggggcggattccaacagcacactccgtagaaaaagtttatgtcgggcgagaggagcctctagggggagatgcagaaaaagaagcgtattactcccaagacagggcctatatcacctctgtgctgaatttacatcgagaactcgtacgtgcacatgcagctggcgagaaaatgttgtccaaaaacctggcggtcgaatcggcagtcatagtctacagtttggatgatggttccaccatgactcgccgctatacattcccggagaagcctttccggacagagctggctaaagtgatggaagctaagccttataaaacggtaagatacaagctggataagctgcaagggaaagcagaaacaatcaatatccaatcagtagatgataatgaacgacgagtggttttgaccgatccgaaagaaattcatgaatttgaggctgtactcgaagaagaagttttaaatatgagttatagcgaaatgcaatcagatcgatatcccttggggagtgtttccattacaaacaaagagtcatcccttaccaaggacgaaccgaaatggaatcgtgaactttcatttaattggccggcttcttttcacaagcttacaggttggttagaacaaaaggggtatgcggataaggtcatcattgattccaaggatattttttcgatacgggctgttcctattattactgaagagcttgaaccttatcagcccaatcagtatattgaagactataaactatttagaagtattcaacagaagcacaaagcaacaactattacagatcagaagctttggagtactgtactggaaaagcgcagaccttataaccttactccaaatatagagaaaggcacttatatgtttcaagttaagattaagcctttatacagttcagatgcccacacaggctattacttattaactccgaaagatatgacaccggagcttgcaaaggctttaccagcaattccttaagcccacgatatagctatacaggatgacaattcccctccgtttggcgatgccgggttcgatcttgtgctaaataagcatgagtcattttcgccaacggacggtaagacgtattttgcacttgtctactatttttaaaagccattgaatggcagattgcagactttcagccagagaaatatatagaacagctgtatggtctgtatttggatatccaacgtgatggatactgggacgtgaagcagcaccgttttttgatctatgccagagcgatataaagaagattcgataccaaaaaggcctttcccgtgggggaggccttttttgccatacgcagcttgagtgtctcctcattcgggtgatcggacaaggacatttttatcctcctctcgtatactaatctttaccataattgtacaatgaagaagcaaaggcttacagtctcatttcattcattagatatagggggatgtacatgtctgatccaaagagagttataaccaagccggaaaaggatgagtctgtgcggatagcatggttttggccatggctgggcggtacgtttatgtttggattgttttcagtcatgtttaatgtagtttggagtatggttgtggcaccccaagtgcagcttctgctgaggcatgaaggtgtcacagatacaactgtgtttgtaatattacttctatatgcatggattatcggtctcatttttgcagcttatggtgccttgagtgcgcgtatgtctagcatgggcaagctttcgctgatgctgaccgggctattatcattattatgtgggctgtggttgtggattgtcggaatacaaggatcaggtggacaacttgccgaagtgtctggaggagcatgggagctgttttcactttatcacgcttgggcagaacctgtactagaggtattggggttatatacacagcgtagcggaatctggtttttgctgaccgcactgctacccatagctggcatggtagtcggggttggggtagatcgttatcctgcggtgaccgacaagcacggaaaggtggaccatagatggcaatgggttgtagctgcaatatctgctgcgctcattattgtgctggtgattacgatcatgcttcctcaacgtccgtacattgcggaaagggatttcccggtagtagatggagctacagcggccattccattcgcgcaggatatgctgcatgaattgaccggaatgaacaaggttcgtgcggctcacgaactgagattcaacacaacacatcaggcttatgtcaatctgattgaaaagaaggcggatctgatcctggtggcgggtccatccgatgaggaattacgcctggcaaaaagtcggggaattcaaatgaagcttacacccattgggtgggatgcttttatttttctcgttcataaaggcaatccagttaacggactttcttcggagcaggtacgcagcatatatgaaggatctattcgtaactggagtgaagtagggggaaagcatcagccgatcgttgcttatcagcgggaggagaattcaggaagtcaaacatatatgcaaaagaaagtgatgaaaggtcatgacatggctgaacctcctcgggaactccgaattggtataatgggtgaaatgattaatgcagtcgcagattttaacaaggatcacaatgcgctcggttattcattttattatttcgcaaatgtgatgcataatcgtcaagaggtcaaatttttatctattgatggagtggagccgaacaaagagcacattcgctcgaaacaatatccattcacagctcaactgttcgtggtcacacgggaaggcgagaaaccaagcccttcgatgcaacgattactcgaatggctgcaaagcgaagcaggaacccgggccattgaaaaaggcggctttgttcctgtaaactcgtaatcctgtaacactggtttgcattcagtccattccgtatattcaccttaagagtgagacgaagacagcagggtaatacatagaatatacatggctgtgaatacaatacccgcacagccatgtatatcaccaacataaggggatgaacgaaaatgaagaaaaaaacatcggtctgggtgcttttactcgccgtagccatagtgacagcggggtgtgaaacaggctcacaaacaagttcgcaaacaggacaaacggctcaaaatgagcaaaagggtgccgcctcggcacaagcgaatggttcgggaaccactgtagatacaccgaaaacaggaggacaagcaaccatagacactacgatagcgaaggtccgcatggacaatattaccgcgctgcgtttgatcgacggccaatccggctggatcggcggaaatggctggattgcccgaacggacgcggttgcatccggttcagtcggatcgacgtggaatgtgcaatatcagggccaaggtacggttcagcagatttttgccttgaacgggcagcaggcttgggctgttatggcagacagcggatcgctgctggccactcgcgatggtggcaaacgctgggaggttgtcgggactgtacctgagcaagggcaagcgggctttttacactttgtatcatccaaggaagggttcagtggcaaccaatatacgaaggatggtgggcgaagctggtcttcgctccccgtgcctggccacttggtaggacagccatattaccatgatcagcaaaacggctgggcagttacgcaggacacagaccgttcgtttcagattttacacacggttaacgggggccaaaagtggactactgtcatgtcacggacaacggaggcgcctctaaatggagccattattcgttcggtagaacgtggcaacgcatggatcgagctggttggcgatacggggatgaatcagacgtcgtattcgctttggcatactgccgatagtggacaaagctggcgtgctgtgttggcgaataccactgctggcggcggtccggcaccaggtattagccagcaagacaaccaggttcccaaaaatgaaggggctgcaccaggtatgctctatgcggttaatagcaataccgcatggatgggcggttactgcgcaccgtgcgacaagcccaataccatcggctggacgactgacggcggcaagacgtggaacaatggcaagcaaggctttgacggttatggtggtcagcaaatcgggatggcaaatgccaaggaaggctgggctattttctcggattcagagcaggccccagtcatgtataccacctcggatggtggacagcattggacgcagagccatgtatttgacaagcctgtggcatcaggctcctaaggagggaatgcatatgagccaacataagaaaagtgtgattacctggactgacggtcgtgatgtgccgctaatcgggcagggcacgtggcatatgggtgaaaaagcatcactccaccaggaagaagtgcgcgcgcttcaacttggcttggagctgggcatgacgctggtggacacggctgaaatgtatgcggagggcggcgcagaagagatcgtcggagaggccattcggggtcgccgggatgatgtctatcttgttagcaaggcgtatcctcatcatgcggaccgccaaggactggctcaagcgtgcgaagcgagcctaacccgaatgggaacggagtacgtggacatgtatctgttgcattggcgtgggaatatcccgctggaagagacgatacaaggtatggaaaaactgcgtgagcagggcaaaatccgcagctggggagtgtccaatctggacaagtccgacatggaggagctatggagcctaagtggaggcgaagcctgcgctgtcaaccaagtgctgtatcacgcagcttcgcggggcatcgaatatgatctgctaccttggagccgtacgcatggggtgcctgtgatggcctattgcccgattgcccaaggtggccgcttgcgacgggggctgctggagcatcctgttatggtagacattgctgccagccacggggtaactccatcccaaattgcgctcgcgtgggtcatacgggacggtgatgtctgggcaattccgaaggcggtgcaggaatcgcatatacgagaaaatgcagcggcagcaaatattcggctcactcctgaacaacttcaacaaatagacgaagcctttcctccgccaacacggaagcagccgctggatatggtttgaggaaggaggagcccatgacagagcgagagacagaactgcatgaggtagatgatcatctggattatggattatccgttgtattcatcggctttaatcccagcttgaaatcaggcgaggtaggacatcattatgcgaatccgcgcaaccgattttggcgcatactggagggggcaggcttgacacctcgcttgtacgatccatcggaagatcgggagctgctgaagctgggcttcggctttacgaacattgtttcccgtcccacgaggggagtagaggatatttcacgcgaggaatacgccgaaggaagtctgaagctatacgagaagctaaaggaataccgcccgaaggttgcttgctttgtcggcaaaggcgtgtacaccgaatacagtaaaaaatccaaagtaaattggggatttcagcctgaaccgctcattcccgagatgcatgaatttgtggcaccttcgtctagcggactggtgcgcatgtcgctggaagaaatcacagatatttatcgccatcttcaaacgttcctttcgtcagaaatcgtctgaaatgcagtaagcacggtgaatacagctagcacaaaaagaaccacacgcttcagtccctgctgggaagagcgtgtggttctttgagttgtttctattctattgtaaggctttcgcctgccatgcctcttccacgggaacataaggatatcccagatcacgtgcaaccgcttcgtaggtaatatgtccgttcaggacattggtgccgctaagcagtggcttgcttctgcgaagcgcctcctgcacacccaaatctgcgagctggagagcaaaggggagcgtcgcgttcgtcagagcgagcgttgaggtttgcggtaccgcgcccggcatgtttgctaccgcatagtgaatgacgccatgcttcacataggtaggctgatcgtgtgtggtgatgtggtcaatcgtctcgactatgccgccctggtcgatggccacatccacaatcacagagccgggctgcatcgtctgtaccatggcttccgttacgagctgcggagctttggcaccagtgatcaggacagcaccgatcagcaaatcactttgcgccacggcttcagcaatgttggacggggtggataccagcgtatggagctgattgccaaaaatatcgtccagttggcgcagtctttgcaggctcaggtcgatcagtgtcacatctgccccaagaccgatggcgaccttggcagcattggtaccgaccacccctccgccaataatggtcactttaccgcgtttcacccccggcacacctgccagcagaatgcctttgccacccttgggtttttccagcagctgtgctccaatttgtacagccattcgaccggcaacctcactcatcggagtaagcagcgggaggctgccttcaacatctagcgtctcataggaaatggcggttacgccgttatctgttaaagcgcgggccagcgctggctcggcagccaaatgtagataggtgaataaaatcaatcctggtcgaaaatatccgtattcagaggagagcggctcttttaccttgataatcagatccgcctgggaccacacgtccgcagcttgctgcacaagagtcgcacccgcagtggcatattctccatccgtaaagccgctttcaacacctgcatggctttccacaaatacgtgatgtccgtgttgaatcaattgagctgcacctgctggcgttagagcgacacgattttcattgtttttaatctctttcggaaccccaattttcatttcattcacctctcctaaaaataattgttaagaaaattacactatcatttttgcgcagccctgccgattagttacatggactcaagccgataaatgcaattcatgttagattaggtacagtttacaaggggtgaagctccttgacatcatacattttgtcggattatctgacttaaaggctcgactttttgatgaatatatgtcatataaaatgacataaagacatatacataaggagaatgccgatgaacggtaaaaaaacatttaccattgcggatgtgctggaacgtcctgttttccggtgggcgaagctggcggcgggggaacagggcgtacatcgccttgtgggttgggtccatgtgctagaaatcacaaatgtttctccgtttgtgagccgtcatgacttgattttgacgaccggcctgtggctcacccggaagggggaagagcgtgccgagtatatggagcaactgatccgctcggaagccgcaggattgtgtgtggagctgggcacgagcattcatgaaatcccctctgaaattctggagttggcggaacgacatcacttcccggtcatcgtatttgagcagccagtgcgttttgttgaaattacacaagatattcattccctacttattaaccgacatcatgaacttctaaaagatctggagcgattttcacgtcagcttcagcaggaaaccctgcgcagcactgatatgaacgccctcttgcgtgtgcttcatgactatgcagcccggcaggtcatctacatgtcttccattgaaaccaatcgattcgtaccttccgtccagccggatctagcggaccgtattgcagatttttatgccaatgaagtggaatctagtatgaccgccgatcgggaggggcatctgctgtttcacctgaatgaatccactgccgtcttgttccagcccgttgtatgcttcggtcaggtgttttccgcagtaggtttggtactgcatagtgaaatgccgacggaagaaatgtcgctgctactcgattacactgccaaggcagccgctacattggtgctgagaacacagtttcttgaagaccgattgctgcgtaatcaaaatgaattgattcaggatgtactgagcgggcagcttcccagtgaagaacaggctcagacccggatgggcctgcgattgttatcgaaggggcagtatttattttgggcaggggtcattgaggtagaacatcaggataaggatgccagtcaggtacgcaaggaatccatcaatcaggatgtgctagtgctgcttcgatcattgttgaaaaaagaaacgttgcacaacctgctgatgatgaagggaagtcaatgctacatcctttgtgccaaggaggaattaacactgcgttccgcagcgcaaatgaaaaaagtgcttgcccatactgttcaatatattcagaattatgccgcaggacagcttgataaggtgcgcattcatgcaggctttggtaaagtaaggcatcgcatgacggggacggatcgcagttttgaagaggcatatgaggtcattgaagtggcacgaagcgtcccagtcatgaaggatcggttattttacgacagcatcggaatctatcagttgttgaaggcggtgccccgcattccttttctacaagagttcgtagaggaccatttaggcgagctgattgcgcatgatcgtgagcaccatatgcagcttttggatacactggatgcctattttcaatcccatggctccaagcgtgataccgcaggaattttgtacattcacagacagaccctttataatcggctggataaaattaatgaaatcatagagggaaatctggcagaccctgacaaacgtcgttgcctggaaatggcactactggcttaccggatgcttcaggatgaaaattgatcctaaataactagttctattttccattctactcatttacaatgcgtgttaacactgagataatagaagagattacggaaatatcttgaaaggggattaatatgaatataaaaaaatggatcgccgtccctcttattctgttgatggtagctttgacaggttgccaggcagtaggtggatttgatgtaagtaaaaatttattgggaacactagatgtgaaatcccagcagacaacggagaaaatctctcttaaattgactccaaaagaaggaatcacgcaaggagataaggaaatcgtagatttgattaattcgatttccgtcactgtggatgaagccaaagtacaatcggaggaacttgcttctgccaaaggtacattgcacatcgataagtataatttgccgtttgaacttgctttagaccgccaaggtttggctattcaactggaaggtgccaaaaaaccttattacatatctttgaactcgcaagagagtttgagcggtctgcctgctggatttgatccatatgtatattccaaagacgtgagagaactgacgaaaacagccgctgcacttatgctcaagcatgcgcctaacccttctaccatttctgcaacgtctgtaaccgaggaagtatacggtgagaaagacaaagtgaaactgacccatctgcatgctgaacttcgtggtgatgagctggtaacattggtaaaaccgttcctggcgaatctggccaaggacgaagcaggcttgaaagagctgatcgggcaagctattgatatgactaaaacaattgcttccggcatgaatattgaaggtagtgataaagtaacagcggaactgagtgctaacaaagaaaaaatggtcaatgaggcttataccgaagttaaaaagtatttggatctggccgttgatcagtatgatgtaggcgttagcaccatgtatgcacagtcccctgaaatcaaaacggttctgagtgctaacacagttctgaaaagcgacatgtattttgatgaaaaaggaaatgttcgcaaagcggcgacagacctgacggttgctttgccagatgtggacggtcttccggtgaagtccttcacaattcttaccgaaactcaatcttggaacgtcaatggtagtgtgacggctgataaagtggatatttctaacggtgttattgacttgaataaacaagctgaattaactccgggagcaacgctgcgcaattttgaagcgaattctccgatctacaacattttaaaaaatgatttggaaattacaaaagtagaaacaactttcgatcctaaagacgattactacgtcttggagaatcgtggtggtactgcctttattccattgcgtgaactgacgagcgaactgaactccgagttaaaatgggatgcagctgccaaacagactactgtaattgatgatattacaggtaagacgattaagctgaaaagtggctccaaacaggctgtattggaaggaagcacattgacgctgccacaagctccatatacggatgaatatggtacattgtatgttcctttcaaatcagttgccgaggcgcttggcgccacagtaactcgtaatactgatggggaatatgtactgaaacgcgactaaaaagaaattcaaggaaccggcccaattaggggctggttctttttttgttatattggtaaaatgctcagtaaagcgattaaaataagcgcttacaaattttaaaagtgccatactttcatacagggaaaattgagataatgatagtatcattccagcataggaaaacacatacaattagggggatatacgatgaaagatatggaactattgaattccagagagggacaaatggtgcttgcccgaatgtacggtcaacagcaaatctctgagcaaacgactcgatatgaatcccttatacaggcgtatcgggagcattttggtgtaggggatattgaactgtttagtgctccggggcgctgcgaaattggtggaaatcatacagaccacaatcacgggaaggtgctggcaggcagtattacactcgataccatcgctgcagcttctaaagtggaggagtctgtaattacattcttttctgaaggctacaagacgaagtacgtcatcgatttaaccgacttgtcgccaaaaccggaggatgacagtacgatgctgctgatccgtggcattgccgctggtctacttgaattcggataccgtatcgggggattccaagcttatatatcaagcaatgtgttctctgcttcaggtttaagctcttccgcttcttttgaaatgttgatatgtacgatattaaatcatttttataacgagggagcgttagatgctgttgctaaatccaaaattggtcagtatgcggaaaatggctattggaacaagccgtcggggctgctcgatcagatggcttgcgcgtatggcggcttgatttccattgactttgaaaatcccaaggaaccgatcataaatcctgttcattggaattttgaacaaaacggatattccctcgttattgtaaatacaggtggaaatcatgctgatttaacggacgattatgcggcggtgcccaacgaaatgtttgcagtggctcagtctttagacgcttcggtttgccgtgacttattgccggaggatctatatgccaaccttaaaatggtcagggaaaaagcaggagaccgtgcagtactgcgggcgttgcatttttttgaagaaaatagacgtgtggatgaacaggtgaaatcactggaggaggggcgctttactgatttcctgaggctcgttaccgaatctggtaattcctcatggaaatggctccaaaacgtatatagaagtgggattgcgcgggaacaagacgtatcggttgcactggctttaaccgaaatgtatttaaagtcaattgataacagcgcatgcagagtacatggtggtggctttgctggtgtcatcttgacgattcttccgaatgatcatgtggatgattataaggagtggatcagcggcatgctagaaactccggtacttgttgtcaacgtccgtgaggacggtgctgttaatgttagtgatttgatacatgttgaacggactcattgcgagtctacaaactagtcagtcagtagaagactttaacccatgggttaaagtcttcgtcctttttatcgccgatacagcttgggtttgcgttataataaagagatgatagttttaatgaaggagggcctgtcatggctatatacccgtcctggtcctattcgcaatcgagggctcaaacgttcgatgaatgcttacgcaaatactattatcattattacggctcgcataatggctggaattcggcacagggcactgaagagcaagttacgttgtatcggctcaagcaactgagcaacttatatattttattcgggaatattacgcatcaaatgtgtgaatcagtcatacgtggatggatggaaaaaggggctatcccgcgcacagcatacctcgagacagctatgaagaacatgttgaataacagttacaaggaatcgctacaccgtgagctatggctacaagatccgaaaaatcgcgtcatgctggcggaggtttattacgacgacgaggtgcttccggaacggatcgcccttattaaggagcgacagcacgcggtgatacacaatttgtaccgtactgcggtttggcgtgaactgcaacagggaaaggcccgaattgtagaagtggagaagtgggatacgatgctccttcatgagacgaaagtgtatgtcaaaatggatttgctctatcgtagagacaatggagacatggtcatcgtggattggaaaacaggcaaggaaggcgatttttccgaccaactttttttgtatgcttcctatgtgcaggagcactatcagcttcctttggagaagattgaggtacgtgtggagtatttgatgacaggagagcatgaggtatatcgtcccgcgcaagaggatatcgacaaagtggttggtaatgtcggacgatacatcgatgaaatgaagtcctgtctcgatgatgattactataatcgccccaagcccgagtctttcttcactccgatgccttcacgcagagcgtgcggaggctgtaattttcgtgaggtgtgtaagtaccgagcggtgtgagatgacttgattgcctttgcccccggattcctaccctaattaagctagtgaatccggctatatggcaaatctataattcttctatattttgaaaccgctttataatttagaagatgcgaggtatgataagggtattactggaaaatgtgaagggggaagttaggaagatgacgagtacagaacatgcacgtattctttttcagggagattctataacagacggaggaaggggacgaaatgaggacgcgaaccattggctgggtcagagctatgtgtatctgatcgcaggtgcattggggagccgtttgactactacgcagccagaatttgtgaaccggggaatttcgggggatcgagtttcggatttgtatgcacgctggaatgaggacatgtttagcctgaagccagacctgctcagtattctaatcggagtgaacgatgcctggcggatcgtcgagcaggagccgtccggggtgacggaccgatttgaacgagcctatcgccaccttctagaagaaacgcgtgaagtgatgcccgatatcgggctagtgttgtgtgaaccgtttattttgaaaacgggagctaccgaggcgcgatgggatatttggcaagaaaaaataacggggtatcagcgtattgtacgtcagcttgcggacgaatttagggccgtatttgtgccgctccagagcatgttgaacgaagccgctacccaggcggacgcctcctattggctgcatgatggggttcatccgacagcggttgggcatcagttgatagctgatcaatggatagatattgtgcaaaagagtccgctggcgattcgctaacagagtcatacatagtctactccttgtcatttttgggtaatacacgattatggacatcattacttatgttatggttccatccaaaaatgaatgtcaaagggggtgcttcttgcttcgtcataaacggagcaagagagggctatggaaacgataaatatcattctggttatattacttatcgcattaactgcgttttttgtggcctcggagtattccattattcgtgtgcgggtatctcgcatcaatcaattggcctctgaaggcaacaaaaatgcgaaagccgttaaaaacattctgtctcggctggacgagtatttatctgcttgtcagctcggaaccacattaacctcaatggcgctaggctggctaggggaatcaactgttgaacatctgctacaccccctgtttgtattggctcatattccggcaggcctgacgggagtgctctcctttttgctggcttttttgatcttgacctatttcgaggtggtcattggggagctggtaccgaaaacattcgccatacagattgctgaacccatggcattgttttttgcccgtccgatcacgatattttataaaatgacctatcccctgaattgggtgctcagtcgttcatcgcgtgtcattacgggtctattcgggctcaaaaaggtatctgaagaagatgcagcactcagtgaagctgagcttcgtttggcgttatctgaaggctttcgtagtggtgaaattacaccgacagaatatcgatatctgaacaatgtatttgattttgacgaccgtgcggcgcaggaaattatggtaccgcgcatccatatccgttccatctcccaccaggcaacagtggccgagtttatggagctgatcgaggataaagtttataattttctacctgtagctgaacatggagaccgggatcgtattatcggaatgattcgcgtcaaggaagccctgcatgatttggcacgtgggcacagcacagggaatacgacgatggcttcttatattcacccggtgcttcaggttatcgagacggttcaggctcgggatctgctgattcagatgcaaaaacgacgcattccagtagcggtgctggtggacgaatatggtggaacatctggacttgtcacactagaggacattatggaggaaattgttggagacattccttcctataccgacaccgaaacccccgcagcgttaactccactcattacaaaaacagatgatcatcgttacatactcaaatcacaggcgctcattcatgaggtcaatcggcgcttggagacggatattgaggccggggacgtatatacgattggcggatggatgctttcagagcgttttgatatccagcaaggagaaaagctgaccattggtgtatgggaatttactgtactggaaaaaaacagtcaccaaatagacacaattgaagcgattaagaaagcagtcgttgaccagaaaaatgacaatgatttttaataatggaaattgactttgtcggtaacagctcgcttaagatgtgacgaatagcctgtaaagcttgtgacagcgcgattcgtccgttttaagatgcagctgctacctggtaacatattttttttggaattaggataggggacttaagactctgtatctttatgctcataaatatatctgtctgtgaaaaattctactagaaatgtagcaattttatggtaaaatggaatcaaatttgagttttttggggtgggctacagtacatgaagatgtcactaggtacgaaaatggttactgcatttgtctcaatttctgcaataacctatggaacaagcgctttttttatttttgtactcaaggactggcttgctcaaggtacacaagaatgggtgtacacttcgatcattctgttattgggtgtcctgtggagtggcattttgggctggttgatctcaaaattactcacacggccaattgttaggttggcaaaggcggcagaggaagcttcggcggggaatctgtctgttgtaattcctgaacgtcgttcggaggatgaaatcaaagttctgtatgatgcatttcggcatatgatgctgaacattaaagatatgttcaatgagatctcgtacagcaccagaacaacttcgcaaagtgcggaaaatctgagcttggctattgtgcaggctaccacacaaattgagtccatgtcttcggtggtagaagatattttgaatggcgtggagcagcaaaagcaagcatctgcccaatctattaaaacagcagaccgaatgctgggcgattttaaaatgatgcgtagcaaatcggggcatatgctggaactgtcaggccatatggagcattcagtagattcgacgcagactgtattttcatccctgatggatggaatgggagaactgacagcatcacatggtcgttcgcagcaggtaattgcacgactggaaaaagaagcttcccaaattgaagcgattacaagcaccgtgaaggatattgccgaacagacccatctgctggcgttgaatgcttccatagaagcggcgcgtgcgggagaagaagggaacgggtttgcggtagtggctcaccaaattcgcgcacttgccgcccaaagtacggagtctgtgcagcaaataaatgccatcgttagccgtgtccagtcacaaatcgtagagacagtgcagttgatgcatcagcaaacgtcattggtcagtgctgaggcggaacggacaagctctgtggatcagacgctgaaccgtctgaacgctattgtacgtgaatttgtcgagagcatccgattaatggaggaagccgtgacggagcagacgaatcgggtagatcaaacctttgagcagatccatcgtattcagcaaatgtcaggggccttctctgaaggagctcataaaatttataaggctgctcatgaggagacagcaattatgcaggaaatttcgtcttcttccgaggatttgaaagtgcttacgaataaactcatgatgaaaacacgtggaatgcaactataacagaaaccatcatgtgaggcatgatatatacaaacaaaatatagccgctatacaccggaaaacgcagcaaaatggttccccggtgtgtagtggctattttttaatttcaaaaaactcacattgttttctggggtggtaagccagatcactgacgctggattgcacgacaatggtttgatcgtcaaaacggattatgattccgccagagccaatcaattggtcatcctgaaatacccggacacgcagatgacgttccagtgcctcgctgaaatcctgatctgtaattaatcggcgattaatggccatgagggttctcctttgaatataatatcttttatcataaaggtaaggtatggaacaagcaagaaacacggctagaacataatcggctattgggtataaaatagaatgcaacgaagagagaaagagatcaaagggggctagctatggataggtcgtggtcagggccttggttcgatgccaacgcgccagaagggttcgaggcttttactccgtcacatgggttggctatattgggactcattgtatgcgctttgatgctgtggctgactcggggatggattcggtcgaacaagcctataagcgagggaattcgctggttgttaattacagtcctcattctgtcagaggtgactctgaatatttggtatgtgatgcagcatatttgggatatccagacctcattgccattagaactgtgcagtgtgacactgctgctgtctatcctgatgctcatttttcgaagccgctggttatatccgatcatcctttttgccggaattggaggggcgcttcaagccgtactcacgcctaatttggcatacgcatttccgcattatcgttttatccattttttcatagctcatagtgctattattctggcagccttgtatatgacctggatagaaggactccgaccgacgtggaagagtgtgggaggagtgatgctttttctgaatggcctggcgctgaaggtgtggatcgtagacgatgctctcggagctaactacatgtttctggccggaaagccgtcaacaccgtcgatattagattttttagggccatatcctctgtatattgtggcagaagaggccattgcgctcctgttcttttctcttctgatgctgttgttcgaggtgcttccgggaggcaggctgtatgtccgctcacgtaaaggagctgtgcatagtgctgacaggtcgtcatagagacgacatagagaggttgtagaggcgttgtaaagccatataaaagcagccttttccacaagtatatgactagggataaggctgctaagaagcctaaacagttgtacgaatgggtataacgttccccattctaatacttaacgcagtagtgattctgctccgtctacataaatttccgtacccgatacatgagatgactcgtctgaggcgagaaacaggaccagattggcaacctgctctggctcaccaggggcatcctctagcggatgctctccgcccttcggaaattcgactggaatttgtaccttcttcaagtcttccgaagggtacgtgttatcgtcaatttgcgtgtcgatagctcccgggcatatcgcgttgacccgaattttgtaacgtgccagctccagcgctgccattttcataaaagcaacctgagctgccttggtggaggcgtaggctgagaatccaatacccgaaaaggttcgattaccgttgatggagctggtaatgataatgctgccaccgcgttctttcaggtaagggacggcatatttaacggtagcaaaggtgccacgaagattaatgttcatcgtgcggtcccattcctccagctccagcgtttcaatgggggccatggttccgttaatgcctgcgttggcgaagacgatgtccagctttccgtacgtttccacgactttagcgaacccctgctgaatcatatccggcttggatatatcacattccagtacaagcgcctcgccgccagcctgctcgatgattgctttggtctcctctgcatgcttgggtgtccgatccagcatgaccaccttggcgccttgttctgcaaaacggatcgcggtcgccttgccaattcctgaacctccaccactgaccactgctatctttccttgcaatctctgctctgccattgactattcctcccattccgttcataaactaaacctgactcgttattccatacctctggacgttgatggtgaaacagtcacagctggattttatcccatttgcgaaatatggtaacataggcgaaccagcaggaacttgtagtaaaaatatatagcaggaacaagtatggagaagaccgagtgacggaggtggatcgaattgagctataacgcaaatgaccgacccgaatcgacagacgctatagcactgaccggaaaaatgaaaccgtgggcactgagcggccccagtattcaaatcgatccgttgtttccctattacgccaaccgttcgcgggacagtatagcagatgagatcgcccttgcgggctaccagaccgttcattattttgtcgtgcgtgaaaatgaagtggatggagcgcttgttgctgcttttcaacgcagaggcatagcggtgtgggcaatggtgctaggcaacggttcttttggcgtgtcccagctgccgccggagtggaaagaatggcgcatggagctgctgcgcgaaccgaacgacggatttcagcggctttcgcattttgcccaggagtatgtggaatggaaaaaggacgccgctgcccggctcgtcaccgacattccgttcgacgggttcgaggtggcggagccttatttccccgaatggaacgggctgcgcagtggagtgtacggggatattgggccgcatgcacagcgtgcctttcgcgagcgcagtggtgagaacattccggatttccgcaacaagcatgcgcgaaattactaccggaaggttccgaacctgtacgcgcagtgggtcgacctgcgcgtggacgccgtgaacggcctgatcagcgagctggtgaacggcgcaggcggtgtgcgcgatgtccggccggacatctgcgtggcgacatggtcgcttgctgtgagcgggcgcggcgatgttcccggccagctgcgggaatggcagggtctggacgcggtagccatgatcgggtgcgtcgccccggatatgcacgtaatccagacccattggccggactggatgcgccgccgtctgccgccacagtatattcgcggctacgcccgcatcgcgcagtcgattcgcgccgcttatccgggcctgcccctcggggtgcaggcggatatcggttcgctcgcgcggatggttcgagaccgcgagtggacgcggcggttcggggctaccgccctggaggacgactacgacgcctggaccgcctatgaataccatttgggtggttacatgtacgatgagccgcccaaaccgcttagggcggaacgttcagccgaagatgaggtggttatttctttcagcaagcgaattgccacgccgtctgtagatgagctgcgtatttggagccaggaggacagagcaggtacaacatgcgacctgagccgccacctaaggaacgattcactaacgttgctggagcttgtggatgccgtagcagacggaaaccgtctattgctgcgtgtacgcaatttaccagcgggggcgttcagcttgcgccttgatggtgtgcaggatacaccggagctatggctgctcaagggaaggaaggcgcatcgcaatctgccagaggatgaagtgagggttccttaaaatttgggtaataacaaaataacagctgtataaatggctcatttgccgtagcatttttgaattgtatactttgaggtaacatctttcaaaacataaactatagtggagtgaaaaaagtatgtgggattgggattacctgattcgggtcatgtttgcaggattatgcggcgcgttaatcggctatgagcgcaaaagtcggatgaaggaagcgggcattcgcacgcatttcattgtcggtattggcgcagcgctcatgatggtggtatccaaatatggttttcaggatcaagccgtctggtctaacctgtcgctggacccttccagaatagcagcacaggttataagtggagtaggctttatcggcgcagggatgatttttacacaaaaaaatagaattaaaggactgaccactgccgcaggcatctggactaccgccggaatcggtattgccgtaggtgcagggatgtatgggattggtgcaggtgtaacgttgtttattttagcggctcagtccttgctccatagtcgtttttatcagatggctaccccgtccacgcaacaagtagttgttcaggtcgacaatgagccgggcgtactgaatcggatcaaagaactgctgaagcacaagaagctgacgattcacagctttcacgtcgagcgcatcaataacagtgagcagttggttattcatatgctcttaaagctgtcccggtcagagggagtggaggaactgctgtcactgcttcaagagatggaaggtattcgttcagtcgagaccaagtccaattagacgaatttactgctcatacagtagcttttttgtcgaacgctgacggcttttataacgaaaaaaaactttagaaataatgattgaaaacgcttccttttgtgtatatactcttactacatcacagaggcagcagccaaacaaagaccccatgcatatgcacagggccgttgttatcatccagatattactttactttgactggagctggatattttttacccagcgtatccacagtgacttttttcatcgtagccggttggatcggtttgtcattgctatcccgtttggaattgacgatagcatcgaccacatccaacccggacgttactttaccgaaagcggcatattgaccgtcgaggtagtccgcatcggcaaccatgatgaaaaattgcgatccggccgaatccagatccgctgagcgggccatggataatacgccacgtgtatgtttgagtgtattgttaacaccattgctcttgaattcgcctttgatactgtagccggggccacctgtaccgttaccttgcggatcaccaccctgaatcataaagcctgggataacacggtggaaaatggtaccgttataggctcccttttgcaccaaagaaatgaaattgttaaccgtgttcggtgctacttccggatacagctcaagcttaattttcttgccatcattcatgacaatcgtgacaatcggatgggaaacagccttgttcttgtctttagtcgcagcaggagttgtagtgcttgtccggctggcagcttccacatcggccgcttttgtaccgcatccagcaaccagcacgagcatgatggccagtaggcacagcgtgtaccatgggcgtatcgtttttcggttcattgatattcctcctgaaaggttggatgatgtaacatcctaattttaaagtttgggggcagcgcagaacacttttccattttctatcataccttttttgctggggataaggaaatacgggtttgaaagccgtattcttgacccatactgctgctattcccaaggaaaggggcaggatcatgatggaggtagacaaaaagctggcgaaaggtctcatatggggtatggcgttcagtctgccggtttgggtaggggtgctgtactcagtacaacatattcgtgactggctataacataaagcgtaaagataggccaaaaccgttatgattttggcttatttgtatttgtgccagtccaaattgctgttattcagcagatgctcaaagttgttatccagcttcttctgttcagctttttttgcttcgacggcacgctgccgttcgtcttctttacgcttgtcctgttctgcttgggcttcattggcttgagccttaagtttattcagcacatcctgactcaacagatcctttaacgtagcaggtttgtcctgagccgcaggagcaggggaagacgaatttctcttcttagccatgtcatcaactccattccattcgattatatcagcttcttcacggttgttccacgatcgaaggatgagggggcggtagacttttctaatttagagggtaataatggaatgagcagaagggacgtgtggcatcatgcatctatattggaagcgaaatctggtcattttgtggattggagtattgttttgcagcatggcctattccgtgtctattccgtttttacctatatttctgaatacggaaatgggtgtaaatgatcatctggaactgtggtcggggattgcctttggagtcacttttttagccagcgcgctgattgccccattttggggttcacttgcggataagtatggacgtaagccgatgctgattcgttcaggctttagcctggcggtgttgtacctgatatgtgctttggtgacagatccatatgtgttcgtaggagtacggttgtttcaaggcctactatccgggtttattcctgctgcgattgcgctggtcggaacaggttcgcctgaggagaaaaccggctatgcactcggtattatggcgaccgctggggcgacaggcagcattataggtccgttaattggcggtgtggtgagccattattatggcaatcggaatgccttttttttctcagcggctcttgtactggtatctgcgttaattgcgacctttggcgctagagaggacagcttcaagggaaccagtacccgctcgcatgttcgtgatgatatcaaggaggctattgctaatcggcctttgtgctttttgcttattctggcgggattaagtaccttttccgtcatgatcttggaaccgttaattacggtgtatgtgcttgaaatgggagttgaccgtagccaggcgtctttaagttccgggattgtattctcagccgtaggcatcgcggcggtgctgatggctccccgatggggacggattggaggacggaccggatttgcacacgtgctgctgattgggctgatcggttcgggaatcgggaatatcttacaattttttataaccaactttgttggttttggtgcacttcggtttggatatggattgttttatgcgtccgtcatgcctgctatcaacgcgatgactgtggaggtcaccaagccggagtttcgcggacgagcctttagcttgaaccagtcagcgactcaactcgcgacaatggcagggccgttgattggcggcatgcttggcagctggatgccgatccgctggatctttgtgttaaacggtggcatactgctgcttgcagcgttgttgctaggggtgaaggggaaaaacgtgttcccggtttcagccaagaagaacgtcacggatcaggatattcattctgccggataagcgaatcacacaggattgtcgaagaggacaaccttagagcccttagagcaggtctttttttgtgttattagataattatcccaaacctttacttttagtatacttattcataaccctctacactgataatatgacaaggagggatatattatgataagagacgacattttatgtcaacagcttgagaaagctcgtcaaaagctgtatattttgcaagcaaaacatggttttaatcatgccagtgtgctcagacagtctgtaattatggataacctcatcaatcaatataaccaccttttttatataaaagaaaaaaagccaactgcataaatgaaaccgatgggcgagaaacttttggtgaggtcactcgcccttatattgtagcgctgatgcttataacaacgatgcttgtcttaacttttataactagtgtgcaatctttcattttaggtacggtttgtttgatgtgcactcagtaaaacaccgataataacgaccaaaccgccaatgatttggcgccatgtaatcgtttcttgcaaaagcaacacagaaaataagactccaaatatcggaaccaaattcatcagagaaacggaactactcggtgacagcttgattaatccgtaattgtagagcaaaaatgcgataacggagcagaatacacccagatatactaacaacataaacgatccggttgtcggaacctgccaacgatccttttctaatagagccaacggtatgaaaaagatactccctgcaacggtttgataaaaagataacgtcacaggcggatatttgtccacaaccttgcgcgtcatgaaagtataaaacgcccacgcaaaacccgtcccgattaatattaaatttccgattagttgattcttactatccgaactttcgtcaactgaagtcaagaaatataccccgatcatggccagtgctatgccgcaaattttatatttggatattttcactttatacaaaataagttcaagcagcgacgtaattgcgggatatgatgcaacaattaatgctgcgttggaagcggtagtcaggctaacccctatattctccattgaaaagtagagagtgatccccaaaacaccactaaacgaaatcgtagccaaatcttttggctttactttgacatgttcttttttaatcagcaaaacgatacctagcacaacggaagctataataaatctggatagacccaaggtaagagggggaaacgtcgtgtaggctgctttggtggcaataaacgatgtactccagatcaatagggctagaatcgtagaaccgtagtaaatgcggttgctttcgctgtgatgagctatgactttgttcaagttaaatcctccctgaagtaattccctgtgaaatataatagttgctactatagtgactactataaaaacgttactaaaaagatagtgtgtatatcagtttttgtcaaggggaagtgatatagtaaggatgaacacgaattgaggagaagacgtcatgaaaccaaaaccaaatatattagaaattctacgagatttgaattttagtgaatatgaagccaaggcttatgtgaccttattggaaagctctccactttcgggatacgccgtttcattgaattccggggtaccgagatccaaaatttacgaggttttgtctggaatggttaaccgtggggatatcatggtcagtcaagaaaatacgcctctgtatgtgccgcttccgccacatgaattgattgcccagagaaaacgcaaagcagagcagattttcaatgtggcgcaagagagtttggagcagtacacagcatcatttcaaaatagagagaatatttggaatatttcggggtatgaagccattatcaatcgcataaatgaaggggtaaagggagcaaaacaccgaattttattagaaatttggaaagaggatgccgaggtgttccgagatgccttagagcaagtagctcagcaaggaattgaagtgatcattgtagcgtatggggagcttaactttgatttcgctactgtttaccgccatgatatgagtgaggagattacgtctgaaattggtggtcggtggattgtacttagcgtagacgaccgtgaggtcgtagctggcatactttcacttggtgatgacagccgcgctgcatggacgttgcatccggggctggtgatgccgattactgaagtgattattcatgatatttatatcatggaaatcctatatgagttccgtgaacaattagaggagaaattcggccctaatctaattcatcttcgcaataaatttgctatgggcccgaatggcaaaggatattatgttcctttgactgaaaaaagcattaaacgtgtatagagattgtccgaggttcgatgtgcaaaaataaacaggcccatggagtgttattccatgagcctaattttattgatgttgtgttctattattttacggttacaatcacacgttgataatgctttaaaggatgtttaccattgtcctgtacctctgcgatgatatgaattgtatttccagacttggcatctgcaggaactatgaaacttgctgtatttgtgtcacttccttgcaagtcaattgtgtttactttctcgcctttagctacttctcggtgaagcccgagctgcatatcacccagcaattcaggtttaacttgtgcgggttttactttagaatcttcatacgtgtcggcttcaaaatatctccaccatttgtaagtcaattgatcaccgtctggatctgcaccttctgcatgcagggttattttctcccctgggctagccgttaggtctaatccttctttaatggtcaatgttggattatggttggcatctttgtagtcggacgcaatagcccaatctgcacgagcagcaaagtcattttgaatatcatcaaaccaacgcatcagagaatattctgcttcgaattttttcgtatgcacatcataatctaacacggtatttctaaatagtttatcgttaacgacaccgaaacgacctccccaaccaccataggttgggttttccatactccgcaatccgttatcaattaaatagaagaaggatggagaatcaccttcagaaataaagtcatacttgccgtattgtggatttttctttaagtaggcttcactgcctctttgttcttcatccaactcgcctttgatgatattgccatcgcccatcaaggcatacatattgagcaacttgccatgaccctctttaatatttttgaaattccattccccgtgcaacttgctgtttacttcttctgtgtgcattttccaagcataagcgaaatgccagaagttagattgatcattaataattctgatgtcaggccaatttttagcgatgtaattattgtagctatcgtcctggtccagaatgatgtacagtacgagtttatcacttactttttttcgaatcgtttcccattgatctgtatttttatattcgtcttcaatggactttagagctctggccgtggtattggttccaccccaagtttgtacgtataaatctcttttgtcatcgtccaggaaaagcgttttaaggaaattggagcctgccgtttctttgtccatttcacctttatttgaaatgttacctattttggtaacgctcttgatatattcaggctttggatatccctcggcatgtttaattaagttgggataaatctctccgtaggcatcaatcatatccgttacccattgggttccggtccatctaaatggcttgatgccagctttttcatcgcctgcataatgatatacagagctagtcagtacaatcccggacaaatccatttcattggagtaaagaaggaagcgaatgacagagttcatatcatctacttctccatcggtagtgatcaccgttctggctttggtagttttattttctactttattttccgtctgtttttctgttggagcagcgctttcatctttcacaacggcgggcgccttaccactgcaaccactgatgatcagaatacatatcatggctaatagaaaaatgcttaacccttttctttctctcatttctgttcccctctctgaacgttcctatgatgttttttgtggattataaccatgtaggtattctttttattcaagaattaggcataaaaaaaacctaaacatatatatgtctcaacaaaagtcgagcatatatacatttaggttttgcctgcatgatcagtcacaatcctgactcaattttacatcattgtccgagaaaatgaaagcggtttatgaatgccggcataaaattagttttacgccttgaataaaccggattctttgacttcagacaggaagttgtggaactcagggatgttcagctgttgctgagcatcggacaaagcgactgccgggttcggatggacttccaccatgataccgtcggctccagcagccaaggcagctttggcgcaaggggccaggatgtccttacgtcctgtagagtgagtcacgtctaccaatacaggcagatggctttcctttttcaaaatcggaacagcggaaatatccagcgtgttacgcgtccatttttcgtacgtacgaataccgcgttcaatcagcatgacttgcgtgttaccacgggaaacgatgtattcagcagcatgaaggaactcttccattgtggcagccagtccgcgcttgagcagaaccggagttctggtttcacccgcagctttgagcaattcaaagttgtgcatgttgcgcgcaccaatttggataatatcgatgtattggatcgcttcctccaaatgtcttggatcgacgatttcactgattgtagccagcccgaactcgtcgcctacacgtttaagaatttgcaatccttctacgcccagtccttggaaatcatacggggacgtacgtggtttgaacgcaccaccacgtagaatcggcacaccggcttccttgagagccgcacctacttcgcgagtttgctggtagctttccaccgagcagggacctgcgaccataatggaggctttgccgcccaccaacgtatctttaaccttgataactgtgctatccggttgatttttgcggctgacgatcagatgttttttgtgttcttctttttgatagttcaaagaagccttgaaaatatttttgaacagctggcgaatcgtagcatcgtcaaatggtccacggttagccgcgatcagcttgtccagcatttgttgctcgcgtaccggatcaaagtcaggtaccccttgagcttccttcaattttccaagttgtcccgccagttcagcgcgttgggacagcaactccagcaattgcaaatttgtagcatcgagctgttcccgcaacagctccaaagaattttcatttgtagacatacagtacacccttcccgaatttaaatttgttttttctgttagcccatggacttttttttgcagaaaataacacaaaaaggcattcgccgcaagggacgaatgccgtggtaccaccctaattacagaagtatacatacgaatcgtcaacgtcgttcagtcgacggcagtaacttctgatcttgatgcccgtaacgggggcttccggaaacctctactgcggacaaaggaatgaatccttctgtcggttcaaggctcgactcgggagtgaatttcaacgcgggattgcggtacgctctcagcaattcgtacctttctgtgggaatccgttaaacgtctacttgtctccgtcgatgtctttgttcatggtattcaaaagatttgaccttattttaaacaaagtaggtgcagaaggcaagccctgattatcaggttcatgtttttgcccttgaaatgctgccttacaacatgtgaagttcaaaagggtgcactcaagccatgtgtatcatttgtgtggcttgggtagcaccctttttgcattctctatctgtcctttcattttccttgatccctgggttcgggcttcgcagatgcgactcctcgtgggttatcttcggccgagatatcatctgtaattgtcttgtccgcagacctgcggtcatcctcttccacgggattcaaggctttgtagcgcttatactccatatcggcttgagacatcggatctttatacataggagatcagtcaactcctttcggttatacacttcattacccgcatagcagaataggtaaccgttttctttcacccgataaaatgaagtgtttaatccagcatatcgtcgctgtccagttgctcttcttcgtccccatcggtaccattcagcaaatcggtaccatgcaggaattcggcaggagcagaagggtcaacaggactgttcggtgtcagttcatcggcatctgggacgtcttcgagaggagtatctgggccctcggttagattctcccagttggtttctgcattttgcagagaaggctcaaaatcattgtcatgtagctcattaactcgatcatcacgattggccatgttgctcagctcctttgctttttgttgcttattccgaccttacccaaacagtagaacggctaaaccttgagttagtgtgtctgtaggaagttaaaatcatgcgaatagggatatgcccattctcaattagcgtttttttggtaactgctgtgatatgataaagaggatagggagggatatgaagtggaatggtacatgtttggtccgatgattagtcgtatccgagtaggtcaaaaggcatctaccccgggattttcccgtaccctcattcggcgcccggaaggcttatactggacagatggcggacaggccggaaaaatagtagaaatacgcgattatttattttccgatatttggacgatctatgaggatgaagattgtgaaccatggttggggcttagagagcagaaggagcggcgcgaacaggaaatgatcattaatcaatatgaagattttacaaaaaatgagtaaaaagaacatgataccctactaatgaagaaggtatgcacatcatcgtatagaataatataatttcaggacgtaaaaaatgttaaaacgaatacaaacttgtaaatcctactatgtaactttgaggtgcttaatatgaggcatgtgcccaaagctgtcgccaccctgctagcggtcattgtgttgttgttgtcgctgggctactccgcctatgcggccaaaatgaccccggaaagggattataagataccctcctgggatatgagatggggagcggtaaacgaggatggctctttagatgaggtaaaggattccagcaaagcctggatgcatattgaagatgatacacaactgcttaggcagcccggtaatataggctctgcttggattcgtattaagttaccttcgctaaatgatgaaacgccagcggtgctttttgaaaatatttatggcaggcatattacgctgtataaagatgggaccaatttttacgaatcctaccgtgggtacaattatgagaataatcgtattctgattccgcttaagccggaagacagcggtaaaacattatacatatggacggaaagcagtaagaatagactgggcattatcggcaatgtgatgaccggtgattatcgtgatttgttggggaccttggtcagaatggatgttttagatattgtactgggcagtacgtttatctttatcgccctggtactactgatctgctcatttttcctgttccgtccgagtatggccatgtggctgtccctaagtgcaatagtattgtctattggtctgatgatcgtaacgtattcaccattcttgtatacattctatcgcggctatggcaagctgtacttacaactttttgatgtggcactatttattctgctgccttcattagccttcttttttgaacaaaatatcaattcgattatactgattcgcaaattcagaaagttgttaaccgcatactctttgttctgctttaccatgatgattgtgaatttaggagcacaggagcggttgaacgatatatattttttttttagtgtagtcatcttgggtatattactcgtcgccttattgatactgctggtatttgcttcggttcgcatggcacttaagggtgatcacgaagcgatcattttatcgacaggctttgcattttttgcagtcatctctatcggggaactgagctggttcttcattctggacggacactacaatatgtttttgtggaaatggggcgtgttcggttttgtactggcgttgatcgcgatattgggcagaaggctggcagaaaagcacaagcaggtggttcggtactccagagaactggaaatgttcaataatgagcttcaacgttcggagaaaatggagattattagcgatctggctgcatctgtagctcatgaggtacgtaatccccttcaggttacacgtggatttcttcagttgatgagcaagcaggaggatggtaaaaataaagactatctacatatcgctctggaggagctggatcgagcttccgcgattattactgattttctgacttttgccaagccagaatttgaccaaaccaaaacgttgaccatattggacgaattcaaacatatcgaaggaatcatcagtccaatggctaatttgcaaggtggaaaaatttcactggatattccccaggaaatcaaagtgcgcgggaattcctccaagttcaagcaggcgttcatcaatatcatcaaaaacagcatagaagcgctgcgagatcagggtcatattcacatatgggcttatgtggacaacggagaagcggtcattcatattcgggataatggtgaagggatggatgctcagactttatccagactaggtgagccttatttctcgaataagacaaaaggcacgggtttggggatgatggtgacttttcggattattgaaacgatgaatggcaaaataacttttacaagtgcaaaaggggtgggaacagaagcgaccatccgcttccccgtagccggataatatccggctttttgcattcggagaaaacggagggaagcttgctgagcccacccacatgagattaaggaatatagattaaataagcatgaacaactaatttaccacatcgagcgaggtttctgggatgcagcgagcacgccggaggggtctggaggaattaccagaaaaaactgatcaggcgtttcctctaacgttttgatttggatatgatcggggatcacgactcctaacacatcacgaattgcagatttgggatctgtcatcagtttctctctgaaactggcatcctcccaagctttttgaatgacttgtgtttgaagaacttcagtagccatcaaaaatcaccctctcattcaattggttatatttacctagtcagtataccacgaaaggctcagaaaaatctagcattatttcatatttttggagagccagtagtcaagtccgcctcttctcaaatgcgagcgtccgccttcaatttccgccgccacttcgcccagttctgctgcgatagaatgtgcaaagctacttaggccgtggatagaaggctccagggtctctaactgttggactgcttgatcggcaatgctcacatagctggcgagcacaccgcgtacataaatcgcttcctgaatctgttggggtcccaatccttcacagtaagctgtcttctgctcggcactgatatgggacaaaagacagttatagctatgttcgaccaaatcttctgaccaatccgcccaatcatccgacatttgaagcacgagtagcgccaagtccgtcatatttgtaatagtctggatcagatcagcacggcctgcgagcagtaaagcacccgttccggccatttttaatggacttgctttcagcgcgaccttatttctttctccttgaaaatagtcctctgttccttcggatatcacactaacggcccattcatcaacatacgttcgggcatatgaccaaaaaggagaggttgccggaaaaaggtcccgatatacgcttatacactcggtatagaagagctggcttaaggcgagttgcattttacggttgtctgctgctgtgtccatcacatcatcttgaattaaatagtgagccatgataaacacgttgccaagtgacagcttgtggcatgtttcgggggggagtccggtgagttcttgcagccaaaatggaagcaaatagcatatgtaattacgcgtgctgtcttcccgcaacggattaaaacgcgccagaaagtttaaaccctcttgctgaaagggagctggaaacgtggacgtccgttcctccgcttgacgaaatactttttccaattcgtctttgtatgcaaaataccattccatcgccatcacctgcatctcttatgaatatttttatagcgatttctagttgttaccggccattatacaacagattgcaattttcaagattttgttatttttacattgagaatgttgtaaaaaggatatcgacaaaaatcccggctgggaagatcccgccgggattttgttttctaaaattagatgatctctaaatagtcaatataagcatcccatgtcccatcatcggctgttacaacaagctcaatctcttgatttccggttccatggctgacattgtttaaagtatagaccgcaggactgctcccgccgtagtagaaggtacccttcgtttgtccaccaattttcaagtcaactttggccatgttggaattatttgaagcaccacggagtgaaaaactatgggtgccgctggtaaaattctgtgtgaatttcactgaatcattgttggagtataaagccactccgttgaacggcgagctgatatttgaagtatactgaccgcctttggtcatattttctgcttccacttttgtgcctttgtttggcggcgtttcgccgtttccgccatcaggcgctaccgcccggccattgcttggtgagatcataccagagcaaaggttacggtttttgaggttctgtgcaatttgtggaatagcttggagtgtagtctggtactgatcatgcatcaggatcacatcgccgtttttaagtttgcccgcagcagctacgatctgtgcggtggaggcgccgttccagtcttgggagtcaacgttccacaatacttcggtaagaccgttttgggtctcaatggatttgagggttgcgttggtctcgccatacggaggacggaacaactttggtgccgtgccagtaatggactgtatcgtttgctgcgtgcgtgtaatttccgatgacatctgcgatgtgctcagttgtgtcatatgcggatgtgaccatgaatgattaccgatccacatgcctgctgcttgctggtcacgtacaagcgaaggattattctgcgcgttttgtccaagattaaagagcgtcgcacgtaaaccgttttgcttcagagcactgagcagcgctttggtgttagagggattgggaccatcgtcgaaggttaacgctacataaccgctcgagcaatcagccgcaagcgcctggttgctcgagatcaccagcgagcctgtgaataaagacaaggtgattgccataatcgccgtccattttcctgctttagctataaacatgggtctacctcctagctattttaatatagtatggatgttccgatactccgaaccgattcaactctttactagatttgaaattttagtcgatctccaaatagtcaatataagcatcccatgtcccgtcatcggctgttacaacgagctcgatctcttggtttctggtgccattattgccgctaatcgtaattgtattactagttacattggcactccgactgctttggtatccctctacagtaagtgaagcttcatacatcttgtccatgtcttctcactttttgaagtgctcgctgaccgaaatggttttgctcgtgcgtttggatgtccataaaaataaccttattttttgtttcattggactttcctcctgtagcctcactatgatgcagtgcattctgtagtagcttgatgcaacatgtctttcaaaaatcaaattgtaaacgtttacaatttgattttatcatattttccttaatatataacttgaaaaatttcaagttatattgtagaaagtatagttattcattcttactcactctacaggatagggttcccaaggagcgcgtgtagatcgaaggttgggtgtaattgtgatagcaatgttcataatttctttttcccgtcttatggttacttaacaggcgaaaatatgaataaaaatagcgggaaaagaaaatattattttaaaaaggatgaaagaagggtctgcaacatgaaaaaacaatggaaattgaccgctgctattctgtatggaggagtgatgatgtatggtactgcgggtgcagcaggagcttccgggaccgaaccgggtaattcgttgcaaactctcactcccaacgactttatccaaggggcagcccgccaatggaatgttgaaccacaggacgaccacggacatgggcatgttcacagacatagacacggcaaacggcctggcggcttgaatcaccatctcaacgagaaagtagccaagctgctgggcatcactcctgtccaattagagaaagaactgggacaagggaagtcattggccgaggttgctaaaagcaaaggcatccaagaagaccagctcattgataaattgaagaatgaaatgaccgtggatctgaaacggcttgtgaaccgtaaaggcccgattacattcgatcgtaagtccggggcttcgaatgaagctcaattaaaacatgaggcagggacgccctcaacctcggctaacgaaaactaaatgtatctttttgcactaaaaaaccttgagaatggcggtcctcaaggtttccatattcaccgggcagtacgcatcggattcctgctctcgcagggtaccttggtctggcacagtccgcagccagcacccgatttggcctcgccgccgtttagaaccgcaaagtcccgtgatgcctggccgtacacaaaattcatgcaggcgattttgtcatgtccgccgtccttgctgatggcctgcacagggcagcgggtaatgcacacaccgcagatgcccttgctgcacagcaggcagttaccggtatgtcctgtggctgaagatactctggcatcaggcggcaccttgagatcggtcaccacggacagcaggcggatggcaattcctttttcggtgatgaagccgtcattgatactgaaggtgccgagacccgcagcatatgcaatgtggcgctccgaccagttggagatcggccccccctcggcgccatggatgctgtaccaatccgtatccagcggtgcaaccgcacggtaaccaaggcctgttaagtatcccgccaaatgccgccttgcagactgtacaaaatattcatcgccaaaggtccgcagcagcgcccattcccttgaggctctttctttttgcgcacgattagccttacggatcgtctcgctgatcggcagcacaacgctgataacggtgcctccatcaaaactctccgttccaaaggaacgttcaaatgcttcctgcggcgtggcgtgatcgggccccactactcttttgtactcctcaaacaaaggatcattagccgcagcaaattggataatcggctcctcgtaataaggactccgcagttcttcacaaacattgcctttgtcttcgctcacataggttttcatctcggctgcgatgttttctctcatatccggtacggattcaaccatcctatccacatccctctccgtggttattgttcacagtaaagcttcccttgataccgcaataaacatttcgatctttttcgtgtatatacacgaattgaacacaactccacctggatgaggagccgtctaatatccatccaaattttcaatcttggataagagtgtgttgagtatctgcaactgtccgattcccaatgactcctgcaaaaaacgttgcgcctcctcccaaagccctgctgcgtcattgtataccgttcttcccctctccgtcagagtaaggcagcggttgcgactgccctcagcagatgtatcctccacatacccgttatgctccagcgctttcaaattgcgaacaatcgtggtccggtcgagccgcatctccagcgccaattcacttacacttgcggggcccagtgcagttaagtgcttgagcagcgagaattggctaatattgagtccgctcggggccagataccggtcatacagtcccgtaacagccatcgaggaacggcgcagattgatgcaggtacagactgaggctgatcgcttctgcgaagatttcttattctttcctgtcgttttcataagttctccattcgtgtactgtttcgtgtatctacaccatctcaaaagtggtaggttttgtaagcgatatttgtcacagcagtcagttctgtcggtctatcatgatttatcccctgtagtccttcctactaatgaaaagttgaaataaccagtcgcacgaaatcaaccagcgactggttatttagctttgctagaatgtgagccgaccgatacctataacagcttttaagctgggaaatagggccttgggatacgccgagccattcagcatattcgccttgcttggctgttggatgctcgcgcatgagttttcttagattttcaactaattgttatgaagacgaccgatggttacttttttccttgtacgcaggtttctttacgacaggaacaggtaaaggactcacgcctatatttcccttcagatcgtttatgcattttttacataaaaatgaatccctgaaatagcttaaatcctgaatcgaatagcataagtgacagcagactccaatatacttccgcatactcaataaacctgtttcacaatctaaataaaattctaaggactcaccagcttgaatgcccatagaggttcgcatctctttaggaataacaattcgacctaacgtatccaagggacgtgtcatacctgtatttttcaagtgatcttctccttccattgtccaacatccaatgatctcctaataaaaatataaaaatcaataaagtaaaagcatttatgtttgttccaaaagatggtattatcgtgaaagaaaatcaataattatactattagtttccaaactatattgtttattgaaattgaaattgaaattgaaattttatgaaaatgctgaaagggtggtttatccatggaaatcacacctacgatacaggcagaaattcaaacctatttgaaacgaaaaggcttaacgatgaccaagtttggtcacatgattgatttgaatgtaggtacagttagtagcattgtgaccggtaaccgatctatctctgttcaccaactggatagtattactgcgggaatgaatttaccaccggattatttttacgaacgttatattgaagaatgcattgaagaatctccgctcaactggaaaaaaatcagccctttcttataccgatgtattgagctaggacgactggactgcttgcagcgagttgtaattctgttattggataaccctaattatccgccatcgctctttgaagttgccgaaaatgtatacaaagacggttacaatgaagcagcggcttacctttacaaaaaagtggctgaaagtgagaagcagcagcattcagagcgattggcgatctgccagtatcgtttgttccaaatcaatattggacaagatagagctataaatcttcaagctgccattgaatttgccccttttgtggatcgtttagacgagatagagcaattagatgcattaaaagatttggcgaacgtgtacagatcattaagtatgtgggacaaggtgtatgaatttgcaaatcaaatgggtcaaatgggaaagatccaatataatttggttcataactctaagcgaaaaggaacagagccacgaaaaaagctaagcaggccactgtttgtatacatagtttactccgaattgctgtgtgctaatgcttgcgatgcaaaaggagatcatgaacaggcattagaacatatccgaggttatgccgatctaagttgggtaaaggagaaggaccctgattcactttattggaagaaacaatatcagcaatgggcaaaaattaatacttacgtcaataggcttatgtccggggatattagtgttctccccgattacgtagaacatatggctgccgaaaatgagatttttgccgagctactaaacgttcttgaagttgctaatcggtacaatgtagatgtagaccatatccttcagcgttttgaatcccaaattgaggcttatcaagaaccgtcatcttcagacatgtatacacagcaggttttaccggaagagtacgtacgcttctggtacaaaatggctaagtacagcctaaataaaggcagatacctatatggtttcaaatgtttaataaacgcgtttgaaaaagctgttacaattaatcatgtactacttattgccaattgttttggattattttttcacttcaaaacacatgcggctcccgaaacacagacacagttccaatctatttatgaggaggtgtgggagaaaaatgatcaaaaggatggctttcttcttggcagtaactagctttttactggtattcacagtaccagtccaagctggaaatctaagccatggcacgatccaaacacaaggacacgttggtggatcttgaccaaacactaattcattaccatggaccagcttatggctggtctttttttgtattattttgtaatttttcggctcaaaaaagatatgacgtatttgtacatccctccttaaaatgagattcattaggaggtatgcaggatgaacaggtatgaaacagttacgttaattcaacaggtggaacacgccagacaacatttgcatgatctttacgaagagtatggtttcggacatgcttgtgtacttgagcagtctatgcttttggatgaactgattaatcagtacaaccgtatgtttcagaccaagaagctacctcattatgtttagtccatcctctcccttctttgttatgcaaaactatgacttctcccgcgtaacgtttattattctatataatgacttattttaaaataaaatacatattaatgtcataaaatgttaatcatctttttgaggggacggcatactaaggcacagaaaagcagagctcaataagtgagccccgccaaagttcattggaatcataaccccatgctgaaacacagacgcataagattagccaagctcctgcgtgcttttggaagcgcgtttggaggaaaggaactggaaacgaaaggagtgccagttcaaccgctgtctgcctttggaaccaacaatccagttaccgccgggcagatgggcaaaaagccagctgatgcccagagaaacacttgccacgacgataaacgtaatgagcgtagctgtaaaatgatgatcgcccagtgcaagcgagcgggtgtagtaggatatgaaggccagcacgagcgcatgagctagatatcctccaaaagaataacgcccgatccagttcaacatacggcgaaacggctcggatcgtgtatctttttgcaaatggagcagcagtccgtacaataaaagcagctgcgacacaatgagcacaaaggtacttggcttcaaataggtggaaatattaagattgatcgtatcgcccgactggatcagcatcgtgtgacccatgagcatgaacaaaccaataaacacaaatacattccacggcaacgtctgtttggccagtccacgccaggtgtctgtcatgtaagcacatactgcgcccagcataaaatagaaaaagtacatgacaaagttataggtgcgataatccagcagagtctgccaaaaggacggcaacccagtgctccatgcagacatgtcatagtaggaccattgtaacagcaaagtataagccgtagcggcaatcagcataatagccaaaacaagctgtttgcgtcttttcgtgctgcaacgacgtagaaacgcttgaacctgcccggctgcttttgcaaataaaggaaacaaaatataaaactgaaagatcatcactacaaaccatagatgatatccgctgacggggatgatcatttcctcgaacatacctttgtaaaaataaatatttccccactgagccgttgaccagttttgagtacatacccaataaataacagtccagcaaaggaaaggaacataaatatctcgaaaccgcctgccaatatagcgaggatagccaatcggtttgttgccgttataaaatagcagcgccgcagacaggaaaacgaacgtcggtgtgccaaaacgtgtcaaatgatacagcatcgcgagcataacagaatctggctgttggatgtcgctgcgataaatatattcgccaatgcaatgctgaagcacgacagcgaggtaggcaaggccccgtagttctgtccactccgcgatacgcggcttactcatccatatcactccttttccgcaagatacgcacatgtttttcctagcacaattgtaggtattgtaacgtagaaacattagtgcaggattaacgccacctgaaagtaagaagagtgaagtagttccaatttaatatgattgcgtttacaatctaactaaaaccagaataaattaaagtgaatttataacttaaggatacacacaggaagaggagaggaaggatgaaaaaaacgctgctggtatatatgctgttgattgcggcctttgctctctatgtgttcaggtatgaacaaacgggcccgttaaatggcacttgggaggataaagggctgcgaggcagtatcggagagacctatataatgattacgttccagtccggtttggagtattggaaaagcggacttaagggcttcgaggatgccggggatgcgctgggggtgactgtggagtatcggggagctacccgttatgatgcgcaggagcagacgaccgttattgagcaagcaattgctcgtaaacccgcagggattgcgatttccgcgattgatcctcactctttgattccggtgattaataaggcgctggatgcgggcattcctgtggtactgtttgatgccgaagcgccggggagtcgggcgtattcttttttgggcacggataattataaggcgggcgtgaccgctgcggataaaatggcagagctgttgggacgagaaggccaggtcgctgttctgacgctgcctggacagcaaaatcatgaagaacgctcgcgtgggtttcgcgataccattcagcggcagtatcctgccatgaaggtggtggaagtggcagatggccgggcagacgcgatggtatcccgggatgagtcgcaaaggctgatgaaagcttatccgaaactggcgggcatttttgtgaccgatgcaacgggaggaacaggtgtgggtgaagcggtactgagccaaaaaaacagccatccgctgaaaatcatttcttttgatacgaataaagcgacactggatatgattcgtggtgggacaatctcggcaacgattgcccagggaacatggaatatgggttattggtcgcttcaatatttgttccatctgcatcatcatttgacgattcctgcaccttcttccactggagacaacactccgctgcctgtgcgggtagatactgggatttccgtagtcacccgggcgaatgtagatgattattatgcgaaataaattttgggagcgtatccaattaggggtgcgccaaacgatgccgcggttacgcttgcgcaatatgcctttacgttatcagctcatgctgctgttcctgttgtttggcattgtgccttcgctgggattaggtctactggtcaattggacggtggaacggattattgagcggcaggtggaagatcatacgatgcagttgattggcaaggtgaacgaagcgctggataccaaaatggaaaatttgcaaaacatgacgtatctgattgcttttaaccccgatatcggggagttctggaaagggaagacgctggctgacggccacgcgggtcatgtgagtatcgtaacgccggaaaaccagggggagcgggcacagaactcggtgcaaaatcaggccttcacttccaagcaggcattaagttctgtacaggagcaggatacgctgtataaaatgaagcaatttttgcagggctataccacgttatatcctgaaattgcagggattctgatcgtgaacgaaaaaggcgattatatcagcaacgaaatgtacgctcgaagcacgcgtagcctgacggaagaaggctggtaccaacaggcggcgcagcatgcaggcatattcactgtgctaggacagccgagccaccgtaatgtgaccactcatgtccggtacaaggacagtgaaattgtctccgtcgttcgctcggttacagatccggaaaccggacgcgtgctaggcgcgattatgattgacctcaagctgcgggctgtatcgcaggctgccagagatgtaaccctgggcaaaagcgggtatttaatggtgacagatgctgaggggcgcagcgtgtacaggccggatatgcctttgattgagcgtattccgccgcaatggttcggggcaggtgacagcgggatgtttacccgtgaagctgggggcagggaattgctgttcatgttcagggcttccgaattcacgggctggagaacagtgggggtattcccggcacgcgaatctacactggaagtgcggcaaattcagttctatgtcatctgttttgttttcattgtatgtctatttggcttaacggcatccttgcgattgtcgagttccattgcgcagccaattttccggctgatgtcctatatgcggacggcagagacaggggatcttacagttcgccaatggagtgaccgtggggatgaagttggaatgctggggcggagctttaaccgaatgctggagcaaattcgccgtctcatgtcacttagcgaactgagggaacggcaaaaacgggatgccgagctgcgcagccttcaggagcatattaagcctcattttctatacaatacgctagatacgattcattggatggcccgaaaaaatggagcagacgacgtgtccgatatggtgggagcgctatcgagattgttccgtctcgggctgagcaagggggatgactttattccactgagctccgagattgagcatatatctagctatatgcaaatccagcaaacccgctatcgtgaccgacttcgctgggaattgaatctacctgacgagctaaaggatctgttcgtgttgaagttaatgcttcagcctgtagtggaaaatgcgatttatcacggcatcaaggccagacgtggtccaggcacgatttggatagaagctaaagctgagggcgacaagctgctgctgacggtacgtgacgatggcgcagggatgacggcggaccgtctgcatgaattgcgtgaatggctggaaatccccctggaggcgatggaagtaaagcagaagcaaaagggagttagtacccatggcagaagctatggcatgctgaatgtacaagcgcgtatccggttgtcttttggcgaggaatatggaattgtactggagagcaaagaagggacaggtacctgcgttacgatcactcatccgttgctgctggatatggcgcaactgaagaagccttatgaaaaaggagagggtcaggatgacgaaatcaaaggccacacacaactcgacaacggcgagtctgattgaccaggccataacagaagtgaccataggaacggcaaaacgttaccaagtattgatcgcagatgatgagccgatcatccgtgaggggatacgagattgcatagattggacggcactgggcatggaggtggcagcagaggcggaggacggagaagaagcgctggagctggtgggtcagcttcatatcgacatcgtgctggtcgatatgaatatgccgttcatggacgggattgaactgattcggcgtctgcgggaagatcgtccggaatgccgctgtctgatcatttccgggcatgatgaatttgcttatgcgcaggaggctgtccgacttggcgtagaggattatattttgaagccggtaaatgcggatcagcttcatgctgcactgttgcggcttcgtcagcgaatggacgaagagcataagcgtgccgcctatgtagaacaagccgccggacagattgaacggaatattccgctgctgcgccagcgtttttgcctggaatggatggaagggcaacacacgggaaaagacatcatggaacagttggcgtttttacggcttccatcgcggccgcctgctcagatcggtgtggtacggtggcctgcagcagaggcacggcagacgattatgcgtgagaatgaccgccagttgtttctttttgccgctgaaaatattattggcgaactgctggaggaccgaccgcatgtgttgttccgcgatgcgaacgggctgatcggcatatgcctgtggcaggaggcacccgagacgattggtgcttccgtggagcaggcgattgggcgctacctgaatatagcggttcatacgcatgtggaatccaacgcgggcgggctggaaggtgcaattgacgcgtaccgggtgagtcgagatcgagtgtatggcgaatcgcagctgtctcccatcgtacgtcgggcccggcagctcattcaggaaggttacgccgatcgggaattaacgctggaagcccttgcttcgcggctacaagtatccgccgtatatctcagccgcgtgctcaaaaaggagctcaacgacagcttcgtgaccctcgtcacgcgtgcccgtatccgtaaagcagtgcagctgctggattccacgacgttgtctatctatgatatagcagaacgtacgggttacgacagtcagcactattttagcaccgcttttaaaaagactatgggcgtgtctcctgtgcagtaccgtaaaggcgggggaattcaagaaaacacggtagagtaggaaggattgaaatgggggatgagtcccacactgtctaataataaactgtaagaaaaaatgtgtgtgtaatcacacctacgcattcaggggtttgttacgctggggataacgaacaaatatctatcaatatttggaggaaaacgatatgttttgttatcagtgtgaacagacgccgagtggcgggtgtaaagtagttggggtgtgcgggaaggatgagacggtagcgagcttgcaggatacgatgatttttgcattaaaagggatcgctgcctatgcgacacatgctcgtcagttgggatatagcgatcctgaggtggatcggatcacgcacgaagcgttatatatgaccttaacgaattctaactttaatgtacaagagcatttggaaatggcgatgaaggtcggaaatgcggctgtacggatcatggatgtgctggatcgtgcgcatacggatcgttttggtattccgcagccgattaccgtcagtcagaataaaatcgaaggccaatgtatcgtcgtgactggacataatttgtatgcgctggaggaattgttgcggcagacggagggtaaaggtatcaacatctatacccactcagaaatgctgcctgcccacggttatccagcattgaagaaatatgcacatctcaaagggaatatcggtaaggcctggtacgatcagcgtagactgttcgaggagttcccgggtgcgattctcgcaacgacgaactgtgttatgccgattaaaggcacgtatgcagaccgcttcttctcttatgaagtagctgggctggagggagtagccaagatcatggacgacgacttttcaccattgatcgagcgtgcattagccctgccagccgcagatgtagattcggagcaggtgcttacgacgggatatcatcatgagacggttatcgggctggctcctgagattattcaggcagttaaagacgggcatatccgccgtttcttcgtcattgcaggctgcgacgcaccgggcaaaggcggcaactattaccgcgagctagctacatccttgccgaatgatacggtcattctgaccacgtcctgtggtaaattccgctttaatgacgtggattatggcaccgttggagataccggcattccgcgttatattgatttggggcaatgcaacaattcaggttctactgtgaaaatcgctctggcattagcggatgctttcggttgtacggtgaacgagctgcctgtcagcattgtattgtcctggtttgagcaaaaagcggtcgccatcctgctgggcttgttcagccttggcattcaggatattcgcattggaccgaagccgcctgagtttatttcttctggcgtactggatgtactggtggagatgtttggcttgaagctgattacaacagcagaggaagatatgaaagcgatgttggcattgtcgtaagagattggtggggaactgcaaagcgcagttccttttttgtttcatcgttcatcgattcttataaagatgtctgtaagaatctttaatgccagctcagtatctttggattcacgagttcttaggagagtcaaaatggtttttatactcgaatcttcttcggtaagctcatcattgtcctttacatatgtaagcaactgatagacgcccacgttcaatgccttcgctattttctccagatttttcaaagatatatttctctccgcacgctcaatgaaaccaatataactcgaattgaatcctgctttttcggctaaagcttcttgggaaagccctttagactttcgaatatctcgaatacgcgtaccgactaattctaaaagttctgacatgattacacctctctatagtaagaatttcacaaaattcgattccaatcgctccgaaatgtaatatatagacgaacgagatcatctcaatctatatattattaattggaagtcgcttattggattttgcaaaatcctctagttagaagtgtagagaaagagttacatctaattaatatgtgttagtaagtaaattgaattaaaaactactatatagtaatatttattaggaagcttgtccgatagctagaaaattatacatcttgatggttacataattgtgctacgttgctcacatttgtttcaggattttgcaaaattctcgtttatgaaattttaattcaggagttgattccccttgaaacattactccttaagtccccaactacatagtgattccgatttcaaactgcctaagtacagcgacacctacatattgaattgcatgatggattttcaaaagcttgccgaataccagatcaagcttgcacagatgatgcgcgaccataaacagtttcaaaactgcctcattctttgtgatcgtgcgctgttttctatggctaaggccatttatgttcatcgaaaccaaatcattccatcgtatattcgtttatccgtgactgacctgttccctttaattcacacagatgctgagcccaatttagacatggtgctgtttatcggtacggtacattatctggtttcgggagaagatgatgtaactaaagagccaatgaagctgagggaagtagacaagttactttataaaacggactctattctagagtctctgtcacagcggatcgtagctgacccgtctaagcggtatccatctatttataaagaaaattcgttcaattaaatcgttattttattgttggtcacatcatctacttttccccatgatcttattgctggcatacaatattgactatctcaatattacttaaagtatacataagcataaaaattagttagcatataagcttcttagtcatagggaaagtatattttttttggtatctattaacattccatggtactattgtctataggtatagaatgctatttttttctggttctatacaaaagtaggtcctaggacttagggggatggacaatgagattaaaagacgtcgaagtgaagaattataggttattaaaaaatattacaggtgacaacaatgttcatatagatatgaacacaactctaattgtaggtaaaaacaattctggaaagacctcttttacacacatatttgaaaggtttctgaaagatagaaaatttgaatgggaggatttttcttctgagtgccataataactttagaagtgtttttcaaaattatcttttagcaaaggaggatgagaagaaaaaggaagatttttttcaaacatgtgttgatgatcttccttctattgagttgatcttgacggttgagtacaccgatcaagataattggagtaatataaagcctttgttgacaacattggacgaatcaaatagcttgaagatttcttttaaatatggattggaacaaataaatatattttttgaacatttacaaaaagagtatgtgaaaaattcacaaaaagatatcattagtcatattaaaggcctttataataaatatttcaacttgtctattaaacctgtatcagatgatgtggaagtagaaaaaattagtcccactgatataaacaaaatttttggtacttgtttcatagctgctcaaagagaagtagatgatgggaattctaggagtaattctaaattatcaagtgtttttcaaaaggagtataagaatagatcagataaaagctcaagcaataaacagacagaaatagaaatagaatcattaaatgaagaaatatacaaggctaatgaaggtattgatattaaattaggttccttttttgaagattttatacgttcttattcgacatttggttatcccagtttagatgatacgactttgactttaaagtctaacgtgacagttagtaatctattcactggcataaaattattctataaagataatgagcatttgcttcccgaaaaatataacggtttaggatatagtaatttaatttatatcatctcagaaattcttagttttaaatctactataaaagacaatggcactgatttaaatcttatttttatagaagagcctgaagctcatatgcatccacaattacaaagtgtacttgtgcaaagaattaatgtatttttaaatcaaaatgaaattaacgcccaagtcattatcactacccattcatctcatattgtttctaactcttcttttgatagcataaggtatttttgtcggttcaataaacaattaatagttaaggatatgaagaaattcacaatcaccgagaacacaacagttcaagatgatcaagaaaatagttatgatatagatactcttaaattcttgaaaagatatataacgttggtaaaatgtgacatgttttttgctgacaagattattatggtcgagggattatgcgaacgtttacttatgcccctattcataaaggaagttgataacgaaattgctttactacaaaggaaaaaagtacctattaaaattttggaagaacaatatatttctttaatagaagttagtggtgcttatatgcataaattcaaagaatttttagagtttctaggagttaaaacattaattattaccgatattgattgttgtaaattaaatgaaaaattagatgttaacgatattcctataaaatataaaaatggagaaattaaaaaatatcctagtaaatatgaaattaagagtgacgagataaatgaattgatcaccactaatcctacgctcataaactggataccccaaacaagactcattaaggaattgattggaatgccaaatgaaaagaagtttcaaaaaaatgtgggagtggcttatcaaacaaattattatgctcaagatgagcataatattggaataaagtgtggaaggacatttgaagaagcttttctgatagaaaatacaaagtatattttagaaaataaaggagaattaagtagtatatataataaaattaaaaaatatactaatgataatgaaatattcgataattcctactctatttatgaatatatagataaatatgataaaaaatctaattttgcttttgatctgatgtatttgaaaggctggcaagtaccatcctatattaaggagggactattgtggttggcgaagtagaacagcaggtttacagatgtattgatcaagaagaaagttttattattgaagctggagctggaagtggtaaaacttggactctggtacaagcattgaattatattattagtaaaaaagcgaacgagtatcgaaaggcaaataagaggattgcttgtatcacttatacaagggttgccaaagaagaaattattgatagaatccagggtaatgaattagtagaagtcaaaacaattcatgattttttatggggaattatcaaaccattccatagagagttgaaagataaacttattgcttatttacaagataggatagataaaggtaatgaaacgctaaactcctccaaagtaaagagtgtagcatataaaaaggctgaagaaactaaaattaaaaatcttgagcggattgaagctttaggtaaactaacagataaaatacagtacaaagaaaatgctaattataaaaagggtattatatctcacgatgtaatgcttgaaatcgctaatcaacttattaagcagaataaagtactcaaaaaacttattcaggacacttatcctgttatttttattgatgagtatcaggatactaaagaagatacagctcaagtattattagaccaactgaaagttgacactaacatactgtttggattatttggagactaccaccaacagatttatgagaaaagtataggtaaaattgaccctctactctatggattaaaaacaattgaaaaaacggaaaatttcagatgttctcaagaagtaattaatctacttaataaattgagagacgatcaactagagcagaagcaagcaggagattcaaagaatggaaagtgtctgttttattatgttgacgatgtgaatttagatacagaagatttcattaatcataatcttttatccaaattttcgatttcagatccgtataatattaaaaaattgtatttggttactaaggcaattgctaagaaaaataactacttagaattacatgaattgtatgatgaggatgataaagcaacttttaaagtaggtcaaattaaacagagttttgttcatagacttcttccagaggctcgtctgaaaaataaagtggcagaagagatttatggaatgctttcatctgaattacaaaattcactcaataacggaactctctcaagtaatgacgaaaactttctaaaagaaataaatgaaaaagtaataaaatcaaaaaagtttaatgctcttgaaatttttgaaaatgatgttcaggaattaaatagattagaattagcgtttcctataattaatcgtcgcttgttggaaaggtattttgttgatcatttatcaatatacgggcgagcagaaggaagaagagagaaaaagaaagactttattttgaaaaataaagataacagagactgtccgtttgctaattttttattcgctattgaagaaatggttgagctgtatcaacagaacaagattcagtcactcttgagtaagacttcatttaaaatttctaaattacaagataaaataaacttaaatagtcttctgaatgaattaatacaaaaatcagctgaaagtaaaattagcgaaatttttaactttgtaattcagaataatttattggaagtccctcaaaaactaaagaaatactatgaatttgaggtattgaaggattcgtttttttacgatttaatgaatttggaatatgtccaattccaacgtttatactatacagtaaaagattcttctcctttttccactaatcatggaacaaaaggtgctgagtttaataatgtggtatgctttataaacgataatgactggaaaagcagttatagcttggatggttatcttagtgaggtcgataaggatcaaaatcagagatatagcaaaactaaaaatttattttatgtgatatgttcacgtgcaaaatataatttggctattgttgttctatctaaattgtccgaagaaagcattcatagagctaaattattgtttggcgaagaaagctttatttactataatgttctacaggaccaattgtattagcgtagtaaggacacttcatgtgcaaaattcttgctaagatttaaaaagcaacaaatattcgaaactatagaagtttaatacacaaggtggattgttacacttatcataataatcagtccatttgattaattttttgatttccgatttagaatcttaaaaaaatcttatagggaacccaattaatatttttgtacagagttgagtttttgattagctttgccagcgctacaaactggcaaagcttttttgtgtttttttaatccaatcccgtctccccccccatcacaaaggttaaaattttataaaaaaagttcaaaaccagcaaagacctttcccggcctggaatgataccatgtggttgcacataaaaaaaggagaggtactcgttgcctcacttatgtaagcgctatctaatttcaactctaatcagcacttaccttcaaatgacccgcatcacatgaggaaaggggaacttcatatgaaaaaaggagctgttgtcgtatggcttctggttttggccctgatgctttcggcctgtaatttggcggagagtggaacgggtagcaaggaaaaaggctatgtgggcatttccatgccgaccaaatcgtccgagcgttgggtaggggacggagagaatatggtccggttgtttcaggagcaaggctataaaacggatttacagtacgccgaggacgtggtggaaaaccaaatctcccaaatcgaaaatatgatcaccaagggtgtcaatgttatggtgatcgcttcggtcgacggaaacacgctgacggatgtgattcagaaggcacacgaccgaggcattcaggtcatttcttacgaccgtctgattcgcaacacaccgtatctgacgtattatgcgacctttgataacttcaaggtgggcgtactacaggcagcatatattgagaaaaagctgggactcaaggaaggcaaaggccctttcaatatcgagctgttcggtggttcaccggatgacaataacgcttatttcttctttaatggtgcgatgtccgttcttaaaccgtacattgattccggtaagctggtcgtacgcagcaagcagatgacgatggcgcagatcgctacactgcgatgggatggagctttggcccagtcgcgaatggataatctgctgagtgcgtactattcgggggctaatctggatgcggtactatccccttatgacggaatcagtatcggtatcatttcatccctgaaaggggtcggatatggatcagcgaacaagccgctgccgatcattacagggcaggatgcggagctggcttccatcaagtccattgtggctggggagcagacgcaaactgtatttaaggatactcgcaagctggctgagcaaacggtcgtgatggccaacagtattttacagggcaaacaagcggaagtgaatgacaccgaatcctataacaacggtaaaaagatcattcctgcttacttacttgatccaatctcggtggatcggacgaatgtggaaaaggatattgtcggcagtcactattacaccaaagagcaaatcggactgaaataagggtaagaatccaaccgaaaggagcgtatcccatgactggaatcattttggaaatgaagggaattaccaaaacctttcccggcgtgaaggcattggaaaatgtaaatctcaaggtcaaggaaggcgaaatccattccctgtgcggtgagaacggtgcgggcaaatcgacgctgatgaaggtactaagcggtgtatatccgcatggaacctatgaaggggatattgttttccagggcaaaacgtgtgagttcaaggatatcaagcagagcgaggaattgggcattgtcattatccatcaggagctggcgctgattccgtatctctcgattgcggaaaatatttatctgggtaacgaacgcgccagtggcggtgtgattgattggaaagagacttttgtgggtacacgcgatctgctgtccaaggtcggtttgagtgagaatcccaatacattagttacgaacatcggggtcgggaagcaacaactggtcgaaattgcgaaagcgctctctaaaaaggtgaagctgcttattctcgatgaaccgacagcggcgttgaatgaggatgatagtgaaaatctgcttaatttgatgctggaatttaaaagacagggtatttcctgcattctcatctcccacaagctgaatgaagtcgcaaaggtgtcggattcaattacgattttgcgggatgggaagacgattgagacactggatatgaaaaaggatgaagtcacggaggatcggatcattagcgggatggttggacgtgatctgaccagccgttatccagagcgtcatgccgagattggcaaagtcgttttggaagtgaaggattggacggtgtatcacgagcatcatgcagaccgcaaggtgctggatcaggtgaatttgaacattcgtcgcggtgaaattgtcggtattgccgggctgatgggggcgggacggaccgagctggcgatgagcatttttggcaagtcgtacggacgcaacatttccggtcagctgattaaagacggcaagccgatccagaacaacacggttacggacgcgatcaacaacggctttgcctatgtaacagaggatcgcaaggagtatggcctcattctgatggatgacatcaagcgtaatatttcgctgactggcctgaacaagctgacgaagggcgctgtcgtcaatgagcaggaggaagtcgtcgttgcagaggaaatgaaaaaaagcatgaacatcaaagcgccgagcattttacagaaaacaggtaatctgagtggcggcaatcagcagaaggtggtgctgagcaaatggatttttgccgggccggatattctgattctggatgaaccgacacgtggcattgatgtgggcgccaaatatgaaatttacacgattattcatcgacttgccgctgaaggcaagggagtgctggtcatttcgtccgagctgcccgaggtactaggcttgtgtgaccggatttatgtcatgaatgctgggcggatcactggagaagttggccgtgaggacgcgtcgcaggaaacgttgatgagatatatgaccaagtcaggaggcgtgaagcatggaaaccataactaaactatttaaaaataacatccgccaatatggcatgatgattgcgctggtcgtcattatgattttgttcgaggtgctgacaggcggcctgctgttgaagccgattaatattacaaatctgattctacaaaacagctacatcctcgtgctggccatcgggatggtgctggttatcatcactgggcatatagatttgtccgtcggctccatagccgcttttgtcggtgcggttgccgccataatgatggtcgactggcagcttccagcatggatcgctgtgattgcgtctttgctggtcggggcgttaatcggcgcatggcaagggttctgggtcgcttatgtacggattccggcatttatcgttacattggcggggatgctgctcttccgtggattgaccatgatcgtgctggaaggtcaatcaatctctccatttccggggggcttccagaaaatcagttcaggcttcctaccggatttttcatctaccggttataacctagtatccatcattgtcggtattgcactcacggtatggtttatcgtgaacgaacttcgcgaacgccgttctcagcttaaatatggatttgaggttccgtcacaaacgttatttgtactcaagttgattgtggtagctgcggtaatcaatctgttcacctttatgctcgcgagctacgcggggatacctaacattctcgtgctactgttcatactgatcgttgtatactccttcgtcatgaaccgcacgattatgggccgtcatgtgtatgcgttgggtggaaatgaaaaggcagcgggtctgtccggtgtcaaaacgaaaaaagtaacgttctgggtattcgtcaatatgggcgtgctggccgccatttccggtctgatctttgctgcacgtctgaacgcggctacgccgagagcaggtacgaactttgagctggatgccatcgcagcttgctttatcggcggtgcttcggcatctggcgggatcggaaccgtttttggagccattatcggtggtttggtcatgggcgtactgaataacggcatgtctctgattggtctgggtattgactggcagcaaggcatcaagggcttagtacttctgctggcagttgccttcgatatttacaacaaaaacaaaagatcagcttaagctcagatttgatatcgtaaaataagacacctccagtcctacttaaaatgtgggtgccggaggtgtcttatttattaggtcttgtcagccaacgcaactaatccgttaccatttgtccgccattgacatgcagcgtttgccctgtaatgtaggaaccatcatccgaagccagcagcacataggcgggggccaattcataaggctgcccggcacgcttcatcggcgtattggtgccaaaggtgcggatcgcttcgggcgactgtgtcgcggcattcagcggagtccagatcggaccgggagcaatggcgttcacgcggatgcactgatcgaccagattattagccagagcgcgggtgaagctgacaatggctcctttggtagctgaatagtcgatcagatttttttgaccaacataggctgtaaccgatgccgtattgacgatgctggccccagcccgcatatacggcagtgcttctgtagtcatatggaagaaggaaataatattcgtatcaaacgtatcacgaagctgctgttcgctgatatccagatacgattcgcgcacaaactgaacacccaggttgttaatcagaatgtcaatccgaccaaaggtttccatcgttttttgaacaaccagacagcagttgctttttagccttagatcgcccggaattaacaaacaacgtctgccgagcttatgaatgacatcacgggtttccatagcatctcgatgctcatcgagataggcaatgaccacatcggccccttctttggcaaaagctacagcaaccgcacgaccaataccgctgtctccgccgctaataatagccacccgatccagaagctttccggtgccgatatactttggattatcataaatagggcgtggaaccatcaggtattccaaccccggctgtctatattgatgctggggaggaaaggtaatcggaacttctttacattgggtttctgtaccataataaggatattgacaattcattgataatcccttctttaggcgttttgaaatccaatatattcaaaatgggcccaagcggtgactcgggattatcgccttatcccgaaatcgtcgctccatctgctggaatatggacacgtccctccaaaccttcacggttgatgtattccgtaagctcggagcgagttagtaaacaatggttgattgcttccatgtggacagccacgatttgtgtgcaagaggcatgctgcgcaacagccgttacatcttgggcagtcataatgatgggatcaccaatcgtaaaccgagcccctccagcgttcacaattgtccactccggacggtatttatccagtgcttccgcgacttcactgcaccagatcgtatccccggccaaatagacgacaggttcaccgggtgcttgaaacacaaagccggatacgggtcccatctgttccccgatttctccggtgccgtgatgcccggtagtacggatgagctcaatttctcccacggagccagccaccgaaatcggagtaacctgtgtaaaaccgtcagcagtaatttgttcttcatttccgggctggcagaagacgggaagttgtttgtccaaccagcgtactgctgccgggtcccaatgatcaggatgcaaatgtgtgacgatcacaacatcaggctgtccgagtgcctgccattgcggcggcaagggaaccagcggattacggcgggcattttccgtattgggaaccggcggatttacgccagcatcactcaacatcggatcaatcagaaattttactccagcgtattcgatccataaggttgcgttgcggattagtgtgattttcatctatggaagctcctttggtagtgaatgtttttggacagagtgtattttcggtggttctttgtttctgttacaatcatatctgacgcaaggagctacaggctacggcctgctgaaaggaaaaccagcattatcgtttcatcatgaaaggaaaaataactatggaactattcgtacctgatgacaccgatctgcgcattcttcatcatttaattgaagacagctctttatcggacaaggagatcggtcagcttgttcacttgacgggccaagcagtaggagcgcgtgttcgaaaaatgcaggatgcgggcattatcgagggctatacgctgcgctggaaccctgagaaaattggacagacgattcatgcctttattacggtttttttgaattcaggaacaactcacagtgctttccaggcttttgcacgggagcatccctatattgtcgaaatccatcgagtgagtggggaaggctgttattggatgcgcttgcgcatgtcatcacaggcagagttaaataccatgctggatgagcttacgaagtttggtaattacaaattgagtttttccattggtgagatttaacgataaaagctttcggcgtttgtgccgaaagcttttttatttgggcgagggctatgaggttaacgttataggctcatttttaaaatatgctgtaatccgtgttgtcccattttagtgttgccttcatcgataaagccgcatttgcgatacagactttgggcagatagattacgggcattgacgcacagtacaatctcgcgaatatgtgggaagtgtctggcgatgaactgtggtagtagaagcagccctttcttagcgaatccttgtccctgatctgcgtaatgaatagagaacgcgcgcagcagcagtgcctcagaagtattcgtatagtccgctaattcatccccatcgtataaaatgaaaaatccaacgggtcttctagtagccgtaatcacgacaggatggcggtgcggatcttccttggccagtgtcagcatttcatccggcattccagtaaactgcttctgctcctcaggcaagtagaaggtatgtaaaatggcatcatgttcacaatggtaagggacaagctctacattagcagttgaagaagactgtgaggcgaatgtgggattattcatctttacactccgatctgtatggatttttaactttctatatcatctagtttgctaaaaaaagaaacctgaactcgccttacttacgtattactcatacataaactagcatagtcaaaaggagacgtctacggttatgaagcagcttacagaatatcgggaaagccaggacgtattgcgtcatgagctgaagaatattgaaaaatgggaaaaggaacagaaggacatttttttctgggaaaaaatcggtagatggccttttatgctgctggatcggctgacgcccaaagtcattaaagacaagctggagcaactgcttaatgagatgggcagtttcattcagaacggcggcaaatatttggtgaaggaagaaacggttctgaacaggctgaaaaagacggcccatgaacatgtaattcagcaaaatggcgtagattccgtgtcggatacgcaggacctgcctcatgccggggaaaacgctgattcggaacatagtgccgaacctaggtgggagttgaagcaggtggctgagctcccgctaacaatcatggatcggactgctgacgatatgacgtcggctcgtattacctttgctaccgctcagggagcaacaacgggaattggcggtgtgtttacgattgcggcggatattcctcttttgctcggcttgtcactcaaagtgcttcaggaaatagccttgtgttatggctttaatccccatgataagaaggaacgcatttttattattaaatgtatgcaatttgcttcatctgatattgtgggtaagaaggccgtattagaggagctggctttgttcgatgatccttcacgtcaggcacaggttttttcccagatgcagggatggagagaggtcattaacacttatcgtgaccagtttggatggaaaaatctgcttcaaatggtcccgattgcgggtattttgtttggctccattgcgaaccgaagcgctattagtgacgtagctgaagcagggaaaatgctgtatcggaagcgtcggattttaatgcgtttggcagaagtagagagtgaggagttacgttaggtgggtataaaggggtgcagcggccaagatggccgccacacgtttgcctgttacacttcggctccattttcttctgcccaacggttcagggttttatctgtaggaagcaggaaggttaagatgccgagcagtggcaaaaagccgcacaggaacatgatgtgagtgatgcctaccttgtcgatccagttgccgagcacgagtgcgcccacacccccaaggccaaaagcgaggcccgtaatgagaccggacacggtcccgattttgccgggcacgagcatctgtgcataaacgactgtgaccgaaaagctagacagcataataaatccgataattgccagcaggatcgccgtccagaattggttggcataaggcagtgccagcgcgagtggtgcagctaataccatggacagaaaaatcatattgcgtttaccaaaacggtccgcgagcggaccgccaaagaaggtacccagcgctccagccccgaggaacaggaaaatgtaaagctgtgcatcagccaatggcattttaaatacttccatcaggtaaaacgaatagtagcttccgaccgaggtcgagtaccacgaacggacgaataccagtagaatgaggacaatcatggcaaacataacgcggttacgcacttcgggcttcatgcggcgtgccaccgcttttttgcgtgcaatgccttctgtacgtaggacgttaccgtaccagcgtgcgatgaacgattgcaccacaattcccgctgccgcaatacctgtgaaccagatcgcaccgaattgtcctaacgggataaaaatccagctcgtgagcatcggcgccagcgattggcccgcattgccaccaacttgaaaaatggattgtgccaatccccgacgcggcccggccgccatatgggatacgcgcgagccttcagggtgaaaggcagccgagcccagacccacaaaaatgactgcgatcagcaccgctttataatcggcagcataggcgagcaacagcatgccagtcagcgtaaagcccatgccgatgggaaggatagcgggcgtaggccgtttgtctgaaaacaagccaatcacgggctgcatgattgaagctgtaaaattgatcgcgaatgaaatccagccgatctgcgtgtagttcaggctcatagattcctttaagatcggaaagatcgctggaatgaccgattgaatcgagtcattgaacagatggacgaaactgatcgcaatcagtatcgcaaaaacggtgcctttcgcttgtggacccgggagggggagcgatcggcccgtttcagtttttgtagcagatttactagtcatggcaacctccgaatatgtatgtatattttaagatataggaagcgatccgtttgcagcaaatggctgaaagtgggataaagccccactttactcattgctgcttgcccattctgctggatactctttattgcacgatcctttaattcacgatagattatcttgctctgagtgcattatatctattataaggtatcctttacttctcattttactcgctaatatgcatgaatgagttcaactcatcttcaggaattattagatttccacagtagaccatgttggaatgaaattcccacgatccatatgctaccaagtgattcgcatctttcaatctttggattagtgcccaaataccaagattactttgtgcgtttgcatccaggaaaatccaatccttatgttgaaatagttgaggctcttcaaacatatgaaatgaatccaaatagcctgctccatcacgcggtggaattttattacatacgtcttttaataacagaacttccttcactctgacattgatccaagctcttttttcatttttggatatgatgtcttcaaatctacatttaataaatgcagagaagttgatctcatcaggctgttcttcccaaccattaaaatgtgaataagcaggtctgaataaagtccaaaaagtttctccaacggacatatgaaaaggaaaatatacttgtactttttttaaatcaccttttaccggaggtatcaatgctctttcccatatttcactatttagatctggagtatcatgtttgaaatccgcccagtccatagcatcttcgatggctacaatctcaaaatctttattttctaacaggggtttatctggtatctgtttgcacgctctacacttgaaagcaatagtttcctcgctcataagacaacctaccttaattaaattttatggttcactgctccaactatattgatcataaggacacatcaacatggtgaaagtattacaaacacaataaaactatttctatgttaaatgttgttgagattccttttacatataaataagtaagtagaatttaacaaaactaagctcttgatttaacaaacttaagatatgattctttatgtcatacatcttgttatttagataatagctccgtagagaaagtatgaagagcacaagagaagagaggatctgatttgagaatgaaatcgctaaggaaaccattatcagttgcactactatctttaccattacttctaggttccctgggtggaagttatgcaagtgcggcaaccctaccaacaacggtaactccaacagaaccgtcatggggatatttcgtagatcattataaaaataatagttctgcaaataagacggaaagctctaatccgactctcggattgctctccgaatttaataagctttggactcccggtgctacttgggatacaggtaccaagctaaacagcagcgtgctggacgccaatattcaaaaggtaattgatatagctgcccgtcgcacttccagtgaggctgatgcagcttatttggatgatcgcagaaaccagagctacagtgtgatcgacgggctgggttcgctcactgatgtatatcgaaagaatgcaggtgccacgacaacgatcaacgatattccggcagatgctctgactaagaaatacgaagatgagggaacgaatgctgggagtacaagctccaatctcggcaatatcgtaaatctggtaaataccttgcgcggggaatactctacgacgaacccggctaagtcttattttagctatcctcgcccgtttcgctggagcgataactcagtggttgttccgagccttattcccgctctcaaagctgatgctactagcgatggcggctttcctagcggtcataccaatgctgcgtatctcagttctattgctatggcctatgccgtgccggagcgttatcaggaactgctgacgcgagcttcggagctgggcaataaccgtgttgttgctggtatgcattccccgcttgatgttatgggaggacgtgtcatggcaacagcgatggctgctgctatcctgtctgatccagccaatagcagtttgaagaaagcggcttatcaggatgctcgcaaacaactgctgtcccaaaaaggttcagctccagatcggttcagcaattatgtcacaaacaaaaaaaattataatcaacgattaacatacggattcagtcaggttaatccaactacgacaccaatgacagtgcctaagggagctgaggtattgttggagacacgcttgccttacctggatagcacacaacgtcgttgggttttggctactacagggattccttccgggtatcctgtacttgatgatgctgagggatggggacgattgaacctgttttcagctacggatggctacggcgctttcgccaataatgtgacggtgaatatggatgcttccaaaggcggtttcaatgcattggatcgctggcgcaataatatctctggtgttggaaagctgactaaaaagggaacaggtacgttgaagctaatgggcaacaatacgtattccgggggtacacagatcgaccaaggtactttggagggaacttcggaaacggctttcggaagtggtggaattacgaataacgggggaacttttcttaaaaatgcctctggaaagctgattattggcggaaattacagacaatctgccaagggaacacttgagcttaacctgcgcagtaaaaatgatgtgctcaaaataaaaggaacagctatactcaacggaaaattacgtctgaatttttctaacaaatatgtaccggctaatggtgctacgatcttaacttatgctaaacgaaatggcgcattttcttccattgaaacggtaggtttaccaaccaattataaagtgaaggttatctatacagctaacagtgttcatttgaaagtcactaagtaaaacataattagttcgctatataacaattgaagtgcacctttaaaatacatggggatgtattctaggggtgcactttattgtttcatcataattcaaatgcgagttgatctccaaaagcgaatatagacaggcaccagttgctatatgcatttataatcaaggatataaaaaggtcaaaatttgaccttaatgaagtaaaataatcccgctgtttgaaagcgcagtcatgatattcttaagaagcctatttgatcaaagttttaaaggattcagactaactaagaggaacagaggaaaggaagagactgatgagtcttgaaaaagaatacgttaaaattgcccaagatgtcattaaagggcttggcggagaagacaatattatttccatggcacattgtgccacacggttgaggctgattgtaaaagatagagaaattattgatgatgaatttattgagaatattgataaggccaagggcgttttctttacctctgggcaatatcaaattatttttggaaccggtactgtaaataaagtatacgatgccatggttggtcaaagcatatctgctacatcaaaggctgatttgaaagaaatggcctccacccaagatgataatcggttcaaaagaatgatccgaattttcggggatgtatttgttccaattatgcccgcattggtagctacaggattatttatgggagttagaggcttagtaactcagcctgcactgctccagttatttggacttacacctgatcatatttctgcgaatttcatattgtttacgcaaatattgaccgataccgcttttgcatttttacccgtgttggtatgttggtcggcattccgggtgtttggtggatcgccactattggggattttgattggattaatgttagtaagtccttcgttgcctacatcctgggatgtcgcccaaaaagttcaggaaccactagtgtttttcggattcattaaaattgcaggctatcagggctcggttttgcctgctttcataataggtgtcgtgggggcgatgctggagaagaagatcaggaagtcagtccccgatgcattggacttaattctaacaccgtttttgacattattaatcacactggtactgggattgttcgtgatcggtcctatttttcacgaggtggaagctttaatattaatggctgttaccgccattttgaaattaccatacggcatcggtggatttatttacggtggcatcaatcagattattgtagttaccggactgcaccatgccttaaacctgattgaaatacagatgctagtgggcggcggttggaatatggtaaacccgatcagttctgcatcaatttgcgcacaagcaggtgctgcgttggctgttggtctaaaatccaaaaatttgaaaaccaaatccattgcgtatccttctaccttgtctgcgttattgggtattacagaacccgctatctttggggtgaacattcgatatggcaaaccgttcttgatgggcttgattggcggagcggttggcggtttcttcgcacgtatatttaatgttcaagcaacaggcatgtcaatcacagccctaccgggaatgttattgtacctgaacaatcagatattcatatatatcttagtttgtgtaatcggctttgctgtggcatttgcactaacgtggatttttgggtttaaagaaaaaatagataacaaataaaatgatgtggggagaatcatggacaacaacacactgcttaagaaattggacagcctttcaatagaagagaaaataggccagctcatccaactgaccggtgatttttttgaaggggatatagacactgttgtgacaggacctttaaaaaaattagggttaaacgccggctacaatatatataacacaggctccatattgaacatcactaacccgaaaaaaattatccagttgcaaacggattatttggaaaaatcgattcataaaatcccgctactgttcatggcagatattatctatgggtatcgaaccatcttcccgattccaattgcacaagcatgtacttggaattatgagggtatagaacatgcaggttcaattgctgcccaggaatgttacgacgaaggtgtgcacgtgaccttttcccctatggtagatattgttagagatcctcgctgggggcgggtgatggaatcgccgggagaggatactttgctagcgaagaaatatgctgaaagcatggttcagggaatacagggaagaaacttggagggtgtcataccagccaataaaattgccgcttgcgtcaagcattttgccgcttatggggcacctgtggctggacgtgagtataatgccgtggacatgtcggaacatgcgctgcgagaatattatttgccagggtatcaagctgcaatcgaagcgggggcaaagcttgttatgacggcctttaataccctgaatggcgtccctgcgacaggaaacgagtggcttaaccgcgacgtgctaagacgagaaatgaattttaatggtgtgttggtctcggattacgccgctatagaagaactgatcatgcacggttatgccgaagatgaggcttccgctgcaaggctggcattgttggctggtgttgatgtggatatgaagacagcagtatacgccaatcaattggagaaagtagtatctgataacgagcatatgctggggctgctgaatgaagcggtataccgtattttaaagctgaaaaatgatttggggctgtttgaggacccgttccgcggattacaggaaactgttcagcggtcgagaaacagcattctgtcagatgaacataaaaaagccgcgctatccttggctgaagaatccgtagtcttgctgaaaaatgaaaatcaactgctgccattgtctaaacatatcaaagtagctttaatcggtccttacgcagatgaaaactccaccctgggcatgtgggccattaagggggatgaagcggataccgtcaatttgaaaatgggattattaaagcatgttgatcccgacaatctctcggtttgcaaaggggcgcacatgctccccgccaatgcgagagaagcccttggcaaatatgcggacaagctggctgctgaaacagtcgatgaggaggccctgctgcgcgaagcaatccgatatgctaacgaagcggatgtcattgtcctcgccttgggagaaagtatttatcagagcggagaagggggatcgcgaacgaacccgacgcttcctaagccgcaaatgaaactgctccatgaattaagtttactgggcaaaaagatggttctgatcgtttatagcggaagacctttgattcttactgaagttgccggaaaagttgacgccattgttcaagcctggtatccaggaacgatgggcggagaagcattggccaatatactgtatggggacgtcaatccatcggggaaattagccatgacctttccacgaagtgttggacaaattccgatatcctacaatgaattgaatacaggaagaccaaatttaaaggcaaatggttcttatcggtttgcatcccgatatattgatgaagtgaatgaacccttgtattcgtttggctatggtaaatcctatacctcatttgaatacagcctattaacaattagccaaaaagaaatgaaaaaaaatgagtcagttgatatccgtatctctgttaccaacactggaatttatgatggaaaggaaacgatccaattatatattcgcgataaatttgcaagtgttgcaagaccagtgaaagaattaaaagactttaaaaaagtttttttgcaaagtggcgagacccaaaatgttgaattttcaattcatgaagagatgcttaaattttatgatcgtgaaatgcaatacaaaagtgaacccggcgaatttgatgtttatatcgggtcaagctcgcaggaaattttgctgagttttagttttgttttgttaccggaggatgagcatgaataaaagcgacgcgtataacctgaagtatcatattacccctccttacggtttgctcaatgaccctaatggacttgtctatttcaatcatcaatatcatgtgttctatcagtggaatccaaaaggaacggaccataaaaataaatgttggggccatgttgtttccagcgatctggtgcattggcaaaggaaaagtgtcgcgctggagccatcggaatggtatgacaaagatggcatctattcgggcgggggcattgttcataatgaaaagctgtatctgttttatacaggaaatgtaatccgagatgatggagtaaaagaaagctatcaatgcgtcgcgatttcggaggatggagaggattttcaaaaaatcggccctttgtttgagcatccccaaggttatactaggcatgttcgagatccgaaagtatggagagaccaacatgggaactggtggttgattgttggtgctcagagagaagatttgactggagatacacttatctacaaatctaaaaatttgtccgaatgggaatgccaaggatcatttgttgatcatgatcatcaatttggatatatgtgggaatgcccggacgtacttcattttgcggaaagcgatgtttttgttttctctcctcagggtttacccgagagaggcgaatattataaaaatcctaatcaatcgggatatattgttggcaaattatcgaatagaggcaaattcaacggggacctttccgattttaaagagcttgatcgaggatttgatttttacgcaccacaatcattcaaagttaatgacagaaccattatgttcggatggatgagcgccatgaatgaagaagcggagagggctgtcccgaccattcaggagggctgggttcatgcgttgactcttcctagagaaatggtgttgatgaacggtgtgttgtaccagaaaccattaccggaattacaattgttaaggctggaaggcatgcattacaaagaggaaattcaaaatagtagtgagtgggtgctgccttctacacaagcggagctaattgttcatttttccttacttacagaaaactttaaaatgatcataagggatgctgtgcaaattgactatgatcaggaacaaaacagtctgacagtttggagaacaaactggttgactggcgagagagagtacagaaaagcaacgttaagtaataagcttgcagaaatgcaaatattcatagaaagttcaagcctggagatctttgtgaacgagggtgaagaagtgttttccttgcgttattttatagaagatgcagagcaacgcaacgtattgcttgaggcaggagacaatgcaggagaagttaaaatgtatcagttgcaggaatgcgtagggtaacattttttgcttgcagagttgcaagcaggctatggaaggctgttcattatcccgtttgcgggaagaactgccttcttttttattttgtccgttgaatagattctgcttgtccggacattttactatcggtatagtatgagtattagtacaagagtttatcgcttaatatagaatacagatggatcactcatggctggctgatgaggtgtggtgatgaaaaaaatatatgaacatatcgaaatagacagaaaaaaaatgattaacctttttatgttccaatccagagatacagaaagagtcattcctatgcattttcacagcaatatggagttaatctactgtacaagtggaagtctaaaggtgtggcatgaaggaaaaataactattttgatggaaaaggatgcgctattcattaacagcaatgttccgcattccacgcagagcattacggagaaccaggtcattgtgctgcaatttccagacactttctttgccaatgaacaagtaaacatccatttaaacacgcaagagaaacaagttgaagatactataatctctaaattaagaggattgtttatggatatatatgacctgcatatttccaaaagcaaatacgactacattttagagcaaagccgaattattgaactgaaatatttgcttgtcaatcattttagtcaggcaacagacattccaccggaagtattcagtgaaaagcaacgaaagataaagacaatcatggactttattaaagagcattatactgaaaatattagcctggccaaaacggcccgtatctgcggttattcggaggcttatttgtcgcgaatgtttcatgaatatacaggccagacgtttaccgaatacaagcaaattctttgtttggagaaggcgatcgatttactggattcaactaataagtcacttacagaaatttcttacgaggtcggatttccaaacgagaagtctttcagaaaagcttttagagaagttatgggtaaaacaccttatgaatataaaaaatcaagatttgatctggatgtgtaacgccacaagcgtgcacagtctctttcagtaaaaccaaggggctgccctgagtcatttgatgactttaggacaaccccttgatatttacgctatgtcagaagagttattagcttatcggttatcaaccttttccgggtacatatcatggttcatcatacggtgctccgctatctgttcatacttcgttcctggtttgccgtagttggtatacggatcgatagagatgccgccgcgtggcgtgaatttgccccatacttcaatgtagcgagggtccatcagcttaatcaagtcattcatgatgatattgacgcagtcttcatggaaatcgccgtggttacggaagctgaacaggtacagcttaagggatttgctttctaccattttaatatcgggaatgtagctgatgtagatggttgcaaaatcaggctgtcctgtaatcgggcacaggctggtgaactccgggcaattgaactttacaaaataatcccgatacggatgtttattatcaaagctttcgagaatggcgggatcataggcaaacgtgtattgtgtgccttgattgccaagtagggtaacgtcggtcatttcttcgggtgttcttccggtcatatggatgaggctccttaagtttagtttggtaaaagagagagggagttatggtgatggggaggtcgctccgcgaaggatttgagcttccgatcgctgttgaaatgggattctttctgataaaatgaaagatatagggtagaatcccatttcaaaggcgaacgctatcgcttctccagcttcaattcctccgcttcgctgccgaccgccgtcaacaccataaagtccctacccgtttacatattggttggggcagaagtgaataatactcgctcctatataaaaggagcgttgtgagaaaccccgtcctcggacgagggtttctcttgttttgtaacttggatgtcgaggatgtacttcgactatcttgtgtatcacatacagctcatacggaatatattacatataagtgttatacgccgcgtttgttgccccatacgagggtgtggagctgtgggagtactcttacgtcgtttagtcgggaatcgtccatgacacggtcgataagccattcataacgatggagtagggactccgcaatctgtccggtgttctccgtgttcacatctggattacccgtctggaggaacagcggtacgtgtggatagcgctcgtgaacggtgcgggcgtaggcaagatcggtgtcatcgaagatgacgaccttcaagctgcaagctccggtatagagccgcgcagcttcattagcgggttccttcaagcctgttgcggttgggacgttggacgtagctcggggctcaccagccatcttccggttcgacagacgggcgacgatatcatccagcacatcccagttggtcgtcatacccgagctgggcggcttcggggatagggttacctcatcgatatcgtacagccattcctgccagcgggagccttgtgtttcgacagcggtggcaatgccttggctgcgtagcaggctaatcagcgccccaagctgcggtagcagggcaggatttcctccagaaagggtcacatgcgaaaaccgttcgccaccgatggccttcagctcctgccaaatgtctgtggcactcagacgacggatctgatccttggcgctgccgtcccaggtaaaggcggagtcacaccacgagcaatggtaatcgcagcctgcggtacgaacaaacattgttttacgaccaatgaccatcccttcgccctgaacggtgggaccaaacacctccagtacgggaataggggctatttgggtcccgtgggaggctatcatgggttggtgagtagtcatggtattactcatcgagcatccactcccgtcggaactcggcgtagctggtaggtgtctcgaacaaccgtacaaactcggtacgtccaccttcgacacggttgcagtatgcatccgaggtcaaggctgactccatttgttcaaagatccagacgaccatattttccgccgttgtattcattggaggaagcgtctcattcaagtaacgatggtccagaaaaggttcaatccgctctttccagatcgttttgatgtcaccaaaatccagcgttagacccgtttcgcccggtataccgcttatgccaaaaacgacgatataggtatgaccgtgcagatttttgcatttgccttcgtagcagtgcaaatgatgtgctgcatcgaatgtaaattgtttgctgaccaatacacgtttgcggtgataacgcagctgagagtgactaatgtctgtcccgaactgctggagcttgtcgacaatacgaaaggtacctggctcacgcatgaccttcaactccttgggaggaagctccgcgcatcgcgagatattgctcgagtccagcacggcgaagtttgcaagcagggcattcgccacagccgtcgccaatgacgccgttatagcacgttagtgtacgtgttcttacaaattcaaaagctttcagctcatcggccatctgccaggtttcggccttgttcagccacatgagcggggtatgaatcacaaagggatagtccatcgaaaggttcagtgtgacgttcagcgatttgataaaagaatcccggcaatcgggatagccgctgaaatccgtctcacaaacgcctgtaatcaagtggcgcgctcctttttgcttggcgagaactcccgcgaagctcaggaacagaaggttgcgaccgtctacaaaggtgctaggcagttcgccttcctgttgtgtaatgtcaatgtcggtgcgtgtgagggcattaggggctagttgattaagcaggctcatatccagtaccgtttgtggaacacctagttcacgggcgattccagcggctacttcgatttcctgcttgtggcgttgaccgtaatcgaacgtcacggtttctacttcagcaaaatgtttttttgcccaaaataaacaggttgtgctgtcttggccgccgctgaatacgacgactgctttttcgtttgcaaacataaaaaaaacctctcgatcttcttggaatggtgcaagacacggagtcttgtcacttggaagaaggagagttcttgaaccgacttcaacaaaaaacaggccttgccccgcgaattcatttttcttgcggaggacaaagcatcgttagttttttatagagggagttcgcgaacctctcccatgcatgacgcatggattttcttcattagtatctgccacgaggacagacggctttagcattgtcattatagcatggcagggctatttgataaacactccaccaaatggaatgacttcccgtaaaaagcgcttgatcacgccatcgtcgttcatatcctgttggagccgccgatgatgttccccggcatggaatagtacggtaccctgtccggtcattttaaaatgatagttcatatgctgactggccagatggttgccgtacacggtcaactccagtttggcgttttcgggataggcaatgacgctgctcgcatccacatatatcggctctgtcggatgaagctgttcttgacataccaatccctgtgtcaaaagaccgatttgacccacaccgtcaaatttcatttttataacatcgcggctaaacaacatgtttttcatgcttagcagcttggtacgcgtttgaataccggagctgtaccagaacaggttgcgaaaatcgtataacagatcatcgcttccttcaagcttaatcatttttagactaaagccaggtggaagtgcggcaattaggcgacaagctcctgtgaaatcggcctgaatcagtttgtgtttgcgatacatgcccttaatgttcattagtttatcactacggcctgagctgggtccgcggtatgcgatgatttgctgcggatgcagaacgtgcagcttttctccttccgccagatcgagcgttacgaccgaaccgacgctttcatcatggtgttgtcctgcttgtatgtccattcagacctttcatcctttcagacagttagtatcttcccgaacgtcgacgcatcccgtaacgcagcagtcggataccgataaaataaccggccagcagaattatagctgtgatgatgagcattttatttcggtgtgaagcctgatcacgttgggtttgaagattttttaattctgtgacagtgtcagtcagcttgcggttttgctccagtaattgggcgttttgctcttgataggcttctaagctgttacgggccttctccagatcctcctgtgtttgtcggtagctttccttgagctgatacacatcaccgggcaaccgcgaaaattgctcgaagccttggtacacatcatcccaataagtagcatgtacttcgggtacacgagttatcccaaaaatagacaaaagtgctatagcagcgcagacaatgcgacggtacaaagcaaaacgacaagttggtcgtgccaagagatgttcccccttttgataaaccaagatgttagatgatatagatcattacccatatgacatggttacgtataatataacgattcggatgcagattttagaataaacggacgacaaatatgaagaaaatgttctcaaaaaaagtcgatatattagtttaagtgtaccttaaaacgggtatatcaaggaagcggcaacattccggcatttttcccagcatacgagtaaagaacgatccgcactgatcaggggcttaagttgaataaatgaactgaaatatattaaaaattgatataaaaggagattttgcaagatgaatgagagagaacaaaactataaaactttaaaaatcactgtaaatggaaagccgttatcaaaggatctcgtcgtagatagcactacttttgctcctatatctgatatttgcacaaaaacgaatgtttctttaacagaaactacaatctcataagtttaaatatagaagtagactataatatggcccggcatacgccgggctatttttgcgcattcatgtaattcgaatggtttaaaatgttatttaccaaactaggtcccccttcataaaggttcccatgtataattttcacaatcaaacatacgttccctgacaatatagtgtcagataacactgttaatttagagttacatgttcttttagggggaatttaccagtggtgaagtcaatgctcaatgtaacgtacacatgggacaaagagtctatatctgcgaatgggtccaaacaagtaaatctactgatagaatggggctatggagctatacgcaaaagaaaaggaaatctaataccgaaagcagcgggatgtgaccttcaactccagttcattccagaaaacggagtaagtttattaaaagctgaaggggtaaggctcggttttaaacgctcggaaaacggagatagcatgtttgttcactgtggtgatgtaaggcggggaaaatatagacaggctattttgacgttttctataccggctcactcgtccggaagacatacgattggaatgatggagtggagctggcgcaagccatcgcaggaaaagcgaacgctgatccggacagaccagctctacattcattttacgcatcatcttggtctgctgagcattccatccaacccgaaggtggaaaaatacataaaactgaatgagacgcctcctattgtaaaaaaggcattgcgtatgtacgagaaaggggaatatgagcaaggggcgttcatccttaccagacaagcagatgaattacttatacgtgcagcaagaagcgatgatatggactacctgcaggaagccgagttgcttctggctatacgtaataaatggagtggtacttttgtatcattcacagcgtatagttctaaagtcttttttaataaggcgatatcgctagaaaatgttcgttttactgaaaatgatactttgagataggcaattatgctagtttatttgtgtaatatagtgagtctaatttactatctttttgtaaaggagagacttccttgactgatcggttgatacgtttaatgcggattattactattgttcaggcaaatccagggatattggcaagagagcttgccgaacgttgtgaaacatcagaacgtaccatataccgagatatggaggcgctaagcgctatgcatataccgattacgaatatggggcatggcaaggggtacatttttattagcaattttgctttgtatcctctaaattggacggaagaagaggcagaggcttttactaagctgggagagattatggaaacggtaaagcctcttttaccgccagcttttgaaagtgcttatgagaaagtgatggcctctagtcagaaaaaaaagatggaccagacgagcttcgcgcaggaaatgaaaaatattgtccggctcggctcgacacttgatcgggaaaaccagccctatctgctcaggctgattgttttagcgagtcttacgcagcagacgattgaagcggaatacagctcacctcaaaatgaagatgtatccctagttcaggtggatccttattgtttggttccgcaggatcggcgattctatatgcttggtttttgtcacaagcaatccgcgatgagaacctttcggatcagtcgatttcggaacatgagaattttgccgtatacgtttcaaaaaaatacaactgaaatggaaatgttttttaaagggacctggtcggtgaccaaaggaaatcagaatatccggtttgtggtacgtttttctgccgagtctgtatatcgggtcaaagaagaggagctgttcatcaagccttttcttagggatttgccggatggaagtttgttgtttgaggtgacggtcaatcatgaccgtgaatttttggattggctcacttcctatggagctgaggctgagatcctggagcctttacggtaccgcaaacgaatgcaagaaatgctgcggacctgggggacattctatttcgataaaaaggcagggaatcaagaataacagggggagatcccccggaacgggccggggagctatccgcttaacggtccttaaacaggttggcgagattgccaaaaggactgtactgctcctgttcttcttctggtgaggagtagacgagcttcgatccacggctttcctcatcgtcagcagcattatgaactaatgtaatacgatcaaaatggtatatgaaaacctgagcggtgttcacggcatcatccagtgcccggtgttgttgaccgtcaaagtcaatgttgcacaattccagcgcctgagacaggctcaactgacggtactttccattggaactaaacagacgagaaatctgcttctgtatatcatttgtattatgaatccatccgagatctacatgatgggtacgacaatgggataccagcttctgacggtcatccgggccccatgcgcataaataataaggggaatccgtaccgagccaggctatgaattccttcacagcttcaggaaatagtggagcggcatcaatatctcgttgagtaatacccgtgaactgaacggtatctgtagagagtacaggccgattcgagggtcttacaaaactgtgaaacgtatccgcaacgtataggccatcgtctccctgaacaactttgacggcaccaatatcaatgatttcggaggaatatctggcgttacgactaacagtaaattcaagatcgtaaataatgtattgcatttcaggactcctttcacacatataactgatcccgatgggtatcgggacgaatgttctctgcccgaatgactcttctccatcatacctctcggttcacaacttgtcagcggttaaaaggtttgctttttaaaaaaaatatgcgatgtccaaataagcttggactatcgcatatctaaaaacgcactgacatacagcagcattcgaaaccactaggattccggacgctgcttttgctagctattgaattaggccggaaggtctaacttttgtcccggataaatgcggtgaggattcttcaacttattcaactgctgaagctgttgccaggtggtaccatgtttgcgggaaatgtcatacagcgtatccccggatttcacaacatatacatggttatttgtaacttgtgcagaatttgatgtctgctgtggcttggctgtttgagactttgccggcgccggttttgcgggtgctggtttcgcagccggtgtaggaacgggttgcggcttttcctgcacagctgcaggtgttgcggttgaagcagacggcccagcttgtgtggcagggacagaagttttaccgtcagccttggcttcttgaatgcgaccgtccgcttgtacttgcaggctagcggagccgaccttttgcatatagcggattaacgcctcatcaagcgagccgaacatacctgcttgtggatatttagcgaacatcgtatattggtcaccacctacggcagtaaaatcattggtggccagtgtgtatgttgcctcaggatcaagtgtttttccgccgatcaggatggaatgaacacggctgcctttggctgctgatgtgtctattttgaacgtgatacctgatacctgtgggaaacctccgcttggctctggataggaggctgtaccattttccagtgcggcctgaatgtcagagcccttcactttcagggtaacgatctggttgccgaagggcagtacagtgatgatgtctcccttggttaccgtccccgtcttgatggaagcccggatgccgccaccattcgttaaagccacgtctgctcccgaaacgtcacgcatagcatcggtgagcaagtcaccgagattggtttcacttgcacgtaccttttcgcgtgctccttccaaatccacactcgtttgcgttacaacctctttaagaataggttcctggtccttttgaatggaggcgatcaatgcagcaatctcagcgttgggctgaacatcgactgcttgagtcgaatcaatcagcttggcttgcttttgcgtaaccttaccgccgtcgacccataagtccacaacacccagatacttggtgtattcacctgcgctagcgatcaatgtaccattgtcactaaccaagcctttttccagtacggtatggctgtgtccatcgatgaaaatatcaatgccaggcacttccttaacaaccttgaggctggtgtccttactagacgcatcctgccccagatgaccaagaacaataacgacatctactttgctgcggatttcatcaacagccgctttggcctcagccgcaggatcggtgaattgaataccctcaacatttttgggattcgtcttatatgccgtttctggcgtagtcagaccgataataccgattttaacgccgtccacttctttaataacatagggttcgaacaaacgtgttccgtctgtatgtttaatattggcgctgagcacagggaactgaatctccttacttagctcaacaagatgcttccaaccataattaaactcgtggttacccggaaccatagcatcatagcgcagcttgttaatcactttcacaatgctctcaccgttaaccaaagtagcaaaggtcgttccgtgaacggtatccccgtcatccagcagcagtgtattgggattggaagcccggtactgatcaatgatacccgccagcttggcgaatcccatttccttgtcgttcgcgaccacgtgggcatgggtatcgttcgtatgtaagatggtgatgtgtttaccgctgactggagccgttgccgttcccgctgttcccacattggttgctgggtctgctgctgctgtaccgagacacccaagtaaaagcgcgacagtcgtcaggattgacgagagttttttccatgagttcatgttgttccttcaacctcccataaaatgaatgaattagagaaaccgcttacgaccacattttatcagatgattgtaaaaataacttctattttatatcaaagcattaaaattttttgatatatcggttgttaaatccatcgtctagttacctatattatagaggaagtaatcaacagcagctcacagaatgagaactaatgttctgttttatgatcaaaaaaaagggcagtctctttgggcagcccgatccggggtaaatagtgatccaacgtttcgtcagctagtggcggttttccttcactcagcaaaagcacggcaaaccgattggcctgctgttcaaattttcctggggaaaagtaggaatgctcctccataaaaaagcggctgatgcctttatgcagtcggtcatgtcccaattcatgcgcacagacgaaccgttcccattcgggtgtgaggccattgtggatgacgataaatcttctacgcagcttgtggtaatacagccctttggttgtggggcctagatcgcagtatcggatatggatacccagggctttcgcaatatcgaaggggcagttggtacggtattttcggacaagtttgtgaatgagttcgttcatacgctcacctgctatccctgatctttgcccgtttggggctctttgggctttttatgtttgttcatctgcttggcttcccagaacagacctgtcagcacgtccttgatccgttgacgatctttttcatccagcggaatgccatcgaacattaattcgtcgtcttcctccagcatttttttaaaatcccggcggtctttagaggttgcccattccggcacagtagaaggataaagttcatgtggactttgctccattgaatcatcgtctccccaatatccggcggccttcatcatttcggtataggatacgctaagcgcgtccgctattttgcggagagtggagggtttggggattccgcgcagtccattttcaatgcgagaaatttgtgaattgctaatacctgcggcatctgccaactggttgatgctccattgtttgtgctcacgctgctgctttaagtaagttccgaatgctggctgttccacaatgggggctcctttctgcaagagaatcatagatattagttttattataccattaggtaaatagtaaaagcacgtaatgtgccaaaaggcataggaaaatgaagcgaatatcctgtttttggagctatactgctttttttgacgatggatacctatcctaaataatgttatgttatactcaagatacgaacaaaaggggaacaaattgtaaacacgagcgtttttctatttcaggattttgcaaaattcgattccagtcgcttcgaagtgcaaaatcctcatttaaaaatacatcattgtcaaaaggcataagataaggagtgttgctttacatgagaaataacttacccgaattggaccgtcgcaaaacgcagaatgcattggagggtgtgtttgagaaataccgaatttataaaacgattacttttatggatcgggagagctttattactgctggctatacggatcgaccgaacggcccaacaaatgtaacaagcgatccaacggctcggacagccgtatataatgtagatgctcctgccgcccgcttggcctactgcgaaatggtggatgcggtagtgagtcgcttgaatgaacgcgaacagctgctcatccgtgaacgttatttaaaggatgacgatgtgtttgattacaaggtttacaattatgtgttagacccaccagtcagcaaggatacgtatacgaagcttcgtacgcgtgctttttacaaaatggcgcttgcgctggcggaccaaggcgttttgaatctggcaggcttgcagaagggcgcggatcgaaaactgggttaatgtaataattatccacttgttctcatttctattttaaaatcgtttcctaaaaggctttgatttcctgtaataacagggatcaaggccttttttcatgacgggaacacatgttctcaaaaaacctcccaacttcatccctagtctctgcttttatcgtccatttccccggcaacgcattcgttattagggtgtaagattatatcatcgggaatcaagacaagaggacataccgaagacacacacagtcaaacgttagccggccattagggccggttttttcatgcggtgattgtctctgtcggttcccgggattcgttgaatagaaaggaggagtcgtgttgcctaagcaagggatgctgcaatgcatgagtacgaggttacgccggctgagaacacggaagtggaaaaaagcctggctgaacagccacaacatgcgaacgcagggtacgcaaaggtggcatgccgcaggatgagacaagcctttaagcaaaagctcattgaaattattccagcgctgcaagggcgtgtatacgatgttcagccaccgtcgcagacggcagaggagccgtatgctgttatggcgctgggcgaggaaatctggaagtcttcctgggccggctatcggcaggttattcgcatcaagctgtacgcaggacaagccggactggcgcaggctgatgtatgggcaaatgccctgattgccggactgcaccgggaaccagtgacaggtgcaggtgaggacacatcggcttttaccgcgcactatttgggcgtgcgagatgcagaaaagctggacactgttacgggcaaggcctatagaacgctgcgttttggcgtgtatgtgcctgagacggaaggtggttcagccgctccagcaaacagtgctgcacagccggaagagtggctggccgcgctggtccgctggacgcagaagcaactgggcgaaacgtggtcggtatacgccgacgcatggcccgcacagccggggcggcaagcggtactatggcggatgagcggctgcgaaactaggatggcgggagcctccatgtatgagctgcgcaaacggttcatcgggcatattaccgccccggacaccaccgaggaaaaccgtgcagcttccgcactgatcgagggctttgccgctcaaatccagcttcctctggatcaggacaagggccgttatatgtctacagctgaagcttcagccgatttgcaggcagatgccattttagatggtcagcttcggctgatgctggtacagcggcgtatgcgcccagctgaggaagcggcgttgattcgcagagtggaaattcatcctattttgaaatgaggtggtccgagtgaccttggaaaaccatgagaaggccccggtacattccgggcaggaagcaagtggcccccgctatacgctggaggagctaaaggagcacgcagaacaattgttttccgtgaaagaagaagtgctggcaggcgccttttttggcacacaggacaagctgtttacagtagcagaagcacaaactaaaatcgaacaatttatgaaagcgaaggtggactaattatggcaggcggaacatgggaaaacacgaataaaccggtattaccgggtttgtatatgaattttcaggcagcagcagcttcagcgattcaaggtgggtcgcgtggtacagtcgttgtacccgttaaggcgaattggggccctgtacgtgagtttgtagagatcggcagtgaaacggcaatcagccaaatcttttcaggtgacagtctggacggggcgaccgcgtattcaacgctgtatctggctttgctgggcggtccgaaaaagctgttagcctaccgtttggcagatgatacagctgctgaagcatctgtgacgctgaaaagcggcggtgagaccccagcggatgtgctgcgcctgaaggctttgtatacaggtagccgcggtaatggttttgctgtaactgtacagccaactttgggtgatgagcaagcacgtgaggtgcgcctttatgaaggaaccaagctgctcggtacgtacaaaggcagtgacggtacggctgcctccattgccaaggccatgaacgagaacagcgaaaacgtatgggtgaaggctgaggttgtcggcgacggcggcattccggtggatgtcagcggcgtacacctcactggcggcaacagcggcaatagcaagctggttaatgcagattacatcgcgatgcaggaggcacttgaaggacaggaatttaatgtcttggccctggattatgcagctgatctggcattgctgcaaagctttgctgcctggatcaagcgtgtccgcaacgaaggtaaaggcgtaatcgctgtattcggcggttctgcggcagatgatgtgtccaaaacagccgtcagcgtggcctctgcacgttccctggcactgaaccatgaaggcatcgtgaacgtcggtacaggcgtacgtctggcaggtacggactacagttctgcccaaacggctgcttatgtagccggactgatcgcaggccaacgtctgaatcaatcggcaacatatgcggttacgccatttgaggatgtaacccgccgctggacacgttccgagcaggagcaggctgtccgtaatggtgtcttcctgctgttcttcgacggccgtcaggtcaaagcgctgcgtggcatcaacagcttggtaaacccgtctgccggacaaaacaacgcatggaagaaaatccgttccatccgcgttatggacgctattaacgctgacttgcagcgtgcagccgaagagacatacattggcaaaatcaacaacacggtggaaggtcgtctggcgcttatcggtgcaatcaaagaatacctggcacagctgtcgctgagcaacgtcatcgaagcagacggctacgatgtcattctcgacccggcttactacggcgatgcaccagtcatcaaaccggagccggatcaagtgttcctgcaatggaacgtgaagctcaccgacgtgatggagcagctgttcggcacattttacgtgcaataaataagcattttacgtgtataagcatttcgcaggcaatcagtagaaatgaagtagcttgttaacaacgaggattttatgaaatcccgaactatattatggattattttgaggaggaaaaagaaatgttggatgcttcaagagtcattttaggtacgtatggtcaggcgcatgtggacggggtgtggcagacgaatatcaataaactggaagccagcgtggaaatggaaaaacgcgagttgaatctcgtgggaaacgagtggaaggtgcacaagcgcggtatcaaaaaagggacgggaacgatgagtggctacaaggtcacatccgatatgattcgtcgcggttttaaccgttttgagattattacaaaattggatgatccagaagcctttggacatgaaagtattcgtctcattcgttgcactcctgacaaaattcaactggccaactggacagcaggtgaagaagtacaggaagaaacgaccttcacctttgaaggctatgagctgctagatccgattgtagcaaactaaattggaagacgggggatgggatgctgtgaggcgttccgttccccaaacacaaataaacaataagggagaatgatttatgagcttgaatgagaatatgacagaagaacaaattttggacagtctgtttgaggccgctgaaaaactaccggaggaaacggttcgtatcaagcgccttgatatgaaaattgtgctgcacggcctgacctccagcaaggtggacagcattcgtgagcgctgcacgattcgccgaaccgtgaagggtgcagtggatgagaaggtagatactgaaacgttcaacgccttgttgatttcggaagctaccggcaagctggaagtgaaaggcttgtcccttaatggttggggcgatccccggattacaagccgcttgaagctgtccggtggcgaacagtctgtccgccgtatgctgctggcgggtgaactggatgcagtgggggataaggtgctggaactgtccggttttggcgttgagattgctgacctaaaaaactaatcggctccgggggaatgacgacgatgctgtaccacttgtgggtccggcaccacctccgccccggagacttttggcggcttcctcgcggtgagcgcatgctgctgctggcgtttgccgaacaggaaatggatagcatagcagcttcaaaagcataaacaaggaggtgaacatgatagatggcagaagcattaaattaccgcatgaaccttgtgattgatcctaaaaacgtcattaaggcgaacagagaattgcgcgcaatggaacgctattttgagcggattcaaggacgtgtgttgaaaatcggccgcactcgcatggccccggaaattgtgctgaacgatatggcctccaaaggcttggataatctgttgaacaagattaaccgggtcaaatcccagattattaacgcttcggggaatgtgaatgtgaaggtgaatagcggcactgctaaagcaggtccggttaagtctgataacaacctgagtacggttttgaaagcaaatactactgctgtagaggccaatacggctgctattgcggatttgagtactaagctaggctctctgaaactcggtggtgagacgaaagaagaagagcctaagggttttttggaaaatcttaaagataccctcggaggtgtcaaaaagtttggcgaaggaatgaaaggattttctgaaactggaactaagtggaaagcgttgaaacaagaatggtctaatgccggaccagttacgggaaatacaagaagacaaaaattggctaatggagtgaagaaaatatggaataataaaggtagtttaggtaaagccgctggtgaacttatagaaagtgtcggcggtactggagatatgctggaaggcggaatggatttttttaaaggcggcggtggaataattgggaatattaaaagcggtggcagtactgctatagatgcagtttctagcgcggcttctagcattataaacccaagcactgctggtgcagctgaggaagccggatcaggcttattcaagaaccttctaaaaggtggagcgaaaaaactgttgggacctttaagctatggaatggatattgtgaacatcgcgaaggctacctctggtaaagaacgtgcagaagctatcggttccacagttggtgggactgctggttctgcattaggcggagctataggttcatttttgcttccgggtattggtactgtggttggttctacacttgggggtatggcgggagattttgttggtgggaaaattggtggattagtctcagattatggtccagccatgatagacaaagcgaagtccgctggtaaattccttggagaaaaagcttcccaggttacaggctggctttcggataaggctggagacttcggtaaaggcttttctgatttcttttcttttggtaaaaaagatgaacctaagaaagagccagctaagccgcctgaagtacctaaaccagcaacctctaaaccagcaatcccacctcattcgaatttaggtaagtcatttgagcccttaacgcctatggctataaattatagtgctagtgcagttgcaaacgtacctccgcaaccaggtgcaaaaggtgttcctaatccttacggaccgatggctatagttaaccagggagtcaatccaaacccactactgaatactgcggctcatgcgaacaatggagccaaagctaaaggcagaggtaatggtaatccgacacctcaagtagttcagatcagtcctgaacaaatgggaacactgtctggctttttgaaggattttaaaacggaaaccaccaaccaattcaatcttcctgcgggggctgtacaggtcactgtacatgagaacaagctagatgtggatgggcttattacgcaaattggctaccgtctcaaagctgaaattctgcgtgcaacgcagaataccaagccagcaggcgctggagctatgtaatggagtagatggtagcaacggggaaggaggaaagagatggaatttagtttgacagatggtaaagggaaaaaatttcagtttccggtgaaccctgaggaagtgacgatctcacggcaaaagggatttgatacaacgacaattttatcctatggggagtttgacttcccacaaggggagaaggtgaaggaaatctccttctcttctttttttccgaaagaatacaatccagcgtattgcacatacaaagatatccctgatccgcaggaggccatgaacacgttgaatggctttttgttatccaagaacccgctacgttttattattacggagacagccgtgaatgtgccagtaattgtggcatctcataattcgatctttcgcggcggcgagtatggggatgtgaattttgatctgtcactgcggacctggagtgatatgaaagttgccaaaaaagctggcgtcacgggaagtaaggcggctgcagtcaacaaaaagcctcgcacagatatgaaagaaaagaaaaaaacatatacggttaaatcgggagattccttgtccaaaattgccaagctggagttgggggatagctcccaatggagtcgcatttatcagcttaataaaaaggtcattggacaaaatccgaatgcaattaaaccggggcaaaagctggtgctgtcatgagttataaagtcattttacaggataaatatgatttgtcgccgcttgtggagaacattaatttgagggattcgctggagcaaatcgcctatcaggggacggtcaatctggtcgttacgtcggatatgccgcccatttctccagggatgtcgatccgggttagcggaattccttatggtaaaaaagattatgttcccttgttgtcccctgcagtgatctgggaagtagaaacctctaacaacgggctcaaacgtatgacgctgacgttatatgaccgtacggtgtatttggacaagtcagaggatgaatatttacttcctgccaagcagacggctactcagcgttttcagaagtatgctagggactggaagctgaaaatcgcttcattgccagatacgaaaaaaacgctaggacgcgccgtataccgcacacagtccatctattctatgatgctgggagatctgcgcgaaacggcaaaggcggggggaaagctgtatcatccacggatgatttcttccggcttggagctgtacgagctgggaacgaacaaagatgtgtatgctctggagagagtcacggatacaactcaatcccgtacgctggaaggtgcggccacaagagtgaaggtactggctacggctgccagtgaatcaggcaatgaggtaccgtccaaggtgatggcgcttgaggagaaggacattgccaaatatgggacacttcaggtgatcgtacaggatgacgaagtcaagtctggtgcagcagcacgtgagttggccaaaagtaagctgagaggcatacagcaaacgatatcagtaaatgcaccggatatgaacacgatccgagcaggagacgcggtaatgttaggctccataaagttattggtcatttcggtgagcagggaattaggtaaccccggcagtatgtcgctggagctcggaacgtatgacgatgtgaaaaggaggttttaccttgaataaggacccctatgggcatttggctactgcgctgcaatcttcatttcataagcataccaagcaagcactgagtggggtaggcgcggtactaggaacgatcacctccacgggactcaagctggacgattttaaacatgagcttcaggattatctggtcgccgagctgccgggactgctatctgtaccacgacatatgtacaaaggcacctcaaccgcagtggaatcggaaaattgggaaggcaaagagctgaaaacttccttttatatcggggaagacgagctggaggatgtgaatctcagtttgaacgaagggctcaagcccggagatcgtgtacttgcggttcgggtgaatagcggtaacgatgtagttgttgtgtgcaaggtggtgagtggacgtggctaatttatttcccgaaacagatgatatgatctggacagacatggatatgaccgacccggatgtactggaggataaccgcgcagtatttgggcgaagctggcggtttgattttgaagctggagagtttgttatgagccctagccgtaaaatcgtgactacaggcgagaaagaagcctgggtacagtggtgtgaaaaagccattcgcactcctcgctaccggcatgtgatctattcacctgactatgggagcgagctggaggagctgattggcagtagctatgggcacggtgtgcaggaaagtgaaattaaacgcatggtcacggaggcgttactagcagatgcacgtacggctagtgtggatcaattcacgtttcgctgggaaggtgaggcgtgttattttagctgccagattacgaacgtgcgagatgaaacggaaattgtggaaagtgtggtgatctaatggcagacttgccggaatatttggtagaccagacggaagagggaattttaaatcggatgctggaaaaagtgccttcggacatagacaagtccgagggctcttttatttgggatgcacaggcgccagtggcttttatgctatccgaagccgcaatctgggcgcaggagctgctgcgacgtggctttgccagcaccgcagccagcgacaacctggattttcgctcgccagagctggatttgcggacagcagagcatggggtgacacggcgagaagcggttgctgcctcaggtacggtcacgttcacgggcacagcgggaacgactgtcccggcgggaacgttggtggcgaccccggcagatgatgtatccggggaagcttccattgaatatgcgaccacggcatcggtcacgatagatgaacaaggtgccggggaggcggctattcgggcggtcaatcccggtcgcagcggtaacgtacccgcgggtgtcattcaggtgatggcgagcccagtcagtggtgtttcctctgttatgaatgcggaggagactaaaagtggcacggacattgagagcgaccagctgttgctggagcgtttttatgccaaggtgcggaaccagggcacaagcggcaacaaggcgcaatatacgcagtgggcgaatgaaattgccggagtaggcggcgtggaggttgttccgctgtggaaaggaccgggtacggtggctttatatgtgctggacacggataaacgtgctgccagtccggatatcgtcgctgcggtgcaaaagtatattgatccgacccaggatgggcaaggagaagggctagcaccagcgggccctgtggtgacgatcatgccagcgacagaagtggaaattaacatctcagtcaaggtacagcgtaccaaagagaagccgtccacattggatgaaatcaaaaagctgatcgaaagcggtgtgcggaactatttgaagcagcttgctttttacaaggaagatccgttggtacgatatacccggatttctgctgtgctgctggacattccgattattattgatttctctgaactgaaaatcaatggacagagcaatcagaatattgagattggatcaggtcaggtggcagtgctggggacggtgagcgtcagtgagtaacaatggaacgaacagctttgaagatttattgaataacccagaccagggaaaacgtgcaaaccgtagtgacacttttgttaatcgagtaactatagcgggagatacattgagccaaatgagcagcgagcggggacgcgagctgctttcctatttgcctgcctattatgaaacctcacgtgtgatgcgtgccgatatggatgctaaaggaagcgaactggacgccttgtatcttgcgatggatgcaacggtgggacaatttttcgtacgtaccgccacttgggggttggaacgctgggaaatggagctggggatcgaaaccgacctggcgaagccattggaccaacggcgtgctgtggtggaatcgaagctgcgaggggcaggaaccttttccggccggcttgtcaaaaatgtagctgaagcgtacgacggaggcacggtagatgtcacttttcatcccgccgaatggggatttacggtcaaatttatcgataccattgggattccgcccaacgtggaagaccttaaagcagccatcgaggagatcaagcccgctcacatggcggtggagtacaaattacgctacctgaccattgctgaagttgagtctatgaccctctatgaaattgaacatacaacccaggatagatatttaggaggtggcgcatagcatggcaagcgaaaagacaccaaatcttggcttaaatcaaattgaccgcacatcgcccaaaaccacgtattttgacctggagaagtatttggatcaaaactggcgagctgtagacgatttcgcaggtgatgtgaatgatggtgtaaatgagatcaagaagcgtctggatacaacagagcgtaaggcggtaactctcgaacctggggtgcaaattgttcatgcggaaaaggctgccccattttcgctgacggggctgagcgggcgtacgttggtgaatttgttgggaagatgggggaatttgagtagcttaaggggggtaacaccgtatcaagctgatatagcgctagatactttgaataaagggacaatgcctaattcgttaaaagtaacgatcaagcctggatataccgttggagtggggttttatagtaattttaaatttttagctgggaaatactatgttgcaattgtaagagctaaagtaggtaacgctatagatgcaggaatctcggctccgaatgctctggtagaatcgaaagttgtagttacggataagactaactttgctacggcttggtttaggctggcacctaccagcgatattattactaacatagatttggtaacacagggtactgtaggacagtattcttattttgaggctgcgcgtatctatgagatttctgcagcagaatatgcagcattagcaacgatgaccgacgatcaaattgacaacaaatatccttatgtagatagtgtaatgcctgtacgtaatccatacgcggtccggtatggggagaatttggccccacactctttttattcttgggacactgcggtcggaacacctcttattaaagatgatcgaagtgttgttgtttcttcttcaaatataatgatatcttccatctacccattagttccgggtcaggcttacacggtttccgctcagtcgagtggaccaacgggtagaatacatgtaaatatgcaaaacgagactgcggttatcggtagtgtaacaggtagcggaattatatcttatacattcacagttccggcaggtactaaaggtgtagtgatccgcttgttgggcacatccactgccgaagtaacgatttcagactttatgttcaacatcggcagtattgccaaaccattcaagcagcatgaagactccatgctggcactgcaaacagacctatacgccgatccagttacaggggctaatgctgatacagtgtttgaatgtgatgggcaatattataaaagcaaacgttggcacagtatgacgcttgacggctcgctaccctggggttacttcgattcagccgcaggctacaaagttgtacggatacctgccactaatggaatggttgacagtgagaggataacaaagtttgacggtaagttggttcagcatgttttcccgttaagcgggccggatcaatcccaccttagcccagaatctggtgttgtgggtctgtccatttctagcgcagacagtggatggggagataactacacacctacaacagacgaaataaaggcgtattttatgggctggaagatgtatttggctggtcaaggagacgttagtaagccgtttaacaatgaggcagtagggaaggcgtggtgtccgcttgattctatctacgattcgaacgggaccgcagcaacgctgtacgtaactactttgccgacaacagcgataacatccttgtcgtacgtaagatatggaaattggtcggcataccaactcgtatacaaactcgcaacgcctacagcagagcctatcatatccgaaggacaactaacgttcgttgcgggagacaatcaggttgaagtaggtacgggaattgtgttgcgcgagcctgccgacgtatttatggagacaggaactatgttcggcaacaggatgaacataaataacgccagctttagcgcgcgcttgctcaggaacaggtctatacaaccgttgacggtatacaaagatggggtcttagacacaagatggactaagggcgtcggatggatcacgagtgcgggtacgttatcgcaacttttgaatgcatcggatagcgacagagcatcggcctacagtgtcacgtactttatggttggtctctcacccgttgtgccgttcacaggaatctacgcagccaacgaaaagacactgctgttggatttgatagactgcgtgcaaaaagcaaatttgcgcctgtctgtggtggagaacaaaaaggcggacaaggatagcccttcctggattacacccacgttgcttaatggcgttacagcagaaacatcctcagtggatatgtggcctcagtaccttaaaatgtcagataatcttattaagatgcacgggtcaataaaggtaccgacttctaatgcaaccgtcacgtgttttaggttgccggaaggatacaggcctaaaatcctaacggtattaacctgcgcagcatctgatgcggtgtccgctgacaaaactgccgtaattgcaatatcctctgacggacgtgttgaagtagtaggcagagggggctatggttggatacgtttagatgccgttcaatttatagcagaagtttaaggaggataatatatgaaagcagtacctaaagtaaatacagatggcctctatctggaggacaagctagtggacgatgccttttcgggtgtcgtccctttttatgctccatcttcactcatactatctgacacagaccagcaacaagacatctatgtgcgtactaccgataaatcgagtgccattgatgaagagaatacagaaaccagccctgctggctatacggttggtattctagttccaccgggcttatatcatcctctgtttgatattcaaggctggttgacctatgaagcagaatataacgaaactctgattgaggcacaaaagaagtacgagaaaattagtaaggaatcgcaagcttcatttcagaagttgcatgttgaatggcaaaacaagctggaaaacgaacgtggagacgaacctatatattctgctccggcttttgcgactccagaacgaagagacccgacgacattttggagtgaaggattgagtgaggaagcgattaaggaactgacacaaaaagcagagcaacagccaagtgagacagatcaattgaagcagcgtattgcagatctcgaagtaacgctgacccagctcatgcttggtaacacaggaaaataaccatgtactgactcctgtttagccgcaaaattcttatttaaaaagaggtgaggtcataactatgactgctttaacagagactcaattgcgtatttgtgcttatgcttgtgttacccgctatgaccggggagaaggtaatatagcagctatcattggatgctacgctttagatgaaaaacaacgtaaacaagtgaaggaaatgattttatcccatcgttctgatctggtattggataacgtagaggaatcgtcatctatggaggtttccagtgcacagcgagaaccggttaaatggtatagctctatttttcgtaaaaaaacggtatagagcagagagcaaaaatgcctgtactcaaaggaggagcgagcatgtatgaaagaatggatctgattataatgggtttctccaagctgaaaatgaacagacaaagcaatctttttataacgattcaatttggtcagggggtagagctggggatggtgagtatggatggatattgacgaaaaaaaagaatctgttatccgagatgtaaccgatgattttagtaaacgaatgttcagttcgcggggaccggagctattttcctatcttcctgcctattacgaagcatctcgtgttatgcatgtcgatatggaagcaaagggtagcgaactagatgctctataccttgcgctagatgatacgttagcccagttttttgttcgcaccgccacttgggggcttgaacgctgggaaatggaattgggtatcccgatccatttggaaaagccgctggaacagcggcgatctgttgtggagtcaaaacttcgtggaagcggcaaattttcaggggatttaatacggaaaatcatgagctcatttggtgtcgatggggaagtgtatttttatccggttgagtataagtttggtataagctttgaaaatagaatccctgaaaatatgattgatttcaaaaagatcatcgaggatattaagcctgctcatcttgctctttatatgaataacaaaacaaggcttgcatttcttcatgagaatgaaatggtttgtcgtattcgattacgttcgagagttcgcttttttggtgggaagccatggtatttagatggtgtcgagttactgaacggaacagcttctttgtccgggtggacagaggaacctatgcgctatttaaaccgtacaaaaatggtcatcaagcatcgaatggatcatcatcaggaaggcagaatgataattcgagaccattattggaagttagatggaagtatgaagctggacggtagtcagatgttaagctcaactgagaaagttatttcagtctaaaccaatataacttttatttaaagatagaaaggatggtaagtatggtagaacaagttttgacagttacgactgcatatgcaagggaacaaatggctcgtgcccgcgctgagggaggaacgctgacaaaagtagtaaaaatggcgtttggtagcggcggtgtggatcaagcagggaagccactgcctttggatggaacagaacaggtgttaaaaaaggaactggttcaaaaggatattacgagctttgaatttattgctcctgcaacaattcgttatacttgctcactggcagaaaatgaattggtgggtgagacgattaatgagctggctttggtagattcagcggagaagctgacggccatccgtacaatgagcaacaagatcaaagatagtgatatggagtttgtttttgaaattgaagacatctattaaggaggatgaagaagtatgagcatacaacagccacgcagatttgttactaccgaccagggacatgcagacatcctgaatggaccgattgatacgctttatgctaacgatcaggaattggccgcacaggttgaaaatatcaaaaaggacccggctgggaacggtgttgcttccaaggaagcgttggacaatcacgccagcaatacagacctccatgttacagcagccaagcaagcggtatggagtgcaggagagggaaatgccaaacaatatactagggattatgcagcacctaaggcgcatacgcatcctgcaacggatttaccatctgcttctacgcaggctagggggattgtacagctcgacacttctgtaagcagtggagctacagatcgggcagctacaccgagcgccaccaaacaggcatatgaccgggcaaatgaggcatacagccgggcagaccaagcttttacgcaagccgttgattttaaaaataaaattgtaggcgcgatcaacggcaagttcggaggcgccaatcctgacatgagcagcgatcagatagcaacagtaattactaatgcacctatagtgaaatatgccgaagggacaatagtccggaatggggataatataagtgtaaatgatggctatgatataggtctacctgccacggcttctgtatcgtatacaattccggtggcatttaccgtaagtaaaatatttgtttacttgttgggatatgcgtacttccattccggtggttggaatggcaagaccatgccgagtggaatctcactggtaacccctagttcgaatggtcgattatccaatgaggtcggtgaattcatcgtaagtataaactcaagtaatctacttacggtcacaatgaatatgagttctggcactacgacaagttcaaccggaaggtattataaattaaataacattcaatggtgggcaatcggttaaaggaattatgtgatgaaatcaacgattgacgacggctttggactttatcctcaataaaaaaagctatttagggagcaggtagttttgcagttggaatatggactctatttttaggctgtcctgacttatgaggggaagtggcatcatgaatgaacaaatctgaaaagcctttgcaaccaaatttgtacatcttatccttgctgaccgccgtactgttgaagacgccagaagcattgcatgaactcataaggcttatattaaagaagtagcgccagttatacaggtggaagaacgagcgacatcgcaaaaattactcacacgctcacacagagcgtgttttttatgcccttggacaaccaagggcattcattttacacctaggttcaaaagggggaacaaacatgcatgaaaagatcgatcagatttggctggggttttccacggggaccttgatcggttatttttttggggggtggaccacaatgttgacgttgctgtggtggatggtcgtgatcgactttttcaccggatgggcagcggcctggattaatggggagctcaaaagccgccaggggtattacggtatttttcgcaaggttaccgtgtttttgctcattacggtagctcatctaatcgacggtattctcggggatgcacattacttccgggatgccgtcgttttcttttatttagcgaacgagctgttgtccattattgaaaatgtgggcagaatgggagtgccgatgccgaatattttgcggaatgcagtagctatttttgagtccaagtcgagtggagaaaaaataaagccaaccgacccttccgacaaaaaaaataaagcttcataaagtgccgccagtggccactacaaaataggcagactacctttttgcccttttttcggtgtaaaagtggaaaagcccagaccgtatggatggtccaagcatatggataacagagacaaagtgagctacaacattatgaatgataaggagggaacgccttatgcagaatcgcagccctaacgctgccgaaggcattgacgtgtcccgatatcagggaacaattgattggaagcgtgtacgagccgatggtaaatcgtttgcatttattaaagcgagtcaaggacagcgttacgtcgatccgacatttatcacgaatgcaaaagggatcaaggcagccgggattctgctgggagcttaccattttgtagatgcaaccactgtaaatgcagcaaaagcggaagccaggcatttcgccgaggtgctggatcaggtgggtggtgcgaaagcgctggacttgccagcggtaatggattacgaaaataatccgggagggcttagctcggccgcgattcatgaggttgcgttggcatttttaacagaatttgaacgggtaagcggccgtaagccgatggtatatacagggaatgcttttgccgcccatttcaaagcgccattgggtagttataagctgtggattgcacgttatagtacacgggtgcccggcgacaccacagcatggaagaactgggacttttggcaatacagcgatagtggacgggttgatggaattcaagggccggttgacctgaatgtatacgccggaacagaggccgagctacgccaggcatttgcaggagaagagggggatgagccaatgacagcagaggaaaaagcggcatttaaggccctgcagcagcaggtcgccgctcttgaaaacagcaaagatgtgctcaagcagacgttgaatgaacaaagcgcttatattaaaaaggtagatcagcgggtagctgaactggaggcgcgtcaggctatgcctgtaccggcctgggcgaaggaagcgatggctgccgctgatgcatttaatccggcaagcccgattgtggatgcgaaactgccaagcagttacgatttttatcgcttactggtcgtactgaaccgtctggatgtgtttaaaaaaaataaatgaccttttgcaaatcatatgcccggaagggattattttcatgtgaaccaagccatacacctgaaacgtaaattgacaggcggttcaaaggcaaccgcctgcacttattgtaaagtaatgttcttcatgatttttacataagctgaactcgaacgctttaaaagtgtgaatcattgggtgaaaatgcagcatgtctaccagccggatcgagctgtaaaggctcctgtaggtttggtgctgaatacatttttggggtaagatcatactcctgcttggaggttgaagaccccaagcaggagtatttatttgatatgattgtgtaaattggtttgtaatattaattgacatgatgtataaaaacatatggtaatgtatgaaaaacccccttgtctgcttccagattttatagtaaagtatccaataatcaactttgtttgagcataatattcactgtttgtgagtatatatcacactttcaccacgacctgacatactcctctttctatttattacatcacatctattcattaccctatagcatcctcttataccactagattatgaacacttctgtcctactacacctatttgatgaactcggaatttgggaccacagcttgaggacaagcttgtcatgtcaatctaaaggaattggcattcatccggtatcaacgaattaacaatatataaggtgtgaaaggggtttgctgcatgagcaaaaagtatgcaaaacacaaaatctggaccgttctgctggtgcttgcgctaggagctgttttggcgctttccggttgtgggggatcaggtgaaggagcaaagccagaggcagggaaaacaccaagcggagcaggagagggcgtgcaggacacgctcatttatggacgcggcggagattccgtggcgctagatcctgccattgtgactgaaagcgagtcgctaaaaatcggattgcaagtgttcgacacactgctggaatataaggaaaatacaacggagatccaaccggggcttgcagagagctgggaagtatcaccggatggactggtctatacgttcaagctgcgtcagggtgtgaaattccatgacggaagtgactttaacgcagaagcggttgtgtttaactttgaccgctgggctgatccgaaaagtccatacaaatttgaaggtgactcgtttgactattatgattctatgtttggtcctgaaggaagtagggtgattaaggaggttaaagcggtagatgcgaacagcgtccagtttacactaaacaagccgcaggcgccgtttttacaaaatatcgctatgccatcctttagtatttcaagtcccaaggctattcaggagaaaaaggctgatttcaagagtaatccggtcggcacggggccttttgtatttaaggaatggaaacggaacgataccatcacgctggagaagaatccaaactattggaaagaggggcagccgaagctggctaagatcattgttcgttccatacccgacaataccgcacgatttaatgctctgcaaaacggggaaattgacctgatggaggatttgaacccagatgatgcaaagcagttagagggcaatagcgaattagtgaaaattgaacgtccctcctttaatgtggcgtacattggctttaatttaaagaaaaaaacattcaataatcccaaggtgcggcaggcactgaatcacgcagtgaacaagcaggctattattgatgcattgtttgcagggcaggctaagcctgcggtcaatccgatgccacctacgttatgggggtacaacgatagtattcaggactacgtctatgatctggataaggctaaatctttgctggcggaagcgggctttcctaacgggcttcccgagcctttaaccttctatgcaatgcccgtatctcgtccttatatgcctgacggcaaaaaggtggcagaggccattcaagccgattttgaaaaaataggcgtcaaagtaaacatccaatccccggaatgggctacgtatctggatgatcttaaggcggggaaaaaggatgatctgtacatgctgggttggaacggggacaatggcgacccggataatttcctttacacattgctggacaaggatacgattccaggcaataaccgtagtttttatgtgaatgaggaactccacaaaatattggtgaaggcgcaggttgaggtcgatcaggacaagcgtgcggaactgtataaacaagcacaagtgattattaaacaggatgccccgtggattccattggttcacagcacaccgctgatggcaggtaaagcgaatctcaagggttttgtaccttctccggcaggtatggaagcgtacggaaatatttattttgaatagcccaaacgcaagtaggcggtgaatctgatatgaactcatatattgtgaaaagactggctatattgattcctgtattactgggcatgacgctcatcgttttttccattattcatgccattccgggagatccggcggaaaccatactgggagataaggctacggaacagtccaagcaggcgctacgtgagcaattggggctgaataagccgtggttacagcaatatgggacctatttaggtgagctggcacaaggggacttgggcgattccattcgcaccaagcagccgattgcccgggaaatggtcccttatctggcggctacgctggagttgacagtagcaagcatgttttttgccgttgtagtcggaatgaatgccggcatcgtgagtgcctggaagcgaaattcctggtttgactatgtcagcatggtcattgcactggtcggagtatcgatgccgattttttggctgggcttgatggagcagtggatctttgcaaataaactgcattggcttccttccatcggacgcatgaattcccgtgatccggtggaagctgtgacacatttagccgtgattgatgcgtttataggtgggcgtatggatcaggtatggaccgtcatcaagcatttgatcctgcccagtatcgcacttggaacgattccaatggcggtcattgcgcgcattactcgttccagcatgctggaggttatggatgcggactatatccgtacggctcgggcgaaggggctggcatcttttcaagtcgtgtacaaacatgcgcttaaaaatgctgcgatccccgtacttactgtcatcggtcttcagactggatcactactgggaggcgcggtactgacagaaaccatttttgcctggcccggcatcggacggtacatttttgaagcgatcagctcgcgtgactatccggttattcaaagcggaattctgatcatagcgttcctgttcgtcatcattaatctgattgtcgatttgctgtacgcggtgctcgaccggcgtatccgttatcagtaatcaagtcgtcaattgttcaagggggagcttgtccgatgtcacaattttcaatggaacccaacaacataccgacgacacgcagcacattggcgcatttgcctgtcgtgactggcccttggagagacgcatggagggctttccgtcacaataaaatggcgttcgtcggcctgagcattattatcttctttgtcatcattgctttgatcgcgccgtggattgcaccttttgactataaagagcaaaatttggtgagccgtttgcagcctccttctgcggagcattggttcggtacggatgatctcggtcgagatttactgactcgcacgctgtatggagccagaatctcgttgtgggtcggtttcttgtctgttattggttcaatgattgtaggaacagccttaggtttaatcgcaggattttacggaaaatgggcagatatggccatttcgcggctattcgacattttactggcatttccggggattttgctggccattgctattgtagccattttagggccttcattggaaaatgcgttgtacgccattgccattgtcaatgtgccaacgtatggacggttagttcgctctaaggtgctgagtgtcaaaacggaggagtatatcacttctgctagagcgcttggagccaataatacacgaatcatcctccgctatattttgcctaacagcctgacaccaatcatcgtacagggaacgttggggatcggaacggccatcattgaagcggcagcgcttggatttctgggcttgggtgcacaacctcctgagccagagtggggtaaaatgttgtccgattcgcggcaatatatccagaacgcgccgtggacagttatctttccggggatatctatcatgctgaccgtattgggatttaacctgatgggagacggcctgcgggatgtattggacccgagggcaaagcgttagagcaaaagtggtgaggtatataaaactgagaaagaggtgttctctggcctgaagcaaatggctggggaccaccttttttatattagattttcaagttcgattcgaactgaaaaagtacaagttaaaaatatgtttactatttaatatctttcgtatatattaatatttggaaattggttttttcataaatttttcctatatagctagattaaattaacagaggagattacttcaatgagcatttcattaagaatagaacgcaaatccggtggtgaaccaatcgagtttgtaaaaggtgagatcattggttttacttataagaataatagttccataaatctttcagctaagtctccgaacttgactcattcactacatattcgaagcaaaattccgcttcattcgcttccttcagttataaacaatgcggataaatccaacatgctgtatacatgggcaaacacagaatataaacctgatagtgaggattactatcgcaaatgtaatatccaaatcgttagaaatgaaaatacaatccgagatattacgtttacacacgcttatgtagatgagtatcaagaactgattgataccagcaaagagattcttgagtttgaacttgttttaaaacaaaaagaagatcaattgggaaaaattcagtacagtcctcagttaaaacctaaggaaacaagagaaaaggatcagtctgatgtctcgcaaaaagtactggaaggcgcatatagtaagaatatgttagtgtatgcaggaaataatacttttccgtttgaaaatccgatggtagaactagaaaagacttgggtgcgaggcgtagagaaggtaaagaaatctacagatactgtaatacattatcctgatcgtaaagcatttgcatcagtagctgttcctatagctcgaaagaagtacggggacattacggccaatttacttcaacattcacttgattacaacccaggaaatttacactttaacgaatggtcatatgaggcgcagcaaattaaaaaatctaaagaacacatcgcaatagttaatgacgaagtcaaaaaagctaatgctaataaagctaaaagtttttcaaataatgaatctaagggattagaaagtgataaagatttatataatgcttttcacaagatgtattataaaataaatggaaactacgttgacgggcaatggaaaattactacaatatattatgataaatataattttgagtataattttaaacaaatgtttactgggaacaacaaacttggttgggctgcagcaaacctaacaaatttaatggaatcatggggaacattaaatgagtatacgtcttatgtaacagtaactgatacaagaaaagcttggaagtgaggtgtgaattttagatgaagcgtagatatatctttattttgatcttgatctctctactagttataattactactctaattttcctggtgaattctggggatgatacgaagtataaatacccatcaggcaaagataccgtagaatattttggtgacgggacttttcaaatttttagaggggggccggacgaccctttaatactttataatcatcttgctgatccaacggaaaatactgttgataatattgtgtcatataagataaaaaacaatatcgtatatgtggttggtgaaaatagcttcattaagctggattcaagtaccaacacatacaagcaaaagaaacggatttccgactttacttccgaagatagagaaatattcaataaattaatggaaaaatagaagttatcataagcaaaaacaagtctcgggacatagttgggacttgtttttttatttctcatcgtctgaccactggcttgacttgataggcgataatgcgctcagtccataaatctagcagattggtttccaattgaaaatctatcctctagtgggaatgaggttcattatgaattcttcctactcttacgaataggtggggatagtttgatgcttacatatataactgaaagtcatgtgagctttcatgaagcgcgaaaaaaatgtataatcactccaattgagtacgtagggagtgggctttatgacatggcaggataagagagagcatcggcaatttgcggaacagacacgaagcgacgcttcacgggccgcatatgaacgggactactcccgtttgatccattcaccgactttccggcggttgcagggtaaatcacaggtatttggcgcaggcacgggcgattattaccgcacacgactgacgcattctttggaggtagcgcaaattgcgcgtgaagcatcacgaagcttgctgcgccgccatcccgaagtagagctggaacaggcagataacgcaggactgatcattgaccctgaggtggtagaatgtgcttccattgcacatgactttgggcatccaccgttcggacacaagggagaagaggtgctggacgggattttggatcaactgattgaaacaaaggtagaaaagatatcctctgccggaggcttcacaccggagtccaagcgtggacaggaggcctatgcgcgtgagcgacgaatttatgagcattttgaagggaacgcgcacaatttccgactgattatgtttttggagaagcgtgagaacgtggatggtttgaatttgtcggacgctgtgttactggggatcaacaaatacccacacccggggattctgaacaaaaaagggttgtacctgcatgagtgggaatacatacgttctatccgcgaggattggggtatccctgatggtaaaaagacgctagaagcccagcttatggacctgtgcgacgatatcgcttattctgcgcatgatctggaggatgggattaaggctgggaaaatcgaggtgcacgagcatttcttatatgatccgtatttaattcgtctgattacggagaaaatcaccacgttagaggatagcttctggcaaggctggcaactggctcagattgagcagaaggtagcggctgtgctgagcgaatttttgaaggtgtggaatggcaagatgccgatgtgtgaacacgattattcccgtactcgccgtgaagtgaaggcatactgggtcagcctgtttgtcagcagcttgggtgtaattgatgatggaaattggaaaaaggtaaccttcgtgcgggatggaagcgaagatttggatatgctgcgcactgtgagtgtgttgaaaagctttgcttgggttacgatgatccgcgatctgcgcgtacagcgactgcaaaaacggagtgagtggatgcttagacggctgtggctggcgtttctggacccagaaacgtccaaatcgattattcccagcgactggctccagcgctatgagcgcgaccaagccaaggcgaaaccgatctggacatgggagcatatggtcatagactatattgcaggtatgaccgatgcttttgctgaaaaaatctataatgagttatacggtctgaaggtgggttccatttatgatctggattgacctttaaatttcccctatatagtagaaggaactggtttgtaatggatagcaggagggaggaatgtgtctatgcaatctcggtctttatctataaaaaggttgaatctcggtgtgctcgatatggtgccgttgctgcccggtaaccgtccggagcaggcggttcaacgagctggtgaactagcgagacaggcagaagcatggggatatacacgctactggacctcggagcaccatgatatggaggggctggcttcctccagcccggaagtgctgctgtcgcatatcggggcagtgacgaagaccattaaactgggtgcgggcgctattttgctcccgcattatagtccagtcaaggtcgcggaatggtttcatctactggccgctctatatcctggcagagtcgaattgggcctggggagagcacctggtgggggacctcatgcttcgatggcactgagcggtaattttcttcaacatgtgacggagctgccacagacgatggaaactctattggctttgctggaaggtacttacgagtatgaacaggtacctgtgtttgcccggccgatgcctgaacagccgccagcagtgtggatgctaggtacaaaccgaaaaagtgccgaatatgccgcccagtattcaacaggctatgtattcggtcagtttatgagtgaacagcaaacggaagaaatgctaagcatttaccgctccagctttcagccatccaaccggatggacaagccacgtaccatggtggctgtaggagcagtatgtgccttgacgaatgaactggcgcagcaatgggctattcagatttcattgggcgacccggcaatgcgagccagctggctagtgggaacgccgtcggatattgccgaacggttacgcggcttgcagattaaatatgataatgatgagtttctgttggttacaccgattcccgattatgagcagcggcttcactcctaccgtctaatagcggaggctgtaaattctagccttgattccaaatgaaaagagatatgacatgaatgaacagaaaacgaatatcgaagaaatgaaaccaagctacatatatacctatgcgtgtcatgaaacagagcgtgagttgtgtcttttggaattgaaatgcttgttcggtcagccgcccgtgcaggactccatcctgttgtcccatcggcggctggagccggggaccagcccgtttattcatcttcggctggatgtaatgacagatgcgggaacgctggaagagctatgcgaagcaacctctatgttacaaattgaggaaggaaagactttcaaggtgttgtgccttaaagaaggtgaccaagaggccgactatgacgagcggcgcgggatcgaacgccgaattggtgcacgcattcatggccaggcgcaaatgaagacaccggatatcacccttggtgttattcggataggagaacggtggctactgggcacgtgtcagtatagcgacagatcgtggcaggagcgtcgtcagaagccgcaaaattattctactggactacccgttctggtagctagggcacttgtgaatttggcagcaactgatctaacagccgcaaagggagagtcaggctcattgaaactgctagacccgtgttgtggtatgggcaatgtaatgattgaggcattgagcatggggaaggatattcgcggttgtgatatcaacccgttggcggtgcgtggggcacgagtgaatttgcgtcattttggatatgaagaagatctagtgaagctcggggatatgaatatgctcgaaggcacatacgatacggccatattggatatgccctataacctgtgctccgtgctcccggcggatgaacaaaagaagatgctgcgcagtctgagacgcttggcctcgcgggcagtggtcgtgagcacggagccgatggaaacattgttatctgagtcaggctggacccttacggagcaatgccgcatacataagacaggtatgagtcgggaaatctggatctgtaagtagtgtattaatactgagttttgtagttaaccaaattcagcggtaactcctgatcagcggcataggcattcaaattagtaagaaaaatatccaccgcccgttcggcatatttgtccgtatcgcctgcaatatgcggtgtgatcaagacatggtccagactccatagcggatgtgaagcaggtagcggttcttcctcgaatacatccagtccggcaaaggcaatatgctttttctccaaagagcgtacgagcgcatccgtatgaacggtgctaccgcggcctacattaatgaagaaggcacccttacgcatagctgcaaatgctttttcgtcaaagaagtgatgggtttcctcggtgaatggcaatatatttaccacgatatccgctgctcccaatgcttcgtgtagttgttcgttagtatacatgtgctctacatggggagcttccttgccagaacggcgaactccgatcacccgcatgccaaaggcttctgcaatccgcgctgtttcccggccaatttcgccaacgcctgtaatcaacagcgttttaccacgtaattccgtcagttggcctttcggtggctgccatgttttctgacgttgcaagagagctgcttgctgtaaataacgtgtatgcgatagcaacattccaaagatctgctctgtaattggaattgcatgcacaccacttgtattcgttagtaaaatgttacgcttctccaattcggtaagcggtagcttatcaatcccagccgaccaggtttgtatccatttcagcttgctgtctggatgtaatgcctcttcggcaatatgcttggaccagcctagaataacctcggcctcccggatttgtctagactccaatgactgagctttgccaataatcaactcgtagcccggagccgttgcacgaacttgttttttttgctcttccgtaagttgatgtaagcttaaaatgtttcccatagttcatagcctcctcgatttttgattccttggagtttccaatatattctggcgaaccatcctttcaagaataacagattgccgaaaaaattgcataaggagggtaaaaaaacgctcgcagtgtcacaatatataacaacaaatggctttaccctgatcagggacaaaccaaacagctactttttgagatatccacaattatctattaggaaaggaggtaataggttgatgaaaaatgaatcgcaaagactttttacagctattgctcttccgaatgagcataagaagaagttacattattgggtagagcaggatttaaaagacctgacttttcgcaaatggagtgatttcagagattatcacgtgacacttcagtttttgggtgatgtggagacctcggttataccgaaacttgagcaggttttagttcaagctgcagctgagcatgaccccttcacactcagcatcggagaagcaggtttttttggccgtgaagaatttccgcgtgtactgtggaggggagtgaccgggcagcgtgattcactggatcaactgtaccagtccatactccaggctaccgaaccgctgggttttaaacccgaggagcgaccttatcgacctcatatcaccctagcacgttcgtacacaggaaagcatgctattccaccgtctatttggcagccaaatgaccgatgcagcgagccatggaaagtgggagaatttgttttatatacaacccgaatgggtcaaaaaccaatgtaccatataattcaaacattcccattaatgaggtgaatgccttgatctatcagcgaatttagtgatatagtgtttcagcgttattcaaaaagcgcattttaggttacatatctgaggaatgtgcttatagttaacgggaggaacattatggaaatcgttaaagaacatcgttggtttgcacctctattgagtgtgctgcttgtttgtatattggggataggcctctacgctgaggttcagcaaacacagaaaaatcataaaaatacacctatgcaatctctgagctggtcagggaactcttcgtctcctacatatggcgacaggatggggacccataacgggtcaaacaggacaagccccatctttgtcgctgctcatgggcagtcaagctggaaagaaatcatgccgactccgttacccgcttcccagatgaagcaggcggaacaagcccggaataacgttgctacaggcaagaaaaagcctgaggtccagcatagcaagtccgcaatcctaacccctcctacaaccatctactttacgaagacaaaaatgctcacgcaggatgacaaggcgttgtctacctggagctatcctgtctccgctaaagaactgctcctgctgcaaaaaatagtgatggcagaagcagaaggcgaaccgtacgaaggcaaagtggcagttgccaacgttgtcttaaaccggctgcggtcagccccatttcccgatacgattcaggcagtgatttatcaaaaagcgcaatttagtccggtcgcgaacgggcgtcttcgtcgtgttcagcccaaccaggacagcatccgtgcggttactgctgctttgaacggccataaagccgtgcctgataacacctgttttttcctgtcgcttacgttggcccaggaccttacggttcatcattcgcgtacgaaggtgaaaactatcggtcatcataccttctacaaataacagccctttctaaacaatagggttcagctttgtgaacgaattttagggtactggtgaagccagtatgcaaaagaggtataataggtaaaggaaagtaaccaaaataatgaaagtgacaaaggaggcgtagatgatatgaaaatcacatattatggacattcagttgtactggtagaggcagaggggaaacggattattattgatccttttttgacgggaaatcctaaagcaaccgtacaggccgaggatattcaggtggatgccgtgttgttgacacacggtcatgccgatcattttggagatgctgttgaaattgccaagcgcaatgattgtccagtaatcgcggtcgcggaactggccgaatattgttcatccttgggagccaaagctcacggtatgaatctgggtggaggtcaccactttgacggtttccatgtgaaattcacgcttgcattccacagctcatctttgacggtggacgggcaaaccatttacatgggagagccggcggggatcttattgaccatgggaggccaaacctttttccatgcaggggatactggcctgtttggcgatatgcgtctcattggcgaaactaactccatcgatgctgcggtattgcccatcggagatggttatacgatgggaccggaggatgcactgctggcagcaaaatggctgcgtgcaagccgcgtaataccggtgcattacaatacgttcccgggtattgagcaggacggagacggcttctgcgatcgtctgcacaaagaaggtattgaagggaaagcattgaagcccggcgaaagtctcgaattttaatacggatatctaatttacgggaatacacttgacggtctataaactcatcaaatctcctttgtcagccttttctgttccttagaggaataggaaaggctgttttttaaaagtgaatatttatacataaaaatgagatatttttgcattgatacgttgaagctgtaatgtaaaagatttattatcacaatcataaaaactttgaattgctaacatgataggtcaatgataaaatgatagaactaattagattcatcagtggaatcgacgtatttttcaagtcaagccattgcataattattgaaaaacatacgcattcggcggaccgtaccgccttgaatacgtcacgtgttttgtcccccattcctcgtagttgttctttgagttacctcttgtcgccactgtcttctattcggccgcctgtatttcaggccagcatgactttataacagaaaggttgcgttccatgagacagacaggtttaccacccaaacagggactatatgatccccaattcgaaaaagacgcctgcggcatgggctttgttgcccacatcaagggaaaaccatcgcacaatattgtaagtcaggctttgaccatgctcgtgaatatggagcatcggggcggtcagggaagtgaaccaaactccggtgacggagcagggatcatgattcaagttcctcatctgttttttcaagaggaagcggagcgattgggctttaaattgccaaaggccggacattatggcgtgggtatgctttttgtatccaatgatccaaaagttcgtgaggtgcatgagcagaagctaagagatatcatcgtggacgaaggtcaaaattgtttgggttttcgcgatgttccaacttatgacgaaatgctgggtaaatcggcaaaagcagctaaaccaggcgtgcgtcaggtattcatcggtcgcagtagcgatttgaaggaagagctggacttcgaacggaaactgtatgtcattcgcaaacgtgcagagcttgctattcgctataaccaagaggatgagaacggtgagtcgttctatattccaagtttgtcatgtcgcaaggttgtatacaaaggaatgctcacaaccgagcaggtaggcaaattttatttggatttgcaggatgagcgggtgacatcggcgatcgcgctggtccattcccgttttagcacgaatacgttcccgagctgggatcgtgcgcatccttatcgttttatgattcacaacggcgaaattaatactatgcgcggcaacgtgaactggatgcatgctcgccaggcgcagtttgaaagcgaagcgtttggcggagatatcaagaaggtaaaaccaatcattaacccagatggctcagatacagccatgtttgataatacactagagtttctgtatctaagcggacgttcccttcctcatgtagccatgatgatggtgccggaaccttggaacaagcatgaaaccatggacccgaagaaacgagcattttatgaatatcacagcaccatgatggagccgtgggacggacctgctgcgatggcgtttacagatggtatccaaatcggggcgattctcgaccgcaacggtctgcgtcctgcacgttactatgtgaccaaggacgatctgatcgcactgtcttcagaggcgggcgtattggatattgctcctgaaaatgtgctctataaggatcgtctccgtccgggtcgtatgctgctggttgatactcaagaaggccgtatcgtttctgacgaagagttaaaggaacgtattgcttccgaggaaccttatcagcaatggctggatgagcacttggttgatttggatgagctgccggaagcactggaacagccggagcctaaacatgaaaatgtaaatcagcttcagcttgcgtttggatatacgtttgaagaactgcgcaaaattctggagccgatggcacttacaggtgcagaaccgattggttcaatggggtacgatgccccattggcggtgctgtctgaccgtccgcaacgtttgtacaattactttaaacaaatgtttgcccaagtcacgaacccgccgattgacgccattcgtgaagagattgtaacgtcaactgcaaccacgattggaccagagcgcaatttactgcatccagaaccggaaagctgtcgtcagattcgtttggattcgccggtgttgtcgaatgaggagtttgccaaaattcgccacgtacaccgtcctggcttcaaatcgatgacgattccgatcttctttgaagcgaaggaaggcgctgagggcttacgcaaggcgctggaaggattgtttgaggcggctgaccgtgtcattgacaaaggtcataacatcctgattttgtccgaccgtggagtggatgcggaaaatgcggccattccggcgttgctagctgtttccagcctgcatcaccatctgattaagcagggtacacgcacacgtgtgagcattttgctggagtccggggagccaagggatattcaccattatgcggtgctgcttggctacggtgtgagcgcggttaatccgtatctggcttttgaaacgctggatgtcatgattcagcagggcttgttgcgcggcatctcgcacgaaaaggcagttaaaaattatattaaagcggcaacgaagggtgtcgttaaaatattgtccaaaatgggtatttccacgattcagtcgtaccgtggagcacaaatttttgaggctgtaggtctgaaacaggattttgttgaccgttatttcacctggacaccttcccgcattggcggtattggtctggaggaagtgactacggaagcgctggttcatcataatcgtgctttcactgacaaggacggcaacgacaaagtactggattcgggcggcgactatcaatggcgtaacgatggggaagagcatttgtttaacccgcaaacggtgcatttgctccagcagtcggtacgctcgggagactacgagctttacaagaagtacgccaagctggtacagggtgaatctgaacagtatttgacgatccgctccatgcttcagttaaagccttcgggtgagcctgtgccgctggaagaagtggaatccgctgcatccattatgcgtcgtttcaagacaggagccatgtcctttggctcgatcagtcaggaagcgcatgaagatatggcgattgcgatgaatcggatcggtggcaagagcaatacgggtgaaggtggggagaacccagcacgtttcataccggatgccaatggcgattctcgccgcagttcgattaagcaggtagcgtcgggccgattcggtgtaacatcgaattacttggtgaatgccgacgaaattcagatcaaaatggcgcaaggcgcgaagccgggcgaaggtggacaactgccaggacgtaaggtatacccttgggtcgctgaggtacgtggttctacgccaggagtaggtttgatttcaccaccgccgcatcacgatatttattctatcgaggatttggcagagctcatctatgatctcaaaaacgccaatccgcgtgctgacattaacgtgaaactggtgtcagaagtaggcgtaggcacgattgctacaggggtagcaaaaggtcgagctgacattattttggtcagcggttatgacggtggtacaggcgcttccccgcaaggctccatccgccatgcgggtatgccttgggagctgggcctggcggagacgcatcagacgctgatgctaaacaacctgcgcgaccgcgtggtattggagacagatggcaagatgctgtctggccgcgatttggtagtagctgccctgttgggcgcggaagaatacggcttctctacagcgccgctcgtagcgttgggctgtattatgatgcgggtatgccaaatggatacatgtccggttggtgtggctacgcagaatccggagctacgcaaaaattatatgggcgatcctgcccatgtggtgaattttatgcgtttcatcgcagaagatgtccgtgaaattatggcggaattgggcttccgtacgattcaggaaatgattggacgtacggattgtctggataccgtgaacgctgattcgcactggaagaagaagggcgtagacctgagcttgctgttgcatgttcctgagttggaagaaggtagtgtacgttaccgcgtacaacgccaaaatcacggtctggaagaaacactcgacatgcaacagctcgtaccgatggctgcggaagcgctggagaacggaacgcctgttgagggtaccttacctattacaaacgtgaatcgggcggtaggaacgattctgggcagcgaggtcacccgtaagtatggagcggcgggtctgcctgaggatacaattcgctttaactttattggatcggcaggtcagagcttcggggcatttattccgaaaggcatcacgctgagcgtggaaggcgatagcaatgactatgttggtaaagggctatctggtggtaaggttattgtgaaaaagtctcacaaagcgacctttaaggcagaagagaacattattatcggaaatacagctttgtatggagccaccagcggtgaagcttacattagcggaatcgcaggcgagcgctttgccgttcggaactccggcgcacgtattgtagttgagggcgttggtgatcatggttgcgaatatatgacgggtggacgtgtagctgtattgggtggaaccggacggaattttggagccggaatgtccggaggtattgcctatgtctatgaccctgaggggacgttcctgagccgttgtaatctggaaatggtgttgctggaaggtgtggaagatcctgcagaagcagcggatttgcgcggcttgattcaacgccatgtcacttacacgggtagtgaagcgggacaacgtattttggatgattggcagactgcgattcagcagtttgtacgagtgattccaaaggattacaagcgtatggttgaacagatccaaaaagaagaggcaactggtttgagcggagatgaagctctgttggcagcatttgaagccaatatgcgtgaattggcgcgtgccgggggttaaaatgtagactaccaaatttactaaaaaaggactcgctgaataccactgttataatcacggtggtaccagcaagtcttttttaggttactaaaatgtgattcatttccttgacaaacgtcataaattctgacattacccccaaaatgttttcctgaaacggtaaatatgttataaaaagtaccaaattttttggaatgtaaccgtttacgtaagagtttatgtcttgttatttatttttggattggttatgatttttttagagtacacaaacacaaacaaacctaatatgcccatcgtcccttcaaaacacagaatagggtgacaggatgaagttgaggaagtcagcagaagaccaaatgatttttttataccgttatgtatcactatctttaacgtcacttgtttttctgttcgaatcatctagattaatcgtgtggcagaagctattactgattggttttctatttttatccgttacagcatttacttggatttaccgtaaatacagacttcatgatatggtattgaaatgtagcattgcactagaaacagcaggaatcattttgttgttgttcccaaccggagggatggatagcccgttcaaatggtatgtgattacccccatgctggtggcttgtgctcatctgtctatgagatacagttggacactcctcctttcttatatcggcttggtgcttacattttgttatatcttttttacaccaggtcaatattttttgtgggatcttatattgcagaacatcaatttgtttctggtactgatcgcaactacgatggcaatgcaggttatcggcgtcatgaaggacgaactgaaggtggctaaagaacaagccaatgagacgatggatcatatcaagtcgatttaccacatcatggagacgaccagccacaatgaggctttaaatctcggtcaggtcatctcggactatacggtcaagctaaccaagcagagccgtgcatttttctggctggatagtcaggaggaggatgcaccggaaagcagccagacaggctggacggtagaggaggaggagcagctattcgaggagctggggaattatcgggaggaattcagggaagagcgtgaaccattttttagacatctgccagaatggggcgatttcctcatgattaccgtaccgatgacgacccgttttgtagcgacgattggcctcaagctgggcccggatcaaagtctgacaggaagacgctggctcgtgcaacaactgatattcttggctgagctgagcgctgtgttcttggagcgctatgagctggagcgtattgaaaatcagctgattgtgacgaatgagcagaaccggattgcaaatgaaatgcatgacaatgtttctcaaagtctttttggtattgtgtacgcaacgcattctctccggcaaacctggtgtcatcagccaaaggagcaggtggaggagcaaattgatctaattcagcaatcagccaaccaagcggttagagagctgaaaggggcgattcatagtttaagttcgaaaaaaagcggaggctcaacttggttagggacggtgaaaagtcatcttcatacactctccaagctgaaccatgtacaaattgattttgacattcatggtgatcattattcacttccgtatttgtaccaaaaggctttattccgcatcatttccgaagcggcggggaacgcaatccgtcatggattggccaagcggattgatgtgaagttaaaattgacgccccaagtgattagactgtctattcatgacgacggagtagggtttgagacggcgagaatggtagcaggaggtgaggcggtcagtgcaggcgggggcctgggcatgatgaatatggaatatttagctcaatcgatgggaggcgaatttgatatttcaagtcgaatcggagagggaacacagatccgattgtccattccggtaaatgcttatgaatgaggattttgcaaaatcctcgaataaaatgtgtgaacattctgcaatacaaaatctgcggtaacaatcggatacatagggattatgcaaatcctgaactgtagacaggaggccgaatcatgaaaattgtcattgtcgatgatcatcctttagtacggaaaggactcgctgcggttatatccatgcagcccaatgttcagtttgcgggagaggcccagaatcaacaggaagcacttatggtgattgaggaaacagatccggatctggtgctgctggatttgaaactagctgatgaatcggggctggatattatcaagatagcgcgcggacgcggtttcagaagcaaatttattttgctgacttcttccgcaacacgtgaagattttctaaaagcagaggaagcttccgtggacggttatgtgcttaaggaagcattgcctgaggaactaatttacgcgattcatcttgtcaacaaaggacgcaaatattatgatccggctattctcgaaaacaagctgcgtgaagatgcgggcaatctgaccgacgacctgacgccaaaggaaaaggaagtgctggtcgagctgggacaaggagcttgcaatcgtgaaattgcatcccggttatttatcagtgagttcacagtcaaaaagcatgtcagtcagatactggccaagctgcggctggcggatcgtacgcaggcagcattgtatgccaatgccatcggtctggcgaagtacgagccaacaatgatgcgctgactctataagctacgctgcactttcatgtgcgagtggaaagaaaagcctcaaaatcaccaagttttgtgattttgaggcttttttcgatttatttttccataatcgacaaagcatggtacaaaagtataccatgccgtatccgaaagtatacatttccctccccccatagtgagggagaaagtgccattcggttccatgtcgttcacagagccaattgttacaataaagtcatacttaaatatgaagagaaattgtgtaggagggaggatttttgtggagaaaaccattttggattatctagtcctgatcaaaagaagattgtggctgatcgcaatttttgtcattctctcatgtgtaacaacatactttgtgagcgacaatgtcgtgaagccagtctattccgcttcaagccaactgctggttaatcatatttccgccaagcaggggagcaacaatctgaacgacgtcaacacaagtcttaatttggtggaaagctacaagcaaattctcacttcacctaaaattatggacgctgttgtagaggctcatcctgagttcggtttgacgcagcagaagttggcagagaaactgcagattaaatcctcggataaaagtcaggttatcggtttgacgtttgaggcagggagctatccacaggccgcagcggttgtaaacgcggtaacccagaaatttgtacagacagttccgggattgatggaattgaataatgtgaaaattttaaatgaagcggaccctcaggccaatcctgacccgattaatgggaacccactcatgaatattgcgattagttttctcgtatcgctgatgattgcattgggcacgattgtgttcctggaaagcattaacggtacgctgcgctcggagaaagaagcggacgcggacatcggtattccggtaattgcatcgattccagtcattcgcaagaaggacgtcgatggagcagccggaaattccaaagaacgggtaggggagcgtaaatatgctgcgattgaatgacatgttgattacagaaagtaatccatcatcgtatatctcggaatcatttcgatccctccgtacatacatccggcagcaggtgattgggcaaaaggaccgtggcacggttctattgttgacctcgccggaaagcggagcgggtaaaacaacactgctcgccaacatcggagtttcctttgcacaagaaggcaagaaggtggctctggtggattgcaatctgcataaaccagcgctgcacgagatattcggaatggagaataccggaggtctatcggcttatttgcgcggtgggacttcttccaagtctatcgttaggcatggtggtctggagctatcggttgttcccggtggagacaccctgtacaacgcagcagatctgctcggtagcgaacgtatggctgagctactggaagaactcaaacgtgaatatgacatcattttactcgattcggctccggcgctgaattatacggatgctcgcctgattgcaggcttaacggatggtgtgattctcgttgctagacatggtcgtaccaaacgggaagatctacgtaaaacaaagcaactcatggagcaagccagtgcgacgctggttggaattgtgatgaatcaggtgaagtaagcaacaccaaaattcgatgaagcaaggagaatgagtgcgatgacgaaaagagtgaaaaaggccattattccagcagcagggttaggtacgcgcttcctccctgccacaaaagcgatgcctaaggaaatgcttccaattatcaacaagcctacgattcaatatatcgtggaagaagcgattgcttctggtattgaggacattattatcgttacgggtaaaggcaaacgtgccattgaggaccactttgacaacgcatttgagctggaatccaaactgctcgaggacggtaagctgaagcttctggaggaagtacagcgttcatcgggagtggaaattcactacattcgccaaaaagaacccaaaggtctcggacatgcggtatggtgcgcaagacgctttatcggggacgagccgtttggtgtgctgctgggcgatgatatcgtaacaggtcagaagccttgccttcgtcagctgatggatcagtatgaggaaactcaaaattcggttatcggtgtgcagcgggtaccgcaagaatttacgaaccggtacggcatcattgaaccggatcagcaggacggacgcttgtaccgagtgaataattttattgaaaaaccggctccaggcacagcgccatccgatttggccattatgggtcgctacgtgttctcgccgaaaattttcaaatatcttgatcttcaagaaaaaggagctggcggcgaaattcagttgacggatgcgatccaaaagctgaatcagagtgagcgtgtgtacgcctatgattttgaaggcacacgttatgacgtaggtgaacgtcttggatatattctaaccacacttgaatttgcacttgccagcgatgatttgaagtatccggttatggaggccatgaatgaatggttgaaaaagaccgagaaagcaaccacggcaggttgagagggggtacgtcagcatgagcatggaaaatttaccggaggacggcgaggctgtcatgtcaggtaaagcgttttacatgccatacggaaatacacaaattcaggataaaacgtcctacctggtcacaaaacgcctccttgatatgctgctgtcgttcgtgggcttgatcgtcttgcttccgctttttgtagtggtaggcgttttgattaagctcgaagacccaaagggaagcgtgtttttcaagcaaactcgggtgggcaagaatgagaagttattcgatatgtataaattccgttcaatggtgtccaatgctgaggaactgaaaaaggacttgatggagctgaatgaagtgagcggcgccatgttcaaaattaaaaacgatcctcggatcacgaaaattggcagttttctgcgcaagacgagtattgatgagattccgcagctgtggaacgtgttggtcggcgacatgactttagtcggtccgcgtccgccgttgcccagcgaggtcgaacaatattccgattatgataagcaacgcctgattgtaacaccgggatgtacgggttactggcaggtgagcgcacgtaacagtgtaggcttcgaagaaatggtgcaaatggatttgaagtatattcatgttcgcaatacgtggctcgatttgaaaatcatcatgaaaacaggcgttaaaatgctgttctccaaggatgcttactgatggatgcattcaagcgatgtcccgcagtgtccgtcgttatttgcacctataaccgggcggacctgctggagaaaacgttaatgtccctgctggaactggaagaccttgcactggctgagatcattgtggtcgataaccgatccactgatcatacagcagcgacgatcaaaaggttcaccgtcgcccatggtcagaatatccatctccgatatcattatgagcgcgaacaaggactgtctgctgctcgtaatgcaggcattacgttatcaagagcggaagtcattgcttttctcgatgatgatgcaattccgtgtgttacatggttgcaaacgattatgtcagcattcgggaacaatcctgagctgacggctatgggtgggaaaattgaccctatgtttgagacggaacgaccgggttggctgacaggcccgcttgaactgccttacacgattattgatctgggcaaagccgttcgtgaatatccgtcgggactgaatccatttggagcgaatatggcgatgcgcaaaacggcttttgccgccgttatgttcccgcttcatctaggcagaaagggagatatccttctatctggtgaagaatcgtgggttttcgagcaaattcgtaaaaatggtggaacgattatgtatcatccacacatgtctgtggaacattttgtgccggcttcacggttaacgaaagaatggatcatgaaccgctactattgtcagggcatgtctaacgctgctcaggccgtaggtctgcgcggcaacgcgatgctgatggcgaagacggcagccaaagtgttatacatcactgtggattccctgctggcgcgtagtgagggcaggaagctgttgaaccggtgcaggcttgaaagtatccgtgggacgctggatacactgcgcaaccggaaaagcgagtcagctgcggggtgaaagatggaacatgagtaactatccttggactactagaataaacaccatacagcatgtttttatttttctactgggcgctcttgctgtaggaattgcggctacctatcagccggtggtcagtattgcggcggtatgtttactgctcttgctggctgtttccatacatcatccggagcgcatcagctacgctgttttgctaagtacagcagtctcagtcgattctctgtatcagggtggcgtgttcggtattgagattttgtcattgtacaaattgggcattttggctctgctggtgccgtgcatgctcgtgtatggcatacgtctcaagttcagctatccggtctgggcattggtgatcatgctggggatcacatttggattttcagcatggctgcctttgttaacgacctcgattgccgtcaaggcgttcgtcggtttatcactccctttcttttttttactgatccagtggaaaaaggatgtggcagaaaagcatatccgactgatcagtttgttgcccattattagtgtggtcattggactgggtttgcagcttctagggctgcattcgtttacggatgtagaatttacgggtgcagtcagagtacaaggagcgaatataccgccgcatctggcaatgctctcctttctcggaattgctgtctctctaattgaggtcaagcgtaaacccaagcaagccgctttttattacactgtgttggcactgaactttctgattctgatcgccaccggtacacgtggaccgattctggcattgttattaatgtttgctgtgtatctgtttgatattgcccgtcagtacctcaaggggaaagtcaattatttgctaccgctggccggatcgtttttggttgctctgggggcggtggccctgcaatggaacaatttaaaaaaacgctccttcgaacgggagaccgatacaggcattgacctgtcgggacgctcggaggcatgggaatattttttgaacagagtacatgattacccttggtcagggagaggtcttggcgcggtaacggtcgcgaacgacgggacattattcaatggctttgttgtaccgcataacgagtatatacgcttttattttgacacgggatatatcggttgcgggctattaatgctttcattgctgatcgtgttcgctctcatttaccggtcgcttgccaagtctatcaaaccttattttgcaagcttaattgcaggctttctgatctactcgttttcagataatacgttgtcgacggttcagatgattattccattttgctggtatttgaacgcgttataccagacatctactcaaaccgattttcgcaaagagaagtgatacgatgagcagagtgaacatgttcgatgtcaactttgataattacgattttaatgatctactcgaatttatagatacttctattgaacatcagcgtcattcctacattttgacctgtaatgtcgatcatgtgatcaagcttcgcaaggatgatgaattccgcaaggtgtattcggatgccggagctgtagtggccgatgggatgcctatcatatgggcgtccaagttactgaaaaaacccctcaaacaaaaggtgtccgggtcagatttgttcactcggctgggagaggcttttgaggatcgaggctatcgtttattttttctgggtgcagctgacggtattcctgagaaggctatgctcaatctccaggaatcttatccgaacatgaatgtggtgggctgttactctccttcttatggctttgagaaaaacgaggaggagaataggcacattatccaactgcttcaagaggctcgcccggacatcgtttttgtaggtgtaggcgcacctaaacaggaaaaatggatctacagatattatgagacttaccgtgctccgatttcgattggggtgggagcgacctttgatttcctgtcgggaaatgtgaaaagagcaccggagctgatgcagaagacgggatttgaatggttctggaggttgtctcaggagcctaaacgattgtggaaaagatatttgattgaggattcccaatttctcgttctgctgtttaaggagatgttcaagcggaagcggatgaagggaggtcaggggtgagaaacatgagtcggttggcagatcagcagatttccgtttggctaggaaatcggcgtggaatcagcatgatcggcatgggattgctggcttgtatactgccactcgccatcggatttgtcagcgccaagatgaatcccaccatgagccagcagggagccatattgctggcgctcgtttttccggccttcctgctggcgatcctgcaatcgcggctactgattccttacacactggcagtgtgggcagtaggcccggaaatccgccgcattgcggattggatggagggaacatatcactcggtttccttgttgagcgtggcaccgctgctggtaagcagtatgttgattattcctgtgttgcgaggcattcatcaggcggaaaaacccttgacccgaattgctgtatttttcggcatagaattggcctacggaagtgtggtcgggttattcaaaaatggtattgtttttgcttatgatttagccaattatgtggttcctttgatcctgttgccttatcttgcgattaagcccatgaaggcgaaggagctggaccgactgctgtattcatatgccaacattgctgttcttgtggcaatttacggcattatccagtacttgacggtgcctccgtgggatgcattttggatgaatcatgtagaaatgaattccattggtgttccagaaccacttcaaatcagagtattttcttccatgaactcgcccggtccctgcgctattttcctggcgatggcacttgtacccatgctaatggaaaaacgttggcgcggcacatcgggatggatcggaatcttgctgacggtcgtttgtctcttaatcacgctggtacgttcagcctggctaattgccttcgtcatgttgctggcttacattctcagttcatcttccaagggaaagtggaaaaccttgtttcaactagctctagttggccttcttctctacatcattgttccaaaacttccaggggcagaaggtttggtggctcgcatgcagacgctgacggatattcagcaggatcattcgtacaatgaacgtttggatttactgcatacgatgcttccggcgattgctagcaatccggtcgggcaggggatcgggagtgtaggaatcggaaccaagcttgataacggcggcgatctcggcgaacttgggattatggataatggatatatcgccattttcctcaccttcggtattttcggggcattctttttcttcggtggtctgttcgttatcatcaagcgccttctcgcccgtattgccgaacgagatgccagtcagccttatatcagactggcgttggctacgtgggccggagctgtagccagtctcatatcagataatggtttccccggtatgcgcggctatctgatctggatgatgatcggaataggactatgggcaaaagatgtcatcgcggaaagaaggtaaaggctgtgcaaaacttacaagcattatccgcacctgtccggacactatggtccacagtgattcggtttgccaaaagcaaggataacagctctgcagcagtaaaaacgatgatattcagtatgctgattctcgtcgtgaatatgctgactggtgtgctaacggcacgattcctgggtcctactggacgcggggaacagacagcgatggtgaactggtcccaatttctcgccttctgcatgagcttcggtgtcccgtctgcattgatttacaatgcgaaaaggaaaccggaggaaacgggcaagctgtatggtctggccttgctgctggctaccatgttcgggggcttggcgacactcgtcggagtttttctaattccttattggctgcgctctttttcttcatcggtcatacttttcgcgcagtgctccatgatgatgtgtccgctcatagcgatttcacagatcaataatgcattgcttcaagttcgctcggaatataagcagtacaatttattccggtatctggtaccgctgagtacactgctgggtctagcgattctgatcttaaccggaaatatgaatccgtacacctcggcattggcctatttactgccaggcttgccgatttatatcggtgtcacgatacgaatgattcggctgtacaaaccaaaggtaaagaacagctggacgcaatttaaaaatctctttacctacggtatgggttcatacggaaatgatctcatggggcaggtttccacttatattgatcagattttgattgcgggtctgctcagacccgctgatctcggtttatatgcagtagcggtcagcttggccaggatggtgaatgtattttctacctcgatcattgtcgtgctgtttcccaaagcctctggtctgaataaggaagaggcggtggccataacatttcgggcatttcgagtgacatcaacggcaacctttctggctgcggcgatgctgatgctgattgctccgttcgtatttacattgttatatggtcaagagtttaaacaagcgctcacggtattccggttcttggtgcttgaggttgctatcagtggagggaccatggtgctggcacaacaatttatggcgttgggtaagcccaaactggttaccattctacagggtgtcggattggcgctcgtcattccattgctgtccatactcgtgccgagatatggattgacgggtgcagggatagcaatgctgtcttcggggattttacggttcattttcattttatgtaatgttaaattcgttctaaaaatgaagattccaagactgcttatttccaaacaagattttcaatggctccgatcaacgatgtcacactacatccggaaaaagccagttaacggttagataaagaaggaggcacccgctaatgaaccacatgtctagcgttcccgcggacaaccggatatccgtagttattatcgctcaggatgatggcactcgaatcacagccgccattaaatcctgcaagccctttgcggacgatatcgtcgtcattgacggagggagcaaggacaatacgattcaggtagctgaatccttgggctgtagggtgttttctaacccgtggccgggttatgccaagcagcgcatgtttggtgttgaaaaagcggaatttgattggatattcctgattgatacggacgaagtagtggatgcagagttgcttggagacttgttgaaagtaaaggaaacgctccacgatccggccaaagcatattccgtatttcggattggcgattttctcggcaaatggatgaataaaggcgaatatctggttcgtttgtacaatcggcgtatttatggcattacgaatagtcttgttcatgaaatgccggatgtagcctcttcccagattgtcaatctggagggcgtgttatggcactacggcttccgcagcatcagtgatcatatgacccgttttaataaatatacagatctggaagcagagacggcatttaacaaaggaagatcctttcggattaccagactgttgtggcggcctcctgcccgctttgtgcagaagtattttgtccaaggcttataccgcaagggattggcgggttttgccgtagccgttttctgggtgatgtatgagtttctcgtctgtttcaagcattatgagctaaccaagcggcgaaaaaagatagaaatcgtggatgacggacataccgagcagaaaggagaaaccagctatgtcgtacaataacggatttcgtattgcggcaacggggttgagctggccgtctttgcagccaggaggcctcaacacatatttcaaatcgatctgtgagcagcttacgctagagcgcaatacgttggatgctctaatctgtagtgacgagcagccgcaagcacccgaccgtattcggattcatacgattggcagcaagcagcaatccatctggaagcgccgggagctaatgcaaaaatatgcagcagagttgttcgacaagcaaccgatagatatattgtattcccattttgccccctatagtgtcgggccagcgctggaggcgaaaaaaagaggaatcccggtagttaccacctttcacggaccgtggacggaggaaatgaagattgaaggacagggcatcaagcattttctaaaaacgacgttggctaaatccattgaaatgaaggcctacggtctgtcggataaatttatagtgctaagcgagacttttcgggatattttgcatgagcactataaggttccactcagcaaaattcacattattcccggagcggcgaatgtagaaaggttccacccggcagaggatcggggagcagtacgagagcgcctgaatttgccgcaaaacgcgacgattgtgctaaccgttcgtcgtcttgttaatcgaatgggactgctacagttactcgaagcatggcgacgagtaaccgagcgtcatcctgatcatctgctgctgattggagggaagggccccttgatggaggaattggcttccaaggtagcggaatacaatcttcataaccatgtaaggctgctcggttatgtgtcggatgaggagcttccccagtaccaccaagcatcgaatttgttcgtcgtacctacacaggcgctggaaggtttcggtctgatcacggtggaggcaatggcttcgggactgccagtgctggcgactcctgtgggtggcaacaaggagattttaagaggattccgtcccgagcttttgttcaagggaacggatagtgaagccattgctgaagggttgctgcgtgtgctggatcatcgtgaacttctaccgaatgcaagggaatgccgggaccatgtcctgagcaggtatacatggggacatgtagcggagcaggtggaagaggtgttccgacaggtccttgatagaaaggcggcggcgaaatgatgagagtagcttatattgaccatacggcaagatggagcggcggcgaagtcgctttgtacaacatactgacgaatatcggggaacatatcgacccgctcgttattttggcagaggagggcgatttggcagatcggcttcggcagcgtgatattgatgtgcgcatcgttccattggacgattcgattcgcaatcggggacggaatgccgtgaatctaggtgcgcctgcagcagcttttcgtttgctggcttacggtagaaaacttgcgcccttgctgcgtgaggaaaaggtcgtgtgcgttcacacgaactcgctcaagtctgcactgtatggtacagtagccgccaaatcggcgaagctgcccttgatctggcatatccgtgaccacatcggtccgccgtacctgaagccgattgtggccaaagggattcggctgatgtcccgctttttgcccaatggagtgattgctaattccaagtccacgctgagtgcgttggagttacccccggacaaaaagacgcttgtcgtttattccgcttttgctaaagcaattacagcacgtgacacggctgcccatgtacgtggtgatgactcgtttaacgtcgtattggtcggcagattggcagaatggaagggacagcatattttactggaagcagcacgctcctttttaccggatcagcgcgtgaaattctggctggctggagatgcgttgttcggagaagaggaatacaagcaacgattagagtccacgatgcgcgaatacgggttggctaacgtcaatctgctgggacacgtcgatgacattcaaggcctgatgcagcgttgtgatttgctgattcatacctctattacaccggaaccattcggtcaggtcattattgaaggcatggctgcgggtctccccgtgattgcttccaatgagggtggacccaaggaaacggtggtaccccatgaaaccgggctgcttattgaaccgggtaatccggctaagctggaagaagccatccgctggatgttggagcatccacaagaacgtcagcagatgggtgagagagggatggaacgggtcaagaagcattttgtcatcgagaacacagttaaggatatagttcattactataagggtttgttggcaggagtctgaccgacattcgcgttaaaggatgattcagatgaaaatagcgatagcacacgattacttaatccaaatgggcggagcggaaagggtagtagaggtattccacgatatgtatccggaggctcctatcttcacaacggtgttcagcgacgaccgcctgtcgcgtaacttgaaggatgcggatattagagccacttggctacaaaaagtcccaggagtgaaggacaacttcaaaggagtgctgccgctgtatcccattgctatccgtgattttgattttagggatttcgacattgttttaagctccagcagtgcatttatgaaaagcatccaggtacccaaacatacgtttcacatttgttattgtcacacaccgatgcggtttgcctgggattacgatacatatatggcccggcagtccaaatccaacctgctcaaaaacatgctcaagctgtacatgaaccggttgaaaacatgggatgccaaaacttctcgcaacgtagaccagtttgtcgccaactcttcggttgttaaacgaagaattttgcactattaccaaagggattcggatgtgattttcccacctattaatacatcccgttttaaacgcgctacaaacatcggtgactactacctgatcgtatcccgattggtgtcctacaagcgcatcgatctcgcgatcgaagcattcaaacgtaacggtctcaagctgcgcattgtgggtgaaggaccggaccgtaaacgactcgagggtatggctgccccgaacattgagttcctcggcaggcttgaggatgaagaggttaacaagctgatggcagaatgccgagcgctcgtttttccgggtgaagaggacttcggtattacgcctttggaggcgaatgcggccggacggcctgtcatcgcttttcagggtgggggagcgctggatacgattgttcctcatgtgaacggcgtatttttccgcaagcatcaagtagaggatgtgctggaggccgtcgaaaaggttgagcaacatgcgtggaatgtggacgatatcattacccatgcccgcaaatttgatgaagaaaacttcaaggatcaattaaaaaagtatgtagaacaagcctatgtgaactttctaaaaggaggatgaacggaatgaagctggctgtaatcggtactggatacgttgggctcgtctcgggtgtatgttttgcgcaaaaaggtaatgaggtgatttgtgtcgatctggagcagcacaaaatcgacatgttgaaccgggcagaatctccgatttatgaaccgggtattgaagaattgatcgcgttgaatctggaagcgggccggttggagtttacctcggatttggccgatgcggtacgccgctcggatatcgtaattttggcggtaggtaccccttctctggctaacggcgaggcgaatttgtcatacattgaacaggcggccgctgatgttgggaaagccatgaacgggtataagattattatgaccaagagtactgtacctgtcggaacgaacgaaaagattaaggacgtgttggctcgtcacacgagtttgtctttcgatatcgtctccgcgccggagttcctgagagaaggctcagccatcaatgatacgctttatccggatcgcatcattattggtttggacaatacaggattgcgtgaaaccatggtcactctgcaccaggtgttcacggataaaatctatgtgacggatatccgtagtgctgaaatgatcaaatacgcgtccaatgcgtttctggcaactaaaatttcgttcattaatgaaatcgctaatatttgcgaaaaggttggcgccgatgtaacctgtgtggctgacggtatggggatggacaaacggattggctcctctttcctacaagcagggatcgggtatggtggctcttgctttccaaaagacacaaatgcgcttatccaaattgcaggtaatgtagactatgaatttaagttattgaaatcggtggtcgaggtgaataccgaccagcgctttatgattgtatccaagctgcgcgaatcgctgggtcaactgaacggtgtgtccattggcatttggggcctcgccttcaagccaaatacagatgacatccgcgaagctccagcactggaaatcgtagaaacgctcattcaggcaggcgctattgtcaaactgtatgatcccattgcgatggataaattcaaggagcgcgtggatcacccgaatattatgtggtgctcatccccacagcaagccgctgaaggtagcgacgctgtgtgcctgttgaccgattgggaagagttcaaaaaagtcgatctcgtacaactggcctccattttgcgcaagccggttctcattgacggtcgtaacgtattcgctgaggaacagatccaaggctccgggctggaatactactccgtgggtcgtccgcggatgagtgggtggaatcgggataaagtggaagtttaaaagtgacagattaaaaagtgactgtggcggtgttggaggcgctgaaggcgctgcgcgtgcagattgttcttccgattgctgttacccccggattttctggattatataaaacattcaaaggttaaaatccggggataaaggcaaacgctgacgcttcttcagaacaattctgcccgctccgctgcttttcgccgtggagtcacagtttttaaactcccaccttatggggggagtaggaagggcgtatcggagggagcggcgcggttgaagccgctccttccgatcaagtacgccattgcggttgccgaaggcaatctgggcaaggcgttacgaaacctcgattacttgaagcttgcaagcacagcgggcaagctctgagttctcgaacgtcttacaggctgaccggacttaataatgtccggtcgtgccttttgcaataaacggtatgatcggcatgatgcatttttgagtagcgcagggatggatttgaatctggagaagcggagcggtcgcctttgacttgggattcttacatataaatgtcttacacaatccaaagaatcccacggcaacagcgatcgtaagatcaaatccagcccgtagcgggctactcaactttgccccatccgatcatccaaccaatatagagaggaagtggagagttatgaagctcgtacttttgtctggtggttccggtaaaagattatggcctttgtccaacgattcccgttccaaacaatttttgaaggtactggagagcccggaggggatttcggaatccatggtacagcgggtatggagacaattgggagacaacggattatcagaatcctcgtttattgcgacagggagagcacaggtcgaaatgatccagagtcaggtcgggccgaatacgcgcatcattgttgagccggaacgcagagacacctttcctgcgattgcgctgacagcgacttatctatattccattgctggtgtttcccctgatgaaattatagctatattgcctgtagatccttatgttgaggatgctttcttcgcttccgtagcccagctggaacatacactccaggagagtgaaggcaagcttgctttaatcggggttgtcccttcctatccttcagagaaatatggttacattattccgaaaaacgatgccacccaaggtagcacaggctaccgcgaagtgagccattttcaagagaaacccgaccgggagcaggcggagcgtctgattgaacgcaatgctctatggaactgcggggtttttgcattcaaattaagttatttgctggatatcttggcatccaagggtttgccgctgaattatgaagaaatgcaaaagcaatacgcatctctggaaaaaatcagctttgactatgaagtagtcgagaaagaaaaggatatcgtagttcttccgtacgatggtttttggaaggatttgggtacctggaatacgctcacagaagaaatgtctaatcaacaagtgggcagaggtgtagtaacggaggattgcgtcaatacgagtcttattaacgagttagacattcctgtggcgatcattggaacgaatgatctgattgtagctgctagcccggatggtattcttgtgaccaataaggctgaaagtcctcgcattaaggaagtgctcaaggctcatgatcagcgtccaatgtatgaagaacgtcgttgggggcagtatcgggttgtggattatgtcaaatatgacgagggtaacgaggtattgaccaaacgaatccgcgtacggaaaggcaaaaatatcagctatcagcttcatttcaaacggagtgaaatttggaccattattagtggtgaggcggaaattattttgaatgagaagctgcacaaagtaaaagctggtgatgtagttcgcattcctgaaggaacgaagcatagcattttggctgtgaccgatgtggattttattgaggtgcagactggttctgaattggttgaagaggatattgtacgcttttgtatggattggaatgaaatttcccgtcaccaatttatctcataattgttttcgtaaaaacgaaaaaaagacgaattcatgaaaattcatagcccgaactgtcgaaattgggcgaaaacctgtaaattcatgaacatgacctattaaattttggtaaaaaaaagtcgatacttagggtaagaaggaatccaaactccttccaacgataaacgcagccctgtcgaaaggcaggtacgcaaagctaaagggccttctacaaggatggcagcctggctaccgaaaggaagagcgaaagtgagattctattttattcctctgtatcgactgatacgtcatgtactccccgttgttatgcttttttcattgttgcccgtcggttttggtgattctctgtctgtggcgaatgccgcttcattacaacctgttaattcggacgcttctactcaggcccgtgaactatacaattatttactcaacatctcagggaaaaaaatagtcaccggtcagcatgattatttggaaagtccggatgaattaagtaacaaggtccaaaaaatcagtcaggcatatgttggtctgcacggctatgagatgggtgccatctctggtcaatccgacactacagaagcagcacaacgtaaaaatgtcgtcgatagtgctatccgttggagcagatccggtggtattgtgacgatgacttttcatgaagcgctaccgggtaggccactgacttgggccaatgtacaggcgaaagtaagtcaggcagagttcaacaaatacgtgaccccaggtactacgcagtataacctcctcattgccgatctggataaggtcgctgtatcattaaagcagcttcgtgatgcaggggttccggttttgtggagaccttaccacgaaatgaatggtgactggttctggtggggaaacaaaactaattttaatcagctatggaatatcatgtacgaccgttttacaaacacacatcaattgaacaatctgctgtgggtatggagtccgaatgcgcccaattcgtataccgtcccgtataccccgaaatacccgggggatgacaaagtggacattttggcagtagacatttacaacaatgattttaagcaaagtcattacgaaggtctgctcgggctggcacggaataagccgattgctattggggagcacggtgagatgcctagttctgaggtgttgcaggctcagcctaaatgggtatactccatgacttggggcaagatgctgaccgagaataacacaacaaaccaaatacaggattatatgaatgattcgaagagtttgacacgggatgatgtgaaaaatgggctggcagcaatcgaacaacctgggacagatgtaccgaccttaccggacgagggacaaagtgagcctatcccggctccgactcctccttccgtccctgatgtggtatatgtgaacgggctgcagggcgaatattttaacaatatgaatttgaatggaagtcctgctttgatccgtacagatagcaagctggactacaactggcgcgccattgcagctgatccaaaggtgaatgccgatcagttctcggttcgctggacggggaaaatcaaaccacaatatagcgagacctatacgttcacaacgatatccgatgatggtattcgcgtatgggtagacggcaagttggtgattgacagctggttcaaacaaagctggacggagcgtaaaggcagtattactttggaagcaggcaaaatggtagatttaaaagtggaatactatgatgaaaaaggcgacgcgatggcacgtctaatgtgggaaagtcagcatgaagcgaaagcggtgattcccggaaacgctttgtttcttccttgattgatactctttcccggtctaaaaatatgaggagagagggtggatcatatgataaaaaaatggttatcccataggtatacaatcgttttatctggactattagcggtcgtagctatagcgatgatcgcttggtttatatacacgccttcaagaagcgcagaattgcagacggataaagtagcggctgccagtccagtatggaagctgggtcagagggatgactcttcagcggaattcaaaggtatggtcggtagggataatatcgacatttctacagcagctgcctctaccgaatcgtctgctaaaggagcattgtcagcgttgtcggtagcagaagagagtacaacagttccggtattgctcagcagtggagatattcctcccggtttgaatgcgtccacgaaccctgaactgacactccagtataagctgaatcagattcctcccaatggtatgatattccgtgttcggattttggatgcgggcaaagcagtcccgcaaatggctgtattttcaaatcatcagttgtccggtattattcagattgccggggtatccggtactgggagtgcttttaatttcaaaaacaactacgagttatatatacccaaagagcaattgcaaagcggtgttaacgtactcaagctaaagacagcgcgctgcctatactgctcctctgcagaagataaaaatgtgtggtggacttgggatgacttgagcttggagacgttagcttcacctgcggccgaaccggtacacggtaaatatatactgaccggaacaaatgtgaacaataaagaattttattatgatcagggtgcagttaagcatttaccatacgttctcaagtggctgggcattgcttatagtggcaacgtcatgagggtgacctgtgccagtaatgtgggcaaggcatgtacagacgtggatgattactatcaaacgttaaagcagtataatatgcaatcgtctgctttgtatttatatacaggtgatattaagctgcaaaaagatggttctctgccagagacggccaagcaaaagttgcgcgattatgtaaaaaaatacggttcttatcttcaatattatgaagtagataacgaacctggcttatttaatcgctccaaggcggtaaatctggctgtggccaagtggttgaatacagaaggcaagcaattggcaccgcatctcaaaaccgtagcaccgggctgggcctactggccaacgtactctaccaaggcgtgcaaaaatcaaaccagtggtacgcaaaaatgcggtgacccagatggatgggaacgggacccggcgcaacgtaaacagctggaggaagtcaccgacctgaccaatggacacgcctatggtgaatcgtataatgaagagggcgggggcagcttcgtccaaaatttgaaaaccttcggcggttcgagcaatggattggcgaaaaagatgctgaacacagagttcggcaccaatgatacgcatcgagacaatccagattacggggctagtcagccacaagcagccgcattcgatcggattatgcgttcgcaaatcgggtttgccgatatgtttatccagcacgctgctttttataaagattatacgctgtttaaaacaggcttcgatctgcaaagtcataacccggccaacacagaaatttatccgttcgggcaaggacaggacacccgcgttaagatcatgagacgcttgagcttagcctatgccacccatggaaaacctctgacgtatacagtgctgaatccagaggataccaaggacaagatggtctatgttcgtgcggtggatacgtccaagcttaaaccgctggcaggtagcggcgctacttcagacaaattgctggtgaatctagtgaatttcgaagctaccccgcagaccgttcgtgtacgggtaacgatgccgaaagccggtttgtacacgggtgaacgttttggagcgggttctacttacagtcaggcacagcgttccatatcagggctcaaggcttctcctgcccttgattttgaagaaaagctgggtcctggcgaagcggtacaatatattttggaattaaaaagtacagatcagaccgcagcttcagccccaacaggggtgaaggctgcttctgttcaggatggggcggtaaagattaattggcttcaggcagaaggcgtatcttcctatgatgtgctgcgtgctgacgggaccgacggggcctatcaggtgattgcctcgcaagtagcgggaagcacgtatacagaccgcacagtaaaagctggaggccactatgtctacaaagtccgggcgaccggaggcactcaggtttcccaggcagccgaggtcgcttaataacagatcggaatgtatataggacctgagttaacgaatacctaacatcatttcgaaataaaacaaaaaagaacctatcaggagaaaataggacctgaccccataacgtgagac

SEQ ID NO: 33 - DNA, 161123 bp, Unknown
  Kingdom: Bacteria, Phylum: Firmicutes, Class: Bacilli, Order: Bacillales, Family: Paenibacillaceae, Genus: Paenibacillus
accgaacgacggaccgtaagggataccggcagtatgcctctgacccagctcagtgccagcattgcccactgctagagcagtgtacccagtctcgaaaccatcgcaaagtggtaactcggcatgtctgggaagacagcaaagagtgggtacggagcaaccggctaagcccatccgggaaacggctgtaccgcaaacgaaaagagacgattgagcgaagcttcgagatgccaaagagctccatgggtttcgctattgccgtttgcgcggtcttccaaacgtcagggaacaagcccttatgacggcagccgtgcagaacatgaagaagatggcgatccacctggatcgcctgaagaaacaggggtaaccccctgtttctccagagaccagagccttttgatgtaaagaaaaagaaacccacgtctcaaaagacggggtttctcgacaatctggataccctcctatttcaggagggtatttttatcctcaccacaatagtcgaactacagccatactcacaataccgacaacgacggtagccagcaggtttttgctccacaaggcggtcactagcgtaggaaggacggctataagcacttgcccattaagagtgactgaggtttcagttcggacgagcagattttccatcacgagggctgtgaatatgcagatgggaatataggaaagccattgtagcactggcttgggaagcgtcagtctttgcagcacgacaaaaggaatgatccttgggatcgccgtgacaatcatggcaccgattatgatatacaggacattaggattaatgctcatttgtcggttaacactccaatcgttgcggtgatcatggttgctacaatgacggcgatatgtgatggcacccaccaggacaaaaggtacatcagaacagccatacatagcacaagcagcaggcgatgcttgagtttggaggtctggacactttggagctgggaaataagcagggcaaggaacatcgcaggcaaggcaaagtccagaccaaaagcctccggccgggaaatccagttcccgagaacccctcccgccacacaggatgcaatccaagcgagataagctgtaatattaagcccgttcatccagcggtcactgacctgcccgcctttagccaatttatccgacgctactccaaaggattcgtccgtcaaaagtgcgccgatgcctatgtttttccacaatgagtatttagaaaagtaaggagccagcgacgcacttaacagcagatgacgagcattcacaatgaatgtcgttaaaataatgacggatggaggactggatgcagccagcatcgagcacataataaactgagaggctccggcgtatacaagcgccgacatgaaggcaatttccatggtgctaacccctgatgaggcacccacaatgcctgccgcgaacccaatacatacataaccaagcaatgtaggaatacaatctttaaccccatgtaaaaagctgagtgaatcgggcttcgtttcgctcaactccgaagctatggacattttaaccttacccccagtgtataaatttataatagtatataacgtaagttgtgaagtatcaatatattatacgtttgtgcgttatgttgaataatgtctatagcgaacacacagggagaatgtttattttattgctttttagaacttgaccctaaggatagagatgaatatgaacagatgtagaggacaaggacgtatacctaatggaatccgcgctggtgcttcagcccggtaaggaagataaagagcttcagcgaaaaaagagtatcaacaaaattgaaacgtttccatcttagtgttattataattttcataaagagagatagggggagggagatgccgatgccaagtattaaagatgtagctagcttagctggcgtagctgtaggaactgtatcccgcgttattaacaactcgggctctgtaaaaccagatacacgcagaaaagtggaggaagctatacaagaactgaattattttcctaatgaagtcgctcgaaatttcaagatgaggaaatccaagatggtggccttgctgcttccaagtatttggcatccttttttttctgaactggcttattacattgaggatgagttggatcgggaaggctttaagctcatgttatgtaatagcggcggcaagcccgaaaaggaactgtattatctggatatgctacggcaaaacaaagtggctggtattgtcggcattacttacaatgatatagaaaatagcgtaagcaatgacattccgattgtaagtattgataggcacttcaacaaaaaaatcacctgtgtgacctccgataattatgagggagggcgtctggctttgagggagcttgttaaagtgggagcccagaaaccggcttttatgggaagcgtcacttccattttcagtgaaaccatgaatcggagaaaaggtttcattcatgaggcgcaaacattgggagtcgattatgtaatctacgagaagcccgaccctatagtggacgacgatgcctattttaacgagttcctaaatgagcatcgcgatgtggacggcatttttgctattaccgatatgttagccgccaactatatagaaagagcacgcagggagggcattcgcgttccagaggatgtaaaggttatcggctacgacgggattcaggaccatccttattttcatccgatattgtctacaatcaggcagccagtggaggagatggcacgtatgacaatcagactgctttataagaaaatcgaaggtgaaactttagatcagcaagtgtatcatctccccgttgtcttcaagcaaggcgaaactacatgattttattgtaaaaatattagctcattcggtcgattcatagtatggatctactaactgatgtttttctcacagcaaattggaaacgttttaaaagtgaaaacatcctagttcaagaaaggaggtgtaatggtgaattcaagaactagcgagtcggatcattcaggatcaagccaaatcgaaaaatatggaaccggatcaaacgcgactattccttaaacatttaaacttcaaacttttttcttttggcagaagaaagatatctcagttcttcccgatatttcgccacggttctgcgtgatagatgcaaaccttcctttcccagcagggtagtaatagcctgatccgataacggtttttgcttatcctcatcatctatcaaatttttgatacgcttttttgcactctccgatgaagcagcatctccgtccgctgacgtcaaggaggaagtaaagaaaaatttgagctcgaacaatccgcgaggcgtctgtataaatttattactgaccgccctgctgaccgtggattcgtgtaagcccgtcttatcggcaatctccttttgggtgattggtttgaggaaatacacgccatgctcaaaaaaatcctgctgcttttccacaatggccttggcaacccgtagaagggtcagccgacgttgcttcaggctattgaccagccattttgccgtattcatcttctcatggataaaacgtttggtttcactattcggtagatcctgcatcatttgccggtaaaaagggttaatctcaacccgcggcgcactaatgtcattaatcaggacaagatattccccgttggctttttcgaccgttatatctgctatgatgtattgctgctctttatgagcaaatgctgcgcccgggcatggatttagcttgcgaattcgatcggccatctgtataacctcttgcctaccgatttcaagagcatccgcaattttttgtatccgattgttcgccagatcggccagatggttgcttaccattctgactatgcattcatcatccatgccagcaagctggagctggagaagaagacattcttccaagctgtaagaggcgatccccggtggatcaaaactctgtatcaccaagagcatatcctcaatttcggctatgggaacgtccaatagtgaggcgaccgttggaacatcaagttctaaatatcccatttcgttcaaattgccaatgaggtaccgtgccaccatacgctgtgaatttgtaagcccacataccagtccaagctgcctgttcagatgttcaaacagggtatcattcggattggggacaaaatccagaaatgtaacggggtttgctcgctggaccgatggatatttttctccgccacgataatgttcaagcagatctccttgatctttctgtgaaaaccgctctgcttcttcttggatactgcctatggacatattaaactccggcaaatcaatgactggattattgttcgcctgttcatgcagaaaggatattaaatcagccgaagaatattgcaagatcgtgattgcttgtcgcaattcgggcgtcataaccagcttgaatccttgttcctgttgtaatccatatcgtatcattgacttattcaaactccttttccatacatttccggtacgaattcacagtcagtcatttatgaaagatctacttctctaagcctatgcaattctcctgcctagatgttaacgttaccgagtaattttatctgatagaaacgattcataaacaagccaaagcttgtcgtaataagtaacagttattatgtgtgttgtatttttggttatatacactatctttcttgtatactcattcattgaataacaaaatacactggagctggaggaatcatttatggaaacttataaaattgtctgcattgatattgacgggacgctgcttaactcggcgcatcaaatcacggaagcaaccaaagaaaccattctccaggttataaatgataagcagattccagtggttcttgtctctgcgcgaatgccaaaagcaattattccattgcagaagcatcttggtatttctgagcctctcatatgctacagtggggcacttgttatagataaacacgggaacaagctgaacacccgttatatagataagaaaatgacacagtgtttgcttgacagcctggctgagtatgatcttcacgtaagcctgtataaggatgatgagtggtatattgaacaattggatgcatgggcgcttcaagaacgtgacatcaccaatatcgagcctcgcatttatagtttttctaagcttaccagtggttggagggaagagactgatggaaccagtaaaattttgtgcatgggtgatcccgaagagatcagacgcgtccttcaagtattgcgacccctatacggcgaagaagtaaatctctacttatccaagcctacttatctggaaatcatgtcaaaaaaggcttccaaaaccgcagccattcaaattctgctaaaagagtaccaactgaaacaaagcgattgtctggctatgggtgacaattacaatgatatcgacatgctggcctttgcaggacttggcattgccatggaaaatgctccccttgaggtcaaagctgctgccaacaccgttactctctcgaatgacgaggatggagtagctcatgcgctgaaaaaccatattctgttccctaaataagcaggttggaatcaatttccaatgactgattcaggctggaggaatacaggtgaaaagaatagataagattttagagtatattgccgaaagcaccaagaaaatttccaaagaggctttatttgcgggggaagggattacggctgcggaaattgctgatgatcaaaagatgttgagaaacaatgtgagcaaagagttgaataatctgctgcgtgacgatctaatccttaaaatcaaaggaagaccggtcagatttctgcataagcagattatcgaggacacctttcgggttcggctgaaagagaaacaaattgaggtcaaaagcatcaaagaggtattgctgcctgacgaacaagtcgatccgttccatgccttgatcggtttcaggggcagcatgcgtaaccaggttgagcaggggaaggcagcgattctgtatcctcctagaggtctgcataccctgatagtcgggcagacgggtgttggaaaaactatgtttgccaggttgatgtaccattatggcaagtatatgaagcggttttcagagcatgcgccatttatcgtttttaactgcgctgattatttcaataacccccacttgttactttcccacatctttggtcacgttaaaggggcgtttacaggcgctgatcatgaaaaagcagggctggtggagaaagctgacggaggcatcctgtttttggatgagattcaccgtttacccccggaaggccaggaaatgattttctatttcatggatactcacacctataacaaattgggcgaaacggatcgaaaaagagatgcgagtgtgttattgattggagctacgacggaagatcccggatcatccatgctgaaaaccttcattaggcgcatacccatcacgatcaatatcccttcccttcaggaacgtgctattgaggagcaaatgctgattttgaagcatttgtttgctaacgaggtcaatagggtaaacaagccgattaggattgaaccagaggtagtaagagcactgatcggcagcgtcacctacggcaatatcggccagttaaagtcgaacatccagctggtatgcgctaaaggttttttaaacagcatacatgaaaacaaagaagaaataggacttgattttaaaaacctgccgggaaatatccgagatggtttgttcaatattgataaaacgcaatataagatgaagggaatcggatgtatttcctcgtccctatacattactccagaaggaagaaaagctttggatgaagaggttgtttccgagctgccgtttaacctttacaaactaattgaagacaagattggcatgctgaaggaagaagggctcgacgacgcctacatccacagatttattgctacggatgtcaatatccatattaaaagcttttataaccgtttttataacaccaaagggagcagggaacgaattctgaaaattgtggacaaagacatccttgaattctccgagcagattaaggaaatggccaaaaaggaactaaaccgaatttacagcgagagattcgtgtatgctttcagtcttcatttaagcgcctttttcaagcgcaccagagagagaaaatacggtgatgcccgaatctatgaaccgatgaatgaacatgatgaagagtacagactggcccagactatcaaaagtttgatcgagtctaagtttggtgtacatgtaccggaggccgaaataacttatatggcgattcttctgaaatctgttgaggaagaacgacagggtagtgtgggaattattgtggcagcacacggtaccagtacagcgagcagcatcgtcggcgtcgtagacagcttgctgggcagttctaatctttgtgctgttgatatgcccctcgatgtcagtcctagggaaattttggagcttattatcgataaagtaaagagcattgaccgtggtagaggcgtgttgctgctggttgatatgggctctttgctcaatcttgaagaaactattatggaacgtgttggaatcaatgtaaagactattgatatggtttcaactccgctcacgctggaggctgtccgaaaggccagtgtttttgacatggggatagaggaaatataccaatcgctaaaagatttcaggggatataacaatagcagcgccgcagtgaaagtagtccataaggcaattgtgacggtttgctcctccggcaaaggtgcagcggtcaaattgaaagagtttgtagagaaagttgtctgcgatttgacggatgaggagatactggttgtcccggcaaacgtaagagagttggataaagtggtccaggatatgcggtctaagcgaaccattcttgccgtgattggagtaaaacggccaagcgagccggaaatcccatttattcccttggaaaagctgattgaagcgagcggtgagcagacattgagagagctactgctgaataacaagcagatccctgctgtggatcaaagtgtagtcgtcagggagttatgcgaggaaagtctgaaagaatttatgacgtatttgaatccccacaaaattctgggaatggtgatgagatttgtgcaagagctggaacttggattagaagtcaaatttgattatgcaacaaaagtccaaatttctactcacacagcttatgcgctggaacgtatggttattcgcgatggacttgtttatcagggggaagtgaaacagctcgaccagcacatactcgaggtggtaaaccgttcatgcagcatatttgtttctggtatgaatcttatactttctgaagacgaaaaatattatatttgcgaaatgttgagcgaagtatataactttattccacagtaatggccaaagagtataaaacgctttcatatgtgtatgaaagcagtggagattgataaataatgatctgttcagactggaaaaaaacctccgacgcaacgggggtttttttgttgtttacaaaatttcctctgatctatacagaagtttggcacagaacttgcatcatagatatgtggagagaaacaaagggggtgagacagatgatcggtgtaattgttgggacacacgggaaattttctgaagaaatactgaggtcaacagaaatggttttcggccaattggataatgtggcaggtgttacgtttgaaccaggtgaaagtgtcagcggacttgtagagaaatataaggctgcgttggcatcgctggattggacggacggtgttatcttccttgttgatctattcggcggcagtccttataatactgccagccgaattgcggttaaccatgaaaaaatggatattgtgacaggagtaaacctgccaatgatcgttgaccttcttgcaaacagaggaattgaacaagtggagaatttggtaaatttagcgatccatgcagggcacgattccatgatgtcttttcgtgccattcgaaacagtcaattagaggaggaattatagaatggaaattgcattagttcgtattgatgaccgtctgattcacggtcaggtggcgaccgtttgggtgaaagaagcgaagtgcaataagattatcgccgttagcgatgatgtcgcagcggatacattacgcaaaaccttattgcttcaggtgtcgccgcctggaattaaggcgtatgtcgtaacgattaacaaagcgatagaggcttataataaccccaaatacagtgattttaaaacattgtttctctttaccaaccctacggatgtactgcgggttgtggaagggggagtacccatccgctcggtgaatgttggaggaatgtgttttaaggaaggaaagacacagattaccggggcggtatccgtaaaccaacaggatgtagatgcatttcgtaagctgcatgaaaaaggcattgagctggaaatcagaaaagtagccagtgatccgaaaatcaacttgattaccaaactgcaggatatgtgatcgtaaataccaggcggcaactagagaggagttatagaaatgactgtttttcaaattgtgatggtaacactggtagcggccatatgtggcatgggtagcgttctggatgaagggcaaacccatcgtcctctgattgcgtgtacgttgattggccttgtcctcggcgatctcaaaactggcattatacttggcggtactctggaattaatggctttgggatggatgaatgtaggagcatccatggcaccagacgctgctctagccagcgtggtttcaaccattttggtcatcgtcggccatcaatcgatcggcgccggaattgccgttgcgattccaattgcagccgccggacaagtgcttaccatttttgtcaggacgattactgtcttcttccagcatttagctgataagtatgcggaatctgcaaatttcaaaggaattgagctatgtcactttattgccttacttttgcaaggtctgcgcgttgctttgcccgctgttttggtggcagttgccgcagaaacgggcctggtgactgctatgcttaacgcaattccggaggttatcacaagaggactacaaattgcgggcggctttatcgtagtcgtagggtatgcgatggtcattaatatgatggcagccaaatacctgatgccattcttctttctgggctttgtcattgcagcttttaccagcattaatctggttggttttggggtcattggcgcggttctggctctgctttacatccagttgagcccaaaatacaaccagcgtaatgagaagatggaagaaattgaagagttatagtaactacctgaagggagaggagagcactatgaaagaaaagaagctgactaaaagtgatttaaataagatgtttgtccgttcatgcttcctgttaggctcgttcaattttgagcgaatgcagtcgatcggtttctgtgtcaccttgatccctgcgattaagcggctgtacagcaagaaagaagatcaaaaagaggcattgaaaagacatctggaatttttcaacactcaaccgtttatctcggcgcctattatgggtgtaacggctgcgatggaagagcagaaagcgagcggccagccgattgacaatgcgaccataagtggagtcaaagtcggtctaatgggacctcttgcgggagtgggtgaccctatttactgggggactttacgtccggttctggctgctctcggagcctcaatcgccttatccggcagccttgtcggaccggttcttttcttccttctctttaacactgcacgcttggcaacgaaatggtacggtctgaaatacggttatcacaaaggtacggagattgtctccgatatgtcgggaaaccggttgcaaaaactcacggagtcagcctccatactggggcttttcgttatgggcgcacttgtttctaaatggactaccctgaatgtgccgctggtggtatcaagatatgtgggaacggatggaaaagaggttattacgaccattcagatgattttggatcaattgatgcctggacttttaccactattattgacctttttatgtatgaggctactgaaaaagaaagtgaacgcaatcgctctgatttttgctttattcgcagtaggcattattgggtacgcatttggtgttttggcttaaaacgtgcggtcagggagtcatccttggccggactttgtcggatttttgtgaccaaagcagcgtaaatataagatattgagctatagagttaaatataaacgctttgtcaagaacattacttggagttcaaaatattaaaagaggatatgaaagatggtgaagaggaagttaagtatgctgcttatttgcagtgggctataacatcccttcttcttcctgggatttgtcattgccgctttcacgaacatcaatctagttggttttgggatcgtaggaactgtgctggctctgctatacatccagctcagttcgaaatacggcggaaattgaagagctataagaaaatattttatgaaagaaggggagtacatatggaagaaaagaagatgaccaaaaacgacttaaacaaaatatttgtacgttgttggttccttaattccgacgattaagcggctgtacagtaaggttactaccgttcttactgatcttcctttgcatgagactgcttaaaaagaaagtgaacgccatggctctcatttttgcgctattcgcaattggtattattggatacgctctcggtgtcttggcttgaataattcttaaaactatttggtcaaggagttatccatcaccggggataggctttcattataaggcgttttgaactgatttataaaattagttataaagggagtgaataagatgaggagtaaaaatatgaatcggatttgttctttagcacttagtatcatcttattattatctttaacttcattcacgaaagcgtttgcatcagatccaggatattatcaggaaacgtaccgcaatcaatttcatttttctcccgaggccaactggttgaacgatcccaatggaatggtttattacaagggtgaatatcatttattttaccaaaattatccatatggaacgacatggggaccgatgcattgggggcatgctgtgagtagagaccttgttcattgggaacatctacctgttgcactttctcctgatatccacggacagattttttctggaagcactgtaatcgactggggaaatacagccggctttggaaaggaagcaatggtagccatctttacccattcaggtgataagggtcaggttcaaagcattgcttacagcttggataaagggagaacatggaaaaagtatgaagggaatccggtaatgcctgaacctcccgccgccgattggcgcgatcccaaagtattttggcatgaacaatccaatcagtgggtgatgtcgttagttgctaacaataaggtgatgttctatacttctcccaatttaaaaaattggacttatgccagtgaatttggtccagatggtggaatacaggccaatagtctggattccacttcttacgcgatttcctcacaagaaggtggatcattcaactatgagggcgacattacccttaatgcaaaaaatggccgggaaggatcaggaggactggtttttcgttctgataagcgtgcggccaacggctatgtagtcaatctagatgccaaaaatgatcgcgtaactttaaccaaaaataggaatggagaaagcattgaacttggggcctgttctttgcgcttggatacttcatctacctatcatttacaaattgtaacggatagacatcacattcaggtttttgtaaacaaccaatcggttatcgaacaaacggatgatgaatttgtatacggctactatgggttaaccgcatggaattcaacagcctcttttcgaaatgtgaaattcaataatacatcaaactttgtgaccaatttgtcaaaatggactgttgtaagcggttcctgggaagacaccgtgaaaggaatgaccgggacttccgcggcgaattcatatataatgagcgggcaagccggggaaaactttcgatatcaggcgaacattgaattatcggatggcggagatgaaatcggctcacttgtttttcgggcagatgccgaggtgagaaatggatatatggcgagcctcgacgctcacaacgataaaataaaattgatgaagcttgaggacgggaagcaatcagtcctagccgaggccactgtatctctcgctacgtatacgaattaccctttagaggtgaggacctatggagagaatataaaagtatatttagatggtaaacttactcaggatgtaaatgattctaccttttcctccggcgttttcggcttgcatttggcgaattcctctgtgctcttccagaatgttcagttgggcaaaaatatcatcacagaggagaatgaaatacttaaccatgattttgaaacaggggatctgactgggtggaccagtgtacaaggggaagcatttactaatgaccatgtaacagatcgaaaggattggtggggtggaactttcgaccagcaaggcaagtatcatctatgggggttttccgatagtcacaagggggatgatgctactggagaactgcattcatcctatttcaaactgggtggctccggagagattaacctgatgatgggcggaggcaaagacgtcagcaaccgttatttttcgttagtcagagcttctgacgatcaggaattgcttcgtcaaacaaatacgaaatccgaaaaggaagcgtatagcagatacgtatgggatgcttccaattatattggtgaagtgctatatatcaaagctgtagacaatgcaacgggacgttgggggcatatcaacctggatgatatcaatgtttataatgacaaaccaattccggaagacgttgaccaggttgcacaagagccggaaaaaggcaatttgccacaaagtggcctcataacggattggtctgccgtctcaggttcgtggataccttctacaaacggaagtataggcggcgtatgggaatgtcctgcattaattgaattgcctattgatggcgacccttcaaaaaagaaatgggttctgcaggtaagtataaatccgggaggacctgcaggcggatccggaatgcaatattttgtaggaagctttgatgggaaaaccttcaccaatgagaattcttccgaccaaatattatggtccgattatggagctgattattatgccggtgtggagtggagcggaattgaaggggagaagggcgagaaatactggcttggctggatgagtaactggacttatgctcaagatacacctacttcaacatggagaagttccatgtcactgccgcgaatgatggaactgacccagacagaggaagggttacgcttaaaacaaacaccaatttctctggccggcattcgtgctgaaacaaagggaatttcatatataaatgaaaagattaagggagaaagcgacctcctatccaacttttctgacgatacatttgaaatgattgcagagtttgatctttccaacaccgaagcaactgagtttggttttaaggttcgtaaaggaactgaggaatatacaacggtcgggtatgatgtctacaatgaaaagctgttcgttgaccgtacgaattccgggaattatgatttcggacctgatatcacaaataaacatgagggcccgctgaaggctttaaacggtacggtgaaaatgcatatttttgttgaccggtcagcgctggaggtgttcgggaataatggagaaacagtgataactgaccaaatattcccccatccttcgagtaaaggaatgcaaatctacagtaagggcggggatgtggaattaaagtctttaaaaatatttccgttaaaaagtgtctggaaaacgcccccatctagtgtctccgtactgtcagattggacgacgatcagcggcaaatgggcggatactattaatggaaaacaggggcagggcgtaggggatgcgtttattctggcaagtaatttcggtgagaactttatatatgaagcggacattaaagtgccggatacagattcgcatcccgatgatcctgaaaaagataacatagaaaaccccatcggcgcaggtgccttggtctttcgttcagaccctacggcaaaaaatgcgtatgcaattaatctggatgtaaagaataatgtagttaagttgatgaaatttgttaaaggaaccggtagtgatcttgccatctacaataatgacgcgaagctgaaactacggacaaatcaggattatcacctcaaaattgtagctgtcggggataccataaaggcttatttggacggacaactggtgattgataccaaagaccaaagttacacacgaggatactttgggttaaatgtaagggatacaacagcattctttaatagtgttcgaataatatcaagttccaattccggccattccggtggcaattctcagaacaacaagggtagcgacagccaggcggtaaagctgccagtcaaggcatctattccggcttccgccacttcaggaatactggagtatgctccgggtattacacaaaaggctgatggcaggaaagaagccgcagtggtcgtggatgatcttactttgcttaaagctttgccggtaagaaaaggttctgcactaactttgcatgtgaaagctgctggggctgacgtggttatcgttgagctgaccagcatggccaataagctttggagcgagcatcgaactctggatcttcagttaattacagaactggggacgtacacccttccagccagcagggtgaatagaaatacctcaccttccaatagcgtgccagggctgcgaattacgttatccaaggcaacaatgcagcaaaatgcggctattcaagaagcggctgtaaaagcgggcgcaaccgtggaaacgactcctatagacttcaaggctgaagcagtaacaggcagtacaacaaccgctcttgatttcggtgatacctatgtgagccggacacttccgctttcatcagcgatggacccaaatcgttccaccgcagtttgctacgacgaagccagaaggaaacttatctttgtaccgagcatttttcgggctggggatgatggagcctccgttgaaataaagcataattccaatggtgtatataccgttgtcaacagcagcccaaccttcgatgatttaccagctgggtactggggcaaagccgacatagagctgcttgccgcaaaaggaattgttgtcggttcgataaaaggaatatttgagccatccaggcctgttacccgcgccgaatttgccgctatgcttgttcatgcacttgggcttaaagaacgggcgactccagcctttagggatgtagtcaagggttcatggtacggcggatatctcagcgcagcctattcagctgggctggtcaaaggttatgaagacggtgcttttcgtcctgaatcgggaattagccgccaggagatggctctacttgtccatcaagcattacaatataccgggtatgtctcagtcaacagcaaaaacgggcaatcgctagatggatatgccgaccgctcgtctatcgcggtttgggcgcaaaatgcagtagccgctgttacagctcagggcatcgcacaaggtatggacactggacactatgagccacatgcaacaactacccgcgccgaggcggcagttatgataaaacgtttgcttcaaaagattgaatttatcaataaataggcaaaatgaataaagtccccggactcttaatgcaatatgcatgcggaccggggacttgctatgtgaaatacacaatataagcaatttgcttatctttataaaaatacttaaaaacacttaacaaaaagcgtctaatcgcttatagtgaatatagggataggggggctttatatttaccaagaggaacgacttttaaaaattttggagtatctccaaagccgtaaccaattatcaaattctgaaatttgtaatttattgaacatctcgagagatacggcaagaagggatattattaagcttgttcacgaagggggggttatcagaacccatggaggtattgccttgcccttattaaaagaagaaataagagcctacaaggaacgtgtaacttcagcaacaaagcaaaagatgctcattgcaaaagcagcttccgcgcacatcgctgacggagatgtttgtttcatggatgtatcgactaccattcaactgctctgtgggcaattggacaagaatctcacggtttatacacactcgttggataatgcagaagctttatcagcaaaaagtgaaattaacataaacttgctcgggggcaaatttaatcatgaaaaccgttttttttatgaccactacacggctatgcagttgaacgatgttttttttgacaaagcttttttaggagctgccgccatcatggaagacggagtgtattttgcaaaccgtgatgatgctttagttaaaaagctggtatcgggacgtgccagagaagtatttttacttgctgattacaaaaaatttaatttaacaagcccgtttaaaggcctgaatttttccgaaattgatattctaattacaaatcaggatgcaccggagcactcattgctgatgttgcaggatagcggagtagaaattatcaaggcgcttgaggaagaatcgtgataaataatcgcaagggagccatcggccatgatacaagcaatctttagcgatattgacgggacgttgttaaattcaaaacatcaaattacgtccgacaccaaaaatacaatccaaaaagttgtgggaagaaatatcccttttgtacttgtttcagcgagaatgccaagcggcatttttcctcttcagcaagagctcaatattcacgctcccatcatttgttatagcggtgctctaatattgggcggcaacggggaaatccttcatagtatctgtttatcgaaaaagagcattaaacgaatatacgatattgtaatggatcattatccttctatcagttttaacttgtatgaacatgaccagtggatcgttggcaacattcaaaatccttgggtaattcaggaagcggaaattattaatggctcccccatacagaggttactcccctcatatatagaagaagatcatgatattcacaaaattttatgcatgggagatcccgaagacattgagcggcttgtacaacaaatcaataaagaagttactggtatcagtgtttataaatccaagggaacttatctggaaattatggatgagatggtgtccaaatcgtatgccattcaggagctcgaggggatatttaatattacttatcgtgaatcgatggccattggagacaactataatgacatggatatgattttgtacgcaggccttgggattgcaatgggaaatgcgccggaggaagttaagaaaattgccgacagggtcacatcgagcaatgatgaagacggtttgaaaataggcttggaggaaaacattttgtccgtttgaaatgatccagtgacattggatatccaaacaccaaaagacggtaggcattggaaatagaagagaggggttaactagttacttatttcgaatagcaggaggcaacctgacaacagagtattgtttcttggatttgatgccccaaaatcaagcagatatatgtctattaggaaacttattaggtatgagtgaggatgaaaacctttttcatacttattattctgctgtagaatcagttatagaaaaagctagcgttcagatcctagcgtcttatttaacttcagatacaaaatggggcttgtttaatggattttcttctagacctatgatgcctatcgcagctaaaatgctattttccaaagaagtgctaaaagaggatgcacgcctcatccaacaactaaaagtatcgaaggatgatatcaggatactaaaactctataatatgatggcagtaacttaacaatgttttgttttaattaggttaattaggcaagagctttctcgttctgtccactgtcattgtttacaatgcctgaatagttgatcgaattatcattttactcatagatgtatcatcaggatcatttattgcattagcaatagctttgcaatccgatcaggataaatgctaagtctgcaatatgaattataatggtttatgagaatatctgagttaattaaagatgaaaagtttttggcaatcgaaaaaaatcctggcctgccttatataaaagaaaacgactacgtaggataagtactcgttttcttttgattaaactccctcgatatgatttagtttcctcacttctccttccaaagaataactaaaaaggtgtccagcgaccttagagatcgtcggacaccttttgctgttcttacgcttcattccttgattcaaccttgcgctacgaaacgattaacttcttccaacgacggcaaggctgcaatcgctccaactttagtgcacacgatggcgccgacttgattggcaagtgtcacaaattcctgctgctgcttcgcgttggaggtaaatgccttaggctgactcagctggctgatttgatacagcattgctccgacgaaggcatctccggcaccagtagagtcgatcgatttgacagcgatactgccgattaacgaacgggaggcaccacttgagataagggttccttctttccctaaggtaaccgccaccgtcttggctcccaacccatgcaaaagatccaatgaagcatcgcggtcagccagccctgtaatgatgtttaattcctcttcgcttacctttaccaaatccgcattgtgtattcctcttctggacagtgtgataaattcctcctgcctgtctttccagaggtccccccggtaattgggatcaaaggaggtgaattgcccgttggccttcgctccatccaataaagacaaatacgcttctcggaaaggatcggcgagcaaggccgttgccgagccaaaatgcagaatggcagcctgccgggtccattctctatcaatatcctgcagagacagttgacggtcagctccgcggttgaacacgaaatcccgttcgccgttagcggcaagggaaacaaaggccagtgtagtcggcgttgacggatcaaaaaggagcatggacgtatccacatgctgctcatccaacgtttgcttcaggtacatgccaaagggatcagccccaactttccccaagaatgacgcttttcctccgagcttggctacggctgcgcttacatttgccggagcgccgccggcctgcttggagaaatgctggcccttggcaagattaacatcaatatccgtgcagaaaaaatcaatgagcaactcgcccacacaaagaaccgttctgtcatttttcactttaattcacctcttggtagatttagtttagaacaggggtcgagtcccggtatacgatatccgttgcgacatgagtcactcggtatggcatggtattgtctttgattctggacaataacatttcggctgaaataatacccatctgactactataaatatgcacggttgtaagatgaggctcgacaacccgggattccgaagcatcatcgaacccgcaaacagcaacatcttccgggactttaatccctttgtttttcaaagatttgatcacgctgatggcaatgaaatcattggcgcaaataaagacggagggacacttcctcagggcatccaactgctgttccatccagttctcctctataaagaagttgcggtcaggcgctacaatgctaagggcaggatctacggcgattcctgcttctgctaaggccttattaaatccggcccagcgttcattgaagcttttgcaatgattgtaatcgcctacaaaaccgaagctttcatagccatgatcgatcaatttccgggtaacacagtatgtgctgtgttcattttccattaataccagatccgccttcaattctggatacatcatatccgcagcgcaatcaataaaaatggttgggatgcaaagatctgtgatcagcttgctgtattccttgctgaacatttcgatgcagaagatgccagccacattcgaaggttcaaaattgccgggtagagtcattgaattgatatcattctcacgaacaaaataaatagataaagtatagccctgtttgctgatttccttctccagtccgctgatcaacaaagatccaaagtgtgagctattaggaagattacaggtcaaaagtgcgatattgccctgtttttcagaagctgtttccatataagaaaattgtttgtatttaagctccattgcttttttgaccaccttgtccctagtaacggcgggaatactctccactccattaagcgccttggaggcagtgtttctggaaatccccaaggcatcagcgatatcttgtatcgtaacctttgactttctcgtcatattgttcaccttattctccgaattaagattcttcatatttctaaatatatagtattttcatgtttttaacaatgtatttattcaaatgaataataaaagtttacgtttgtttatttatattgtgcaattttgatagatttttgctgaaaacattacaattatcttgaaatacgctttttaaatgaatttttcacccgaaatatattgactaattaaatgtacatctgataaattgtaagagtaaaatatgttcaaatgtaaattgtaagcccattcattttgggaatgtgtaaaattctcgttctgttggaggtgtggatattacaagcaagtatttgaaaaacatcttggttaattatgtcagagagatgacataacatggcttatattttgtgtcgtataacaagccgtgaacagtaggagggaaaatattggcaaattcgatcgttcaaaaaaggggactaaaggcttcagaaacaaaaaaaagaaaccattggttaagctatatgcttcgaaattatatactgtatttgtttctgcttccgtccataattcttaccgtcattttcaagtatgttcccatgtacggctcgatcattgcgtttaaaaatttcagcccaagaaaaggcatcctcggcagtgaatgggttggatttgaacattttcagcggtttctttcatcaccaaatttttatgacattttaatgaatacgcttaaattaagcgcttacggtcttattctcggtttcccagtaccaatcattctggccttaatgctaaatctggtcagaggagcgaagttcaagaagaatattcagcttattgtatacgcacctaacttcatctcggttgttgttgttgccggtatgctgtttgtttttctatcgccagctggaatagtgaacgctttggtaacaaccttcaccggcaagccgattgcttttatgactgatcctgcctatttccgaacggtatatattttgtccggtatatggcaaacagcgggctggtcctctatcatttatgtggccaccttagccaatgtggacccgcagttgcatgacgctgcaacaattgatggcgcttcattgatgaagagaatcttccacattgatctgccagctcttaaacccgtcatggccgtcctgttcattctcgctgcaggaggtattatgtcgatcggctatgaaaaggcttacctgatgcagacggctttgaacacacctacctcggaaatcatcgcgacttacgtatacaaggtggggttgcaatccggcgattatgcttattctacggcaatcgggttgttcaattccgtaattaatgtattcctattgattttcgtaaataccgtcgtcaagaagctgaacgaaggagaagggctgtattaaagaaggaggtatttatggatattcattacaccgggaaggaccggattctgctcatcatcaattatattctacttggtttgtttgttctcgctattctgttaccgctggtttatgtggtgctttcgtcctttttaactccaaataccctgattaccaaagggtttgccattacatcatcagactggacactcacgggatatgccaaaatcctaagcaacagtgccatgatccgcggtttttttaatgctattttttattcagcagcctttgcgttcgcaaccgtattattttccgtcttcgcggcttatccgcttgcgattgaagagttggtagggaaacggtccattatgatctttttcctgataacgatgtttttcggtggcggtctgattcctacctatctggtgattaaggatttaggcatgttgaatacggtctgggccattattctgcccggctcgatcagcgtattcaatattattctggcaaagacttatttccagggacttccgaaagaactgttccaggcggcgagtatagacggagcttccgagctcagtattttctttaaaatcgtcctgccgctttccaagcctattatttttgttctagctttatacgcttttgtcggacagtggaattcttatttcgacgccatgatttatctggatgatccgaagctgtttccgcttcaactggtactgcgctccattttgatacagaatcaggttcagcccggcatgattgccgatgcgatggcacaagcggagcttaagaaattgtctgaaatgattaagtactctgccattgttatatcaagtttgcctttgattgtcatgtatccattcttccaaaagtatttcgaaaagggtgtcatggtaggttcgatcaaataacaaatcgggggaatagagatgaaaaaaacattactaaccttgtctgtgttggcactttctacttcactgcttgccggatgtggcggttcaggcaataattctgcggcatccgaagattacaagctggaaaatgttaatctgccgcttaaagagaaagttactttgcattttatgactcaaagctcgccgctggcaccttctgatccaaatgaaaagttgatttataaaagactggaagaaaaaacaggggtgcatatcgattttaccaacttcacctccgattccttcattgaaaaaagaaaccttgctgttgccagtggagatcttccagatgccatactggatgccggatattccgattacgatttattaaatctcggtaaggatggaactattatccctttagaggatttgattcaaaaatatatgccgaatctgcagaaggtattgaaggaagcacctgagtacagatccatgataaccgcacaggacgggcacatttatgcctttccttggattgaagaactgggttctgagaaggagagcattcattctgtaaacgacatgccatggatcaatgtggagtggctgaaaaagctgggacttaaaatgccaaaaaccaccgaggatttaaaaaaagttctgctcgcatttaaaaatggcgaccctaacggaaatggccaagcggatgaaatcccgctgtcctttatgctcaataacggcaatgaggacctgaattttctgttcggatcattcggtcttggggacaacggcgatcatacggtagtgaccaatgaggggaaagtggtcttcactgccgatcaggatggttataaagaggggattaaatatcttaatgagctgtataagctgaacctgatcgacgaagagtcattcgagcaggattacaatacgtatctggccaaaggccagaatgaaaaatatggtctctactttcaatgggataaggcgaacatctcaggagataacgataaatatgaattgatgaatccgctcgccgggccaagcggtgaagtcaatgtgacccgcacgaacaatctcggctttgaccgggggagaatggtgattaccagtgataacaaaaatcttgagcttacggcaaaatggattgaccaactgtatgatcctatccagtccgtacaggacaactggggcacctacggcgacaaaactcagcagaacatttttgaatacgatgaagcgagtcatatgctgaagcatcttccgcttaagggaacggcccctgtcgagctgcggcaaaaaacgaatatcggcggtccattggcaattcttgacgagtattacggaaaagtaacgaccaagcccgatgatgcagtgggacggcttaagctcatgaaggaaagactagttccttatatgaaggctgaccataatttcccgaaagtcttcttctcgctggaggatcagaagcagatctccacattggaaaccgatttgtttgcttacgttaaccgcaagcgggcggaatggatcaagacgggtaaagtggaagaagaatgggccgaatataaagccgagctgtccagactgggactagataaatggctggaaatcaaacaaaaaggctatgacagatatcttaaagatcaaggctgaaacatttaaaggggggatctcaatccggcaaatatcccaaattcatttgccaaacgagcaaaatcaaacaattttgttaaatgccttatcaacaattaaaaggagagcggatactatgaaagaattaaaaagtaactatagtgaaacgtacaggcctcaatttcattattcaccggagaaaaattggatgaacgatcccaacggcatggtttactttgaaggagagtaccacctgttctaccagcataccccccatgatacgcaacctgattttggcaacatgcattgggggcatgcggtaagcaaggatctagtgcattggacagagcttccaccggcaattccacctggggaggacggagcgatcttctcggggagtgcagtggtggataagaacaataccagcggatttttcgacgaggaaggatcaggcttggttgccatttatacaaatgagggcaacaaggctcagcctggaaagccgcaggtgcaaagcattgcttacagcaaggataagggtagaacctggacaaaatatgaaggtaacccggttttatttccaacggacacgctagactttcgtgatccgaaggtgatttggcatgatgaatcatcaatgtggatcatggttcttgccgtaagggaccgtgtagaattttacacatctccaaacctgaaagaatggtcttttgcaagcgaattcggttccgacattccgcatatccaccgagggatatttgaatgtcctgatatatttcgaattcaagtggatgaggatcttaataccacgaagtggattctgatgctaagcgtcggggatagaaatggtgtgaatccagacgatccggaaccaccggcaggcggttctggcatgatgtatttcgtaggcagctttgacggtaagtcgttcacgccagatgaagcgttggaatctatcgatactatcaaatgggtagactatggatcagacttttacgcggccgtgtcctggaatggcatttcgaacgaagacggacggaaaatttggctcggctggatgaataattggcgttatgctaccacgcttccttcaaaggaatggcgtggcaagacatcaattccccgggagctacagctaaggacttacccggagggacttcgcctaatccaaacacccataaatgaattaagtcagctaagaaaaccgattttgtctctgcaagatttgacgattaagccaggtatgaacgtgttgtctgatatttccgcagccaaggcagaaattattgcagaatttgaaatcggtactgccgtggaattcgggtttaaagtacgaaagtccgccaatcaagagacgatcatcggatataatatctcgaatgaggaattgttcgtcgatcggacgaagtcgagcgccactgattttcattccgatttcacagcaatacacaaggccactatgaagccagagcatgagaggatacagttgagcatttatctggattggtcaagtgtcgaagtcttcggcaatcatggaaaaacaatcatttcagacatgattttcccggacttcgaaagtaagggtctagaactctacgccattggtggagaactaagggtcgtgtcgcttcagatcaatgatctggtaagcatttggggaaatgagaatgtttagacgttaactattgatatcattcaaattttaattatctcacgaaggaactcattgagtagtcgagtgtcaaattgatttttcaatttgacacttttttatattggataagataatgagtttgtgtaagctagatagcaatagtctgttaagacttagttgtagaatcattttcgaatgaacctctctcgagtaaattgtgtattcttcttatatagacttttggatacaaggaggcaacgtccgtggattcaatgcagcatattattggctctaatttggctcaaatcaggaagactagaggattaagtttggataaggtggctgaactgacaggggtcagcaaagggatgctggctcagattgagaaggggaaatccaatcctacggtaacaaccctttggaaaattgcgaacggtttgcatgtatccttctccacctttctcaaagaagacccgccgcaaatcacgaagattcggagggaagacctgcatccggttattgatgaggacggtaactattttgtttaccctgtattcccgtatcacgctgaaaagaagtttgaggtgttcacggtaagtctgaagccaggctttacacaccaggcagagaagcatctgggtgaggaaacgattctcatgatccgtggggagatgtactttgaaatgcaggggcaacagctcaagctgagtgcaggggatgctgtgcaatttcaagtatctgacatacatacctaccgcaatgattcggaagaggatgccgatttttatgtattgatttattatgcggattagtgggatgattagcatagtctaaaacaggcttccacatcaggattttgcaaaatccagagatataaaaagagagcaacgaggaaaagagaggaaagaacccatggaaagcaagtacatccgagaaacctactgcttcaaaacgtcccgagtatttcccaatgatatcaacaatcataacacgctcttcggcggccgattgatgtcgtatatcgacgatatcgcatctattgcagctgctaagctgtgtcgtacgaacacagttacagcctctacggattcggtggattttttgctacctatccatccgagtgattctgtcacgctggaagcgttcgtaacctggacaggccgtagctcgatggaggtgttcgtaaaggtaattcgtgaaggactgatgactggcgaccgaaaaatcgcagccaccgccttcctgacctttgtggcattggacgagaacaaccgtaaggtgaccgtgccgcaggtgattccagaaacagaagagcagttacaattgcaccagacggctccatcacgcgcagccatacggcgtcagcggagggaagaaagcaagcagctggctagttttctgacaacagattatccgtgggaactgtaacgtactagagattatcaatttcatcgttttacgtaaaaaggagccgtcttttccgttagcagtcaaccatgatctgctcggaatacggctccttttgaaaataacttgagctattctactttaactacacggaaatgctgatttgtcccaccgttatcgccccattgaatggctttagctccatcggcggtggcgccttcagaaatatcgatcagcttgccggttgcccgatttttcagcttgtaataaccaccggttacggatactaattgccaatgctgactggaccagcctccgtcgctccactgctcaataactgtaccgtctgttgtcgtaccgctttcaacaccaattagctttccgctgttgcggtttataattttataatatccgctgcctgcatctttgagctgccattgctggtttgctgccccggaatttgcacgctgctccagatctgcgccgtccgtcgttgcattgccaataatgcttagtggcttattgctcttgcgattgactagctgataataggcatccggatcaatggcaattggcgtcgttatcccctcgaccacaccactggcggtgtcaatattaatgctgtcgaaccaatccatggctaatgaagtcgttgttggaaaacgcagtggcaaccatacatattgagaatcctgcacaggaccgctccatgcacccgcccaacggtcgcccaaatacaggtatgaagttgtctgggcaccttcaacaggaatcacgtaagccgactgtgaaccatatgtcgtaccgtccccgaagtttatcgtattactccaggttccttcaatgctggatgcggtagcatacttggcctgattgggattccagccggttgccccggatgtaatcaggaagtagacgtctccttttttgaacatcgccggagcttcacgatattgtccaggccaaagtgtagtcaccagcgattcaacttgcagaaaatccggtgtcagacgataaatgttcagatctgcgtttacccgggtagccgaaatgaggtaagctgtaccgttatcgttgtatacggtcatatcgcgtgaatcgtaatccagaggacggaagctgccctgatacgtgtaatcgccgtccaccgtatcggaagaggcgacagccactcgggcttcgttgtaattaaccccattttccttgtgcatccataatacgtatttacgtgttttttcattataaatcactttcggacgttcaatattcgaaacattcagctctacggcggagctgctggttagtacgtttttacgaaactcccagttttttaaatcagaggaacggtaggcggatatcgccttgaacgtgccgttgggattacgattttcaccaaaccaataatagtaaccgtctactttaatcataccacccccatgggcatggaccacgtttccatctgtatctttaaactgaatgccattcacgacattcgctgaagcggctgaagcgatcttaggtgaaaacatctgaaaaatgctcaacgtcagcaaaatagagagcataatacacagcaagcgggcaaaatcatatttcattgtttcgtcctcctctgtatgtgttattttaaagcgctttcattaatggactctatgaagtagttttaatagagctacttatcccaattgtatccatattgaattgaaagtgctagagtagtatattgaccatgtacacggcacacgccatccatatctaacagacttccatcgagcggtgagtgttacaaactggctgatattcattaggtatacaggaggcaaccatgaaaatatacgcgattgatacgagcaagccggaggctgaggagcattacgaatcactggtaaatcaggtttcgctggaaaagcagcagaagttagatcgttttttacatcgggaagatgctttgagggggttatatgccgatgtgctgctaagatggttggcctgccggcaattgaaggtatctaatgccagtcttcaatttatatacaatgcattcggtaagccttccttgattaatgcacccgcattccattttaatgtttctcactcgggaaaatgggtggtatgcgctattgatgatcacccgcttggaattgacattgagcagctccgtcctattgatttggaggtaggtagagtgtgcttttcggacacagagtatgatgcgttaatgcgtcaggacgcagacagccgcttatcgtatttttacgatctatggacgcttaaggaaagctttgtcaaggccgaggggcagggactaaccctaccgttgaagtctttttcatttgagctaaaggcacaaccattcataggcttcacgacagagggctttaccaccgagtattgtcattttaagcagtatgagctggatcaggattataaaatggctgtctgtgcagctcatgaccaatttgcccagcaggtgcagcagatagatataaatacactacgcttggaagtggcaacataggcgtaatatgaagtggatatgcgtatagttgaaaaaaaggagatgagtggcgttgacattcgttttgttcaagcacggccggttgtatggggagtgggctttcaaaggagactctatcgttgtacagcatggacggatacaggccatcgggtatgctcgggagcttgaattacagttgtccggtaaggaatatgaaactgtggattgggaagacgcctatgtactgccaggcttaaccgattcacatatgcatttgtctatgcatggtatgaagctggctatgctggatttaacatcagctacctccaaggaagagatgctggctatgctgcgcaaacgggtcgctgtaacaccgccgggagaatggattttaggactcaactggaatgaaaatgcgtttattcctgttgaaataccggatatagccgagctggatgccattacagatcagcatccggtatatctcactcgtacgtgctttcatacgttcttggccaattcagaggcatttcgacgtgcgggtattaacgaggacacccctgacccggcttcgggagcctatgggcgagatgcagatggacggttgaacggattgatttatgaggaagcatcctttgcctttactagtgtgcagccagagccggattattcggttaagaaggatacgattcggcgggcttgtatggatgcgctaaggcttggtttgactgctgcgcacacagaggatttacgttttttcggcagcgtggagacgatgcagcaaatttacagggagctgagggaagaaggtcttccttttcgcacacaccagctcatctatcatccatttttggaagaagcgaaagtgcaagggctgcgttcaggtaccggaaatgagtggtttaaaatcggtgcgataaaaatgtttgccgatggcgctattggtggaagaacggctttattatccgaaccttacagtgatgctccacatacctgtggaatggcgatccaaccgcagccagagctgaatcagatggtggctgctgtcagagcagcaggctatccggtggctgtgcatgccataggggatggggcggcgcacatgattttgacagcgatggaggctcatgcgctcacggaggaaagcggtttgccagaccgcctgatccatggacaggtgcttaggggtgatttggtcaagagaatggcgaagctgccgctgatcgcggacatccagccccgttttgtcgcaagtgacttcccttgggtactgggtcgggtggggaaagaacggactgaatatttatatgcctggaaaaagctactggaagcaggcattccatgtgctggaggtagtgacgcgccgattgagccgttaaacccttttcttggtattcatgcggcagtgactcgtgccaagccggaagaaatgcatgagggctatcttcccgctgaaaagctggatgtacatgaagccattcatttgtttaccacgggaagcgcagtagcagccggtgaggctgatgaaagagggacgatagctgaagggaaagccgctgactttacagtcattgaccgtgatgtatcggaaagcccgcaagctttacttgatgttaaggtacgaatgacagttgtaaacgggaaagttgcatatcggtcataggctgggaataagtatatatgtcaaaagccttcaacttcacttttcatgtgaggttgaaggcttcgtattttataaaccacgctgtataaatcggtctgcgttttttacactggaccacagatcagagctggctccgcccggataccagtaggcgaagccagcaaacccagcatcctgtcccaagcgatacttacgagtgaaggatcgtccttcctcgagccacagcttatgaagctgcgtgtctttgtaagacacggcatactgctgaatgtcctcattccagattggtttggagccggaacgagatactagctggttttgctgatctaatgaaatatcagaggaagcgattgattgcccgctagcgttaagcgtccagttccgtgtaaataatggcaacgccaagatcgctttctccggatcggtggtttgtacaaaacgccgcacgctttcacggagccatggcagtgaggacacagagccggggatcgagctacctccccaatgctcgtcatatcccatcaggatcagatagtctgccgcaccgccaagctgtttataatcaaacgcggcagtccagtccgttccgtaatcaggagatacacaaatcgccagtaccgtattctgactcttcaacttagcttttaattgttggacgaacaatgttaaattggcacgatcctgaccatctacattttcaaaatcaatgacaagtccgttcaaaccgtacactgatacggcattagcaagctgagttatggttgtatttcgtagaacctcactggacagaatttggtgcgtcagtgccaggttggaacggttgcctaccatcgcccagatatttttatgatgctgtttggaccaggcaagcagcgacgaattggtataatcgctgataatacctgtttcatttagaaaaaaccaacgtggtgatagggtgttgatgttggattggagcaccgtattttcaaactgctgaacggtttgatcatattgccagcctattcggatggaagaagcggtggaagcagtttggttagcatgctttgttgaatacgttagcagtcgttccagcaatacagctgtttcttcacgggtcagagaggatgcagggcggaaatagttactttcacctttcataaagccgtaacgatttacggtggttaccgcatcaagggcccaatctgcaatttcgccagtatctgtgaaggaggaagtagcatctcctgatccgcccgaagagcggatgagacgtgcgatcatcaaggccgcttcttgacgggttataggactattaggttggaatgtggcagacgttcccccctgaacgatattgagttgagaagccgcttcaatccatccatagtaccacgtctttttggcaacatctcggtaggaggaaacggccgcttgtacaggctccagaccgagtgtacggtccagtgcggtaacccattcggctctggtaacagcctttttaggagagaagtaaccaggttgtgtaccgttcaaaattcctttagcgtgcagggaaataatagactgataggcatagctgtgtgcgatatcttggaacgtagcgccggatgctgctgctggagcagctaagtacgaagtgaatgttgtgaatattgtgatggctgcagttgctgaaagcgtgagcctggttaaccaacgtgatcgtttggaactcataccaaataaccttcttttttatgatagattgtagactcatatatcgttactcgacgaataatactatcaaaaagaggaaagttattcattgctaaattgctggaaaaataccaaaaaacccgccacctatgcggcaacgggtttgatattggataaactatgcttttttggcatacataataccgatggtctgtggaccacaatgactggaaatgacacagcctgctgtagttagcagtacctcttgtgcgtttgtttcttctttcaagcgagcttgcagcatcagcgcgtcttcctcggccaaagcgtgcacgacaataatgatatcgttatccatctgatctcgttgattcagtgcattttgcagcatctgatccaaagctttttcacgtttgccgcggactttgtaggcaggcgtcatttttccgtcaatcactttgatcaccggacgaattttgagcagactgccgatcaggttttgcatgcctgaacatcttccgcctttatacaggtattcaagtgtatcaatgacaaattccgtgtctatgagcggcctggttttcgtcaacatgtctacaatctgctctatcgtattaccgttggttgccgcacgagcagctttcatcacaagcaggccaaagccgcacgatagattcaaggaatcaaaaaccgtaacgcggccttccggaaattcagaggcagcgagtagcgcattctggtatgtcgatgatagctcggaagacagactgatatataaaatgtcgtccccttgttctatgtagggcgcaaaggcttgaataaaatccgatggagaaggtgcggcggtacgcggtaaatgtccctcgcggcttacacgttgaaataattgttccgggtgaatgttcaccccatcctgcaatgcctcatcaccaaatactgtatacaatggcacaatgctaatctcgtactgttgacgccagtgagcaggaacatcactggtactgtcggcaaaaattttaattttgttcatacattgaatcctctctgtgtgatgcagaaaaattataaagattgcacggaggaaggatagatatccgctgtgctattcggaacggaaagaccgatggccagaagagcaataaagcccacaataataagtgcattaatgattaagcctgtaatagcaaaggttttcttacggttttttaacgcaattccaatgataccgaccacaagtccgctacaattcagcaacaggctgcctaaaaaaataaaaggaagcaataccgttccggtttgctgtagagcgacttccgggttcaacgtttggtattggctgaaatgagccagcagattaatgaccataatagccagaataacatatccgatcaggctgacaagcgacataataaaagaagcaattccgggaccggaatgtttgagcttgaccggaggctgaaacacaggagcttctgaaaaaacagggtgctcctcagacgcagcaggtttttgcaaattaggatcttggtaactcattttttccactccttgaacatagtccgaacaggtactaattttccacaaaataaacaaaaaagcaagccatcctacacattacccttcaaaagacagggtctaatcatccaattctgtatgcggtctgttcacacacgctggctggtaaacttcatacggtttcgataaaataagaagaacattcggctaaaaggatgagatgaaaaggagtacacaaacatgcaacgaaaatggatatttgtgggatctataatgatgatgttggcggtagccattggagcgttcggggcacatattgtgaaggcccggatcgacgcggatgctttggccgtgtatgaaacaggtgtgaaatatcatatgattcacgctgtcggtttgctgatcattgcgttggctgccggacagtggggtccttccaaccgtttaagatgggcggcgcgcctgttattgacgggtatcattttgttttctggtagcttgtatgtgctaagtttgaccggaatccgtgtgctgggggctattacccctctaggaggcgtgtgttttattgcaggatgggtattgttggcatgggctgccatgggtctgaagaaagagaattagagttcttttcggataatgcaaaaaaagagaatggacaagaaagacgtcatgtttttcctgcccgttctcttttttcatgcttcgtttttttgtgaagtatttacatttacgatgtgatttcatcgatctcattcattttaaaggagtacacttgcttctcatctacatgatacacactcagcaggctattatcatgatccaggttgaggatgcggcaaggaatgctgcgctgtccgccatagcggttcacgattaaccgtacaagcgtattatcatgtatatagcgtttgatccattcatacgtactaaggtcttgttgtgttgcaggctttggctgtacctgggattgtttgatttcttgaacgactggtggcttgttcgtaattgcggctgatttctttttagagaatttttccgcgagcgtagcggctgcatcagatgggctattcacggctgactgtttttttaggtacagtgcagcttcaattaaattgccaagttcgataccggattgaatccggctatccgcaatttgctcattttggctcaagagattaagcaggaactgaagggcctctacgttcgaacgacctttaactaatacatctacattaaataaataactggtttcgtcttgatttgattcctttttcatacatcctccagcccaagccatgggtaattagtcttttatagtacctatcaatatatcattaaaacgtaatctatcatagtgcctaaggccctgttgttggatattaacaaaaataaaatctatataaagccctatgcgtaaaattttcacagataagcaaagccagagttacatatacagagaataaaggaggtagggggtgaaatcaagtagtttaaattttaaatatattacagtggggaaatataatataacgaagcagtatcatccatccagaagaaaagtaagatcccccttaacgaaagggggagggggcatatcaaaaacatgatatattatagtaagcgtaattaaagtaaattttattttcgatcaaaaggggattcgttgtgatcgaataaggtaatcatgttcgactgcccaactcacaagaccactccagaaatcttcacaggctgaaatgatcttcgctggttcagctaaatctccggacatcaccaacttaactacatcatcaaatccttctggacgactcggcagttccaaggcctccggtagaaccattgaacccgttgagaaaagcttctgattgtgcaacccaactaacatagccccatactgggcaaactgcattaccaagtacggcaagtaggtatgagggccatttacacggacatttctcagctttcctataaactcgtacatttcacctacaagcacttcgttgatggcatgcctgaaatcttcctttgttggggattcggccgcttcttttaatatagaaaaaaagtctttaggatcatatagacgaagtggggaaaagaagggtccatgtgtcaacggccaatcgccctcaacagtagaggcaattttaagaagaatgtctgaactacagacgtttacctcagctttccagggccctgccgaccattcatggctaaattctacggggccgtttggttcactcagtacgcaaaacatttcaatgtccgaaaaagggccgtcagtacctttggcaacagatccatagacccctatagccagaattttgtctctgtatacttcatgtaacctcgcagctatttcgtggcaagtctgaagtctctcacttcgagaaatgttgacagtccattcatgtccattagtgacctccctctgtttcctacggtctaagtgacttgtccaatttacggattcgccattcagcgcgggtttaatttcacttgcgagcccttgccgcccgtctggattccagtttccttcacccctgcttccttcagatcgaccagtagccgctctagtaccgctttggcgacgggggcttcttttgctccagacgctttaacgaccaactgcaccggtttgccggaacgcagatgtttgtctgcctgacgcagcttcgtgtcgtaatcatgctcctcaatatgagcagtgaagcgaagctccttgaccttttctttgccgctgtttcttgcggctcggccgacatttttgcttgctgcggtttctttttgcgccagcgcttttcctttgccctttgccaccaagctacagggcggtggactgctcatgagtgaggtacataccaggtccaccccttgggatcgggccatagccaaggcttctgacttggagacaacgccgagcttctctcccgcgagtccagtgagtaccacttcgtcagctttaatttgctcgttgattaatactgccacgtaaatgtagcctcccttaaacaatgataaagctatcatatacggaacctgtttgtgattcaattttagatttatccgtattgacaaaagtcactaacccctataatcttttactgataatgattatcattttccaatgcaatatacatacaggggtgattgagagaaatgaaaaagatgttgaatagcctattattatttgtagtttttactattgtattggcgggctgcggtgcagctggggatagctcgaagacggaaggtactgcagggtctgagcagacatccacaacggctggtccggttacggttaaggacgaccacggggaagtcaaactggacaagccagcggaacgtgtcgtggtactcgaatggacgtttaccgaggacctcattgcacttggcgtacagccggtcggcaatgcagacaatgaaaactacaagctgtgggtaacaccggaggcgaagctggctgataccgtaactgatatcggcacacggggcgaaccgaatctagaagcgattgcggcgctcaagccggatcttattatctctaacgccgataacaatgcagcgatctatgcgcagcttaaaggaattgcaccaacgatagaattcgatccttacaaggggaacggctatgattacgaccgtatggttgaaatctttaagcaagtggctgtagctaccggtaaaacggaacaggctgataaggtcctaagcgaacttgaccagcactatgtagatgcaaaggctacattggagaaggcgggcaaagcagactttcactatgcgctgacacaggcctttacagctcaaaatgctgccagtctacgaatgttcaaagaaaattcggttgtagtgggaacgcttgcgaaaatcggcatggtgaacgactggaagtcggacaagaccgagaaatacgggtttagcaccgttggcattgaagctcttccagctgtacaggacagcaattttatctatattacacaaaagacggacgatgtatttggagccgcgatgaagaacaactcggtatggaacggactgaactttgtcaaagaaaaacgtacctatccgctggacggtacaacatggacattcggtggtcctatctcatccaaagtactggttgatcaagtagtgggagctctgacgaaatgacccgaacagacacaacgggtttatcgaagacttggcgtgtaggaagcatctttgggggcggattgatcgtcctcatcgtgcttttttttgtaagcttgtgttatggagaggcttcaatcccgctgcatacagtaattgaggcgttgacccagcgtcagaatacgcttgatcataacatggtgtgggatctccgaatgccgcgtacggtcatcggaatcctagcaggtggtgcgctggccatcgccggtgctttgctccaggccatcaccaaaaatccgctggcggcttctgatacactaggaattaacgctggtgcctactttgtggtcgtccttggcgcggtgatgtttcccggattgctgcatcaggcgccgtttctatttgccgctgtcggcggcttgcttgcagcggtactcgcttacttcatgggcgggggacgagctggaagtccgattcggttggcgcttgccggcttgattgtatccatggttctcggttcgtttaccggagctttgcatatcttttattcatttgaaacccagggactgtttctctggggttctggctcgcttgtgcaaaacgactggagcggaacaacttacgcctggccctgggtcgtagggctctcggtcactgccgttctgctgtcaaggcagtttgatgtcctggatctggatgagtccacatccacgtccctcgggcaaaaggttagcttgacccgggcggtgggaattgtattggctgtcctgctgtcgaccattacagtcagcgtcattggacccattggttttgtgggtttggtagctccgcatttggtgcgcttaagcggtctaaaaatgcatcgatgggtgctgcccggttccttcctctggggggcattgctgttgacgggcgctgacgtgctggcgaaaatggtccatcaatcaagcatggacctgccgaccggagccgtgatggccttgatcggtgctccttggttaatttggctgattctgtggaaaatgaagctgccttctggtattagcgggcagtcttccatgaacataggtgtgcgctctcggaaattaccgtatggcaggctggtcacgttatttggatgcggtgccgtgctgttgactgtattcagcctgatgtttggagggatgcgaattcctgtcggcgatctattgtccggcctgttcggcggtgagaacgcaaattcggccttgctgcagtttagaattccgcgcacgctggtggcagccggggctggtatcgcgcttgcggtcagcggtgtcttgatccaattagccgttcgtaatcccttagcggatgcctcaatcattggtgtttcttcaggggctggctttggtgcgcttgcagtgattatcgtttggcctgggctacctgtttatatgctgcccatcgcggcgattgccggagcgacggtgtcggcggcggtgatcttctttttatcatggaacaagcacctaaacccgtctgtggtcatcctacttgggattgctgtatcagcgatcggagcagccggcattcaggtactgattatccaaggctcgctttggggcagcacaggctatatttggctgacgggtagtacctacgctcgaaactgggggcaggtggcgacgattctggcctttctgctcgtgttgttgccaatagcctggtggctagctcgccgcttcgatcttttggtgtttgacgatagcagcgctatgggactgggacttccggtgcgccgcacccggctgctggccatggcagtgggtgtgctgctggcgggtggagcggtagcctgtgtggggacaattggcttcatcgggctgattgctccgcatatcgtgcgtacgttgattgggcaccatgtacgccgctccattgttctgtcgagcctcttgggagcagtaatgctggtgctggctgatacgattggccggacagtgcttgcgccgaccgaaattccttccggattgctgatcgcactgattggtgcaccgtatttcctgtacttgatgtatcgctccaataagagtaagtcagtgtagttaaatatgtacttgaacaggctgtttcccagcggattttccgtggggaagcagcctttattatttatttttctacgtaatcattggactttatatttacaaatctaataaaatagatataatgttttatatggaaccgtcattgatttataaagcattgtcaaacgaaactcgtcgtctaattatgctgtggttaaaaaaaccagaagagttttttgatgaacaggcttatctaaaacaagggcttaattttcaaattggtgtatgtgtgggagatattcaggctaaatcgggacttgcgcagtctgtgatttcaagttatttattaacaatgcaaaaatccggtttgttagagtctgagcgtattgggaagtggacgtactatcgtcggaatgaaaaaacaatccgggaatttgccgagtacgttcaaaaagaactataaactgaaaggaggttttttttcacataacatatctagaaatctatatatataattaaattggaggcttatacttaaaatgaaaaaggttaacccgttacttattatcattctggctttaggcgtattcggcattattacaacggaaatggggattataggcgttctccctcaagtaactcaaaaattcaatgtatcagctgcccaggctggttggctcgtcagtattttttctttagttgttgccatttcaggtccgttcttgaccttactcgtttccggcatgaatcgtaaagtcattctattaaccgctgtattcagttttgtcatttctaatattgtctatgcctataccactcattttgaggtcatgctcatttttcgtgttcttcctgctatttttcatcctgtctttttttcggtcgctctcgtgactgcatctcatcttgtcctccctgaaaagagtagtaaagccgtcaccaaggttttcgctggaattacagtaggatttgcgtttggcgtgcctttgacttcctatcttgctgaaaagatatcgttagaagctgctttcttgtttggagctgtcgtaagcatgattgcatttgtgggaatactcgtatggcttccttccctgcccgttcaggaaaagatgtcttatggcaaacagcttggtatattacgtaaacctcaattgtggttcaacattgtgactgttatttttatctttgcagctatgttttcggtgtatagctactttgccgaatatcttggagaagtaactcttatgaacgggtcatggatcagtatgatgttgatggtctttggaatcgtcatgatttttggaaactttttatttggaggattattacataaaaatctgacaaagaccgtcatcatgttcccattgctatatatggtcatttacgtattcacttatgctctaggagcttctttcctaccgatggttgtggttgtactcatttggggggccgtgcattccggggggctaattattagtcaaacatggttaaccactgaagcgaaagaagctccagagtttggtaacagtctgtttgtctcattttctaatctgggtattacgataggggctgctatgggcgggtggtttatctctcacttgggaatacaccagctcatctggagcggattgatgtttgcactgctagcgtttttatctatgattataaaaataaaatggttcaattcgaatgcaacggaagtcaacgtgcgttaaaatatggagagatattagaagagtactctagaagatgatgaccataaaatgatgcatggggtgatgttgattgaatttcgtatggacttcgatcttaatgacattcgtaatcgttatcgggattttggcgttgctcatctggggagtgatatccttaattaagcgttttcgctaatcgcaatgaaggggtaggcatctctatgtacaggtgtaaccttgcatcaatacgttcaaattctcaattataacgggcatactcagcggtcagtagagcttttaaatgaggagattttagatttggaaggtacagggtaccggattatacatgctgaaccttatattcagatggcggaaacacttcttcatcagagcaatcctgtattagctcatgaatatctccagaaggcatacttgattggaagtgcaagagcatttcgggaccagcccaagctttatcaagaaatggcgaaaagtaaatctctggatgaacaggatatactacttcaatttgcggcgttggatgtgaacgccaaacttctaagcgatttagaggataatcaacaaccaatgtaatggtcctatacagtcctagacaaaatgccaatttggatacgtacagataatgggcttatcaattatttatgaggaggatgattgcattgaaattaaaagaagtgctcttaggcacacacagtttcgaagcgatgaaagctttttacggctctctcctggatttgcaggttgtagacgaggggccttcgcggttgtcgtttcaagtaggggaatcggttcttgcctttcaggaatcctcccacatagaaaatgggttttaccatattgcctttacgattccaacaaataaattcatagaggcaaaacagtgggccatcgaccgtgggatttcattgatttcaagaccccaagaagatgatgagttttttttcgaaaactggaatgcaacagcgctttatttctatgatccagatcataaccttgttgaattcattgcccaccatatactcgataatgcagtcgctgaagctttcggacccaactctatacttcgtataagtgagattggtcttccggtcgatgatgttccagaggtatctagaataattaccgaaacgttccaacttaattcatggggaggggctggacagaaattcgcgccgctaggggatgtagaaggttcctttatagtcatagacaagcaacggccttggtttcctgatgataggcttccgaccgtgttcagcatcagtgtcttgtttgaaggtccatactctgccattctttcactgcataatggtttgtatgaattgagatcagacggatagtgctccccatacccccggatttctggaataaagtttacgatggggtggaaatccggggatcataatacatacaggagagaatatatgaatattagactacttcattcaaatgaaaaatatccaatagagcttttgttactagctgatccatcgcaccaacttgttgaggaatatttaaaaagaggggagtgttatgtagcagagattgaccatcatattgttggggtctatgttcttttacctacaagacctgaaacagttgagttagtgaatatatcagtgtcagaaggtatgcatggtaaaggaataggcagacaattagtaacacatgcaattgaaacagccagggcacaaggttataaaacgatggaaatgggtacaggaaactctagcattgggcagttagctctctaccaaaaatgtgggttcagaattgttggtgtagatctagatttctttgtcagacacaactatttagaagaaatttatgagaatggcatacagtgtagagatatgattcgtatgtctcaggatttatagagcttaaattctttgcaagcccatcaaaggtatcttaagtaaggttctgaaaggtatatgatattgtgccaaaagatggtacaataaattgcggaaaggctatacaatcattggattgcaatagtccttttttaataagttgatatcctactaagttcctgataaggggtggttactttgtacaacacaacaaccacgatactcacagagataacaaaacatatgaaagataatgatttaatactaagtgatttagctagagaagccgaaatgaatccgggcaccatgagcagtattattaatgggaaccgcactctttcagtggatcagctagaccgaattacacaggcgatgaggcatcccgttggttattactatgaacgctatgtgtctgagtatttaacagaggctaatccgaattggcgtcgaatgagtccttttatacataattgtgcgaaattaaacaaactggactgcattcatgatgtggtcaatctattgatggacaagttgggttattcagaatccttatttgagcttgctgaagaattatttcatgaaaagatgtaccaagcggcagccatactttatgaaaatgtagctttaagtgagaaaaaacaatactcagaacgcctcgctatgtgtcagtaccgcttgttccatacgagacaaggagacaatcaagagaaaaattatgaggcggcagttcaatttgaaatatatgttgaacgactagatgagatagatcagttagaagcgttaaaagatttggcgaatacataccgttcgttacgtaaatgggacaaagtagaactgttcgctaaagctttgggagacaaagctaagattcaatacaaactggaacaacagcggcatcatatgaaaaaagaaaattcaaagaaaccaagttttcctctgtttgcttattgggcattctcacatttacttcgtacacaagcctgtggtgaaagaaaagattatgaacgggcgtcttatcatatcaaaaaatatgctgatttaagttgggttaaggctagtgatgaagaaacaatgaattggaaaaataagtatgaggattgggcggtagtaaatacgcacgtaaataagcttctttcaggcgaagagagcgtacttcccgagtatgtagcttatatttcttcaagaaaagatgaggttcttcccgcacttgataatatccttgaggcagctaatcgataccattttgatgtagatgatattctagagcaattcgaggaggatattttatcttatttggaacaacaaaaaatcgaaggcttttatactcaacgattcataacagagcgttttatacatttctctaaggaattatcggtctactttttgagcaaaggaagattttctgatggctttaaatttttattaagttgtttgggaaaatctaaattaagcaataataaatcgtatataattaaatgtatgcggctgtatgagtcttatcgagagtatgcatcaattgagataaagacagcatacagaaatttgattgttgaggtggatgagaatgaaatgtaaaataattctaacctttttaacaaccagctttatgttagtggcgatagcgactgcttccttacaattttatgatcaagggcctagttatcaaccaacatatcatggcgaaatgtaattctttctaacaggaaaagatacttgatatttaattcaattaaatggggcggaatattaaaccaaatggataatggaacaggttagatggaatgatccgtctagcctttttatttcctgttttgttgtatttaagcaatatgaggaaatcttattttgagaaatttatgtaaaaggtgcaaaaatgtaatgtgtgctgttgtaaacaactaaagggtatatggctttgttctaaaagacggtacaattatgggtgaaaaagtattttttccaactgtttctctattacatggtttaactatgtatcatatgcgagtcgacgttgaaagggtggtttattcatggaaatcacacttacgattgcagcagaattaaaggaatacctaatacaaaaaggcttgagtatgaccgagtttggacatatcattgatttgaatgtaggcacggttagcagtattgttactggaaatcgtattttatccgttaatcaattggatcgcattactaccgggatggaattaccatcagactatttttatgaacgttacattaaagaatgtattgaggaagaaccgctcaactggcgaagaattagtccttttttgttccgatgtgtggagcttgaccgagtcgattgcttgcagcgcgttgtattcctgttgctggataatccaatctatcctccattactctttgaagtagccgagaatatttacagagatggttacaaggaagcagcggccttcctttatgaaaatgtggccgagagtgaaaggcatcagcattcagaacgattggcggtttgccagtatcgattgtttatgcttcgtgttggagacgatcaagagaaaaactatgatgcagccgttcaatttgagccttacgttgaacggttagatgaggtagatcagttagaggcattaaaagacttggcgaatacataccgctcgttacgaaaatgggacaaattagaattattcgctaaagctcttggagataaggctaaaattcaatacaatttggaacaaaaacggcatcataagaataaagacaattcgaagaaacccaaatttcctttgtttgcgtattgggcattctcgcatttacttcgggcagaagcttgtgaaggaaggaaagactacgagcaagcacttcagcatacttattgcttacgccgatttgagttgggtgaatgctatagatgaaactgctttgaagtggaagaggcaatatgaagactgggcagtagtaaatacgtatgcaaataagcttctttctggtgataagggcgttcttctcaattatgtaaattatatttcttcaagaaaagaggaagttcttcccgcacttgataatatgcttgaagcggcaaatcgatatcattttgatgtagatgatattttaatacaatttgaaggagaaattatctcctttctggagcgaaaaaaagtggaagggttgtatactaaacgcttcataacggagcgatatactgatttctcaagagaattagcaatctatcttttgcgtaaagggaagtttttagacggttttacatttttgttcagttgtttggaaaggtccgctgaagttaataataaaatacaagcaattagatgtatgaggttgtttacacattttaaagaacatgcatctgctcacacgaaggaagtctatggaaatctgattaaagcggttaatgaagatgaagagtaggttgattccaccctcctagtatccagttttatgtcagtagcattagtgattatgatccaactggacaatatagacgaatgttggaataaaatagtctcaattataagatcacaatagacctagaaaattaactatgatcaagaggttagatggaattatccgtctagcctttttcatatcgtttgttttgctctacataaataagcttctagaagtgacttagcttggacttttatctgtaaaatgtttattcgatcattggaaggttatataatgtggaaagtagtatttaaataacaagacatattgcctattcccttcatttcccttatgataattgcactactaccaaagaaggagatacatatgaagaaagctattctactactattaatgtttgctatcttaattccatcacaagtattagcagcaaaagctacaaaagctatgtcaacaagtgaaatcgaaaaaatatactttgagaattacaaagatagtgtgaaggaaattagaattgcacaaaaaaaacttaatgctgttctgggggcagaagttcgtgagctaactcagagattaagtcaagcgtcagcgcgctacaaaaacgaagtgaaaaataaatctagtaaagtggtaatagctcaagccaaggctgattgtgataaattaaagaagcagctcggggtggctaaggtggcactaaacaaaacagttaaaaattataaaaaagaaagcgaacaagcattaaaggatattgcaaaacagaaagcagagcttataaaattcattaagaatcacacagcaggaaaagataaacttactgagtctcaatttagcaaacaagttaatggaggtattatgtcgattgacggctcatttactggcattttaaaaatgttgacggaagctgaataatggtgagtaaaggcagcaggtatcacctgttgtctttttaatttaggcttagaatggaagtccttgttggagactttggattgctgtgaaatggggacaaagaggatatatggatatggatgaaataaatttgttcgtttttatataatgaagtacgattagcgaggagaaaaatgtatgaatcgtaagtttttatcatggctttaataagaggtattttcgggtatttcccttgtgggctgggagttgcagtattattggaggcttatagcagatatagtctaagaggttttttaattggagctacatttttccttatcgggggattagtgctttacttcacaagacgctatgaatcatcagattggttactttagataaagcaaatattacattagaaggagtatatgatgttatcaccaaaacaagaaaagagccttagtaaatttatgagtaaaattcttaggcatacaccagagcagtttggaattaagttggaccatgaaggttattgccacgtgcaagacttgatttcagcaattaaatcagagaatagatggtcggatataggaaaagcagggattgatcaagtcgtaactaattgtccaaagaagcgataccacatggtaaatggatacatacgagcgaactacgggcacagtgcaggaagattagattacaaagaatccattccgccaactgctctttatcacggaacaaatagcaaagtagttgataaaattattaccgagggaattaaatcaatgggaagaaaatatgttcatctatctgagacacttgaatttgcaacattggcaggtaagagacgtggtgaattagtcattcttgaagtcgatacagtaaaagcgctggataataatgtgaagttctatatcgctaacaatggtgtttggcttgccgattttgtgccaccacaatattttaaaaaaatttaacactgatattttcgtttatattataaagtcagttgcattacttgaatctgttagtgaatctattattctataaaattggatgctatcaaaagagtgaagtcaaataatttactttgccaggcatttatacaatacttttgacatagtaaatccgtttatatcagtccatttgtcatataatataaaaggaaatttcaggataacaggtggatatccctaaacatctccttctgataagattatttccatctaaattaaaatggacgtgatcaattggggagaatattggttccacctgataagctaatggaagtggctgaccagttcttgcatggtaaacacgaaatggaacgtatgttgaatttactgaatggaagaattgattttgtccaacaaggttggtctggtgctacccgagagaggtttttccaagattttcaggtctctagacaatccatgggcgtgacacttgaacgactttctacggttgcacaagaactcatttttatttcaaaaaacttcacacagttagatggagaaaaagttgtactggatgtgccagggaatggtatgcctgttaaaacggcatcaagcggcgaaggttggctacataaaatttttgaacagatcggaaaagcggagatcaccaaggctgaagcccagatggaagctagcaagcttcaaggagaaattctgtgggatactgctcagggagcgaaaggtgctattcaggaagatttaaccttggggatgctgcctgacaaagaccgtgactatgatcatccaatggcagctaaagtaggtgaaattcttggtcacgtagctacaacattgcagggagctggtgaggtaatcgttggaacaggtggagaaggattatcagttgctgtttcatccacgggagttggtagtattatcggaatacctggattgattggctcagcagctttagcggcacatggaggtacaaccgcagttaaaggcgcaagcggaatagggaagagctcagcggaattgtggcagatggcgaaaggagaaggtggaggttcagctaaacagacacttacttccaacaagggaacgtcgatagatgttactccttcatcaaatcatacaagtacgacaacgaatccacatccagctaaaggtgaacataactcatcaattgatattctggataaaaatacaggtgagataaaaacaagaagatattatgatgaaaatggaagggctacacgcgatgtagactacacgaatcatggaaattcaaagcagcatccagagtggcctcatgaacatgtttttgaatggaaagaagatgggacatttaaaagagttaacaagaagtaggagggactgttttggaatacaatgaattggtggaacgttttgaaatgggagaagagtttcagttctactataaaaatgatagctattggattagccagaatgaagaagagtactttcttactcgtgaaagggacagtttttcgcaatcatttgaatcagcaagagagttgttcattaatgggaagattgatgataagactattctagagttgtgggatagcatagagatttaaaaaagtacaatttgagcctgctccttaacaataaaaacgggagtgggcctttctacatagttagccaatctgactaaaggaggatgaaatttacaaccaccttgcttcaaacgaaggtgcgtcaaattcaaattaccatgccccaatatcaaacattacaagttgttgagctaggataagggaatcaagcagatgaacaaaatgcccatctaaaagatattaccgatattgttaaggaactcggtatcacgaaacaacagctacataactataaaaactcctaaagttgattcctgagttacaggatatgtttgaagatcaggagttgaaagcgatgactacaagcttgtggtcataggtataaagttatcttatttcacataacaattaggaattaagttcgttttccataaatcggaataatgttactatgtcttaacgaactcaaacagaggtatattataacaacaattaaagtgacacctgagcagcttatgactgtctccaaacagttagagttagcacagcaaacggcaactcaaatgaatagtaatttagtacaacaaatttcatctatggggcaattgtgggaaggactaactaaagagcacttatactattccttccaaacctctcagaataatatggatgatttgttaccttgacggattctattgctagggaattacgtcaccatgcagataaattcagattagcagatctgatggaagcaggtaacattgacgcaagttgtttaccacctccaccgaattcatgtgctgttcctgctccagatacacggaatgcgttccaaaaatcagtagatagcttaactgaactaggccaggattttgtagacgctaactcagtacgctatgagaaaaagtttgattcagtctggagctttctagattatatgtcatatggtattccaaaaggaatataccaagggtacatggaacgggcagctaaacaaaacgattcatggaatgacatgctcaatttcggtacatttggagtaacaggtatgattcaaggcgcatttaatccaaacaatgcctggtcaaaggaacactgggctaatatgatcggtacagctggattatttggaggagttagttcagtaatcaagcctaaaatgggttgaaatcatctattaagtatgagattccgaagaataatacgaattcgaaattgcgtaattcaatagaatctgaacctaaaacagaagtacaaacaggtggaagaaacgatctttcaattgatgaatattttcgtagagaagctgaagcagatgagatgtatgatcaaatcagagcgtctgatagtgatgtaagagcaatagctgaaaattctggaatgaaggaaagtagagttcaaagaatcaaagaacacgttttcataaatgaacatataaagtcgagtggttatggcagatttcattctgattacgaaatagctcaagcatgggatagattacaaaaaggattacaaacagaaaaagatatggatttgcttaatcatgaattgtctgaatccagatttgagggtatatttaaaacagactatgagactgctcataaagctgcggtaaggtcgggtcgtccatgggaaatagaatagaggagttttataatgggagcatttgttttactttttaaagagcatgaggatgagaatgtagttatttatagatatggcccaaatgaacacattatggggaaaattcaattgaacaaagagactaagctattctctgaaattgaacctttaccagatccgagtcattcaaataaattttattttgatagggcttcacagcggatggcacgttgcttcgttaaagaaggtggtatatttcccgaaaagttgacatttgaatcataaagtagcttcaataatacgaaccgagcttgctcctttaacagtaaaatgggagcaagcttttttcatagtaatttatctgataaagaagataatttgcatgcacctaagaattaagaggcgggtttaaacaggagagtcttcaatcaggctactaacttagcgatatgggtaaagtatacggaaggtgcgtgaatgttatgaagtatgatacattcttaaaattatgggaagaacaaaatagtctaatgagactattgttctgtgaaaataaagtgttagactgaaaaacaaagcattagaccatgaaaaataaagttgtagaatggcagccggcattagccaacgggcaggataacgcaaccattagatggacttatggttctcatataatacaatttatcccagaagtatcttcgcgggttcatgaaaagcagcggtgatgaactaataggagaccaacacaaaaaagtggtagttttatggatatgcaatagtttactatagggtcttattcctcggttcgtctaaccgattgtaacggagacttcatgaagtgcctggagagatgaaaataaaagtgttgcctgacaatggacagagcgggactggaagagcgaaagtggagtggcaaagcccataagcgtaggtcacagctcataatacgaacggagaactattgcttaaccaagatattactggaaagtgcggaggataatttggatcgcaattcgctggaatcgagtggagattcacttcgcagacaactggtggcactacgcgccgaatggaacttggtactaaaaggaggggcaggacacatgcaagaagaacaggaaatattcgcgggcgacggatataacaggtcgtacgcaatggctacgggtatgccgattctgaatcttaggggtagcataccgcgtgaaagtaacggccaactaccgtttccgtgggtgacaacgggcatcaggattgataaagaacagatgttggaaaccgttatgaagcaaaagacactcgagtatttgtttaatatgcaattcagtaaggaggaaatgaccgaccgcaatttggttgtaggctgttatgaatacaggaatccaaatgacaaggaacaaataatgctatatgcgctggtttcgttgaaggaatttctcgcgagatacggcaatgaacgggcattggagattctgatgcgagttggctgcacatacgagaagattatggaggaatgtgatgaagccattaaagaacactttgcagtgttgcgccggtcacttcatttaaagaatttgagggacaaatatgatgtcgtttacgagtggagtgaagaggaaggggtaaagacgtacataatcagatacaccaaatcgagttatacgaagattaaagctaaatcattcgaagagttgaccaaactctatgatgagcaacggaagaaggatgcgaagaagacgttcgcgactctggaaccgttagaagcatttatgcaagcctaagaaaaccgccctttacggggcgattattcaacatttcatcgaacgaagattcgaggaatatccagcgatagagaggattctcgacagtcgcatcggaaagtgctgacccgtacgccagatatggtcgaatggggactgatggaagacgttgatccagccgattatttcggcaaaaccatagaggtagaacgatttaaggcgattggaagcctagcgattcaggaagaatttatcgcctcggtgtgtttcttactgacggcaatccgatcggcagcatcgaaacggttgtagatatcaacggagatggcatgttctcgctccccagtggcaagctgctgcagagtataagtggcaattccttcgaggcgtggcagcgcgactggctggatcggtacggcggatgacaagaacctcatcttgtatcaaataaactttatcaaaacagccagtcttatcacatgaaataattttgcactacttgttacgctaacagagaacgttagttcaataaacgagcggcagtctaggactttattttcaggtccttgactgccgctcgttttatatttgggtcagtctaaatctttattttcatcggacaactattagagaggagggatttaagaatcagaaattttttatcatggatttgataagaggtattttcggtattttcattgtgggctgggacttgcaaaaatattgaggcttataacagatacagtctaagaggttttttttaattggagctacatctttccttgtcggaggtttgggactttacttcacaaggcgctatgaatcatcggataggttattatagatagacaaatattttattaaaggagtatacaatgttaacaccaaaacaagaagagagcctcagtaagtttatgagtaagattctgagacatacaccagaacagtttggtttgagctagaccatgagggttattgtgacatccaagacctgattcaagggataagatcagagaatagatgggccgatgttagtgagttgggtatcaagcaagtagtaaaccattgtggtacataagagctaattatggtcacagtacagacaggttagattataaagaggctactccaccaaccattctctatcatggtacaaacacaaaggtaatccataatattttcaatgaaggaattaagccaatgggtagaaagtgtgtacatctgtcggaatcccttgagtttgcaattttagcaggcaaaagacgtggggaactagtgatcctcgaagtagacacagaaaaggcattagccaatcaagtaaagttttataaagccaatcatgatgtttggcttgccgaccttatatccccacagtacttaaagaagcttgaataaagtgtaaacctagaacattaacgatgataaagggactagatggaatgattcgtctagtctttttgatatagcatgtttgctatacataaataatcctcctaaaattttgaacgtatccacgggcgtccacacttacccgaaaatgctgcataaaatatcccgggtgaacaaagaggaggtgcatgtaataaccatgatacacatggaacccgtacaagtgggtgagcatacatttatcggagtcgaagttaaactgcctaaaacaacgctgctgactatctccaactcccgtggttacatcatgtgtggtgcgtctaaggtgtatcgaatttgaggtagtaaaattttccgctgtttaagccgtaaagtcaaacgggacaagctttcatagcaattttcaatttactgatctgtactgatttattctattaaaatcttataaatgacggaattttgtgaccgcatttgtgaccttttggagaaggacaagcatgtgactgtgcattgcatttccgttataatccttcaaagaataattatacgccccatcatctactccttttaatgaggcttggctatactgaataattttatcttgctctttaaaaataccttgcattggtttcgtccttaaaaacaacttgtgtactaactaagggagctttacctatttaagttttaactgaataaatttcagatggtttgtatccttgaatttttacaagataatcgaaaactttgttttgagtatcacttttagtgtaactactaagcatccaaacacttgcgaatatcttactataaagattgctattccatattttatcataactatctcctttgttggagcaagctaaagtggcgctaccaatgacgaaatattttgcttcgaaccgtcacttaagaaaaggagccattgcgatttggacagcttcttttgctttggagttattcaaagaatctacttatttcctcttatacataaaaaagtaattgtatacaccactccagcaaagaggcttagtagaaacgaggttgataatgttctgaaaataaaagtagaagtgggtaccgtataaaattcaaacataccgttgatcggagtactcgttgttgttggccctttaataaaggaatagtatattcctacaaaaaaaccgtaagacaaatacttaattagatttttttcaaatttactcatttgttagcctccaataatatttttggaaaagaagaattcttgtactatgaagccattcaaagtaatgtaggaaaagtctagaaatatagcgatcttaaaaatctttggtaaggatgtttattgatattatgtcaattatattgttttaaatcaataaaaaggaataatgatgtaatcatcattactcaatctttggtgttagccctatggataaaacccctgaaactctaggtacacagcgtctaacattaacattacgttaaatccagtcatatcaaggcttatgacagtttgtcaaaagtataaggaaaagaaaacttcttataatcaggaattttattcttttttcttcgtgattcactaaacctggaatgatcaataaaatgtacaacatataaacttaaaaaattggtctaggctctgtgcatgtctatgtgaagcaaaggttacaaagaggaaggcaaaacaagaaggaatgtgtatacaggagtcaagaagagttatcccccatgaatatgaagctattcgcctagcaatagacgtttctttgttaacaatttactatacttatccaaaatatatggtaaattatccctatatgttgtattataagatagtgtgaaaaagagccaaagtagctaaggaggaacattgttgtctatatttgtgatagtgtgtgtcgttgttttattgattgctttggtgttgctacgcttatttaagaagcctagagttcaggaaccgtataaagtaacgcagaatattgacccttataaaattggcattaacgaaatagaccgtatggaggatggcaaggactttgaaatgtatctgttcaggctgttccagtgtttaggctatggtgatgcgtataaaacacaagacagtagagattttggaacagatttggtatttacggacagagagggctaccgtaatgtcattcaggctaaacggtatgcaataagcaatcctgttggtttgagcgcagttcaggaagtgtatagttctatgcgattttacagagctaagaaatctattgtcattacttcaagcaaatacacaacttcgtgtgaacagttagccagttataatggagtaaagctgttggatcgcaacgatttaattaaaatgattgagctattcaaagaacaacagcacagcaaggtaaaagatataattgaagcagagccatacttgagtttggattcatgggatgattataggaataacagtaaagtgattaaaatggatcgcaaggctgaaaagcttatcgcttcaggtaactagatactggagactcctgtagtaaaacgatgattttatatttaacgaagaaattttaaaattcctgtctcaaaaggggcaaatgatgtgaaaatttctcaggtagataagcgtgagtggtacaataacttgtgggttcgattacttgttttatttgctgttatttttatcgtagatttggtcagtaaaaaagataagcctgatgctactaaaccagttcaaactgaggtgaagcatgtaacatctaaaactgaagatatccccaaagatgctaaggtaacagcagaccctttatcaacattaccagcagatgaaacagtgtttaaagaatatatatcttacgctactggaaacccatttataaagagtgtttcaattaaagacaataatgttttgattttatactatggcagttattcagattataaagaggataagcctgatagtttggtgaagaacgaagattacagtaatcaccttgggacagaaaatgcaattcaaaaaatattagttggtgaaagtgctaggttattacgccagtttcacgatttaaatgctgtctcaatgatcttgccattcgatgggaaaacatattcaattgatgtggatagaaatagcctgaataaattcttgggatataaaattgaaagcttgagtataaaagatgggacttggaacgataaattttctgatccatacatctatgataaatccaatcggcagaaattctttgacacattcgttaaaattaattaattgtaagggcgtgggcaaccacgtcttttttgttttctatttatagtataatgaacattataagatagattaaaggagtagcttcatatatgaatcaaaaccagcatcacacaatgacctacacgttaaatagcggtattaaaggaacaatccaactatccactaaacaaatacaagactggatagaatcatatcgtgtaggaagtaagtatgtgactacagtgggtaaacaatattttggtttaaaccctgagttggtagcagattttaaggtacataatgaatactcagagcaaagagaacatatagcagtgatacagcaatttacagtagcaagtaaagccagtgaacagttagcagatgcatacagtcagtatagaacattaattcaggtagaatgtaaatgtggagcttcttatgttgaggagtcagcgtacaagaggaacaaatggggctgtaaagagtgtggcgagattgtattcttggatagcaagaagcgtatggtggatacgattaaggggaaagcgtggtatatgaccaacaggtattttgttgagcaactgacatgtgtcggttgctctttttatattaacccaaataaggaacatagactaattgactaataataagtgcgtatatgtctatttattctttaaaattaacatataaggtttaaatagattttaatgttgataaataggggaaaataggtaatattatctcgtgtaacattttcaaaaaaattcatatcaagaaagggattgaagaggatagagttggaaaccaaaagctaggtttaaataaaaatgtgtcggaaagtgtttatgataatgcaatttatgattacactattatagccgaagattatgtttacaaatatgaagaggctcccgataaagctccagaacttactattgaaaagccagatgttaaatacttaactgaaggtcaaaacgacagaatcaatactttagcttataatattggggatggtattgggggtagacagaatatagtcaaaaatggaagctacctatctactttgttaagacttccacttgattcacaagttggtgaagagacagctgcctataactattctggattctcttcaggtgcatacgaagcaggcatgggactagtctatgattctagtgttggtttaggtttagctgaaaagggatggaaaccaactatggttgtggaaaaaaggtaaagtaggcagtcctgctaaatttattgcaggctatgcagatgtacaaggtgcaaatgcatacttaccaaattccgatgtgaatttgtatatatggtataacgatggtggtaaagtaaggatgaagattaatggtacagcaacttgtttaaatcagtcctgtagtagcagtaaagagactcccttaatttctattatggaaactaatgatagtctcggccttaatagcgtcgatcaatggaagcttctatcaacggttgtttcaaaagatgatagaggacggaataaagctacctattcaagtattaaagtagacggtgcctcagtcccaagtagtgcctttagtgctccgcttactgattttgctaacatccaacgcgatggtaataacactgtcactataactgtaaaaggaagtaattactaatgaaaaggaatctttttataatgtttttaattctattaatagcaggagttttttctggagcgatttatgctgaagaggtatccaaacttaaagtatacgttaataatgagaaacttgattctgaaacttttatttcctattctggagtggcaatggttccatttcgtgatatcttcgcaagatatgatatggaagtgaaatgggataacgcacaaaaaacagtaacggcctcaagtaaggacggttccaatgtaataaaattgactcaggatagtaatgatggttatgtgaataataaaaagtataatttgacgcaatccccggctttagttaatggagttttatatgtgaaccttaggttcattagtgaatcgataggtgcgaaagtgaattatgataaaccatcactttctgtatacataactctccctaaagctgcaaaagaatagagactttgccccggtaaatattccggggttattttttgttttgaattaatataaagaaataaacagttataaacaaatagctggacagtcagtgtttgagattggacgacgattgaaacatgttaaggaaaatgttctagcgcatggcgagtttggaaaatggtataaagattcagtagatataacttggcagacagcagacagatatattcgctcatataatcaatttggaaattacacgacatcgttcaatctgccgataggtaaaatgttcgaaatgttatctttacccgattccattgatcgtctggagtttgttgagcagaagcatactgtcccatcgacaggtgagacgaaaaccttgaagaaatgactgtgcgagaggttagagaggttaagctgagtttcttctattatgtagaaccaacttgatagagttaaaaaacatgaaaatatgtcatccactccgcgattcttgttacgtttcacgatacgattgagctacgatacgaaatgcagataaataaagtgttttctaatttttgattttaaacaatttaatttataaaaatacaataatcccttaatccatcaagtttttttgaacattttcctccgatacatacgattgaaatcacgatgttgatcatatttacccaaagtccttatcccatctacattttgctatattttgatacggcaacgatgtaaatatattatggtacaattttgaaccacaatgactcaaaaaatcatatagaatatagtatttatgcacatattatcaattttgacgattgagcttttgataagggggtagttacaggctatctctacagtgcctccaaagttggtgataccctcatatgcttgacacagcgtcaacttcctatcctctttactgagaacatcaaaatattactttcaaactatgattacaaatgtgttaaaaaaagattgagcaatttgacttttgtagaattcatacatataatttgaatatattggttagggaattttatctaataatatgaaatcaaaaccatatttaattaaatagagagattttagttacatataattaattaaaatccattttaaacctacatgttatattcatatgcttgaaatcttcgttagttactttttttgtcaacaactagcgcaaaaaaagtttctatccagtttatttgctaattggcaatcccactggaaaagatggagatggatatcaaattcaaatttctggaaatgtttatacaagttaatttaatggagggtgaggacagaagtgaaggctaaattaaaatttttggggttggctgcccttactgttacgtttgctgtagttattagtaataatgtttttgctagtgatgatacttcagaagaaatggagagcgttacaaaagcagtagtccctgatagtgtattagaaggacttaatcaccctgataaaatttatactaaagatggattatttataaaaaaaccgcaatctatccatgatgaagataagttcagtcaagatgaagtagtctacgatggttcaaagactacgaacaaaacaaaagtgatcattcaatatgatgctacttatatcaaggaagaagacagtaaataggtttgtgtactaaagcatttgaaaagttaagttatataattggaatatctagggcgacttcggttgcctttttattatgctcaatttagccaaggtcttttccaaaactatgtcataaagtataccttttgcaataatggtctgaggcatgtcaaaagtatttatgatacatgtcaaatagtatgcatataatttcgaaatatttcatatgtaaatatatacattttgacatagttaatcaatgacatagtaaaggatgatccatatgagcgagattagacactatggttacataagagtatcgacgaaagatattacgcacgagataggcgcacacattgttattcttgatatgcctatccttgatactagacaataccataatggcttggagaaagttatatccagtattgtgcttgaattactcagctacatggcagaacgtgaacgtgagaagataaacggtagacaatctgaaggtatagcagcagcaaaaaataatggtgtggtatttggtcggcctaaacaggctataagtgatgccttcattgcggtttataaggaatggaaggacggcagcataacagcagttgaagcaatgaagcgtgtagaaatgaagcctaacacattctatcgtagagttaaagaatatgagcaacagaaacaagtaggataaattgttcatgtgtatggagccaggatgattatgtctaggtttctttgttatgtctgctgatcaaatactagcaggtacaataaaaaggacgggggggtattttacatcataaacgtctatttaatttctaaaattgcccctagcacattcactttcacactcaagttattttttgactcgataccgtccctaatatcattaaagttgcttgtatgtcatacatccaatctaggctcaattcatagattaaaacacaagggaatgcgaacctggctattaatctggtaactttgtattggatgagttgtgttctaatttttcaaataaactatacatcaacataaagacgatatccttaattatgaaatcatcgcaactatcccaaaaggtatcttgagtactatatgaaaggtatatgattttataccaaaagatggtacaatcaagatcgctagaacattttactacttgtttcacaactacataataattttaactattcatcgtattgttagtctacgttgaaagggtggtttatagatgaaaattacacccacgattagagcagaattggaacaatttctacaacaagaaggcttaacattatcgcaatttggacaaatcgcagggatgaataggggaataataagtagcattgtcacaggtaataagtctatgtctattaatcagcttgatcgaattactgaagctatgggcttaccagaaggtcacttttatgatctatttatagaaaattacattattgaccatcctcctaatatgaggcgaattgaaccgtttttatatcgctgtgcggagttggaaaagttggatgcgatccgtcgagtggtgggagccatcatggacaatctactctattcgcccaagctattcgaaattgcagaaggattattggcacagggacggcatggggctgcattgatattatatgagggagtagctgaagcggagaaatatcaacattctgagcgtctagccatctgccaatatcgcatatttaagattcagattggaaatgaccaagaaaagaattttcaatcagcgctccaatttgagccatttgtcaaacgtcttgatgctatagaccagttagatgccattgtagatttggctaatgtataccgatctttgcgtaaatgggaacgggttgaggaagttgctaaagacttaagagctttaggcaaagcgcaatattctatagcacagtctcttaaaagagaacaaattaagaagcctttgcgaccgttatttttttatatagcattcagtagttcacttattggtggggctaactatgagcaaggaaactatgagttagcactgcaagcagcctatgaatctgttgatttagaatgggtgaaagaaactgataaagaaacaaaacactggaaaaacttatttcaggagtggggtgagactaatgtgtgcctgagcaagctcatggctggaaatagagaggtacttcctgcatatgctgatctcattacaagaacgaaagatgagattctcccgggtctatggaacattatgatcgcagccaatcgctatagcatggacgtagatgatattctgaatcgatttgagtgtgaaatttcaaacttacatgatcatacaagaatacaaaccaatgatcagcaaaatattaataatcagctagttggcgtattgagtgaattggctgaatattgtttatccagaggccagtacgaaaagggagttcggttcttattagatggtatgaggaaatcaattataattaatgatgaacgctcaatccttcgttacaggataattgtcgaacgttatcagaaatttgtcctagctgaagccaagacggagtatcataatttagaaagctatgcacgacgactttcttattagtattagttataagtacacaaacaacgagtagtcaagttaactataccatcggcagctcaaagtggttggtttcaagtttagggctggcatataggaagttagcacgtttgtataaatagtatggagcgtttgttcgaaagaagaatattaagtcacaattaagggttagacgggattgcccgtttagccttttttgtatgttagggaatgattggggggtgaaaatacgaggaattgaaattatttacttggggttcgtctctaagttgtagaaaaacaccggtgccgataatgacaaaacttagtaattgtttggcaccactgcgtattaagatctaagtaaggttagattttgaactggttatctaccataactaaatgtgaagccttggctaattgcttttctcatatggttattaactcctagattatagcccaagaccgccagagaaactccaccggattgtgtttctacagtatcaaccacagcagttccagtaatttggaccctttgagtagggaatttaccagttgtagaaatggtattagcatgtgtattctccaaactccaagaaccatcactaactggtgcccaatatgtttccagaaaattcgaaatctcaccaaatgaaccactactatatactgatattacctaatataatccataaattacaaatcaatcctgatatacagtacgtgtttcgtagccgtttgtagtaatatcctgtggtttaatcgttttactttctttcaactcgcctacagtgtaaatcacattccctgactcttttcagtaacatttatttctacttctttttcattttcccttctttgaatatcatatttatcagaactgtaaggtagatcaacataaagagtattgatctgaatatactgtgtaggtgcctcgcttgctttcgcttgttctcctagtattccagagaaacatgctaaaaaacaataaaactcattagaactgcgggtaatgcctttttagattttaatattttaaattaattccagaaaatagaatttattaacgacctcgttatagcactatatgaaataattgtaaacaaataataaaaatgatatgttattgtaaacaattgactggaggtgtgctggatggatataggtgaattagtacagtatttaaatcggatgagttctagcattagtgaaataggggataaaactagttcaggtttacaggacattgaaactagattgagcaacttagatagcactcttactatgactaatgttttactcatcgtactaattattgttattgccataaatacatttctaaaatggaaaaattcggagaattaattatcagctcattaaatatgttcatacatgaatgctcctatacatgccagaaagttgcggcgatctggttaggggcatattcttatggattgagtatagaagctactagtacatgaaaaagaatacgagcctaaaacacaattaagtattgctcaagaaattagcacaaccaagcaacaactacataattataaaaacttctaacactcatttctgagttttaggatatggttttcgttacaactataaggcctttagacgtaggtagaaaggttaatccttcacataacaattaggaattaagatggttttccataaatttgaatagtgttattatgtcataacgaactcaaactagaggtatattatgacaaccattaaagtgacaccagaacagcttatgtctgtctccaagcagtttgagttagcacagcaaacggcaactcaaatgaatagtaacttagtacaacaaatttcatctatggggcaattgtgggaaggactgactaaagagcacttttactattccttccaaacctctcagaagaatatgaatgactttgttaccttgacggattctattgctagggaattacgtcaccatgcagataaattcagattagcagatttgatggaagcaggtaacattgacgcaagttgtttaccacctccaccgaattcatgtgctgttcctgctccagatacacgaaatgcattccagaaatcagtagatagcttaactgaactaggtcaggattttgtagacgctaattcagtgcgctatgagaaaaagtttgattcagtttggagcttcttagattatatgtcctatggtattccaaaaggaatgtatcaaggatacatggaacgggcagctaaacaaaacgattcatggaatgacatgctcaatttcggtacatttggagtaacgggtatgattcagggagcatttaatcctaccaatgcgtggtcaaaggaacactgggctaatatgatcggtactgctggattacttggaggagttagttcagtaattaaacctaaaattgggttatcggggtctgtaaaatatactccgttaaaagatggaactacccgaataatagaaggtgcggacaatacaagaaaaattatagatactaatggcctgcgtaatgaagtgcctttaactgaagcacaaattggaagtttaactcagtatgcaaaaaaataggaatgccagaagaaaatatccgtgtagcggggcctaatgatacttctcctacaggattattattcgatacgattcttaatataaataatgatgtacttccttctaatgccacaggtaaattagcagctaatagccggattactggtcatggaacaatagctcatgaagttgtcgggcattatgaagcaggactagccggaaaaacctttcaagttatggatgatgaatttaatgttataactaggaactttgcacttgacgaagctcaagcaagtatccgagctgcaagatttgctcctgacttgactcaattagaaagaatcatgcttttaagagatggaattactagattaaaaaacgaaggtatcaaaattagggaagttaaagatacactgttcatacatgaacgttagttagaatggagatgttcttttggagattatgaagttagacgatatcattaaaacacccaataaaggaattattttagttggaacaaatattgaattagataagccggattataccaatttgaaaagtttgataggttcaaaaatacaagtagataagttagatgggacgaaatgtgaactggacgtattggatattagcatttctttttccattgctaaccttccactcattggtattagtgtaaagaattcggaaaatattaaagatataaaaaaggggacaaaagtagtgcaattactgtagatttataatgtattgcgattttcataaaataaattaaggcatctgaaaaagtggagtatgcgaatcgcatactcctatctttatttatagtgttgtaaatataaacaatgaacttacgcctacaaaatatttaaacaactaaacgaaaagaacattgtactgaattttgcccaaagttaggaggccccctcgagttatagttattcaccatgatattttgaacgtatccacgagcgtccacacttacccggaaatgctgcataaaatatcccgggtgaacaaagaggaggtgcatgtaataaccatgatacacatggaaaccgtacaagtgggtgagcatacatttatcggagtcgaagtcaaactgcctaaaacaacgctgctgactatctccaactcccgtggttacatcatgtgtggtgcactggatgttggactgctcaatgagcggctggcggatcggaaaattcttgccgcacgagctgtgggggtaaaaacgctgaaagaattgttggaagcgccgatggaatcggtgacgacagaagcggagcagctggggattaagccggggatgccaggctacgaagcattattgaaactggtgtaatgaagcctatgtgcatatgttgcataaaagtagaggaacaagaaccgaaaaaaaccggactttttggctccggtttttttctatgaaaagttctattctatcgagaagaattctttgaattatatacgaactatatgatctgtaagaacaattattcggcaaacaaattggtcaggctctcgttaaagggtgcttgcacaattcctttttcggtaatgatggcggtaatgtactcatgaggtgtaacgtcgaaagctgggttgtagactttgatgccctgcggggcggtccttttaccaaagctttcggtaacttcctccgcagaacgctcctcgatcggaatatctgtgcctgttgcggtctgcaaatcaatggtagatagtggggaagcgacataaaaaggaatgccatgcgccttcgctagcacagctagactgtaggtgccgattttgttggccacatctccattagcagcgactctatctgtgccgacaataacggcctgtacccatcctttggacatcaccatgcccgccatattgtcacagagcagggtgacatcaatgcctgcctgctgaagctcgaaagcggtcagccgcgcaccttgcagcacagggcgggtttcgtcggcaaatactttgaggtggatgccgttctcctgcgcaaggtacatcggcgcgagcgctgttccgtatttggctgtcgccaatccgcctgcattgcagtgagtgagtacgcccatcccgtcctcgaacagaggtaaagcatggatgccgatctggcgacatacttcttcatcctctgcctgaatggctatggcttcacgctccagcccggcattccagtcttcgacctggcctccgccagcttcaacgatgagttccccggcccgcttcttcatgcggtccagagcccagaacaggttcacggctgtcggccgtgaggtagccaaatgtccgcacacggcatgtacatgctccagccacccagcagcgtcggtgccgtcgtaggcggtagctcccagcacaacgccgtaggccgcagccatcccgatggcgggcgcaccgcgtaccttcatggtatgtatgccatcccatacttcatcgaccgtgaataaatccagcatgacaatcgtttcgggtagcaggcgctgatccagcatggacaaatggttacctttccacaccagcgaagatagagcctgcctggacactgcagctttcccggaggttacgggtgccgaatcttttttttcactcatattcattaagctcctttagtttgggcagctgttgctgtccgaacaatgtctcccagttcccgaatcgaatgaagctcgcgattgcgaagaaccaaggatttaccgatagataacgccagacgttccgcagcttccttgatagcaggatcggcaatggtgtcgatatctgccacatgcgacaggctgatgatacggcgaatcactttgcaccctgcaaaaccaatcgtatcttgcagcactttctggagatacaagtcctgatatccagctgtacgtgccatatggtcggtgacatgctcgtcccacagtttacggaacctaccctcaaactgctcccatacctgaatggcagtctctagaagccagtcacgtctttcctttagagctttctcgccagaggtccatccgggctgagctgcgtagttcaacagcagattggcgatcaccgctccgatatcaaagcccatgggtccgtagtaggcaaattcagggtcaatgactttagtcgattcggtcgttacgaaaatgctgccagtatgaaggtcaccgtgcagaagcgcttctgtccgcgtcaaaaacttttctcgcagcaatgccacttccaggtgaagcacttgatctgtacgtaatgcctctgcttcgtcttcgatgtaggcaccatagttgttattgtctgagaaccgatacggttcatccagaatcagatcttcagttattttgcagagatctgggttgataaagcgcttaaccagatcttttttgtcctgctgattcatgcccaaatctgaggtgaagaagagcgtgcgtgctagaaactccccaatatgattagcgaaatatggataggtgtttccttctattagtcccttgcgcatgatggtgtgtgagctaagatcctccatcacggtcaacgcaagctcatcgtcatacgccagtaccgcaggaaccaatttggggcaaatatggtgttcctgctgaagtgcctcgcgttcaatacgggcacgatccagtgaaagcggccaggattcacccacaatttttacatagggaagtgcctgcttggcaatgatactcttgttagattcagaatccgtaatgtgaaaaaccagatttaagttaccatcaccgatttctcggcattccagacgggcatcctgactaaaaaatccggggatgttcttcacgaattcgattgcttcttcggtcgttaaaggatgatattgggacaacgaagtcacctccataaattgtgcgcatgtaaatagttcaaaaaatatcacaagattaaaccaagtattttgataggatagagaaagtataacgaaaatcattgaagttttgtacattttttttatggggattgaaagaggaagaaaggagtactcttctttttgtttcgactccgtatagagagggtaaatatgagacagacgtccggcaggtgatattaggatgcccgctggcgtcttaccgtcagcaatgacggtgatggatacgtaaacgttcctgaaaatcaatttgatgaaaaaggaagggatttatgatggctaaaacaacaagtaactcgaaaaatacgcaaaccaaatcggtggaagaacttttaaaccgtcaagtcgctaacctcaatgtgttatatgtaaaaattcataactatcactggtatgtgaaaggctccagtttctacacactccatgttaaatttgaagagttatacaatgaagtgacattgaaaatggatgagatcgcggagcgtttgctcgcgttgaaaggttctccttccgcaacgttgaaggaatacctggagctgtcgtcgattcaggaagcaaacggcaacgaagatgctcccaagatggtacaaaccttgatcgaggattttgcaactgtatgcgaggagtttcaggaaggtatcgaactggcggaaagcaattccgaccagccaactgcagatttgctgatcggttataaagcggatctggagaaacatatgtggatgcttcgctcttatttgggctaattgtcagaatttcgattcatcacttatgtctagttcggtgaatttaattccactccatagtgatggggttacgcgctgaaataaaccctttacatgtaaaacgctactgacgtcatgctgtcagtagcgtttttatggctgaaaagagatcatgcatctcatgtttttagtacaaatttataataatatggccattcgtaggatatattttgccatttgtgtgcttggtagggtgaacattttatgaagaaagttggataacgtgtgtctgttggttgcacccttcaagatatttattataaaatagcttgagaatcattgagaatcagtttagaatgattataaataaatttttaaatattatgtttgcttgaaatcagggggctcccctgtttaaatatactttctgatttcgacaccacactacattttttggagggtattgcgaatatggctacaaactttaagattgaaggtctcaaagcgaccattgaaggcaaggaaattttgaaaggtattaaccttgaaatgaagggcggagaaatccatgccatcatgggtcctaatggtacgggtaaaagtacactggcgtctgctttgatgggtcatcctaaatatgaagtcacagatggtaaagtaactttggatggagaagacgtgctggatatggaagtggatgagcgtgcacgtgcaggattgttcttggcgatgcagtatccgagtgaaattgcaggggtaacgaactccgactttttgcgtagtgcgattaacgcacgtcgtgaagaaggacaagagatttccctgatcaagtttatccgtcaaatggaaagcaaaatgaaggagcttgaaatgaatcctgagtttgctcaccgttacctgaacgaaggcttttctggtggtgagaaaaaacggaatgaaattttgcaaatgatgatgattgatccgaaaattgtcattcttgacgaaatcgactccggtctggacatcgatgctttgagaatcgtggctaacggtgtgaacgccatgcgttccgaagatcgtggcttcctcgtgattactcactaccaacgtctgttaaactacgttaaaccagattatgtacatgtgatgatgcaaggacgtatcgttaaatccggtggtcctgagcttgctgagcgtctggaagcagacggttacgactggattaaggaagagctgggtatcgttgatgaaactgtaggacaagaggcgtaagccggaagcgaggaggaaaactgatgactacacaaacaatccttccggtagattccgagcaactgcgtgttctgtccgaacgtaacggcgagccgtcttggctggccgaagacagacaaaaagcacttgagcttgcaggcaaactggagcttccggtatttgaaaaaacaaaaatcgaacgttggaatttaaacgattacggtcaacataaacagagcgaggccattgcatcgctagagcaggttcctgcagccattgctgatctggtcaaagagcagcaggagggcggtctgattattcagcgcaactccggcgcggtatacgtgaagctgagcgaggaactggcggcgcaaggcgttattttcacggatttgcaaacggcggttaaggaacatgcagatttggttaaagctcatttgaacacagtcattaaggctgaagaaaattcattgtctgcattgcatgcagcactttggaacggtggagtatttgcttatgtgcctaaaaacgtagagctgaacgttccgcttcaggctgttttcctgacggatgatgcgactgcaacgtttgcgccgcatgtgctgcttattgccgaaagccatagttccgtgacgtacgtagacaactatgtatctgcggatttggcggcacctgttcttcataacggtgcggtagaagttgttgcaaatgcaggagctaaagtacgttatgcgacagttcatcagtttggggagcaagtaacggatatttcgattcgtcgtgccacgttgggaaatgacgcagctatcgaatggattgtgggcgaaatgaacaacggtaatacagcaagcaataccatgtccgtgctcaaaggcaatggctccaattcggatgccaagatcattgctgtaggttctggctcacaaaaactgaactatacgacacaagcacagcattttggtaaaaattccgccagtcagatgattacgcgcgcagtaatgcgtgaagaagcgtcttccatcattaacggaattacaaaaattgaaaaaggtgctactaaagcagacggtcagcaaacggaacgtgttctgatgctcagcccgaaagcgcgtggtgacgctaatccgatcctgctgattgatgaagatgatgtaacggcaggtcacgcagcatcggttggtcaggtaaaccgtgaacaagtgtattacttgatgtcccgcgggattagccgtgcagaagctgaacgtctgattatttatggcttcttggcacctgtcgtatctgaaattccgcttgaaggacttcaacatcagctgcaaagccttgttgaaaggaagttaggccaatgaatactgcattgatccgtgaacagttcccgattttacatcaggagattaacggtcatccgctggtttatttggataatgcggccacttcgcaaaaaccgctggcggtcatcgaggcgatcaagcactactacgaatatgataattcaaatgttcaccgtggtgtgcataccttgggtagccgcgcaacggatgcttatgaaggtgcgcgggagaaggtagcccgctttctgaatgcaaagcgcagtcaggaaattatttttacaagaggaacaacaacggcgctgaatctggtcgcttcttcctatggcagggctaattgccaggcaggtgatgaaattgtcatcacacaaatggagcatcacagtaatctgattccgtggcaacaggtagccaaagccacaggcgcgactttgaaatatattccacttcaagaggatggtagcgttgatcttgctgatgtggagaatacgattacagagaacactaaaattgtagcgattgcgcatgtctccaatgtgcttggtgttgtgaaccctatcaaagagattgcagctattgcgcatcgcaaaggcgcagtcatcgttatagatggtgcacaaagcacaccacatatgaaagtagacgtgcaagacatcgacgctgacttttatgccttttcgggtcacaaaatgtgtgctcctactgggatcggagcactgtacggcaagaaggcgctgctggaaaacatggagcccattgagttcggcggtgaaatgatcgacgatgtgggattgtatgaatccacatggaaggagctgccttggaaattcgaaggtggaaccccgattattgccggagccgttggcttgggagctgccattgattttctggaaagcatcggactggacgccattgcgcagcatgaaagccgtctgtccaactatgccctcaaacgtctccgtgaagtggaggggttgactatttacggacctgcagaacgtcatgtcgggctcgtaacctttaacctggatgatgtgcatccgcatgatgtagctactgtactggatagcaaaggggtggctgtacgtgcaggccatcattgctgccagccattgatgcgctggttgaaagccagtgcgactgcacgtgccagcttttacctctataacacggaagaggaagtcgacgctttggtcagcgccttaatccaaacaaaggagtattttggcgatgcaacttgatgacttgtaccgacgcgtgattatggatcattataaaaatccgcgcaatcgcggacgttttgaggaagatgccgttacggtggatttgaataatcctacgtgtggtgaccggatttctcttcaactcaaaacgaaagacggcgtggtcgaagatgcccgttttactggcgaaggctgctcgattagtatgtcctcagcttcgatgatgacagaagcggtcaaaggaaaaacgattgatcaggcactggatatggcgagccgcttctcttctttaatgaagggagaagccgtcgaattcgatgattatgaagaattggaagctttgtcaggcgttaataagttcccggcccgcatcaaatgtgcaacactggcttggaacgcgctgcgcaaagggattgatgaagataaataatttaaatagaacagaggaggtttgagaaacatggccaagaaagcaccggaaatggaagagtataaatatggctttcgtgacgagcacaagtccattttccaaacaggtaagggtctcactccggaaattgtaaaggaaatctccaaaattaaggatgagccagaatggatgctggagttccgtctgaaagcactgaaacagtttgaaaaaatgccaatgccaaactggggcggagatatggatgaactggatttcaacgatatccagtactatgtaagaccttccgagaaacaagggaagacatgggaagaagttccgacggaaattaaagaaacctttgataaactgggtattcctgaggcggagcaaaagtttttggctggtgtatctgcacagtatgaatccgaggttgtctaccacagtatgcaaaaggaactggaagatcagggcgttattttcatggataccgatacggcgttgcgtgagcatcctgagattctaaaagagtattttgcaacagttgtacctcctgcggacaataagtttgcagcactgaacagtgcggtatggtcaggcgggagcttcatctatgtaccaaaaggtgtgaaatgtgaagttccattgcaggcttacttccgtatcaactcggaaaacatgggtcaatttgagcgtacgctcattattgccgacgaagacagctttgtgcattatgtagaaggctgtacggctccaatttacagcacgaactcgctgcatagtgcggtggtcgaaattatttgtaagaagaacgcacgtgttcgttatacaacgatccagaactgggcaccaaacatctataacctggtaaccaaacgtgcggttgcggaagaaaatgcaacgatggaatgggtcgatggtaacatcggttccaagttgacgatgaagtatccagccgttgtattgaaaggccgtggagcgaaagggatggtcctgtccatcgctgttgcaggcaaaggccagcatcaggatgcaggtgcgaaaatgatccacttggcaccagacaccacctccacaattgtatccaagtcgatcagtaagcacggcggtaaagtaacgtatcgcggattagcttcattcggtcgtcaggctcaaggtgcaaaatcaaatatcaagtgtgatacgttgattttggataatcaatcaacttcagatactattccttataatgaaattatgaatgacgacatcacgcttgagcacgaagcaacagtttccaaggtatcggaagatcagctgttctatctgatgagccgtggtttgactgaagcagaggcaacgcaaatgatcgttatgggctttattgagccgttcaccaaagaactgccgatggaatatgcggtagagatgaatcgtttgatcaagtttgaaatggaaggttccatcggttaaaacgcagtacccttggtgtgataaggttcttaaggtaatctaaagctgttaaattggagtcgtgccgatttatgctgactcggattttctctagtatagaaggcgaactttttaagttcgtcttcttttattttttctgtgatgcctaagtccataagccttttttctactacataaaaaaatttatgcttaggaccgcagatacttgcctagcacttatgtatgtttgcttaataggatgttgtgagtgacataaacataaggaggcataccaacagatgcagaagaataaaactggagtggagaagaaaaacctctcttctaaacagacacagaggcatgtacatgaatttgaaggtagtaccaaactggctgaagaaggcgcagaccgacataaccaccgctttgcaggtgttactgggcaagcgattcgagttggaagaagtcatgtccatgaaatcgatcttacaaaaactgatttcgtgaaccactttcataatctgaaaaaaattagaacaggaccagctattccagtcggaaatggaaaacacgtacattttgttacgggccaaactacattaaatgatggtcatgtacaccagtttaattttgcaacattaattcaggcacctcttatttaatgacggtggtttgaccgaagctgaggtaatgattgttataaacagctgctcataaagaatgagagcatcgtcttcgatttttcggtgatgtgtaaattactcgaaataaatcaaaaagctctgctaaccataaatggtcggcagggctttttagtcttacattgattctgtacttcttgattatgaccggctatgattttatgccttatgataagctgccttattcgaattttaagtatatattttttgtttcatttttatggtcagtgtcaccaattagcaatctttaatgttgggacagctcgtctgctacttgtttatttatctgaagttttatggtctaagtcatgatgtaattcggttgctggtattttggcactatagatttgacctttggcaacagggttagagatgtatacatagctcccgcttccatccggcgcacttcctgttgcccacaaaccttcactggattcttcgccttcagacaaattccaaaactcataagcttcaggctgagactcttgctctgcttcaggaggaaaagaagcggggaccacaacaccgtttttttcttccaattcttggattgccgccatccattgatattggtgatagcggtcacgtgctagcattttccgtagtgtagctctgacgctttcatcttgtgtcatatgatatagccttgctacctgcaaccgaccctgactctctgcgtgcaaattggaccgcatatccgccaataggttgccacttgcgacgatataagagccgttccatggaactccatttgaattactaggtaatccaccaagaccgctgaccagcaagtgctgcgggttaattccccccataatggcagccgtaacagggtcttttgcagcttgttcttgatcttctggtttagctccatcaagtagttgactaattaaagcacacagcatctccacatgccccacttcttcagttccaatgtccattagcatatctttatatttttcctcaccgcgacagttaaacccttgaaataaatattgcatcatcacggtcatttctccaaattgcccccccaaaacttcttgtacctgccgggcaaaaagaggatcaggacgctccactttcacttcaaactgcaactctttttgatgtctaaacataattactcctcctatagttaagcagcttagtaaattctaactgtatttaaccttttcaagatgtaataaaacgaggatcagcataacaacaatctgataggagtctttacatttaactatctgtttgtttggtttgtataaaaattattaaggagggaagcatatgttcacgttttaaaaaaagtttaaggaggtttttttacattgtatttttataaagaagatctaattaacataatagtacccgataagcccgacccggctgctgctaaagtgattcaagaagtattaggtggtcgattcggagaaatgcgtaccatgatgcagtttttctttcaaagtaataattttcgtggtaatgctgtgcagtttagggatttgatacgcggagtttttctagaggagcttagtcatgttgaactggtccaacatactattaatcaacttctgactggctcaggcgcagaccaagccggcgatgctggaattgatcatgctcctttagatgaggcgataaaacacgcaaatcctcatcattttattatgggagctcaaagttccttacctgttgatgcaagtggaaacccttggctaggcagttatgtttattcccacggcaatctgattagtgatttgcttgacaatctcgtactcgaatctacaggggttctgcaaaaatcccgaatttacgaaatgagctcgaacaaaacattccgggaaacgttggcttttttgattgtgcgggataatgctcatcagaatgcgtttgccaaagctttagagacacttggagttgattggggaaaattgttcccggttccaaactacgatattaacaagtatccagaatgccggaagtatgttgaaatgggctttcacaatgcacagtttaattttcgattggattctacccgtattggagaaatattcaatgggcaaactccaagcagaaacggtggggatttgagtgtaatggatcctccagaaggttttcctcttccgtatatgcctgaattgcctaatgaacatagcccaggtctgcatgatcttaacacttaggtttaaacaaataagtaaggatagtaactaggttaatgtccgtaacataaaaagaggctgtccttcgtaaagaacctacgaatcaaggacagtctctttttttattcgcgtagcctgtaattcggcataacatttcgttctaccgaagtaacgccgggaggtagtagtagcggatcaggattccaaataaatttcatcaatggatacatggcgttctctagacaaatctacatattcattatcggtaattctcactaagggtctgaagtaatcagcaggattgttcagaataatcgttcctgtctgacctgtagtcagcagaacctgcttattaatgaaattaggaagcatgtgtctgatgaacacttgggtagcttctgggtttagatgtccaaaactcatgctgtgcagctcacgtaatacggtgagcagctcctgcttcgtctggtacacacgattggaaatcatcgcgctatacacgtcggcaatagctgttatgctggcaaaaggatgaatatcttccttgaacagtccatggggatatccacttccatcttcacgctcgtgatgctgcaaggcgacaattgcagaaatctcatcgctggttgaattgcggataatatcatagccatatagcgaatgttttttcatctcatggaattcttcgggtgtcagtttatccggtttgttcaaaatttcatccggtatcatggacttgcctatatcatgtaagtacccagctttaccagcggcatatgcttcttcttccgtatatccaagccatgtggcaatgtaatatgacagtacacctacttggagagaatgattataggtatagtgatctccccgttccataattaatagcagagatacgacatctttttgacgagccagctctgaaacaagagggccgaacagctcatcgactcgatattcatcaaattttccagttgaggaggctttgagaaacatgctttcaaagccactgatcgtctgctccatgagaggaacggcacgtttgagggactcgggggaagctgggacatcgggggcaaagtcaaccggaatgctcgctgaaccggcatcaatgtcgatataatcgacaccgtgcataatgagtttggaaatatcgtcatgctgtagctcggtgccctgaatcatgacaggtacaccgtgcccattgtatgtatcggatttgaggcgatctcccggcttggcatcggtaacgtgtactctcatgcgctaacctccttattgtcgtaaatttgtcgaaaatacgaaacaaacttaatatatcaagaattaaatggtatgacaacgactaatttactattattccaagctgtaaaataggtcccaggaacccgtttcctatcagatacctacagtagataacgtcaatacctttcactatgtttaggatatgagattgcccagagagtacagcgaagcttaaggactatgtccactcatatgtaccatattgctaaataacatggtatgcttaaacattagaagctccaaagtcgatatatataaagtatagaggagggcggttatggagatgacgactcggcaaacgttgaccattttgcataccaatgatatccatagtcattttggcagtatgccttcgatagccgcgatgatcgatgaacgaagagccgcatcacgggatgcgctgcttgtgctcgacataggagaccacatggaccggatggcccccgaaacggaaggaacgctcggtggggcaaatgtggatgtgattaatctaacaggatacgatgcaattacgatcggtaacaatgagggactgacttttaccccggatatgattgaacaggcatatgcggggattcattgtccggtcgtatgcggcaatatgacagagcgtgccacggggatgagcccttcgtggatgaaggaatcccttatcgtagataaagcaggaattaaggtgggtttacttggtgtgacggctccttttgtagagttttatcaattgctgggttgggatgtgctcaatccgtttgaggtgctggggaagcagatcgcggcactgagaaagcaggttgatgttttggttgtgatgtcgcacctgggtctaccttccgataaaaaattagcgtcgcagtttcctgaaattgacgttatccttggaggtcacacccatcatgtgctggaagaaccgctttggatcggaaaaacagctttatgtggggcgggtaagttcggaatgctgctgggtgaagtgacactaagtcgtaacaatagcctcgaaccgtttcgagtcacgtcgggcggcgtagttcctgtggatcagacactactggacgaaaaagtggcatcggccattgtggtgcatcgcagacaagcagaacgcgccatggagagcacagttgcggtggcggatcgaaaactggagatcgcatatgatcaggaatcccctttcgggaatatgctggcacaagcggtgtcccattttacaggaacagaaattgccctcgtcaatgcgggacaactgctcggcccattacctcaaggggatatcagcaaaggaatcctacattccttatgcccttcgccgattaatgcctgtgttatgaagttgcggggaagagatattcggttggcgctggagcagtccttgctacctgaatttacagacaagcccatgacgggttttggcttcagaggcaaagtgcttggaacgatgtgtgtggaaggcttggccattcagtatgaccctggccgtgctccttatgaaaaagtgacggacattcgtgtagcgggtcaacctttggaagagtatgaggaatacacagtgggcacgttggatatgttcactttcaaagcaggttatgaggtgcttgcgaacggaacagatctccgatttatgcttccagaatttttacgggatatgattgaaatggagttgaagcgtccgggcgcgatggaagaatgttttgcagctaggtggcttcaggtatcaaaacaatcgggagaggattaagctgcgactggtacctgttacattattgagagccggcatgaagctgggcaagaaaatttacaatgaaaacggaatggtgctgctctcggaaggtgttgagcttacttcgcgattgattgaacgtctaggccaagtcggtattggatatgtatacattgaggatgctgtgacagaagatatcgtcattcctgagatgattcatgagcagacaagggccgcggcgctacaggaaatcaaaaagcagtttcaaggtttatcatcctactccgtagatcataagcacaaatattttggcaagtcattttataaggtgatggaatccattctggacgatattggaggccgtcaggacgccgtcattatgttgatggatatcggggccgcggatcaggatttgtatcatcattctttgaacgtatgtttatattcactagtacttgggatatccaatggctacgataataaccagctcatggagctggggataggttcactactgcacgatattggtaaaatgaaaatttcacctcaagtactctataagccgggtaaattgacggatgaggaatatgagcatatgaaaacacacacggtgatcggctacaagctgctcaaagacgaacctggcattcccttattgtcggctcattgtgcattacagcaccatgagcgtatcgacggcagtggatacccacacggttggaaaaaggaccagatccacgaatatgcgaaatggatcggtctggccgactcgtacgacgcaatgacagcaagtcggatatacaaacaggctttgttgccctatgaagcgatggaagtgctgtacgccggggcaggaacgttatatgagcagcgaatgctggaagcctttcgtgactgtgtagctatttaccccctgggactctctgtggtgctcaacacgggggaagagggggtcgtggtgcgtatacatcccaaaatcccgcaaagacccgtcattcgcattgtaagagaccgggatgggcaggaagtgaaggcaccttatgatgtggatttgtccgtatccctctcggttatgattacaaacacattgggtgctactgtcgcccctttcggaggagtacacgtagattagcagatgatgtggaagaaagtatgcagacactttacacatcatgatatgataattatacgtcttttgaggttaataacagaaataaggtgaaaacataatgacagttctacaaaataacacgctaccccaaatatcgccaacctatgatccgtgggacccgattgtctcactgcgtacacatggtcgtcatttgcttacgagtgtggagatgaccgtaacgcatctatgtaatatgcgctgtgagcattgcgctgttggcgatatgctggttatgaaggaggcccctttccttcctctagacctaatgctgaagcgtttggatgaagtcgagcatctggagacgatcagtattacaggtggggaacctgctttactcgataaaacagtggatgaagtaatcgttccactgctgaaatatgccaaggagcgcggtattcgctcgcaaatcaactccaatctaacattagatattcgcagatatgagaagatgcttccttatctggatgtgatgcatatttcatttaactatttgaatgcagacgatttttatgaagtgggttttgcaaataccggccggccgactccgcgtgcgggtgctgttcgcctgtatgaaaaaatgatggaaaatgcccgcagattgagtgaaatggggatgttcatttcagctgaatccatgattaactatcggacacacacgaagctggagggcattcatcaattaatcaacgaaatgggatgccgacggcatgaggttcatccaatgtatgcgtcgaattttgcctctgctttgcctgtgctttcactcgacgacatgcggaactctatccataagctgctggatgtacgtaatcaggacatgtggatgttgtttggtacattaccgttctttgcttgttcggatcgggaagaagaccgcaaactgcttcgacgcttgcgtcaggaaccgaatattacggtgcgtaatgatccggacggaagaaaccgtgtgaatgtgaatatgttcacgggtagcgtgtatgtgacagattttgcagacataccggctttcggaaatattcaggaagatagtctggacgatatttttggtgaatggctgaatgagcatccgctgaatcagactgtgaactgtcattgtgatgccgctgcctgttgtggaccaaatctgctcgtggcggatatgtattacaaaggaatagattttaaatcaagaaaagcattacaactatagaaatggggagttcgtattggatggtcataccgagtttcattggggattgctagctgtgaatctcctcttggtactgctgcttgtctttctaaatggtgtatttgtggccgcagaattttcgctggtcaaaatgcgccaatcccgattgacgcagctccaaagcgagggtcatcgcctggcaggctatgcgctgaaggtgaaccaaaagttggatgcttatctgtccgccacccaattgggcattacgctggcttcattgggcttgggttggattggagagccagcaatatccggctacctgatagagccactcatgcacaaactcggtgtaactgacggtacactgattacaacggtatctgttatcgtcggattttgcgtaattacctttttgcatatcgtattgggggaactggcgccaaagtccttagcgattcagaagaccgaaggtgtggcgttgtttttatcggcgcctttgctgcttttttataaggtctttctgcctgtgatctgggtattgaatgctgcggcaaacttgctgttgcgcgcattcggcattcagccggcgagtgaagccgaagcggctcattcggaggaagagattcgtatattgatgaatcagagcgccaaaagcggtgtgattgataaggacgaaattaagctgatggataatatttttgatttttccgacttgcttgcccgtgaaatcatgctgccgcgtacagatatggattgtttgtatacgaatttgtcgtttaaggaaaatctcaagatcatcagcgagaccaagcattcccgttacccggtagcggttgaggataaagaccagattatcggttttgtccatattacagatcttctgctagctgagcagggagatcaattggatctggcttcggtggtacgtcctattttgaatgtgccggagtccatggaagtgagtcacgtgctacgccttatgcagaaaaaacattcccaaatgactctcgtggtagatgagtacggcggaacggccgggctgctgacagcggaggaaattttggaggaaatcgtcggggatctctatgatgaatttgaggatgaacgcccgagtgtggaaatgaaggagaacttcatctctgtggacggtcgtatgctcattgaggatgtcaatgatttgactggagtgaacattgaagacgacgaggtggattccatcgggggatggctgttcaaggaattggagggcattccggtgaaagggaagaaaattgagttttataaccttacctttgaggtggaggaagcaacaaggcttcgcataatgagagtgaagattcaccgcaagcctgagcctgtgattgaagatgagctttctaccgattgattcctaatccacagatataggtaagatcagttcaggtatgtaagttattatagagtgctgaagaaagagcttttagatccacgtaccgtggttttaaaggctcttttttgattagaaacagttctatagttattttcttgaacaattatttttatctgtgattttttgttcgagacttgggcgatgcggcatatgttgaatagtaaaacagatggatcaatcaaaggaggttccggcccgtgaaatttccacagcaaggtgagtatgccccgtttgtcggcccgttcgatccgtgtccgcccgttctgtgtaagacttatgtgcttccgccaaacttgtttatacaatttcagccccttggtctaccacaattcagtccagatgaggcgctgacgaagggaacgctatggcctttgctttacagcccttatgagcctaggagaaaccaggggggaggcgaatagaatggagaatccaaatcagggtcagtccccattccaattccagcagcaaaatcagcatgagagcgggcagcaacagccgagtccatatcaaagcccttattcaaatccgtatccataccagaaccagtatcagaaccaaactcagggctatagtcaagccggaaacccggcccaaggctgcatgcctcaaaccaagccagttgatgcccagttttatgcgttgctggagaaactccaagcggtggattttgtgttggtggagctgaatttgtatctggatacgcacccagatgatttacaggctatcgaacagttcaataagctgacgcaggaaagaacggcgattgctaacgagtatcagatgctatatgggcctttacaaaattttggccgtgcctattccaagtatccttgggagtggagtcaatccccttggccgtggcaagtctaggtagatattaccttttataaaggaggaacatgaatgtgggtatatgagaaaaaactgcaatatcccgtacgtgtcagcaaatgtgatcctcatatggccaaactgcttatggagcagtatggtggagcggatggcgaactggcagcggcattgcgctatctgaatcagcgctatacgattcccgataaggtaattggcgtactgaacgacataggcacggaggaatttgcgcatcttgaaatgattgcgactatgatttataagctgaccaaggacgcgagtgtggagcaaatgaaggcagctgggctaggggaatattacgcggcgcacgatcatgcgctatattatcaaaacgccggcggtgttccttttacggcggcctatattcaagccaaaggggacccgattgccgatctatatgaggacatagcggcagaggaaaaggctcgagctacatatcagtggctgattgatctgacagacgatgtggatttgcaggatagtctgaagtttctgcgtgaacgtgaagtgattcattcgctgcgtttccgtgagtcagtggaaattttgaagggggaaagagaccggaagaaagtgttctgagaaagttttataccatcaacggtttaaattgttagcttgttctatatattattacaaataggaaaggccatctgcaagcctcaagtgcaggtggcccttttttatttttttacattcatctatcccctaatattaattacttggaacgatggattttttggacgtctggactagaaactgtgcttaaatacaaagcagaggatagccttcctcaatatttagataggtagccacatcaaaggaaaaaaactccataaccaccctgacagaaaacttatttttgttctagctgtgcaaaatactgctcgttgtataagacgcttggatgagtaggatggtgcaactgagctatgcgatgatgcgattttgccttttcaatgtcgccgattcggtcgtaacacaggcataattgcaagtgtggaaaccaggtatagtacgacgaattagttaaggccatcacatcctgtgggggctcgatcagcgtcgcctgacgaaaccagtaaatggcttgagtatactgctcatcttcaatgaacaaattgccaaaggcacagcagaactgggcgcgtggtacatcgaggttgagtgtgcgaagcagtgccatacgctgctcctgtttttgaccctggtgagcgtagcaatctgctagcttaaaacaagcagcaatccgatcctcaatccatccttgatcgagccccagatagtgttcgtactgctggatggcttctagtatgcgtccgttatcatatagttcattagcgaagtagtagtgatctcgctcagaaaatgcagtgcctttctcccggtgctggagataaatatgtaaattacggtcagtgtaggcacgtgtctttttatgagtcactgccatattgctgtgaaaggtgctgccagtcacattcaggaattcgtgcacaaagccgatccatctgaatctacgatcacgccgcaccattcggtttcttttgagcttatgcagcggctgcccctgttcatctacagatagtacataatccatcgtaatgctgtcataggagacggtggcttgttttttccagtcgagaaatgccagtcgatcttgctcctctaggatgtcatcagcatccagccaaaattgatattcctgtgttgcctgatcaaacgcataattgcgggctgcggagaaatcatcgcaccattcaaaattgtatacccgagcattgaacgatgcagcgacctcttgggtactgtctgtagaaccagtgtcaacgatgataatttcatccaccagatcatggactgatttcaggcaggtatgaagggcttcttcttcgtttttgacaatcatacataagctgacagttaccatgctctttgtcccccccaaaaaaacttggtataatctccattttattaggatagcttgctcattatgtagtaattcctatggatcgtttagaggatgtgtgatgatcataaattcaatcttgctctaataaattagaaaatcaaagtctgatatgaagaggaggagattgtgcaaaattcgatattatcaagtgcgaccgggaaataaatttgatggctaaatgtagttagaaaaccggtaacagaaaaaaaggcagttaactggagggtaagattgtattttggtattgatgtcgttttcattgaatttccaggtgtaagtccattcataccacgctcactcccatatcgcttggtcgcaattatgatatgtcttaggacatggagggagaacggtttatgaggcttctacctgatggaggcgttgaatcatgcgtatactaatcggtagcccggtgcaccagaagccggaaatattgtctttatttcttcaagctttggagcgactggaggcacctgacgtgctgccggattatttatttgtcgatgataatgacaatccgacttcaagccaatggcttgccgatttttccaatcggctgccgggcagggttttacccttgttgacaggctcacagcaagtagagaatcgaagtgatgagcacactcattattggccgcctgccctcgtctggaaagtggctggctttaaaaatcgtcttattgattatgcacttcaacataattatgacgcgctgtttttggtcgattcagacctgattctccattcccgtaccttatgtaagctggtggaggcggagaaggacattgtatctgagattttctggacacgctggcagccggaggggcctctattgcctcaggtgtgggttagtgatgaatataatttgttccatcgtgaagaaggcgaagtgttgtcggcagaggagcgagcgcaacgcgagttgcatttcatacaccaattgcatgttcctggtttgtacgaggtgggtggtctaggcgcttgtactctaattcgcagacgtgcactggaagcagggattcactttggtaaaatcaaaaacgtttcctattggggagaagatcgacatttttgtattcgagcagctgcatatggatttccactttttgtggatacacactatccggcgatgcatctgtaccgggaagcggacagaatgaaagcagagcagctactattcgccctaaagtattttacaacgagtgctgttcatacggaccattcagaacatttagcatatctggatcactccgatacttctactaactctcctgccttcaatcgttctgcatcatcaagtccctctaagttccctgaacctcctgttataccgtatgatctccgtgagtcagctgtctttgccaagtacactgcagattcttttgctgtaccacaaacattctctggtccacgacaaagtgaacttcatacgccgcctgtctccaaacccaaattgacgctgactatgacggtatacaatgaggcagatcgcaagctcattgacgtgctgcggagtcatcgggaatatattgatgaagcggtcattattgatgatggcagtcaggatgatagcggagagttgtgccgtgagatcctaaagggaatcccactgcgtttaatacgcaatgaaacggcttcttttaccaatgaattagagctgcgtaagcagcagtggagagagacgttggcttcctctcccgaatggatattaaacatggacgctgacgaaatgtttgaatcccgttttgctcaaggggtacattcgttgttagcgggaacgaaagccgatacgatttgtttcaggttgtttgatatgtggtcttccacgcattaccgcgatgatgattattggcaagctcatcggtattaccgtccttttttgattcgatataaggaagggttctcttataaatggaaggagcagcccttgcactgtgggagatttcccgaaaatgtgcttgaccttcccaatgaaatcagcaactaccgcatccagcattggggatggtatacacctgctattcgcatggccaaatttcagcggtaccagttgcttgatccaagtgctcgttatggctggaaagagcaatatgaatctattttggacccgaacccccgactcacgctctgggtggatcaggacaacataaatgtagaagaagaaactgcaccagaatatgaagcagcccaccaggtaaacgacatggatgttgccgagatttcgagtgtccaggttattgataattccgatctgcaaataaaaagtgaaaccaaggacttactttatagtaaatgcaaactgtgtggctcatctgacacggcagtatttcatagctatgaacgctttaccttgatgggatgcggctcctgcggattggtttttcgtaatgatgtggatcatatacagccagaagatatgattgcagagatttataatgccaaatgggttgctatgcgggatagtgcagcagcgtcaacttatggagatcatgccctttttggactcatgctgctggatatgttcagtaccggtaaaggaaaattgcttgagattggatcaggtaccggagaatttatccatgctgcccttcaagccggctgggatgcagtgggcattgaaccttccatagactcgcgtgcttacgccaaatacaaatatgacgtggatttattgccgggttactggggcgatgaagccgaagaagatactcaaacccaagaagcacatgaaatacaggaattgaatgaagtagaagaagccgaagaagatactgatttaccactggatcacaaatacgaggccgtagcatgctggcatgtgctggagcatattgcggacccagttgcatttttgacagatttacgcgaacagcttcaacctgacgggacgatctatattacggtgcccaacaaaaattcgttcaccaatgaggcttatggcgtttactcgcctctatttacggaggaagatcatttgtatcattattctgagcatacgcttgcgctcttactggcaaagtccggcttgcgcccggtggctttgttcacccgccagcttccctctggtttagatgccttgctgcaagcccatcctttgtacggtgagcttacccttacggagcaaatgggattgttggccaaacttcaaggcgagaaacggggtcatgaactgtgctgtgtcgcaagggtaatttagtcatccccaaaaggaggcagtatccatgaacatgtctgatccgtatctgtctcgcttttttgtatattctgaccccaactcctccaacatgatttacagactcccccaaagctggtggagtcgcccctatgagtatgagtggtgtctccaatttatgtctgggcaagatacagtactggacgcagcatgtggaatccctcatccattcaaatttgagttggcccgccgttgcgctgaggtctatgcctgcgatctggatatacggatcgtttccgtggatgccattttggccgaggtgcggcgggatatcggagaggaggctgccgagcgcattcaggagattttaccagttcgtctccactccgcacatgccaatctgacggctctaccctatgaagatgccagttttgacaaaattgtatgtatctcggtactggagcatttaacgcctgatgaatctttggcagccttacgtgaatttcaccgaactttacgggatgacggaatgcttctgcttacgtttgattatcctacagtggacttatcagcgatggagcaatggatagagcaggcagggttttcgtattggaatggtgtggatctcaagcttccacggggggctctacacacggatatgtggggcggtctgcattgttttaggactgttttaaaaaaatataagagttagcggtatgcgcaatgaggtttacacggacctctcttattgcttatcatgagaggggttagagttgtaaacctacataggaaaggaatgactgataactacatgaacaatgcacctgtgttgaagaaacctgaggctatggtatttgatatggacggtacactttttcagacggagacgctattgcttcctgcgtaccacaagctgtttgatacgctgcgcgccgaagggctttatgaaggagagactcctcccgaggagcttattttgaatagtttgggtatgttgctggatgaaatctggagaagagtgatgccggaagccagcgaagcggcccacagaagagcggacgagctgctgcttcagctggagctggagggattgaagagcggaagtcatgccctgtatccacatgtaaaagaaacacttcagtcccttcatgagaaaggtgtccgattgttcgtagccagcaacgggttggaggattatgtaaaagggatcgctgctgcgtatgaaatggttcccatttttgaaggactgtacagcgctggggagtacagcacgctttccaaagtgaatttgctggaaattctgttgagcaagcacgatatttcgaatgtatggatggtaggagatcgctcctcagatgtggaagcaggcaaaaagaacggacagacggtgatcggttgtgcttatgctggatttggcgtgaacgatgagttgaaggggtctgatgcaattattacggactttacgcaactgcttacactttataaaaacgccgagtaactgtgaaacacaggttaatggttataaataggcttgacgtaccatataaataaaacatgctagcactgtcgggcagacgaaaaagaaaggaaggcagccactttacgcggagccttcctttgtcttattctcagtcttactctctgctttatcttctgttttatcttctgctttgtagtccgtctgaggctttggattaatttgtgtgtggtagacccacaaggcatattccatgggcttggcgatggaacggcgataggtatctttttctccaatacgtgaaaatacctcgcgggctggtttcgggttgacttccagcacgtatatatgaccgtccttattaattgccaaatcgagcgcaagctcgcacaatgccccgtagctttcttccagatacgcagcgatgtccagtccgagtttttccccctgcttgatgattttctctctacggctctcatcacgaatccattgcgtcagcaattggttcatcggtaccgccttgcctccaccatgcaggttggaagtaacactccgatgtgccccaattcgtccggcgcatccggttagctcccatactccttggctatttttctgcaccagcatacggtaatcatggaccctgccattcggcaactgcacaggaatgccttcctgaacaatgtagttatccatgttccagctgctcagacgcggctccagacggtctagacgtacccgctgctggggaataatatggcgtttgcgattgcggccttcaatcagatacaggcccccttgcttgttaacaggctcaatacgtaaaatgccgcgtcctcccgtaccgttaatcggcttgaggtacactaatgaattctgtttgagcatccgttttacactatgaaatccattgaacagctctgttgcaggcaaatgggggcgaaaggcagaccttctcgcaagctgctgatgaatgacccacttgttactcagcggtcggtttaaatatacaaggtctgtatactgcgatcgaaactgcttcaactgacgatatcgttcactgcgctgtactcggcaacggtcgaaaatcatatctgggaactctcgccactttcggctccattttccgctgtgtggatcatagatttgggcaaggagcagcctgcgatccttatggacatctgctggagtgaatacatacatatccagtcccagtcttttcccttctgcaatcatgcgctcatatatatcacgttcctccaattgcttcttgttatttaaatacaaggtcatgatgcctaggacaggttttggcacagcattccaccttcctctgccgtctgcttatcttgggataactccccgtgaaatatcagcgtgggtttcccggtcggtccagtcgtcatttcatgcgcaaccagtccagcacggaaacaggttttgagactggccatattgtcggcggctacgctgcacgtcagacggcgcagctgtttgagctgggcggacagcagtctagcgcccagtctgcggccccggtaaagcggacgaacaattacgatgcaagcatccttcccgtaattcagagcgagggaaaatcccgcaatccgcagccccttctccgtgcgcacatatgcgcacaggagagaggaaccaggggtgttcaattgctccggcgtcaaaacagccaactgccgcagagcattacgagtaatgcgcatgccccctgagctgcgggccagaaacagtaactgtcgtcgtctcagcagccagctccgggcaggcaaatgttgaacatcgctaatttgcggcatgattccacttccttgatcatgatttcattcgtccggccaaaaaggagctgtactggaatatgcgtctaagcgacttttggcggatttccggctcgtcaaatttcatcggtttggcattggcctcaaaaaaccagagggttccgagcgtatccacgcccaaatccatggacatttcgccatgagaaagaccggatgcgcgttcaatctgacgtgcaatctgtatggccgtacttttaactttgttcagtagatccgtgctgtcttcaggcccaaacagtgaggacagtagcttgaacgggtcctctacactcccgccacgcgggacatgtgtggtaatgctccctttacccgccagtctggcaccgaccccggttatactccaggagccacggatatttttttgtaccaggatacgcaggtcgaagggttttttctgataagttgccagatcgataccctgttgaatgatataaggcgagttgcccgcttcccggcggatacgtccccacagccgggatagcgatacagatctgtaggttacactttttttgtcatgctgaatggtcagtctgtaagccattagatgttctgggcggaatttaagaatcataatcccttttccggccttaccgttttccggtttgagatacaggtatggatacgcagacagcatttttcctaaggaagacaggttgcttaaccgtttggttgccggaacaagctgacgagtggtttccgaggtacgcaaccacttgaacagttcccatttgttaaaaaagcctggattgtacagctcaatgtctgaagcatgtgaaatttcatccaactttgtgcgcacagaggttttaagttcataattacgattggggatgcgattataaatgacctgtggaggtggaaaattctgttcctcccacgtctgtaaactcttgttgaaaacgtagcccttaaccgtttcgtctgccagtttcaggtccctgacggtaacaatgtacacctgatagcccatccgtgttcccgtttcaagaatatccctgaaattgcgctgattgcccttgaagaattgttcttcgtcgtgcactgtcaatacagcaacgactggcttatgctccgcccgggtattcatagttcctcttttctgcggaatttactgaggtaaagacagtggtccaaaatatgctccacggatgctttaccctccgcacgcaacgatggatgctgaaaaatggatcggcctggcttggagttggcttcaaacatccataccttttcatcctgatcaatacccagatcaaagccgatttcacccagtagatgctggtgatggtattcaatggcttctgcgagcgtaactgctacgttcttggcacgctggagcacttcacctgcccggtctccgaatacccggtttaacgcctgttcaggtgtcataagggagccaccgtttttgatgtgggtcgtgacactgccgcgtccggcttttttggctccaatgccgacgacgacccattgattatttccatttttatgcatgtgaaatcggaaatcaatcgggcaattgtcaatctcgatcagctggataccctgttgaatgacgtaaccctttaacatctgtccctgattggagtgaagcatcctgagcatggagttaaaagaggcgaattttagcaatacattgctatttttcttacggtacctcacaaaatagccttgtttgggaacatgggacagacggtagattcctttaccgaggctgcctccacttggcttgtaataagcaaattgatgtcgctccaacatacctcggatacgttcagagctgggattcatatatgattcagggacatagcggttaacatctgggttattctccagcagattataaatatcggacttattgaaaaagctccagttaaaaaagggaattcgtctgcgggaaaagcgttcgcgtagttgattgatcgccggggaaaaatcagagcgtcggctcggcaaacgattataaattacgtccggcagaggtacaagtttacgtgtgaattccccgctggaagacagaaaatagccgttaatcgtatcattttgccagttaatatcccgaggggtgaaggcgaaaatataagattttttgctgccttccttcagcagttgcttaataaagcctgtgcgtgatccgaaagggcgagtggtggagttggtaccgtcagacagcacgccaatcaacggccctagctgtatatccccatccagatttcgcaaatagatggccccgcttttgggaacacggattgcattacgtaagccggaggtcaagtatagatggcgtcccgccttctgaatgggttttactgtagcgggaatctgatccttaccgagccgcagacgtacggacttggctccggataatttaaggcttttcaacaaggaagtggatatatacgccaccttgtcgggctgctgtgagaaatgcacattgcaatgcgttaaactcatctgtttatcctcctataccgtatgttcaagggaggcgcccgcgccctttggccctgtcgctttggaatgggtcattaaatatcgagcatattcgagcgggcggttgaccgactggaaagcgcactcgggctgacgggtctgaaaaaaggaggcccggccaggtcgggaattaacctccaatagccagatgttcccgctccggtcaataccgtaatcaattcccaactcgccaaggcggccataacgttcctccagcgccctggtaatggtcaaggacagcgccatcatctgcccgatgatgagacgcgtggtgtccgcgccaaattgttcacgaaggtaaggctcagctggatgggcttcgcccccaccgtgaagattagaagtcagagttccttgtctgccttctcttacggcaaagcccgtcaggcgccaatagccgttgccatccttttgcatgagtgcgcgaacatcaaagggatgattgctttggcttgttaatttcaaataaggctgcacgatataagcgcgtttgtgtgcaattccgtggacccatgacaatcctgcatccaattcggaaaacaagcgccggaacgggcggttacgggagtctctaccctgtacaagtagtccctggcctccttctgccagccggagatacagtgtgctcttgccatgtgttccggtctgtggcttcataaacagctccgaatggcgtcgtagccattccacaagctggatcgtgtcccggtatggcgccgtaggcggcacaaagggacgcactttatctaccgtatgcaaagcgcgatacacctgccatttgccaggtaagttacgcgaccagtagatgagcttgcgcgatttttgctccgccatatcttccagtgtgcgcctgacattctggctctcgtgagcatggagacagcggttatacacaatatccggcaacggaaagcggccggatgtccatactcctttacggtaaacataacctcgtatggagtgatcttcaaatgaaactccttcggcggtaaacgccattacgctaagaccagagcgcctgcccaacagacttagcctgcggcaaaaatcggcttcagtaatagggggagtggcagcctgattccggctaacaagcacgcccagcgtgcctggcacaacaagagacaccgacaacagctcctttgacagccagactctggaagaggtgaattcatttgaagccggctgaataacagcagtattcaatcattttttttacggacgggcgagttttctgatcatttaacggcgtgttgtcattcttcgatggcttcgaattgacctccagcaaccagatgcgccccgtgctgtctattgccagatctataccaaattctgcgaaatgggcgggaatcactttttctactccgcttgcgatatccagtgctgctgttttgagagaggtatgcccattcgatttaacggttgcgggcagcgtggttttggcaagtgcttccttgactgtactcagcgtgccgcctcttgccagattggacacaaagtggctgcctccggcgatccgggcgacaatggatgttacggtccaagtcccggacgaatttttctgtacaagcgcacgaaagtcgaccggacgcttaccgtgatcaatcaaggtaagtccctgttggagttgaaagcgtgttgttttcatttttcccgctaagcttttgtacagtttatcgacgttggcatacatttgcttgcggggtgtgcccgctgttgtggatagcaccgaaaaggtaccatccgtttgtttgttaatgcgcattatgcctttacctaggcttccgcgcactggcttgagaaaaacagcgggatactggttgcacatttttttgaaaacagcaaaggtttgcagcaagtgggactcgggtaaatacttgcgcagggaagaatttgatttaagcgcatcaaatacttcatttttatccagaaacttttcgttaaaaatggttgtgccgtactgcgattttacttctttcatgaaatgctgtacgctagttctgttctcgagtttacgggaggtaagacgattattgacgacatcgccggcgggcatgaccgtctttttccagcctccgtcatacacccatccctgaactcgcccgggctgacttccgatatgctccggggtgaaaaaatacacatatgctccttgtctgcggcattccccgactagttcacggcagaacagggtgatcggcccgaaaggcttgtcgggctgttcgggatagtcccgactgaccagcacgctaataagtgggcccactcgaagtgtccggcgacctcggctgtaggttactcgcagatcacaattggcatgaagccccatttttcgggctagcacgcttcccacacgtaggccgctgtagcggggcaccgatatgacggtaacctcttggcggaacgaaccgaaggcgagctgaacggggtggccagcggatattttccatttgcgaagcagggactcgccgaccatgagtacgtcatcctgcaagatgcccgatccgatgatttgaatcgttgtttttttgatggacatcgtggatctccttccgggcagcaacttgatgtcttgaaagtaacgggaaacgtgaatgggctgtaatagcactgattcatcatatgaggacatatatcccttggtgattgacggacaatgtgaaatgttgacactaaacttgtattggaggaataaacaatcatgaacatctatgacaaagcccatgatttagcgaaagcattgaaggaaagcaaagaggtagaggaaattacgtcagcgatgaagctgatcgaaaccgatccagaagctaagaaaatgctcgacgatttccgtgaacgccaaatggaagtacagcaacgcatgatgagcggcgatatgccagcacaggaagagatggaaaagatggagaagctgtttgaggtacttagcttgaacctcaacatccgtcgcctgttcgacgctgaacgtcgcctgagcgtgattattgaggacgttaacaagattattgcagacagccttcaacatttgtacggttcatctctgtaagtttgtctcatattccttcctgtcctctcatagactagatacatagagtcacagggagaggaagggatacgattgggttctttcaaaaaatggaaacacggtttgtacacactcattgcattggctatggttttgatcgcgttaccacgcatctcgcttgcaggcggtttgaactgggtcaacggctttggaatggtatgggtactttttgcgctgctagtcatcggagcaaacatgcattttttgctgggtgtggatgaggaaaagcgcaaaacgctggagcgtgtgcgacgggccaaaatgcagcagtggcagatgaaatgggataaaaaagctgacaaaggcagcatgtagtgagttttttcagcttgtcctgggcttgtctcccagatgacaaatcaatcatagtaagaagcgatcccttgtaaaagaggggatcgctttttttgctatttgcgaagcggagaagtcaaaatgaacaagggtctaaaatatagggatattgtgctataatagatacagaatgatacagattgaacgttgggggtgtaacagagttggacgggctagatgaaacagttacgaagcatgagcagctattgcgacatatcgagcagttgaaaataggctccaaaatttctgtgcgcaggttggctaaagaaatgagtgtcagcgaaggaacggcctatcgggccgtgaaagaagccgagaacctgggaatcgtcattaccaaggaacggatcggaacagtacgagtggagaagcgaccgcgcggcttgtccgagcagctgacctttgcagatgtcgtaaatattgtagagggacatgtgctgggcggaagtgaggggctggagaagcccttgcacaagtatgtgatcggagcgatgcgcgaggaagctatggcccgttatattgacgcaggtagtttgctaatcgtaggtaaccgtgaggatgcgcattcacttgcattggagcagggggcaggtgtgctgattacagggggcttcggtacgagccgagaggttaagcagctcgcagatcagattagtctgccgattatttcctcacgccatgatacttttacagtggcatctatgattaatagagccatatttgaccgcttgatcaaaaagaaaattatgctgattgaagacattgcggcaggcaaaccgaaaacgttgaccttgaaaatcaacagcacgcttaccgagtttgaagaactttcggtgacgaccggacatcatcattttgcaatagtggatgaatggaatcgtttaattggtatcgtcagccgcaaagatgtggaggggcttctacctgagcatacgatggataaatgtctgatccgcaatccgataacggtcacctaccagacctcgctggcttctgccgcgcaaatgatggcgtgggaaggtgtagattatttgccggtcgtggaccgtaaccgcaagctgcttgggtccgttacacggcgtgaggtgctggaggcgctgcgtaacgcccaaaagcagccacaacttggcgagacgttcgaccagttgatctggaacgggtttgctgaagagcgtaatgaggacggatcgttattttttcgcggttttattattccgcagatggcgaccaatttaggtacgatctcggaaggcgtactggtcaacgtgatgacacaagcgggctaccgggcagctagagacatgaccggcaaggattatgtgctggacaatttgacgacttattttattagacccgtacagatagaggatgctgtcgttcttcgtccgttgctgctcgagctgagtcgccgcacttgcaagctagaaattgcaatttcacgggaaaaccatttggtatgcaaagcagtgatgacacttcaatccattgaacatggttagtctacctgtggctacctatgaatcagagcagggtgtgaagtcgaatagatcgacttagtggctttcaggcagtctttcttttgcttccagccaaatttgcagcaccccttccattacaagcatcgttttgacctggatcgtatactccttgtcacgaacggtgtattttttttggtgcagcaacatacgtaccagcttgctgtcagagtcaatttcgaacatatctctgccgcgcagcacctccagatcacgactgacacggcgaagaagttccttcaggttgatagaatcaattttttcggccgaagcttcctccgcgatcagcttaatttctttgacaacggtttggcgcttgctgtatttgcgcaatgttttgttgtcttcctcggcttgctggagctggaattgaagatcctggttgttcgtccacagctgattgaagctggcatgccagatggcattgtagatcattcctcccgtaatcataccgagtacaaagacagaggataattgcataaaagggcgcaggcgctcaaaaggggggactctcatagtcgtttcacctcacggtcgtccgttgccgcatacccacttgaccagctctgcacccatatgagcgcctaaaaaggcgaaaatcaaatacaatatctgcttaatggcaggtgacaaattaccatccaacatattgctttcaatgacccggatcgggtccatcgttccccccacagcggcggcaagcgcccatattttaattcttccggcaacctccagcatcgtctgggttggcggctgaagcgataccacagctcccattccgccgagcatggctcccccgagcacgatgccgaaggcaatgaagaagtcgagaatcgctttggatataaaagtgctcatgctcttttcctcctaggtatacgaatcaggaccgcgcttgtccgccgaggtctgtacttttattctatgggcgctactaacgcggatatgataaaatagtttgaagaaaatcaagcggtgaaaggaagagaagcgcatgagttcatttgtgcatttgcatgttcatagcgagtacagcctgctggacggcgcggctcgtaccgcggagttggtcaaacaggcatcagcttacggaatgaaggcgctggcccttacagaccacggggttatgtacggtgccattcctttttatagagcgtgtgtagagaacggcattaagccgattatcgggtgtgaggcctatatgacggcaggatcgcgcaaggagcgtggcagccggaaggatcagcccatatatcatttgattttgctcgccaaaaataaaacaggctatcaaaatctgatgaagttgtgctccatcggccatttggagggctttcactacaagccgcgcatcgacatggaggctttggctgcccatcatgaaggcatcatatgcctgagcgcttgtttgggcggtgaagtgccacagcatttactgcatggtcgggaagccgaagcacgacgagcagcggaacggtatcgtaacatttttggcgatgatttttatctggaacttcaggaccatggtctttcggagcaaaaacgtgtaaatcctctcttgatcgcactggcgaaggaactgaatattccactggtggcgacgaatgacgtgcattacttgactgagccagatgcagacgtgcaagacgttctgatctgtatcgggacagggaagacagttgacgatgaggaacgcttgcgtataccaacacgtcagttgtatctgaaaagtcaggaggatatggctcgtttattcccgcatgtggcagaagccatcgccaacacggtgcgtattgctgaaaaatgcgaactagagctggaattcggtcaatccattttgcctgaatatcgcccgctgccggaaggaatgacctcttcgccctatttacgcaatctgtgcgtgcaagggctggagcgtcgctatggaagcgatcccggatgggagcaaccggaggaacgggaaaggctgaaccaacggctaaactatgagttgaataccattgacagtatgggtttcagcgattatttcctgattgtatgggattttattgccttcgctcataagcataagattgcaacgggaccggggcggggttcctcagcaggcagtttggttgcctatgtgcttaacatcacgaatgtcgatccgatgaaatacaacctgctctttgaacggtttctgaatccagaacgaattagtatgccagatatagatattgattttagtgatgaacggcgtgacgaggttatcgactatgtagtacagaagtacggaaatgagcatgtagcgcaaattattacctttggaacgctggcggcaagagccgctgttcgtgatgtcggtcgtgcattgaacgtgccgtatggcgaggtggacaaggcagccaagctgattccggcgcagttaggcattaatatccgtcatgcgctggaaatcaccccggagctaaaaacgctatatgaaacgaagcccaagacacgtgaactgctggatatggcgatcaaggttgaaggaatgcctcgtcatgcttcgacacatgcagcaggtgttgtcatttcgcggactccattgaccgatgcggttccgcttcaagaggggagcgaaggggttcctttgacgcagtactcgatggaaaatctagagcgcattggtttgcttaaaatggatttccttgggttgcgtacgctctccattattgaacggtgcatacactggattgcggaagagcatggagaaacgcctgattttaatcgtattcccgataacgatccgcatacctatgacttgctgggcaaaggagatacaggaggcgtattccagctggagtcggccggtgtacgccgggtactcaaggatttgaagccgagtgtattcgaggatatcatttctgtcctggctttgtatcgtccgggcccgatgggctttattcctaactttatacaggccaagcatggtcaaattgaggtttcttatccgcatcctgacctggaaccgatcttaaaggatacgtacggtattattgtgtatcaggagcaaatcatgcagattgcttcgcgcatggcgggcttttctctgggagaagccgatctattgcgccgggctgtgtccaagaaaaagcgcgaagtgttggatctggagcgcgggcattttgtcgaaggcagtatcaagcagggatacacggaggatgaggccggaagggtttacgatatgattgtccgttttgctgactacggtttcccacgtgcccatgcagctgcttatggtgtgctagcatttcagacggcttatctaaaggcccattatccggtacaatttatggcttcattgctaacagcggtgatgggtagtcatcggaaagtagctgaatatgtcgtcgaatgccgtcgtatggatatcgcagtgttgccgcctgatgtgaatgagagcggagtgttgtttactcctttacagcagggaggcatccgcttcggcctagcagcgattaaaaatgtcggcacacaggcgatggagagcattctcgctgttcgcaaggaacggcctttcgacagcctgctcgatttttgtcgacgtgtcgatttgcgggtatgtaataaaagagtgattgaatcgcttattcaggcaggagcctttgattctttgacgggtcatcgggcacaattgcttgccatgctggatgaaacggtcgatgcagccgtcaagtggcgcaaggaacgggatgacttgcaaattgatatgtttggttttgtggaaatgcccaattgggatatcgaatatcccaatgtacccaaattcagtgccagccagcagttagagctggaacgtgaactactgggactgtatttatccgggcacccgttggatgattttgagtcgctgttggaaagcagcgaggcggatcgtttgatggagctgggcgatgtgccagatgaaacggttgttgtgaccgcaggcatggtagtgtcactcaaaacgattacgaccaagcagggtaaggccatggccttcattgagctggaggatcagattgagcgctgtgaggttgtgctgtttcctgaggtatggaagcgaagccagcagtggattgaaaagggagctttgcttacgcttcgagccaagatgcagcagcaggacgagcacttcaagctccttgcggatgagaccgccccgctggcagaagactcgctggcccggctcctccagcgccgacgtgccagtacgcgctcgtccgccgctggaacatccgtgccagctgctggctctgctgctggcggcccgggcgggagagcgtcacgcgtgtcgcccccgccttcggcagccacttcatctgcttcgcctcagccgaaggcggcccgtcccgtgctggctgcttcaccgcgcggagccgaagcggctcgcggtgagcaggtaccgctcccgcgcagctcggagtcgaccgcccgtcagcgggtgtttgtcaaaatcacccgccaggccgaggaggacgccagcttgctggtcagtctcaaggcactgctacaggagcatcccggtgctatgcctaccgtacttttttatgagagcaaccagcgtctgctggctttgagcgatgcttacagcattaagccttctcctcagctttttgatcaaatggagtcgatgttgggtgaaggtacggtgaaagtcaaatgataggcacacagcaaaccgcccttattgtaacggtttaatgaacatttttcttccttcccgcatacacttggaaaactggcggaacaggagattcaacacgtctcctgcaccataaggtcccgtacggtgaaagaatagaactgcacggtgaaagcgggagggaaattatgtcctatgaatatgcagaaactttgttaaatcgcagaggcattcgtatcaagtccattgcggacattgtttttcagcttcagctaaaatattatcctcatttgacgatggaagaatgtatagacagtgtcaaagcggttttgcaaaagcgtgaggttcaatatacgttgctcacaggtattgcgctcgatgagctggccgaaaaaaaacttctcccccagccattgcaagccattatggaggctgacgaaccgctgtacggagtggacgagacactggctcttggaattacgagtgtgtacggcatgatcggcttaaccagttttggttatctggataaggaaaagacggggattattgaacagctgaaccaaaaaggcagtggtattcatgtgtttttagacgatcttgtcgccggactagctgccgctgcttcttcgcgcattgcacaccggagcctccatgccaagcattatcctgcatcattggacgcttaattgacctgtgtagacagagttgatgattttctaggccctccgacggaacttgaatgatcaggagggcttttgttgcgggaaaaaagtaaggtatgttatcatgagtctattatatgggctcaaaacttgaggcttagggggtagaaacaaggcatgtggacggtgatttatattgcaccgacggccagactggctgacatgattaagctcaaactgtctgaagaaggttttatggtgcaggcccgggccatcagtgcgtccaagcaacagtttgagatacttgtgccttcgggtgaagtcgaagaaattcaggaagtgcttaattcgattttgcgcccttgagtccggaacggcggaaatgatacagcagcatgagtggaacaaaggatgcacgatcggcggtaatgttttagtaacaggcgttgacgtgtgtatgaacataatgcttaaaggtgccgcatagacggcagaggaccttgtatcggttacggctgacaaataaacggctggagaggtgtagttgtgtttaaagatttattccaaaagaagcgtaaatacgcgaccatcccttcggaacgggcgctgagcggcgatcaagcggacatgccggatcgtcccaaacgggaaattcccgaaggtcttatgaccaaatgtggcaaatgtggaagtattcaatacagcaaagaactagagaaaaatttgaaagtgtgtccggtgtgcggataccatatgcgtttgaatgcaatggatcgcattcgcatggtgctcgacgaagacacgtttacggaatatgatgccgatatgatttcggttgacccgctggattttccgggatatgcgagcaagctggagcaacagaccctgaaatctggcttgcgagaggctgtcgttacgggcgacggccttatttatggacatcctgttgtcgttgctgtgatgagctttgacttttttactggcagtatgggttcggtcgtaggagagaaaattacccgcgccattgagcaagcaatagacaagcgtctgccgctaattattttctcaacttccggcggggcacgtatgcaggaaagtattttaagcttgatgcagatggccaaaacaagtgctgctcttgctcgtctggatgagcagggcttgctgtatatttctgttatcaccgacccgactacaggtggcgtgtccgccagctttgctacgcttggagatattaatatcgcggagccaggagctgtattcggctttgcagggcgtattgtaattgaacagacaatcagacagaagttgccggatgattttcaaacatccgaatttaatttgcagcatggacaattggatatggttgtacaccgcaaggaactgcgtgataccctcgggcaactgcttgatctgcacagtgtgaaaggggtggaatagatggctggtgaattgccttatgaaaagcccctggtcgagatgcgacagaagatcgaagaactcaagcaattcggacaggataagcaaattgattttacagatgaaatcaaccgtctcgaggaacgttatctcgagatggaagaagaaatatattcgaacattacagcaccacaaaaaatgcatttggcccgtcatcatcaaagaccaacgtctcttgatctgattgagcaggtgtttacggactttattgaattgcacggcgaccgcttgtttggagacgatctggcggttgtgggcgggattgccaagctaaatggtattccggtgaccgtcattggccagcagcgtggtaaggatacgaaagataacattgcacgttttttcggtagtgcccacccggaaggatttcgtaaaggcttgcgtcttatgcagcaggctgataaattcaaacgccctattattacatttattgatacgaagggcgcttatccgggtaatacagcagaggagagaggtcaatcggaagcgattgcccgcaacttgcgggagatggcaaagctttcggtacctgttatttgtgtggtcatcggcgagggtggaagcggcggtgcgcttgcgtttgcagtcggtaaccgtgtgctgatgctggaacatgccatttattcggccatttctccaaacggtgcagcttcgattctatggaaagatgcttccaaggccgatcaggcagctgaagccatgaagattacggctaatgacctcctgcgcatggaaattatcgaggatattgtgccggagccgaaagggggcgcgcatcgtaactatgaagtgactgctgccgcaatcaaggagctattggaacgtcatttggcagaccttacgaatatgagctgcgatgaattgagggaagatcggtatcaaaaattccgaaaaataggtcaatacaccttcttaaaaccttcggaatctgagcctatgttgtaatacgctgtaaacgggtaacaataaatatgacgaacttcctatacaaataggaaaaagtgtagtagatttaattgttggaaaaagatataaagagtagcacctttgaaaacggaggaaaaacccaaatgcgcaaaactaagattgtatgtaccatcggtccttccagtgagtcattggaaaatgtgaagaaactgattttggctggtatgaacgtagcccgcctgaatttctctcacggtgatttcgaggagcatggcaaccggattaaaaacatccgtcaagcttgtaaggagcttaacaaaaacgttgctattttgctcgatacgaaggggccggaaatccggacaggaaagctcgaagttgaacctattgagcttgttcaggacgagttcattacgctgacaacggaagaaattctcggtacgcaagatcgtatttccattacgtacaaagatcttccctcggacgtggagcccggctccaccattctgatcgacgatggtctgatcggactcaccgttattgaagtatcaggcactgaaatcaaatgccgcattgttaatggcggaacgatcaaaagcaagaagggcgttaacgttccaggcgttgctatttctttgcctggtattaccgaaaaagatgctaatgatatcattttcggtattgagcaggacattgatttcatcgcggcttcttttgttcgtaaagcaagtgacgttctggaaatccgtgaattgctggcgaaacacaacgcaagtcatatccaaatcatttccaaaatagaaaatcagcaaggtgttgacaacctggatgaaattttggaagcttcggatggcctgatggttgctcgtggtgatctcggtgtggaaattcctgctgaagaagtgcctctggcgcaaaaattgatgattaacaaatgtaatgtagctggcaagcctgttattacggcaacacaaatgctggattccatgcaacgtaacccgcgtccgactcgtgcggaagcaagtgacgtggcgaatgctatttttgacggaacagacgcaattatgctgtccggcgaaacagctgcgggtaaatatccggtagaatccgtactgacgatgtcacgtattgcagaaaaagctgagtcctctctgaactaccgtgatttgttcaagaaacaaagaacggctcaagaaattagtattacagaagcaatcagtcaatctgtttctatttctgcacttgacctgcatgccaaagcgatcctgacgtccacacaaagcggaacaacggcacgtatgatttctaaataccgtcctgaagctccgattgttgctgtgacaacacaggaaagaacagttcgccgtttggctctgatctggggcgtacatgcagtacaaggcagaccagtcgttgacacaacagatagtctgtttgacaacgcactggaaggcggtcgcaaatctggcctcgttaaagagggcgatttggttgtaattactgcgggcgtacctcttggtgattccggttctacgaacctgatcaaaattagctgcgttccagcacaagcgtaattaaagtctccatgacataataccgaggctgtatcgttacaacaagcaaaagagcattcaagtcaataagacttggatgctctttttttatgttctctagcttttcatttccagtccttctcgtcgtatgaaatcaagaaatgcctgttgcatcaagttcatgtgtgtatcttgttgatacacgatgtttatttgataatggctcctttggttatcagcctcgggataagggagccattccaccgagggagcagcattttcattattatccactccgcttgcaggaaagaaggcaagcgcttctccgccgcttacgacttgctttaccgcttcccaagagttgatttccagatgaggcttaactagcgaggaatactgatctacaactgatgaaccgctatattttacccatgtgtgcttgtccagcacatcgggtccatcgacctcctcaaatttgaatgcaggtgcaagtgcagatgcagaacggataactcctacttgatcagaagccactggctctgccaccgtatactctggaagagaatctctatcgtcgagaaaagcaaaatcaatttccccctgtttcagtagctgcttaattgcatccggggattgaatctccaactgaatacgacaatctggataccgctcagcaaacttagccatcaaagtggggaggaggtacgtacctgatatcgactctgcactcagatgtaattgcgcctgagactcttctgtcagttcatctacagcttgtctagcttcttgctccagagagatgatctgctttgcgtaaggtaataatttttttccagcctccgttagcataattctgccttgttgaagagagaatagagaaacacccatttccttttccaagcttttcatatgaaagctgacggtaggttgtttaacttgcaaagcttcggccacatccgtcgccttatggaatttgtcgatcagcatcaaaatacgcaattttagaatattcatggaattcaacagctctccttatatgtcattcatatgtgaatttcaaactatagattaattatataccgaaaaataatttatctatcaatattttatatttgttttacaaaaccacgtcgttcgtctaacattccaggcctacaatgtaaaagtgttgatggtcataaataaaaaaccgtcacttaactaaggggaggacaataaaaaatgttgaaaaaatggccgttcattctgatgactctcaccatggtatttgcacttgcagcttgcggatcaggtaacaatgctgcaccacaaggagaagctgctacaggaacagacaataaagcagctgccgaactgacaggaaacattctggctgttggctccactgcacttcaaccattggtagagcaagcgggacaaaaatttatggctgtcgataaatataaaggcattgcagttcaagtgcagggcggcggtagcggtactggcttgactcaggtttccggcggacaagcggacatcggtaactccgacgtgtttgcaaaagaaaaactggagagcggcgcaaatgagctggtcgatcaccaagtagctgttgtagccatgtcagcggtagcgaatcctaaagtaggcgttacagacctgaaaaaagatcaattggtacaaatctttacaggtaaaatcacgaactggaaagaagttggcggtgcagatcaaaaaatcgttatcgtaaaccgtccaagcagctccggtactcgtgcaacatttgaaaaatacgcattgggacaaaaaacggaagatctgccgggctccattcaagaagattcctccggtactgtgaaaaagctgattgctgaaacaccgggtgcgattggttatctggctctgtcctacatcgacaacacagtaactgctttgaaatacgatggcgttgaagctaacgttgaaaatgtagaacaaggtaaatatccagtgtgggcttacgagcatatgtacactaaaggtgagccaaaagagcatgtgaaagcattcctggactacattctgtcagatgaaatccaaaaaacggatgtcgtagacttgggatacattccagtagcaggtatgcaagtgaaacgtgatgctgacggtaatatcacgaaataaggagagtcacacctcctgttcgatgaacgcagctaatgcgagtatattcacgaagaagaggcggactagcgtccggcctctattcttcggttaaaggagttacagtatggaaccaattgaagggaaggcatacatggaacagaataaacgatcccgagttatgaaagaaagacattactgggaagaatggaccggccgcatatatacgtcggtttgtgtcgtttttttagttgcagtcattgtctccatcgtatattttgttgcctccaaaggtgtagctacatttgcggtgaatggggtcagtctgcgagagtttttctttggaaccaaatggagcccggatggcgaacctaagtccttcggcgcgcttccgtttattacgggttcttttgcagtaaccatactggcggctttaattgccagtccactcagcttatgtgcggctttatttatgacggaaatcgtgccgaaatcgggtaaacgtatccttcaacctgcgattgaattattatccggtattccgtctgttgtatatggctttgtcggcttgaccgtgatcgtcccgctgctgcggaacgtgtttggaggacaaggcatcggcattctggcaggctgcctagtgttgtcagtcatgattttgccgacgattacgagtattatggcggatgcgttgtcttccttgccgggggggctgcgtgaatcctcttatgctttgggtgctacccgctggcagacaattgcccgtgttattattccgacgctgttgcctgctcttttaacaggaattatcctcggtatggctcgtgccttcggagaagcgttggctgtacagatggtaatcgggaatgctccgcatataccgcattccttgctggaatccgcttcgaccttgaccagcgtcattacactaagcatgggcaatacagcgatgggctccgttcataacaatgctctctggagcatggcgcttgttcttctgctcatgacattcattttcgtgctgctggtaaggctgcttgaaaggagaaaccgggtttgatgaaagctaaaacgaccgacaagatcgctacatttgtaatctgtttcttcgccttgttcattgttgcacttttggttggattactgggcttcattttggcccgcggagtcagtcatatttcttttgactttttaaccagtgctccccaaacattacgtgcaggcggtggtattggcccacaactatttaattccgtgtttttgttaatcttaactttgattatcaccattccgattggctggggcgcaggtatttacatggcgcaatatgcaaagccggggaaaattacggactttatacgacttgtcgtcgaagtattgtcctccttcccgtctatcgtcatcggattgtttggactactacttatcgtaaatacgtttgattttggtttttccctcttatcaggagccttggctttggccgtatttaacctaccgctgatggttcgcacaacggagcaggctttccgagctgtgccgaaggagcaaaaggaagctggacttgcgcttggattgtccaagtggaaaattatcacctccattttgttgccagctgcgctgccaagcttgattacgggtaccattttggccgcaggccgtattttcggggaagccgcagcattgctgtttacagcagggatgagtacgccgccgcttgattttactgattggaatccattgcatgccagatcgcctattaacccgatgcgacctgctgagacattggctgtccatatttggaaggtcaacagtgaggggattgctcctgactccaaagatattgctgcaggcgcttctgccgtactggtgctgcttgtgcttgcattcaacttgagtgcaagatggttcggaagagttgtataccgccgtctgacagctgccaaacgtatggattagaaaggggatggagaacaatggaacatgtgattacgcgaacggtaaaaaccgccgcaccagcaacatccgttcagtctacgcgttcggaacagcttgcggggcaaccgccgcatccgttcagtactgaggatttgagtatttattatggcagctttgaggctgtgaaaaaagtgaatctggcctttccggaacagacagtgactgccctgatcgggccttccggctgcggtaaatcgacctttttgcgctcccttaatcggatgaatgatgagattgcgtcttcctctacaacgggacatatctggatggatggacaggatttgacggcaccggaaacggacgtgatcaagctgcgtcagcaaattggcatggtgtggcaacgtcccaatcctttttacaaatccatttacaataatatcgccttcggtcccaaataccgtggggtgcgcaagaagaaacagcttgataaaatcgtcgaaagcagcctgcgtaaagcagcattatgggatgaggtcaaggatcgccttcacgattccgctctggcgctgtctggcgggcaacagcagcggctttgcattgcacgtgcactatccgttcagccgaaaattctattgcttgacgagccagcttccgcgctggaccctgtgtctacaggcaaggtagaagagctcatcaccgaattaaaaaaagaactgcgcatcgttattgtgacgcacaatatgcagcaggctgcacgaatttccgattatactgcttatttttatattggaagtctggttgaacatgggaaaacgaacgatattttcacgaatcctgaaaatgagcttactcaggagtacatcatgggtcgatttggttaagcgatgttgctcatcgacctactatatatgagctgcacgtaaaatcctcttactaatccagcattagtaagaggatttttattgtgttcaacattttgtaacttttttaatctattagtaaattaaaatatattgatcgtttgggtatattttcatataatacaactaactatttatcatgcataaatagtggtttagttcccctcgctatcaaaaagaatcttctgcaagagtaaatagggttaaactgaacacaattacccaaatcaaaataagggagagggttcaaatgaagaagaagatgtgtccaaccgtaaagatgatagcgctttcaagtttggcaattacagtaacgtcaggactcctaagtccctcatgggctgcggcacaggagatggtgccgactacatatgattcaggacgtgaatcggcgactgcttcttatgaacttaccacagattcagctgtgcgacgggacgtttatggcggtgatgtaaattcaggtgttttggatcgtgagccattatttgggctgtcggctgtggcgaagccaaccgctgttgtgaatacagacagcctcctgaacaaaatgcgcgactttagcaagttttctacggggaatatatccaaggatacgacgcttgccttaaatattgtatcctggcaattgccgcatggcggattcttcaaagctatggaaaagaattataaatctaaatgggatggcaaagctgcacgctccacatggaaaagcaaggatggtgttgaactcggaacgtttgataacgaggccacgacaaccgagattcgttttttagcggatgtatacaaaaaaaccaaaaataaagatattaagaacagtgtacaaaaagcagtcgacttcgtactaacctctcaatattcctcaggtggctggcctcaagtataccctaaacgtggtaattattccgatgctgtaacttataatgatgatgcgatggtcagagttatggttttggctgacgatattgtgaacaagaagcagccgtttgatagcgatattctggataactcttaccgctccagacttcagcaagcgctaaacaaaggtatccagtacacaattaaatctcaaattgtaaataatggtacaccaacaatttggggggcacagcacgatccggctacttatgcatctgttgaagcccgggcatttgagttaccttccaaaacaactacagaatcagtaggcattactgcttttctcatgtcccagccgcaaaccgctgaagtgaaaaaagcggctcagagtgctttgaaatggtttgacgcgaaccgaatcgacggtatcaaatacaatcgtcaaggtccggagtttttccaaaaggacgcatcgagcgtaatgtggtatcggttctataacgtggaagacaataaatatttcttttcagaccgggatggcaaaaagtataccgacatcatgaaaattagtgaggaaagacgacttggttacgcctgggcgggaagccaggctaagagcttgctcaagctggcttcggatagcggatattataaactgtccaagccgttgccacaataataaaggcattattatatatgattggagagggcggaccgttcggtctgccctctttttgttcccgggctgtaaatatggtttaatggagagagggcaaaatagagataaagatgcacaaagataggagagcttgtatgactcaagaggagaaacaaacggaattacgctggtatggcgcaccgctacgcgtccgttatcaggaaagcgaccagatgggggtcgtatatcatgcgaattatttgaactggtttgagatcgggcgcaccgaaatgatccgacaggcgggttttaactatcggagtatggaggaacgaggagtcttgctgccagttattgaaatcaatgcgaaatatgcgagtcctgctcgatatgatgatttaattaccatttatactgcaattacggacttctccagattacgtctaaactatatctatgaggttcgacgggtaacggaagatgagcatcaaaggtatatgggaaaggtatggacccaggcagacacgctgccgggagaattgcttgtcacagggatgacacggcacgtatggttgaacaccgaatggaagcccgttcgactggatcaggcgctacctgagctgtacactgcattaaggtttgcttttacaggcggggagggacagaagtcatgatgatgcgtaaacgtctgtggctgttgctgctgctcattcctttggcggagctgtacgggtttatatgggtaagtcactggattggagcgggcaaaacgattttactcatcattctgacgaccctaatcggggctgccatgatgcaatttgaaggtcgtaaggtgattgccgatgcgaaaaatgaaatgaaccggggacaaatgcccggccgtaaaatgctggatggattatgtgtctttttcggtgggagtttgctgcttatccctggatttttaacagatattattggttttacgttggtgtttcctttaacacgagcgttgtaccgacggtttttattgaagtggctggagaaaaaaatgaagaacggcagtattacgtttcggcggttttgacgtgagctgccgtttttcctatccctgatttagcggactcttccagcgagaatatagttgcgcaagtcctgaatgacattcgcgcgattcagtgcatcaacgacaatgagtgatacaggtccgataattagtcctaaaacgccaaacagcttgagcccgatgaacataccgatgagggtgggaagcgggttcaagcccacgctgctggccagcaccttaggctccacgatctgtcgtccaatcaacaggatgatataaaggatcgacaatcctactcctagtgccaaattaccagacatatacgcatacagtatccacggaatcatcacaatgccaacccccaaataaggtagcaagtccaccagcccgatcatcaaaccgatggtaaaggcggattccacacgcaatatgaacagcccaacaatgaccgttaatgccgtaatggatatgataatgaactgtgcgcgcaaatagccgtacagtgctttacgcaaatcgtgccatatatccgacaatggcttgcgaatcgtatcaggaatcgtgtttgagagcatccgactatgtcggtcccaatccttactaataaaaaaggctgctaatacaataaccattagaactgctcccatattaggcagagaggtcagcaagttcaaaactccattaaaaaattgagcgactagcgtagtgacagccgaactgacagtttgagttgtcttatcaatattactgttaatggtatgttggtaatccggattatcccggatgaaatggttaatttcaataattacattttgaatcaaatcgctttgtgtccaatcgataaatagacttttaaaacgctcaatatgtccgtcaaaagtcatggccaactttataacttcacggaccatgcgggtgattgcagcagataggataattgcaattccacctaaatatacaaataatgagaccgtgacagccgtccaacgtggcatacgggctttgctacgcagaaaactaaccagtggattcatggcataagccacaagccaggcgaataggaaaggatagacgagagggaaaagcacatatatgcccagtaacagagctacaatcacgattgccacccatagagcacgaaatatgcgattcaggattaaccggctcaagctctcacggctcctttcttttacgatagtttttcataaaataaatgctctactatacatatgcgggaaaggggggagacaagacctgtgtaaaaaagtgcaaatgaatcaatattttttgtaaggggtttcaaaaatttatttatggaagcgataaaacatttgaatgtgttggaatagccctcaatgttcacataaacgacaaaatccagtatagtgaaagaaggtttaaatattgacatatggcgttaacattactcagctatttaaaagacatatcttacttttgaaaatgtttacattgcaagtccgttcacaatgtttttacaaaggagagatgtaacgatgacagcgactaaaggtctggaagggatcgtagcgaccacttcctccataagctctatcgtagatggcgttctcacgtaccggggttataacattgatgatttggctgttaacgccgattttgaagaggtagcttatttgttgtggtttggaaaattacctgataaagagcaattgcaggagcttcgcaaccagttaagcgaatacgctgctattccggatgaaattgttactcaattaaagttatatccgaaaaatttgagcacgatggctgccttgaggtcagccgtatcgtctctcgctttgtatgacccagaggcggatgatatgtcgagagagtctaatgtgaccaaaaccgtcaagcttcaggcgcaattgcctaccattgtggcagctatagcacgtatacgcgagggcttggagccgattgcgcctaaaaaaggtatttccatcgctgaaaactttttgtatcagctgactggcaaggacccggaggagacggctattaaagcgttcaatcaggctctcgtgttgcacgccgatcatgaattaaatgcttctacctttgctgcgcgtgtaacggtagccacattgtcggatatttattccggaatcacgtctgcaattggagctttaaaaggaccactgcatggtggggccaatgaggctgtggccaaaacgctggaggagattggtggcttggatcaggtggactcctatattcaggcgaaactggataaccgcgaaaaaattatgggctttggacaccgagtctataaaaacggtgatccgcgtgccaagcatttgcacaaaatgtcccgcgagctgggggaaatgaacggcgacacaacgttgtttgatatgtcagttcgaattgaaggaattgtaacagggcaaaaaggcttgaagcccaatgtggatttttattctgcctctgtgtatacccagttgggtatcaagagagacctgtttacacctatttttgctgtgagtcgtgtatctgggtggaccgcacacattttagagcagtatgaaaataaccgcctgattcgtcctcgcgccgaatatacaggtccaatggatcaaaaatatgtatcaccagagttgcgctaaccctttgtcgaaggaagattgaggttgtataccctgaatttaaaaaataaggtacaatagaggggacgacgagagatgtacgtttttgtctgtgataaagatcatgtctttcgtcctgtacccattcatatctgaggaggaaaaggaacttatggcgaaatttgaaaagtttgagctcccaactgaaggcgaaaaaattacgattgataacggtcaactacgggttccgaaccatccggtaattccgtttatcgaaggtgacggcacaggtcgcgatatctggaaagcttccaagcgcgtactggacgcagctgtagaaaaagcatataacggcagcaaaaagattgcctggtatgaagtattcgctggtgagaaagctttcaatacatacggcgaatggctccctaacgatactttggaagccatccgtgagtatattgtagccatcaaaggtccacttacaacacctattggcggtggtatccgttcgttgaatgtggcattgcggcaagaactggatttatacgtatgtctgcgtcctgttcgttattttaacggtgttccttctcctgtgaaacgtcctgaattggtagacatggttattttccgtgagaacacagaagatatttacgcggggatcgagtatgctgaagggtccgaagacgtgaaaaaggttattcagttcctccaacaagagctgggtgtgaacaaaattcgtttccctgaaacctctggtattggcattaagccagtttcttccgagggttcaaagcgtctggtacgggcagccattcagtatgctgttgaccacggacgcaagagtgtcacgctcgtacacaaaggtaacattatgaaatttaccgagggcgccttcaaaaactggggttatgaagtggctgaggaagaatttgcagataaagtatttacttgggcccaatatgatgtaatcaaggaaaaagacggtgaggatgcggcaaatgcagctcaaaaagcggctgaagatgcaggcaaaatcattatcaaggatgcgattgctgatattgcacttcagcaagtactgactcgtccttctgaatttgatgtaattgctacgctcaacctgaacggggactacctgtccgatgctcttgctgcccaagttggtggaattggtattgcgccaggtgcaaacattaactatgtaacagggcatgctatctttgaagctacacatggtacagctccaaaatacgccgacaaagacgtagtgaaccctggttccgtaattctgtcgggcgtaatgttgcttgaacacttgggttggaaagaagcggctgacctgatttacaaagggctggagacgtccattaataagaagattgtaacttatgactttgctcgtctgatggatggtgctacacaagtgaaatgctccgagttcgcagataccattattagtaacctgtaaggaaggggaataccacttgtccattcaacgtaaaaaaatatccattgttggcgccggttttaccggtgccactaccgcattgctgctggctcaaaaggagctgggtgatatcgtactgatcgatattccgcaactagagaatccgaccaaaggcaaggcgcttgatattttggaggccggtccggtacagggatttgacagccagatcacgggcacttccagttacgaggatgcagctaactcggatatcgtcattattacagccgggattgcacgcaagccgggtatgagccgtgatgatttggtaaatacgaacgcaggaattgtaaaatccgtttgtgagaacgtgaagaagtatgcgccggattctatcgtcattattctgagtaatccggtagatgctatgacctatactgcttatcaaacgcttggattcccgaaaaatcgggttattggccaatcaggtgtgctggatacagcgcgatattgtacctttattgcacaagaactgaacgtttccgtcgaagacgtacgcggcttcgttatgggtggtcacggtgatgatatggtgcccctggtacgctattccagcgttggaggtatacctatcgaaaccctgatttcgcaggaacgtatcgaagcaatcgtacaacggacacgcggtggtggcggtgagatcgtcaacctgttgggtaatggtagcgcatattatgcaccggcagcttcgcttgcacagatgacagaagcgattgtaaaagataaaaaacggattatcccggtcattgcctatctggagggagagtacggctatcaggatttgttccttggcgtaccgacacttcttggcggtaatggtatcgaaaaagtgttcgagttggaattgacagccgaagaaaaagcagcgctcgatcaatccgccgaatcggtccgcagtgtgattaaaatagttactgtatagattcaattttctactaaaacgctatacttttacttgaagaggtgttcccaagccatagtcatggccatcggacacctcttttacttttaaacggaatatagaatctattcgttttcttccttatttcctttgctttggaccacttccccggtataatagagttcatatgcattgatagttacatgaggatttttcaaaaatccttacatagaaaagcatgtcccaaaacactgaaaagatggtagtcattcgttggaatatgatcgttctatggaaaaagagtttgtgagaaaacaaagaaatggaggttataaagaatgttttttattcacattattggatcactggcgatgggtttttatttattgctccccttcgttgtgggcaaaatcgacaaattggctccaagtgcgcaggaagggacgatatcggctgtacagctattaaaccgtctggctcaatttgcactgattcttgtacttattagcggcatctatatgatttttgtttgggattcttattcggtagcatggatcgttgttgtgttggtgttgtttcttgccatttccggtattgctggtgctatgggtaagccattacgcttgtcactggaagcggttcgtaaccaacagccgattacgcaatacgctggtaaaatgcggatgttcagcacgctgctggctgtcttcatgattctaattacgattttaatggtatacagccatattatttaattatgcatttggtgagagcctataatccaatgatgacaaatgctaaattgaaaaaaaacggtctgtgctgaataagcataggccgtttttttgtgcactcaaataactacatttttcttttttcgtttaacgaataactttgtgtggtaaatcaggagtagagtggatgcaaatgttgcatcctaaaaaatatctgattttgaagggagaatgtacaatgcctaaaagtaatcaacctcagcaaactttgcccccacagcatcaagaccaacaaccggggattgagtccaaaatgtcgcctgcacctcagtttgaaaaaccaacttataaagccgctggcaagctaacaggtaaagttgcacttattactggtggggacagtggaattggaagggctgtagctgtcacgtatgccaaagaaggtgcggacgtagctatcatctacttgaatgagcataaggatgcggaagaaacaaaacgtcaggtagagcaggaggggcgcaaatgcgtattgattcctggcgatatcggagatgaccaatttgccaaaaaagcggttcaacagacggttaacgagttgggcaagctcgacattgtcgtgaacaatgcggcagagcaacatccacaacaaaagctggaggatatcaccaaagaacagttggagcgcacgttccgtacgaatattttcggtatgttcttcctgacgcaagcagcattgccgcatttgaagaaagggagcacaattgtcaatacaacatcgattaccgcgtacgctgggaacaagacactcattgactattcatcgaccaaaggggcgatcacatcctttactcgttccctttcactcaatttggcggatcaaggtattcgggtgaacgctgtagcaccagggccaatctggacgccgttaatcccgtctacctttgatgccaagacagtcagcgaatttggaggagcacagcctatgaagcgcccgggtcagccggaagaattggcgccagcttatgtgtaccttgcttcagacgattcgtcttatgtaagcgggcaggttattcatatcaatggcggtgaagttataaacggataagaggacaaaggaaaggctggggccgtgttatgccctggccttttttcttttcacagtggaacataatgaaggtagcctgtagaatgagacttaacttacataaaggatgggcatattttatgaaatcgtttcgtttcaggcttaccctgatcatgctgattttgattggcgtatctgtccttgctgctggaatcacgatgggacaaatttttaaaaattcgaatatgaaggtgctagaggagaacatgggacgggagatcgacctgctacgcgctacattcccatttgtgaatgcagatgccctgtccagtacggattatgtatcttattattctcaaaaggcgaaggaaattgcccgtctgacggaatcgcgggtgaccttcattcgcaaggacgggacggtggttggcgattcgttaagcgatccgcgtaagatggaaaaccacgcatctcgtgaagaaattcagcaagcctccacagagagaatcggacgcacgattcgttacagcgaaaccttgcagcggaacatgctatacgttgcagagcctgttgtatcggacaagggctttgacggatatatccgtttgtccatgagtctgaaagcggtggaggagggagtacgccgcggctggacggctatcgggattggactcgtattgctatttcttgctgctggattggtgagctatcgtattgcccgcagtctgacttcgcctattgagcatattacaggggtagccaaccgcatttcaggactggattatgacgcaagggttggtgtgcagcgccgggacgaagtagggcaactgggggaagccattaatcgtatggctgacagtctccaaaaccaaatgaaaacgatacgtgacaatgaggatctactccagagcgtcatgagtaatatgacaggcgggattctaatgattgatgcaagtgagtgtattgcgcttgtaaaccgtgagtctgagcgaatgctcggtgtcgtgggtaaacgggtgacggacaagccgtatcatgagctgaagaagcactatgagctcacaaagctaattgagggcagcatacaaagccgagagaggctgcatggtgaggttcatttgtacaatcccgaggagagactcgtgttgctagacggtgttccgatgtatgaggatgaaggcggataccgggggatgctattccttttacaggatattacggctattcgacggttggaaaatatgcggagcgaatttgtggcaaacgtttctcatgagctaaaaacaccaattgccgcagtcaagggttttgccgagacgttactcggtggcggggttaaagatgaggagacggcccgttcatttttgcaaattatatatgatgaaagcgaacgattgaatcggctgatcggtgacattttggagctatccaaaattgaatccaagcgttctccgctggattgctcgccggtgcacgtttcgtcgttcatagaatcattgctggaaaaactgaacaatgtagctgccaaaaaaagaattacgctacacatggatatcccggatgagctgtttatggaggcggatgaagataagcttcagcagattttcctgaaccttttgtctaatggtatcaactatacacttgatggtggcaaggtaaagattaaggttttaacgatccagcgggagaatggcacggaaaaggtcgtatttacagtcagtgatacaggtattggaattccaaagaaggacctgccacgtatctttgaacgcttttaccgggtggacaaaggacgctcgcgcaactctggcggaacgggactgggattgtcgatcgtcaaacacttggtcgatttgcatcatggcaccctttcggtggaaagtgagcttggattgggtaccacatttacagttgaattaccgctattgcaacaggaagaatgaactataaccttttttacattctgttaacaatgccgtgataaaataaacgggtgtcgcatgagtatggaaaagatttctggattttgaccaatgcgcctttaataggtaaacaggagatgaagttatttatgggacaacgcttgctggttattgaggatgaaccaacgcttgccagattgctatcctacaatttgatacaagaaggcttcgaagtggacacggaggatcatggcagtgcagggtttgaaaaagcctccagagagtcctacgatttgatcctgctggatttgatgctgccgggaatgaacggtctggacattctgagcagacttcgccatcaggggctgacaacgcctatcattattttaacggccaaaaacggcgaggccgaggttgtccaagggctgaagtcgggtgcagatgattacatcacgaagccttttggcgtttctgagctgttggcacgtgtaacggctgtgctgcgaagaacttccggcggggatgaaggagtgctgtctgatcagaaagatagctccaaaattcaactgggcgagctggagatttatcctgagaaatatgaagtcattcttggaggtcagtctatcagcctcagaccaaaggaatttgaggtacttctttatttgtcccgcaagccgggtgtggtcctgacccgggatgatctgatgaatgctgtttggggttttgactacattggtggtcaacgaaccgtggatgtgcacgtcagttccttacgtaaaaagctggagctggatcccgactcggttcatatcgattcgatccgtggagtggggtacaagctggttgtaaataaaaaaagaagcgcttctcatttattataaatgaggagcgtttttctttatccagggaagtgtccgacgacttttgtgtccatttcgtgattttacatttcattaacaaaaatagacgctagaatcaacaaatgaccgatatgatgttcccgtcactccaagtagttaaaaaaaggggacttcagaacgatgataacggaaccaaagacccagccgagttccactgccgtgattgaacgtgaagcatacaagccgattactacctatgtgtcatgccgggaggttccgatcattggtacggatatgtcttgtaaagaactgttagcacttatgaaaacacaggaagatataccttgtgtcattgttgtggataaaaatgatcttccattgggcattattatgagagatgcgtacaatcgccattttacgggtagatttgctgcggcgttgttctatgataagcctgcggccatatttgccgatcccaatacattaattgtggatctgaaaagccaggcatcggacattgtggaactggcgatgctgcgcgaagatcagcgtttttacgattgtgtgttgattaaggaaggaacacggttactcggcgtactcacgattcgtgatatcctgtccgtcgtgcagcgaatgcaaagagaagcggacgaagagcggggcgatgtgattcggcatagctatgagggagtccagcgtattcagctgactgtgctggatgcagctaaagaggccgatgacagtgtgcggctaacccggtcaatgagtgagttatcccgccgtggcaaagtagaactggaagatgttttgctctcctatcgtgcagtcacggagcaaatgaagcgccagcatgagcagatgactgcgttgacccaatcgctgaatgacattgcgggcatggcctcatccattcgtgcactggcagatcatagcggactgctggcgatcaacgcgtccattgaagcggcgcatgctggagaacacggacgaggcttccagattgtgtctcaggaagtgcggaatatgtcactccagacgaaagccttttccacgcagatcacaggcttactcacccatatcgagcaaatgctgcgtgacaccgctgaactgacggatacgagtatgcagcagattcatacaggctctcaatatatttctgccggaacacaaacttttgccaaactactgcaggctgtcaatgaaattgaagccaaaaacagcgaaatgtcccgttccgcagaggaagcggctttgaatgcagccgaaattgcgcaggagcttgagctcatgctaagttcttgatcattttacataccgttaacaaatccaccacactaaatttacacacagcttatataatcttcatattgtgcaaatcaggtgcaatgcttgaggatcataactgcaacacgaaggagatcataaatccatgaatgattccgtaatccggatcgataagctgaatttatattatgagaaatttcacgcgctgaaacatataaacctcgatattcctgaaaaaacggtaactgccttcatcggcccgtccggctgcggcaaatcaaccctgctgcgtacgctgaaccggatgaatgacatgataccgggaacgcgtattgaaggcactgtgagtatcgcaggtcaggatatatacggcgatactatggaagtagaaactctgcgtaagcaggtgggaatggtttttcaacagcctaacccatttcccaaatcgatttatgataacgtggcctacggcccgcgtctgcatggaattcggcaaaaggacaagttggacgaattggttgagcaaagcctgcggcaggcggcactttgggaagaggtcaaggattttctgaagcgttctgctctgagtttatccggtggacaacagcaacggttgtgcattgcccgggcgcttgctgtacagccagatattttgcttatggacgaggcgacatctgcgctggatccgatctccacgatgaaaattgaagaactggttcaggaattgcgagacacgtataccattgtcatggtgacgcataacatgcatcaggcagcgcgtgtgtccggtcgaactgcgttctttttgaatggtgttgtggtggaagcggcggatacacagacgatgttttccacgccgcaagattcacgtacagaagattatatttcagggcgatttggctaaagcctacagatgaatatgccagaaggggtgacttcgaaatgatacgtagaaaaggttttgatgaagggttagatgaactgagagccgtactgcgcgaaatgggtgcacacgtttcgaaggcgctcgatcaggccattgaatgtttgcagaccaaaaatacagaattggctcagcaggtggtcaaaaatgatgcatcccttaatacgctggaagagaatattctcgatatgggttccaagctcattattacccagcagccggtagcgaaggatttgcgccggatcattgttgcatttaaaatttccagtgatctggaacgaatgggcgatttggcgcttgatattgccaaggtgacacttcgcttggaagggcagcagatcattaagccgctggtggatattccgcacatggcttccattgttaaagaaatgatagatgatgcgatcaaatcctatttggatgaaaatacagatctggcctacaaaatggccaaagaggatgatcgagtagattccatgtatagccatatgatcagcgatttgtacgcctttatggtagaaaagccggcagaggcttcacaagccatgctgcaactgcttgtaggacgatacattgaacgaattggtgaccatgctacgaatatcggtgaaagcactgtatatctcgtgacaggggagagaccagatttgaaccagtagagctttcaggtatatagcggttgtttctgacccagacttgtctttgagcaaaaggcaaatttggttaggaagcagccgtttttttctgaaaaaggagtcttgtatgttaagataggaagaggaatgcgtaaaacgtaagaacgttacgaatgcattgatgaacttgcgaggtgctaaatggataaactcatgcttatagatggtaacagtatcatttaccgggcgttttttgctatgccaccgttaacgaattcgagcgggcagcagacgaacgcggtgtacggatttacgacgatgttattgcggctcttggaggagcacaaaccaacacatattctggttgccttcgatgccggtaaaataacgtttcgccataaaggatacgaggattacaaaggtggacgggagaaaacaccgccagagctgtcccagcaatttccgttgctgaaagagctattgaccgcttttggcattgcccagtttgaactggatggctatgaggcggacgatattataggcaccctctccaagacagcggacgaagccggtttcaatgtgctggtcgtgaccggggacaaggatatgcttcaattggcttcagaccatgtcacagttggcttgacccgcaaaggggttactgaggtggagacatatggacctgagcaaattcaggaacgatatggcctgaagccgctgcaaattattgaccttaagggtctgatgggcgatacatcggacaatattcctggtattcccggcgtgggtgaaaaaacagcgctcaagctgctgcatcaatacggttcagtcgaagaagtgctggcgcacacgaatgagctgaagggcaaaatgaaagaacgcgtagagacacatgccgatgatgcgcgaatgagcaaagatttggcgaccatttatcgggatgtaacgttggacaagcagctggaagatgtggcctttggcgggctgcaagcagaaacggccgggccagctctggcgaagctagagttcaagtccttgctggagcgtttatccttttcaggtgaggttggcagtactggggtagatgtagaggaagccgcggctgacgtaacagtgctggatgagcagcggattagcgaattggtagaagtgttggatcatgtggatgtgctgcatgttgagacgcatggtgataatccgcatcatgctgacatcgtaggtctgatatttgccgcaacagggcagcagtattttatgacgctggatgtactgcaaagcgatgcagctacacctattcgcgaatggcttgctgaccctgaacgcaaaaaacgtggtcatgatctgcatcgtacggatttggctttacactggcatggaattgcgtttgcaggggccgagtttgatgtgcaactggcagggtacttgctggacccgaccgatgcaaaccagacattgagcggattggcagccaaatatggtttgtcttcgatccgtccagacgaagaagtgttcggtaaaggagctaaatataaagtccctgacgtggctgtactgtccgatcatgtggcgcgtaaggcagcggtgattgaagctttggtgcctgtacagcaggcggagctggaaaaaacggaaatgcacaagctgtttcatgagctggagatgccgttgtcccgcattttggcggatatggagaagcagggcattttggtgaatgtagaagaactgcgcgctttggggaaagaatttgaagcccagattgcaacgttggtgggtgaaatttacagcattgctggagtagagttcaatctgaattcgcccaagcagttgggtgagattttgtttgataaactgggtttacctgtcattaaaaagacgaaaacggggtactcgaccgatgcggaggttctggaaaagctggccccctatcatgatattgtgcaaaatattttgcagtaccgcaccattgccaaactccaatcgacgtatgtcgaaggattgctgaaagaaatttcggagaaaacaggtaaggtgcatacgtatttccggcagaccgttgcagcaactggacgcttgagcagtcaatttccgaatttgcaaaacatcccgattcgtctcgaagaaggacgcaaaatccgcaaagtatttgttccgtccgaaccgggctggtctattttggcggcagactactcacagatcgagctgcgggtgctggctgatatttcggatgatgaacgtttgaaggaggcctttgtccacgatatggacatccataccaagaccgcatccgatgtgtttggggtagcagcggaagatgtggactccaatatgcggcgttctgcgaaggcagtcaactttgggattgtctatgggatcagtgattatggtctgtcacaaaatttgaatattacgcggaaggaagcggctcgttttatcgaccagtattttgatgtgttccaaggcgttcgccgttacatggatgatattgtgaaggatgcgaagcgggacggctacgtaaaaacgctgttggaacgcagacgctatttaccggagattaacgccagcaatttcaacctgcgttcattcgctgagcgtacagcgatgaatacgccgattcaaggtaccgcagccgatattatcaagttggcgatggtacagatggatgaggtcttacgtgaacgtaaacttcgcagcagaatgctgctccaagtacatgatgagcttgtgttcgaggttccgcctgaagaaatggaaacgatgaaagagcttgtcccggctaccatggaagccgcattaaagctggctgtgccgctcaaagccgaagtaagctatggcagcaattggtatgaggccaagtaatatatttcaatgagtagatagtcccaatttgacgctgcttccgttataatatagggtgaggtgaagacatcatgccggaattaccggaagtagaaaccattaaacgaacgctaaacgagcttatcgttgataaacatatagatcatgtcaccgttaatttgccgcggatcattcaacggcccgatgatatccacgcttttgcgatggaattggccgatcaccggattacaggggttgagagacgcgggaagtttctgcggattttgctggacgggctggtgctggtctcccatcttcgaatggaagggcgatatggattgtattcgcaacatgatcctgtggaaaagcatacccatgtcatctttcattttaaagatggtacggagctgcgttatcaggatgtgcgccagtttggcacaatgcacttatttccggcaggacaggatttgctggaaaagccgctgaacaagctcggtttggaaccgatggacgaggcctttacacccgaaatgctgcgtgtcgctgttggaactcgttcgacttcgatcaaagcagcgctgttaaaccagtcatatgtggtgggcatcgggaatatttatgtagatgaatcgttgtttaaggcggggattcatccagcacagccagccaaaagcctaacggatagccaatttcatgtcttgcatgaagctattgtctccacgctgggtgcgtcgattcaggttggaggctcgtccattaaatcgttcgttaatggacagggtaaaacgggcgacttccagcatcaattgcaaatctatggacgtaacgcgaagccttgtgttaactgtggcacattgatcgaaaaatctgtcgtagccggacgtggcacacatcattgtccgatctgccagcctctgcgctaaacaggcacagtcaccccaagcctatccctctcatatattgttccaagtaccaatactgcggagggtttcggttgttataaggccctgccttcgcaatgggagggaattggagtggctaatcattggggagccctgctgttactggcatttgcgctaagtttggacagtttcggagtcggtgttacatatggtctgcgcaaaatgaaaattccactgttgtcgattgctatcatctccgtatgttcaggtttggtgatcggcatatccatgcaattgggcgcattactatctcatgttctgtctcctgtatatacgaccgttttcggcgctgtcatcctgatctgtatcggctgctactctttgattcaagctctgcaccgcaaagaggattcgccagaggattcagcggaagcctctcggcggctgcttcttacagaacagactgatccagtgagcaaatctgttcttggagagaagaagagtatagaggatgctgatacagagtctttccttagctcaagaaaagatctgtcggcagaagcttctgtggagcagcaggagcgaacgctattttctctggagttccgcaaatggggacttgttattcggattcttcgaagtccgtctgctgcggatatggaccgttccggcagtatatctgctaccgaagcggtttggctgggcattgcattatcggttgatgcgttcggagcgggactaggggcagctatgcttggttttcagccactgtctactgcgctggctattacgttattcagtggaacatttttgattgcagggatgaaggcaggcttctttctatcagcatttcgatttatgaaggcgctgggtgtattgccggcattattactgattatgatgggcatattgaagctgttatgaggtgaaagagcatgaatatcggattaaccggaggtattgctaccggaaaaagcaccgtgtcggctcttttggtcgccaaaggtgcgctgctgatcgacgcagatgccattgcccgggaagtcatgcttccggggcatccggtgctggcggcggtcatacagcattttggacaagctatagtgaacaatgacggaaccctgcaccgcaaaaaactgggtgagattgtattcggagaccctgcccagcggcgggcacttaacgatattacacatcctgctattcgtgaggaaatgcgtatgcgcatggaagcatatgaacgggaacagccggacaagcttgttttggcagatatcccgttattgtacgagtccgggctggagagcttgtacgaggaaattatggttgtgtacgtaccacgtgatattcagctccagcgtctgatgctcagagacggtctgacggaggagcaagctggacttaggctgtccgcacaaatggatattgaacaaaagaaaagcttggccgatatcgttatcgataatagcggaacacagactgagacgaaacggcaaattgatcaattttggcagcggaagggacttgcatgaacattttgcgaaaaaaaagagtcctgctcactttgtttgtcgggtttgtcctgatcctgttccttaattcaaattggatgtcctggttctatccaattcaatataaggatgagattcggcagtattcacaaacgtatgaagtggacccatttttggtggcgtctattatccgtgtagaaaccaattttaaaaccagtaagcagtcgcataagggtgcactgggcctgatgcagattatgccgaatacggcaaattggattatggacagtgcccaaattcaaaaggttccgctggacagtgtcaagcacgagcctggcaccaatattgagctgggaacctggtatttgcataacctatccataaagtttcaggataatcctgtagcaatcgtagctgcttacaatgcagggccgggtaaagttcaagagtggctggataagggagtgtgggatggaaaagaagagtccattaagcaaatcccttttggtgagacacgacattatgtacagcgggtcatttattattacaggcaatacacgaaaatttataatgatttttaaatgacaagttaatgacatgatgagccttttcgctttaaaatgaaaaaagcgcaggacaggctgtttttagcagcccatccatacactttatcttgttatttctgcattattaccgcgattattggtattgacctgccaattgttgttcggcgatcgttacgaggcgttttgtgatgtagcccccgatcgaaccgttctcataggaagtcatgttaccttggtaaccatcttgaggaatgctgatacccagctcttgagcgatttcatatttcatttgctccagagcgccggaggatctgctgactaccagattgttggagttgccattgtttccttgtgccattgttgttcacctcctcgcgatatggtaaacatattatgatctgttttgacaaaattattactaaaaatctacgggaatttattggaaaaagaaagtggtgagattatgaaatgtccgtattgtgcctacaacggcacgaaagtgttggattcgcgacctgcgaatgataacaagtccatccgtcgccgccgtgaatgtgagcagtgtgccaggcgttttaccacctttgaaatggtggaggaaaccccgctcatggttatcaaaaaagacggcagccgtgaagagtttagtcgtgataaaatgctgcgcggtctcattcgagcctgcgagaagcgcccagtatccgtcgagcaactggatatgatcgtatcccaggtagagaatgctatccgcaacacagcagccacagaagtggatagccagcagatcggtgagctggtcatggaacagctttacccagtggatgaagtcgcctacgtacgttttgcgtccgtctatcgtcagtttaaagacatcaatatgtttatgaaggaactgaaaacactattatctaaagatacagccagcgactgatcgctgactgtatctttcttgggacaaagtgggaagatgattatattttttttataaaagtattgacacaggaataaaaattttatatgatatagaagtcgcttgaaacgttgattaacttacttacgatggggccttagctcagctgggagagcgcatcgctggcagcgatgaggtcaggggttcgatccccctaggctccaccaaacttttattatggactcttagctcagttggtagagcagttgactcttaatcaattggtccagggttcgagtccctgagagtccatcctttagaaaaaacggcagagatgccgtttttttgttgtttatagatctattcccagtctaaccgagaacagttatggggttttcattgattgacataatcggcaaggattttgagatactcgtcattcaccaattttcttggggcgaatacggctgttaaaaaagttagagattttgaacgcgcgattttttcatccatcatggaatggtcggcttcaggtaaatgaataacggacagcagctctgcgggtattttctggcggtagactcgctcggtatcctttacatctacattaatatctttgccagccagaaccaagagtacaggagaatggaagtgacttaattcttcggtggaatcagaccgaaaatttttgcctataaagctccatctttctttggagatcatatcctcaggatcggctatgcttaggtattcttcataagaagcatgttttttcagtaactgtagaatctcttgatcgtagttcaatgtcttttgaatttcttgaggagtagctccttcttgctccatttcttttctggtattaaattgtccttgggaaatccagttcacggcaggcgatacaaggatgctgaatgcaatatcatgttcctctttaacgatcttcggaatgacccatcctgcttgactggctccccataggccgattttttgcttatcaatcatcggcaaggttttcgcccagtctattgcatatcggatctcctgtgcgcggtcctccatgctttgatccagccaattgccaggggcactattaataccgggcttattcaatgacagggaggcataacccttggaggcgaacttttcccacagtggtttgtatccatcatcatatgtgtcattaataggaccatccccatggacaaaaacaaccaatccaaccttttccgagtagttcttaggcaaagctaatgtacctgttaacagccctttaggcgtcgtgatttgtattttttcttctgtcatcttgtaggaattttgatatagaacaatgagtattaaggcaacagctagagctgccgcaataccaaaagtaagcttgaatgtttttttcaatggtgttctctcctcgaatgcaggttctctttccaactcatcagatgccatacaggctccttgaaccaaaaatgccgtaacccattatatttggattgttctacttcaaacgcaagtttgtgatacaaacggatagccccttggttcttatgcgctacatgaagcgtcaatgtatgaaaaccagattcaaccgtaaattgctgtgcgaaagctagaagacggcgtcctattccctggttacgatgacttgaacgaatcgccaaatgatcaatgtaacactcatctgcagcggggggatactccagcgcatgcatacctgtcaaaaatttaaatatattaaagcaaccaaactgttttatgagcggagccaaagaaatgggggttgtttcaggaagtgaagaagaggagggtttccatttaagagaaagaacaccgataacttcttcgttttctttggctacaaattgtttcatagatgtagaataaggattttgaacccaaacctgcattaacaactgctgtatagcttgatcctccagtgtaacaagagattgaaattttgctttaaacgattcgactaaaagactgcaaacagcttcatggtcttgtttctggtatgcaacaatgtcaaaggattttgcactcatgtaacgccctccaagatttattctactttaacctgaatttcgtattgtagcttgttgttgtcgaacatcgaaagataagatttttctactaggacaatcctgctttgccagttatattggtgatgagctacatatcgttccatttgtttaatttcataatcaatctcaggctcttcaatgacggaaagatgcttataaagatagttgccttcttccagaatatagtcagccagatccactgtttcataacacagcttcacctgtccggcatcagacaagtaatgcaggtcattttcaaataatcgaggtggggcagggcggtgttcaaataagtttccggcagtgagctcttgaccattctccaatgcaaaccatagctttaaatgacggggacctaatcgtttgacctgatattcatcatttcgctgagtcaggctatcatgttcttctagcactttgtgaataaactgttcatgcattttcaagttagctatttcagcctgtaccttctgcaacgaatgctctaaaagccggttataatcatcggcagcataggaagtcatacattctagaatctggccgacagggacgtttaatttgcgtaataataaaatatgcgaaagctgataaatctcatgaagcccgtacatccgatattgattttcttctgtatgtgatggatacaggattcccttttcttcgaaatatcgcagttgatgtacagatacattcatgagctgagcaagctggctgatcgtaatgtgttctttcaatgacaggactccttactggtagttgaataactccactataaaccttaggtcagacctagggtcaatagaaaatatcaaatcaaatcttggataggcgtaggtgtcgagtatttgatgccataccaaggggagactggagagtttacctgtcggtaataacccgttataatcataagattagtgagcataaacaagatgctcaggatgaaggttagaatggggaaatcatgttgaaaacttttaaaaaggtatacattgagataacgagcatttgcaatcttgcatgcagcttttgtcctcaaacacagcgtgtcaaaaaatttattgatccggaagtctttcgaaatgtgcttgatcaggtcaaaccacatacggattacatctatttgcatgtaaaaggagagccgttgctccatccgaaaattgatcttttgctggaaagtgctcatgagaaaggcttgaaggtcaatattaccaccaatggtaccttgctgccgaagaccggacataagctgcttgggcaaccagcgctgcgtcagatgaacttctctctccacagttttgacgggcatgaaggctccgtggatcgagaaggatatttgggtaatattttcacgtttgtaagagaagcagtaaaacacaatgtcattatttcgttccgtctctggaacctgactcaggataatttaactaatgtgcagcgtcagcgcaaccgggaaacacttgaacgactggagcaagagtttggactggactatcggattgaggaaaaggtgataccgggcagtggggtcaaaatcgcacccaatgtttatttgaatcaggaccatgaatttgaatggccgagcctcagtgccccagaagatgacggaaaaggcttttgccatgcactccgtagccaggcggcggtattggtggatggaacagtggtcccttgctgtcttgatggagaaggtgtcattaatttaggtaacgtgcatgagcaatctttttccgacattgtggaaggggagcgtgctaaccgtctgtacttcggtttctccaagagagaagcggtagaagagttatgccgaaaatgcgggtaccgcaaacgatttggaacataatcatacaggtagagctccaatcgacagtagaatgaattgcaagaaagatagcccttttgcagggctttttttgcatatattttgatgtatacatatatataatcaatggatttggactgttcagaggaagttagatacaatcgattgcttgtgagaatgattatcaattataatgaatttaattctgatagcgcggaataagaagtgaaggaacggtttggatggaggctgaacaaaagcaatgaagttgaatgatcacattttgctgtggaatcatgtttttatacaggtgatggatgttcgtcataagaagatcgaaaaaggggaggaactacgaacctatcgacttcctgccagtgcgttcttgtatgccgttcgtggaaacgcacgggtacagttggataacagtattcacagggtagagcgtttccatgtactgcatggcggaaaaggaatgtgcctgagtatcctggcggaagaggggcttgaatatttcatcattttgtacaaggcaacgttggctctgcctggtcgcaaggagattgcacaattgttggaaaaggaaaatccttttgagaatcagtatgctttcgcacctcattacccgctgcccctgtacgataaagtgaagctgttggagcaagaatggcgtgaagcttctggacttggcaaactgcatgttaaagccttatttcatcaatttgtatatgagttgttgcagcagttgtatgggcagggcatcgaacctcttaagcccgaccttgtatcgcaggctgtagcctatatgcgtgagcattttagtcggcctatgacacttgagtccattgcggaggagctacaatgcagtactggacatttataaaggttgttcaaaagtaaaatgcataccagtccgattcattacttgggccaagtaagagcagatcgagcagcagaactgctaatgcagacggacgccactttgcaggagatcgcagagcgtgtgggatatccagatgcccattcgttaagtcgcagcttcaagaaatataagggactatctcccgtacgattcaaaaaggagcgggagcatcctgtccagaagcaagatcaggatatgccccaaacgatgcttaaatatgcccttcagcggacatctttcacacgttatactgatattgattatcaatatcggtatcatgcggaaggggatttattcatgcacggaagagtcaaaataacggctatgatgattatgttgtgtttatcattgatgctgggagcttgctcggctccgacgaatacaaatggaagctcgcaaacgaaggctaatcatacagcgacatcatccaacagcgatggacaagcggcagtgcaagcacagacaagagcggttaagacattaaaaggcgatgtggaagtacctgcaaacccgaaacgagtgccatcggatcagtatatgggtcatcttttaaaactggggattattccggtgggcgtcagaagctatatgctgaatgaggcttggattgatcaatcgggatatcccaaagagaagttggccggaatcaaggatctcggtgattttcctatggatttggaggaactgaccgttctgcaaccggatttaattatcggttcaatcgaaaagaacatcgacagctaccaaaaggtaggaacgactgtgttcttgccgtattgggagggcgaatctacagcggggccactggataaattccgtagaatcagtgaaatctttggcaagcagaaagaagccgagcagtgggagagacggtttcaattgtacaagtcgccaataaatcgatatatgttttggcagcgaaaggcggcaattacggaagtccgaccatttatcagatgctaaagctgccacctaccaagaaggcattgaacatgaaagaaggatttgaaaatatttcacttgaggttttacccgagtataggggagatcacatctttgtatacggctcagaagatgaaggggctaatcagattctgcatagtgagctatggaaaggccttccggctgtaaaaaaaggacaggtttatatgtacggttcattcagcgataaagaggatgagtttgtgatggaagatccttattcattggaacttcaattggatacgatagttaatctcttattagcccacaaaaaataaaaggatgtacagtaacatctcctatctaaacaaggggaagcttttaaaatttcaagctgtgatagtcatatagacaaaatccgcttaacacaaagattcctaagtgtttggcggattttattatgtctatatttcttcttctctgtatgttttggtgtatctttgaaattcagatttttgattatcgtaataatcagctctcgtccaaaaaataatttgagagaatgagtcggaatgttccaaataagtgattaaatatacaatttttactttatcactctctacccatacttcgtattgcaagccttgattcccgtttatattgacctttactggtcccgtcgaaataattccttttccagaccttttgagtactaattgagttgaaaactcagcgtaatcttttaatgtgatcattgaggatttctcatacggcagttcggatttccaatccttgatgatcgtcatgtatgcatcgtttttttcataccaggcttgaattagcgcatctggattaagaattaaaccagtcttccatatataagggagacgaatttgttgcttggcatcttcacttttaaatgttttcaaaatagttgttgagcgaaggtctggcttaacttgtgagtcgcttaagactttcaaggagctggctatagttgcaaattcgtgatgttgttctactgcagagcctccccttgaatagattaatacttgaagatagtgctgcttactctctaacatggcactgaagtaatagacctgttggccattgtatttcccgctataatcggctgttctggcggttgtggaatcaatctggattggggtagtatccacagccttaaagttttctagacccaatgcggagatttcttcacgttgctgtacgaattcgtcgagcgtcatattatttgcaaaagctgacttggggacacggaaaaccagacctacgttctttttttctttgtcacaaacactaagcaccgaatccagttgtccctgtttaaatttacgccagccagcgggaatggtaagagccacaagatccttatccgaggtaacggtatgagccagcgactctgtgacgggtaaaacaggctgactttctttgtctaccactgttgtactatgagtcgcattgtctacatcagaatttgtttggactgtagttgcagcattatttgaggtgcagctggtaagcatgagcactgcgatcagtgcaataacataaaatcggaaatgcgcaaaattgaattgcatggaaataactccctctgtttcatatttacaaaggaaattttacccttttataaaattataaaaaagaggcgtttgtcctgttttacgtagcttagtcacttatggtagtcgttactgtgacattgttgacagaggttgaggaagcactagagttgaaattaataacctcaatgactactgttgcaccaacaatcaggcctgtatttataattaggtttgtagcagaaagcgttgttaagccgcctcgctgcaacgtcccatttacaaatacattgtagtatccgctactggtcggaaccacaagactgtttgccgcgactgaagtaccactatcattcgtgaaattttgtgctgggatagtggtcactccacctaatatattaccaagcacgacaatagctgtgtaacgattaaccgctggagtgacattgatgcttgttgtgatagcaatgtttccagatacgatactgtctacttccagatagagaacctgccagaaaatgatcttgatattcaatttgttgagttcttctcattcatagatacggttgagatgaagataggtcggcaaatgctgttgcgtctgtctctaaacgtagataattactcggatgttatattggtgtggaatccgaagcagaagtgcctgggttattatgacgaggagcatcaggaatatgcggatgtgtgcagctttgccgagtttcttgcacagccggaagattatctggagaagattattgagggtgaatatttatcataacaaggtgagccatgaatgcggtatgcacgcagtcatggctcttgttattttaaaatacagcgctagtgtacacagtgcctaatgctcatcaggaatggttacgtatgagctgaatgagatttagagtagcggtagataggggttcgttcttacgggtacagatggcgattgaattaagaagctggatgtcttctacatatacccggcacagttcgccacgttctacatattcacgcacgaccagtgaggacacaaagttggcaccatatccggcaataactgcggtaatcgcctcatgcagccctgtgaagtttagggtgacctggggggcgggggcattataggttcgacataaggaaaataatctctcccgtgttgagctccccttttcacgcataacaaagggttcatgcatcatttccaataaagaaacctgctgatttgcataccgatgatctgcagccaccacgaaccacaattcatcacgaaataattcttcagtctgaatcgtatcgggatactgctcgggcagtcctccgtagatagccaaatccacttctatatttaatagctgctgcaaagcatcgttggaatttgtagtgttaatcgtcatttcaacatgttcatattgttgtttgaattttgcaatccaggccggaatgagaaaatgagccggtaaataagtagccgctagccggatatgaccatgggctccatcacgataatcttgtgaaaattgttcgatttgctgttcgacagcaaagagccgtctggcgagtacagcaagtttttcaccagcatccgttaaggcaatccctcttcctagcggcatgagcagtgtgagagatatttctttttcaaattttttaatctgggcggtaatcgcaggttggctaatatttaaaagttcagaggcacgtgtcacactccctgtagaggcgaccacgtgaaataagcgtaatgcatgcaggttcaagaccattctccctttccgacagattcatatatgtagattatgaatagagcaaaaacatatattatttttataataataattcatttacaatcaaattgtaagttaatccaaaggagagtggagcgaatgaatcaaacgaacacgtgggatcaagtagaccagtatatctcggagtgtctcattccgcatgatgctgtcttggaacaagtattggccgctaatcaaaaggcgggactacctccgcatgatgtatcccccaatcagggaaagctattaaatatccttgctcaaatgcagggagcgcgacgtgtgctggagatcggtactttgggaggctacagtacaatctggttgggaagggcgttgccggaggatggagaaatagttacgctggaagccaatccgatccatgctaaaattgcccggtcgaatatatcgttggctcagttggatggaatagtggaacttcgggagggagacgctttagagcagttagcacagatgaaagaggagagagttgccccctttgatcttatttttatcgatgcggataaacccaataatccattttatctggattgggcacttcgcttctcatatcctggcaccgttattatcggtgataatgttatccgtgaaggagaagtggttcaagcttatagcacagacccccgtgtgcagggagtaagaaaattttatgatatgctagctgaggaatcaagaattacagctacagctatccaaaccgtggggagcaaggggtatgacggtttcgtcattggaatcgttaagggctgaacgctaagcgtctcgattggctaaacaaaaaggggagcagtcctcgtgtttagcctttttctgagcagtagagaaggtggggacgaattgtgcgcataatggtaaaatagtactgatggaagctttagaacgtttttgaacgtttactgctgaattcctatgtaagaagaatgaatttacataaaagcagatgaaatttctttgaaatgtaaacgcaatcatgctgattagagcaggaattcaccattttgtaaaaaaatgaagtcggaatgaatttttttgaatctttttgaagaaaaatgattgttttttgtcaagtttgtggtacgatatgaacagttgggggaatgatgatgctgacggaagaaagatacaagttaataatacagcgcttacaagaatgtggggttgtaaagttgcaagaattggctgatctgttgggagcttctgagtcaacgattcggcgtgatttgatagatcttgagagccgtcagttgctcaagcggattcatggcggggcaaccttgctgaatcagaaaagtcaggaacctggcatggaagaaaaaacattcaaaaacgttcaagaaaaaaatgcagtggcccgtatagcagccaaagaaattttggatggcgaatgtatttatctggatgcgggaacaacaacgatggcgatgattccttacattgaagctaaagacgtgacggtcgtgacgaatggactatcccacgtagaagcactggtaagcaaaagaatcagaagctatctactgggagggatgatgaaaattcataccaaagccgtaatcgggagtattgccctacaaaatttggacaattttcgattcgacaagtgctttctaggaacgaacggggtggatatggaaatggggtatacaactcctgatcccgaagaggcgctgatcaagcgacgtgcccaccagctgtctggcaaaacgtatgtgttagccgattccagcaaaattggagaagtaaccttcgccaaactgttcgagctcaaggaagctatacttattactgaatcgatgccagaacggtcacgccgatccatcgctcagaaaactaagataatcgagggataacaatgatatatacagtaacgctgaacccttccattgattatatcgtggaagttgatgatttgaagcttggtgatttgaaccggatgaaacgtgatttaaaactgccaggtggtaagggaattaatgtatcacgtgtactgaaccagttgggggcagatagcacggcgattggttttctcggaggattcacaggcaggtttatcgacgatacattgcgggaagaatccattaaaactgattttgtaatgatcgaagatgacacgcggattaacattaagctcaagcatggcgatgaaacggaaattaatggtttgggacctgtgattcgtgagcaagaggccgatgcgttggtgcaaaagctggcgggactccagaaaaatgacattgtcgtcttgtcgggaagtattccaccgtcacttggaggagacttctatgatcggctgattagcgtatgccagcaaactggagctgaattcgtcatcgacaccacaggtgaggcgctgatgaaggcactggttcataaaccgcttctcatcaagccgaatcaccacgagttggctgagttgtttggcgtaacgattcattcaaaggaggagatcgtcacttacggtcgtaagctgctggaagcaggtgcaaaaaatgtactgatttccatggcaggagaaggggctttgttcattacggcagatgaagtgtatcacgcaaatgtaccagcaggtacggtgaaaaattctgtaggcgcaggtgattcaatgattgctggattcgtgggtacgctggctcttcatggcgatccgatcgaagcattccgtgcaggagtggcatccggaagcgcaactgcgttttccgatgatctggctactagagagaaaattgaacaattacggccgcaagtcacgatttcaaaacggtaatccggctgcatcatgagcttattatgcgtgtatcgacacgctgatcgaacttaggagagtgtgaaaaatgagaataacagacctgatgattaaagaaacgatgatcatggacctccaggcgacgacaaaagacgaggcgattgaggagcttatcgctagtctcgaagcaagtggacgtattaatgaccgtgccttgtttaaagaaatgatttacaaacgtgaagcagagtctagcactggaatcggcggcggcattgcgatgccgcatgccaagactaaagccgtgaatgaagcgactgtcgttttcgccaaaagcagtaaaggcgtagaattcgaatcgttggacggtgagccggcaaaagtgttctttatgattgccgctccagagggagcagcaaatacgcatcttcgcacactagcggctctttcccggcttctaattgataccgatttcattgacaaactgatgaatacgcaaacaccggatgaagtatccgagctgtttgataccaagcaggcggaagaagaagcagccaagaaagcaaaagaagcaaagaaagaggctgccaaagcacagaaaacgccggatgttatcgttggtaacccgaattcagacgagtttgtggttgcggtgactgcctgccctacaggcattgcgcatacgtttatggctgaagacgctctcattaagaaagcgacagaaatgggtgttaacatccgggtagaaacgaatggctcggaaggtgcgcaaaacgtactgacagcggatgaaattcgccgtgccaaaggtgtaatcgttgccgctgacaaaaaggttgaaatggccagatttgacggtaaacctgtattgcaaagaccggtaagcgacggtatccgtaaatctgaggaactgatccgcaaagcgctgaacggcgatgccccaatttatcgtagtgaaggtagaagcagcgctgaagagtcgaaagcggagaagagcagcgtgggcagtaaaatctacaaggatttaatgaacggtatttctcatatgctgccattcgttgtaggcggggggattttgttagcaatttccttcttgattgagcaagtggcaggagaagacaatgcattgttccaactgttgcagacaattggcggtggaacaggtgcgttccacttcctgattccgatactggccggatttatcgcgatgagcattggagaccgcccggcactgatgccaggtatggttgggggactgatggctgtaaactctaatgcaggcttccttggcggtctggcagctggtttcatggctggttatgtggtgatcttcctgcgtaaagctttggcaggtctgccgaaagcactggatggtttaaaaccaatcttgttataccctgtatttggacttctaatttcaggcgcgattatgttctacctgttcgatccaattttcggtggtattaatacgtggcttgttaatgttttgaacaatttgggaacaggtaatgcagttattttgggtctgatcctgggcggaatgatgtcgatcgacatgggtggaccttttaacaaagcagcttacgcattttcgatcggtgtctttacttccagcggtaacacgaacggtgctatgatggcggctgttatggcgggtggtatggtacctccgctggcgatcgcattagcttcgacgttcttcaaaaataagtttactgagcaagagcgcaagtctggcttgacgaactatgtacttggattgtccttcattacagaaggagccattccattcgcagctgccgatcctctgcgtgtcctgacctcttgtattgtaggttcagcgattgctggtggtctgacgcagttctggcaaatcaatcttccagctccacatggcggaatttttgtagcagctcttgccaatcatgctttgctgttcttgcttgcagtcgtgatcggctccgtggtttccgcgctcattctgggactgtggaaaaaaccgcttgaagcgaaataacgggtaagagtataaaaataaaaagagggccacattttccttaggccatcaaaatagtaaagccgctaaacatcaggtttctgagtgtttggcggctttttctttatggaaaggtgttggctttgccgatgtagcttattagtagttattgcattggagctatagcctataaagctccttaaccagctgtataaacagctttcgggccgaagacatatactgctggtgatggttgttttgtagcagtccaataggaatattcgggtctgttaactggagggggacggtgaccagttcctccggcaaaggcattgacgatagaaccactccaactgatggaatcgtttttacaaatgtggggatcgacgaaatttgactgacagtataaaaaaacggcatcgacggaaagcgtgaaagctctttctccagtcgtatatggtacaagcagttcttacctccgacgataagcggatactcgtacagattttcgagatgaagcccactttttgccgcaaaagggtgattacgggacacaataaaggcgatgtgttcgtgatatacgggttcaaagtgtaaggaaggaatcgagtgaggttctccggagattgcaaaatccagcttaccgtccaccaaagcatttgcgagtgcatccgtgttgccaactgtaaaatggcacgtaatattcggtttatgctctcgaaactgctgcagaaccaagggcagtacggtagccgccaccgtttcaatcacaccgatatggagcgtgccaatctcctcctttttcagagacttcgcctggtccatcacaaaattccaatgctgaataagcccgtttatctcctcggcatatagtttgcctggggacgttaactctgcatcccaaccccttttaaaaagctgaaatcccagctctttctctagcctctggatttggttcgtgactgtagactgagcgtagtttaatttggcagcagcttttgaaaacgttccttcttcgattatggtacgaaatgtagttaattctttcagatccacgcatgttcatctccatcggtaaaattgaatatatttatgattattttcaattatacagatgaaaataagaggagtacaatcatcttatcccagcgaataggagagatgaacatgccatttgtacgaattggctacatggagcagcaatacacagagcaagagttgccttggattagtcgctgtatcatgaatgctttgatcgaacattttcaggttccggaaaaagattactttcaggtttttcatgctcataagcaaagcgagttttattatagtcccgattatttgaatgtatccagaacagacaagttactgtacatccaaattacaatgggatcgggtagaactacggaacaaaaaaagagtttctaccaaaagttagcggaactcttatctattgaatgtaaggttagaccggaggatctatttgtgacactggtagagactgaattagaggattggtcctttggcaacggacttgcccagatgattgtatgaagcataaattgatcagatcgagtattcgggaaaccatcggtgattttgctcccgcttttgtaggttatacggaggatgttctttttggaaatgtatggagaagaagtgagctatctctaagggaacggagtctcattaccgttgccgctctggtagcgtgtgagcatgtaaatcaacttccttatcatctgaaactggccaaggagaacggaatttcggaggaagaactggttgaggtcattacacagcttgccttttatgtaggatggccccgggcagcctcagccattcaggttgccaaagaggtgttttgcaaagagaaagagagttaagcatgaacctaaaaactgctaagcacaagggattccgagtgtttggcggttttttggcatgattgtgttgttattctgcattgttactgataagcaggcgatacccaaataatgactaattgaatcgagcagattcaactggcaattacagacggtgtagaagtattcggcttctgtccgtggtctgcaattgatcttgttagtacccatcagggctccagcaagcgttacgggtttatctatgtggatcgtgaggagtttgatctcaaggatctgcgtcgtattcgtaaacaaagcttctattggtatcaaaagctgatctccacaaacggtgaaattcgttaattaaagcggccgtgaaaaagtacctccttgaaatggacgttaccattttgagggggtgtttgtatttgtagccttgggggagagtctgatttcattcaagcatgcaattactcctttctcagaaagtgtgatcgtgtattatataatagaagaaacacaaacggaaaggacatcatgcattgactttacaacaattaaaatatgtcattgaggttgccaatcgcggttccatgaatgaggcggcaaagcggttgttcatttcccagcccagtctgtcgaacgcgattcgtgatctggaggaagaaattcatatcaccatttttgagcgtaccaataaggggatttctttgtccaaggaaggcgtggaattcctcggttatgcacgtcaggtcgttgagcaggcggagctgctggaaagtcgctatctggatgccaagccttcaccacagcattttgctgtgtccacgcagcattacgcttttgctgtaaatgcattcgtaaatctggtaaatcaatatggtcaagaagagtatgaattggctttgcgagagaccaaaacccatgaaatcatacaggatgtcaaaagcctgcgcagtgagatcggaatcctgtatctgaacgaatttaacgccaaggtcattaacaagctgctaaaagatgcgaatctgcaattcaacagcctgtttacggctaagccacatatttttatcagtgccaataatccgctatcccgacagtctatcgtgaccattgaccagcttcatccgtatccgtatttgtcctttgagcaaggagagtacaattcctttcacttttccgaggagattctcagtacgttatcgcatcccaaaagcattcgtgtccatgaccgggctaccctttttaatctgctcattggcttgaacggctatacgatttctaccggggtgatcagtgcggatctgaacggtaacgacattatttccgtccctctggaatgtgatgagtctattaatgtgggatggatttgccataaaaacgctgcgctctccaagctggccaccgtctatgtagaagcgctacatgaggcgataggggaataaaaggttgggtatagccttaggctataactagctatagtttattggagttaccttataactgaaaatgtatgttatctttcttacaagaacttcacttatagaagcgaaaaaggagataaccctaatgagcagcatccttgataatgcatcccaacgtaaagtgaccccttttagacacgatatggtcggcagctttctgcgcccgcaagcgattaaagacgccagaattcaatttcaaaacaatgaaatctctgcggacgagctgagaaagattgaagataacgaaattattaagctagtggaaaagcaaaaatctgtaggacttcaagccgtgacagacggtgaattcagacgctcctggtggcatcttgattttatgtggggtctggacggtgtggaaaaggtacagctttcgaacggctaccaattccaaggtgtggaaacaagagcggaaaccgcacgcttgtccggtaaaattggacattcccgtcatcctttcattgaagatttcaaatttctgaagcaagtagcaggtgaggatgcgatcgcacgccaaacgatcccggcacctgcacagttcctggccgagctgttgcgcggagagaataaagaaacaaccgatacgtattacagcaatctggatgaactggtgacggatatcgccaaagcctacaaatccgtgattcaagcgttgtacaatgagggctgccgtagcttgcaactggatgattgcacatggggtatgctctgtgataaaaactattgggaagccagacagcatgcgggtgagaatgtggaagataccaaaaagctgttcgctcgcgtgaatcaggaaacggtgaaggatcttccagccgatttggtcgttacaacccacgtatgccgtggtaactaccattccacctgggcatcttctggcggctatgagcctgtagccgaaaccctgttcggcatcgacaacatcgacggctactatctcgaattcgataccgaccgtgcaggtgatttcacaccgcttaagcatctgaaagatcaaaagcaggtcgtactgggccttgtttcctccaaaacgggtgaactggaagacaagcagacggtcattaaccgcattaaggaagcgactcaattcgtcgacatcaaccacatctgcctcagcccacaatgcggattcgcttcgacagaagagggcaatattctgacagaagagcagcagtggaaaaagcttgccttcattaaagagattgcggacgagatttggaagtaaggggttagtttaggggaattgaaaggttctattagttaaagatattttattaaaaaacacgtcatatatgacgtgttcagattgtcgagaaaccccgtcttttgagacgtgggtttctttttctttacatcataaggctctggtctctggagaaacagggggttacccctgtttcttcaggcgatccaggtggatcgccatcttcttcatgttctgcacggctgccgtcataagggcttgttccctgacgtttggtagaccgcgcaaacggcaatagcgaaacccatggagctctttggcatccgcgaagcttcgctcaatcgtctcttttcgtttgcggtacagccgtttcccggatgggcttagccggttgctccgtacccactctttgctgtcttcccagacatgccgagtcaccactttgcggtggtttcgagactgggtacactggtctagcagtgggcaatgctggcactgagctgggtcagaggcatactgccggtatcccttacggtccgtcgttcggtagggcagttcctgttgggctgggcatctatacacattgcgtttggcatcgtattcaaacttccatttcggaaacagcccttgtctgggatggaatcttcggtgagcaatcacggcaaaaatctttcggttttgcaaacctcggcaaatcggcgtcgttaaataacctgaatctagcgcaacagcttctacttgaaaaccaaagcgttctctttgtcgatccaaacgg

SEQ ID NO: 34 - DNA, 22035 bp, Unknown
  Kingdom: Bacteria, Phylum: Firmicutes, Class: Bacilli, Order: Bacillales, Family: Paenibacillaceae, Genus: Paenibacillus
cggcagcggactatccaagcgagcagacgattcacggcttgttcgaggcgcaagcggcgcagaccccggagcaggcagcattgttcttcgaaggagcacagttgacctaccgcgagctgaatgaacgtgcaaaccgactggctcgtaccttgcggagtcacggcgtaacaacagacagcttggtggggattatgacggagcgttcggtggatatgatcgtggggatgctcgggattatgaaagcgggaggcgcgtatgttcctctagatccaacgtatccagaggaccgtatccgttacatgctggacgactcgggaacagctctcttattaacacaaagccatctggtggaaaaagtggccttcgacggcaagatactggtgctggatggggaacaggggatctatcacgaagagggggcgaatctggagccagtgtctggcccgaacgatctggcgtatgtgatttatacctcaggaacgacgggccagccgaagggcgttatgatcgagcatcacgggccatgcaatctgaaaacctattttgatgaaaccctacacatgagcttgtcggatcatgtcctgatgtttgccagctattcctttgatgtcgcttgctgggaagtgttccaaacgctgttctgcggagccacactgtacgtaccgaccatggagacgattttaaactatgagcggtttgaacaatataccgcagagcaccaaattaccgtagtcatgctgccaccgacgtatgcggtgtatctggaaccgaagcggatgtcgagtctgcgtatcctgtttacagccggatcggcctcctcattagagcttgtacagcaatggaaagatcaggttccgtattataacggatacggcccaacggaaaactcaattgtcacaacgatctggccggtgcctgaggatgcgaatgcggatgaacggatttctatcggacgtcccgtaccgaatcaccgggtatatatcgtggatgcgcatggacatctggcacctgtgggcgtagctggagaattgtgtgtatcgggggaagggctggcacgtggatatctgcatcgtccggagctcacggatgagaaatttatacctaatccgtttacggacggagaagcaggatatgaacggatgtatcgcacaggggacttggcgagatggatgccagacggcaacattgagcacttaggccggatcgaccatcaggtgaaaatccgggggtaccggattgaactgggcgaggtggaggcaaacctgctgaaggtggaggctgtgcaagaggtaattgtactatcccatgaggatgagcagggtcaaaaccaactggtggcgtactatgtggcagagcgcgaagtgagtacaagtgagttacgcagcttactgggtgaaaagctgcctaactatatggtgccttcgtactttgtgcagctggaatccatgccactaacaccaaacggtaaaattgaccgcacggcactgccactgccggaattggcaagtagcccggatatagcttacgtggctccaagaaatgaagtggaacaacaattggcgaatctctggcgggcggtgcttggggtagaaaaggtaagtatcgacgagaacttctttgagcttggaggtcattctttaaaggccattcagctcgtttccaaagcacaggaatcaggtattccactcggcatacaccaagtgttgcaacatcaaaccattcgaagcttgtccgatctgttatcccttgataaagttgtcaccaagcaagatacttcattgcttacagatgtaacggaagctgaacaatggattagcgaaacctttggcgtacaggccatgcttcaattcgtacctaatgatgaacgcgactacttgtttctgcatgtgcatcccttccgggcagatcaggtggacgagatgaccgccggaatctcgtctcatgttcattccgacctccatcctcattatatcgttccgatgggtgaggaagacgccagcctaagggtcagaacagggcacacagagctggagcaaacagacgaggaacaggaaaacagtcaccaacgtcagactgaagaatggattttaaaaatcgctgaaatgaatgctagctggcatgagcatctactcagctcagaggctatctatcgtttcccgctggcccctgctcagcattaccatttgatgcacccggcttcctcgggcaccgtggttcggttggaccaatacgtggatatggggcgtctgaatacagcgattcggcagttaattcatcgccatgaattactgagaagtgtgcttgtacacgcggatggagtctgggaatgggaagtacggcaaacaccggagcatatttcattgccttgtgtggatctttcgatctatccggtacagacccaacagcagcttctttcatccctcatgtcgaatctttattttgaaccatatgagcagaaacacgctctgcaataccggatgatgctggttcgcttgaatttgcgggaacatttactgctactgccatgctcacatatcatctttgatgcgacgagtggtgtagttttgcataatcagcttctggaggaatacgatcatatacagcaaagtcagacagttaaaacattccattatcacgaatatgtcgctcatatccgccaaggtcctcaaggactcagcgatccgcagattgtggagcaatttaagctcccggcatttgaggatcataatagtcgtatccatgaacggatgctggggtgtaattatgcagcacctacttcatatcattggaatctaaacctgcatgatgttccaacgcaggaggaggctgtgaacctatgggatatttcgttgcaaatggcattccagttcttgagcagctattttgaacagtccgaagttccattatggttgacacagtatggacgacagtatggggatcggaactactttggatcggtgggagaatatattgaccacattcccgtcttactcctgaaggaggagagaatatcctacgaaaatgatatccagaaactcttggatactgccacacatcatcatttaaatttcttcaatctgatctttaacgaagaaatgaaatcagcttacccgcaatcaagcaacattctaaaaaagggacttgaacaactgccaatcgtgtttaactacttgggtgaaatgcagggaggcttaaatgaaatcggtgctttggacaggaagaaggaacaggcaaacggaggaaaagcgattttctttgagtctgtatacacagaaagtgtattgcagatttctctatcccttccctttgaagaggatcacgagaaaattcatcgaatcttccaagctgccagtgacaggctcttaaccgctttgaccatctcgcagtaaggagatgaagatgtgaatcaattgtttaaggatcatcgttttatccgtttctttgcttcccgtacttctgccaacatcgcggacagcatttattctatcgtcctgctgtattttgtacagcaatcgacacagtcggtggcgatgaccagcttcacgtatacggccgtatctgcggcgtcgattttcagctttctcgtgggtcctttggtggatcgctattcaccgcctttgttggccagtatcgccttgtttacgcaggctgtgctcattttggctgtcccgtttctcattcaggacgggatggttaatctggtcgctatccttgttattgtttttattgcatcctgcttctctacattgttttatccggccaacagtaaaatgctgccgcaactggtaggctcgccggatttgattgtccgggcgaattccatgatttcgtcgacggatcaggtgattaatatcgccgggtatctggctggagcctcgctcattatcgccatggggatgaaaaacacgttttttctagccagcgcaatgctgtttctggcaggctttgtgtatatcaggctcagcaagcagatcgacgctcctgcgatggaggacacgaacggtaaaggttcactgaagctggggtactatctgagggagctgaaagaagggtatctttttgtaaaacggaacgccttcctgagaattatgctcccgttctttgctttgacgaatttttcgatggccattttaattattgccctaccttccattgcggtatcctatggctcaccgatctattacagcttactgtatgtggcctattttatcggtatttttgtcggttcctttctggtcagtgtattgaaaaagaacggcatcaccattgcggtctcctgggtagctatggggctggcgatctacgtgttttccattgtgccggagatgtggatgaagctgctggccgccctgttgctaggtatttttacaggcatcatcaatgtactgcaaacgtccttgattgaaattattaccccgctgccgttaatgggacgggtggcatcctttctaaacacgctgtcgagcgcagccctgccattgggagccttgattggtggtccgctagctttacggtttgctcttagtgaggtgctgtttttcagcggactgattaccgcattgtgcggcttgatcatgtttttggtcaaggatattcgccagtttgagattccttcagaggagattggaagagtaaccccaactcccgttactgaggacataagctagagcttgatccaaattcataagctacgcatgcaaaatgccaggccctcatcacagggcctggcatttttagtatttctggctctggaacgtaggagctgatcgttttagtgctggtgttggagcgctgtttatggttatcatagacgaaggtatgaatctatcgtttacattcggatacaaaaggagatacaagatggctgaacctttaaaaaatatatacacagaggattttcttcgacttttcggtgaaaaagtacagtctgcgtacaggccgttcgataccatcggatttatccatcaagtgatggataaaaaatgggatgagctggagctgaaagaacgaatacggcgtatttcgttaacattaggggcatttttgcccagtaattatgaagaagctcagggtattctttttactatagatgagcattgcagtggttttccgtacttgtttttccccgattttgtggaggtgtatgggcagggagaagaacattgggacctgtccatgaaggcactggagcgattcacatctaagtcctctgcggagttcgccgtaagacccttcctcctgcgtgaaccggaacggatgatgcagcagatgacgacctgggcgggacatcaaagtgagcacgttcgccgtcttgccagcgaaggctgccgtccacggctaccctggggacaggcgttgcctgtgtttaagcgcgatcctgctccagtattggctgtattggaattattgaaagccgatccatcactatatgtacgtaaaagtgtagccaacaacctgaacgatattgccaaggatcatcctgatgtggtcattgctacggctcaacggtggaaagggacacatcctgacaccgattggattgtgcgtcatggctgccggaccctgattcgcaaatccatccctgaagtgatggcaatgttcggctatgcggatgaaacagacggggcaccgttggtcacgggtgcctctttcaccacagaccctgccttgctaagactcggtgatagctgtgagttgagctacgcgcttcagcttcgtggaggtaactcggtacgagtccgcatcgagtacggcattgactttgtgaaggcgagaggacaagtctcacgtaaactgtttttgctatctgacaaaacagtccctggaggaacccatcttacaggtacacggacacaccgctttgcagacctgacaactcgtcgccactatgcgggaacgcatcggatttcgctgctcgtaaatggtcaggaagcggcttctacagcgatagaactccagctgtagatcacgatagcagtgaagaaaaagagcctgaaatcaggctctttcaggctgtcgagaaagtctcgacagcttcttttatgttaattttatttaagacgacaccgcgttaatgttgtataatataggtaactattgtatagaacggacggtgttgatatgcttcgacctaatcaagacaaacaacaatcttttgaattggtttctctggaagaactggttccccaagatcatttgcttcgcaaagtggatacatatatagacttctcctttattcatgagaaggtaagcccgctgtattgtgcggacaacgggcgtcctgccattgatcctaccgtattgtttaaaatgattttcctcggttatttctatggcattcgctcagaacggcaactcgagcgtgaaattcagacgaacttggcctatcgttggtttctggggctgggcttaaccgataaagttccggatcatacgacgattagctggaatcgccgtacacgctttaaagacaccacgatctttcaagatatcttcgatgaaattgtgctgcaggcgatctctcaccgaatggtgggcggacgtgttctcatgaccgattccacccacctcaaggccaatgccaataaacataagtacaccaaagagcaagtattgcagaataccaaagactatatggacgagcttaacgaagcggtgaaggatgaccggagaaaccacggaaaaaagcgctaaaatctcgagaggaagtgaacgaggaaaaagaaataaaagtaagcaaaaccgacccggacagcggctatatgatccgtgatggcaagcctgaaggcttcttctatctggaccaccgaacggtggatatgaagtacaatctcattaccgatgtgcatgtgacaccgggaaatgtacatgattccgtcccctatttgtcccgtttggaccgccaacgagaacgttttggttttcaagtagaagccgtggcactagactcaggttatttaacgacgccgatttgtcgaggtttacaaaaccgaaagatttttgccgtgattgctcaccgaagattccattccagacaaggactgttcccaaaatggaagtttgaatacgatgccaaacgcaatgtgtatagatgcccagcccaacaagaactgccctaccggacgacggaccgtaagggataccagcagtatgcctctgacccagcacagtgtcagcattgcccgttgctgaaccagtgtacccagtctcaaaaccaccgcaaagtggtgactcggcatgtctgggaagacagcaaagagtgggtgcggagcaaccggttgagcctatccggtaaaaagctataccgcaaacgaaaagagacgattgagcgaagcttcgcggatgccaaagagctccatgggtttcgctattgccgtttgcgcggtcttccaaacgtcagggaacaagcccttatggcggcagccgtgcagaacatgaagaaggtggcgatccacctggatcgcctggaaaaacaggggtaacccccctatttccccagaggacagagcattatgatgtaaaaaagaaacccacgtctcaaaatgacggggtttctcgacaatctgaaagagcctgaaatcaggctctttatttttatcgatcgctttacccaatttatttttttccaaaaatatgattctggtattagaacctggtactaagacgtgttatactacagtaagaaagtggatttcatcttatgtataaaggggaaggtataatttgacagatcaacaacaatggcttgcgcctgaatattacaatatgacttcggaaatggaacatcatgaggctgataaaacagcacttaagtggctgagtgagacaggagaatacgaagaaatcacctacggagagctgttgaaaaaggctaaccgactggctggaggactcgcaagtctgggatttaacaaaggtgacagagttctggtcgtagtaccacggcgtattattgcgtatgtaatttatctggcctgcttgaagctggggcttgctgtcattccatcttcagaaatgctacgtgccaaggatattgcatatcgtcttcgccattctgaagcacgcgcagtcattgcctggaccggagtaacaggtgaagtggacaaaataagcgatgatttgcctactctggattatcgtatcgtggtctccggggacgacacgccagatgtatctggctggctcgtgctgaatgagctgatggatggacaggaagatacttttgaagctgtgaagacgcaccgtgacgacatggccattctggcctatacttcgggcaccacgggaaatcctaaaggtgttgtacatagccatggctggggatatgctcatctgcggataacatcaccatggttggatattcaagcttcagatatagtatgggctacagctgcaccgggatggcaaaagtggatttggagtccgtttttatccgtactgggaaatggagcgaccggattcgtatataatggtccgtttcgtccaggtcggtatttgcagttcatgcagcagtatggaattcaagtgttgtgctgtacgccgacagaatatcggattatggcgaaaacggatggtttggatcaatatgatctatcccaattgcgcagcgcagtttctgcgggagagcctctcaatcaggaggtcattaacaagtttcaggagcagttcaatattacgattcgtgacggctatggtcaaacggagagcacattaattattggtaatttaaaggacgcgcctctgcgcactggctcgatgggcaaatccattgcgccgggacttgttgaggtcgtagatgaggatggcattccgctggctccggggcaagtgggagatattgcggtgcgtgccgatctgccggcattattccatacgtattaccatgacccagaacgcaaattagctagtgtccacggagattattttgttacgggagaccgggcgcgcaaagacgaggatggatatttctggtttgaaggacgtggtgatgatatcattatcagctctggctatactattggtccttttgaagtagaggaagcgcttatgaagcatgactccgtgcaggaatgtgctgccgtagccagccctgacgaaatccgtggacatgttgttaaagcttttgtcgtactcaaagctggggtagaaggatcaccggcattagtgaaggaactgcaacatcatgtgaaaacatggactgcgccttataaatatccacgaaaaatagagtttattcaagagcttcctaaaaccagctcaggcaaaatacgaagagtggagctgcgtgaactggagaagcaatccgtactgtagtgatgaaattattcaatataatcaaaacggagcaggagcgtggaaaaatgagtacatttgaatcattgttggagcaatacgcggaactggttgtaagagtaggagttaacattcagcctggacaggtatttttggtaactgcaccactggaaactgttgagtttacacgcctgattgtcagcaaagcctatgaagcaggcgctaaatatgtacaggtagagtttgaggatgattccattacacgtagtcgttttgaacatggtgacgaagccagcttcgattactaccctgcttggaaggcagagatgatggagaaatttgccgaagagggtggagccacactaacgattaaagtgccgaacccggatttataccaaggcattgatccacaaaaggtttctcgtgcgaccaaggcggcagctacgtcgagagaaggtttttccaaatatacccgaaatcataaaattagttggtgtttgattaaagcgccgacgaaggcttgggctgataaagtatttgccgatgtagcagaagaagatcgtatacgtatcatgtgggatacaatcttccaaatgaatcgtgtagatggctctgatcctattcagaattggcagaaacatttgaaaaaccttgaacaggtacaagacaagctgaatcataaaaagtataaaagcctccactatcgtgcaccaggaacagatttgcgaattgaactggctgacgggcatatttggcgcagcggtggtggggagaacgagcgcggagattactttgtcgcgaatatgccgacagaagaagtattcacgatgcctaagcgtacaggtgtgaatggtcatgtcacaagtaccatgccactcaatttaaatggacaactggtggatcgcataacgtttacctttaaggacggtaaagtcactgaatatacagctgaatctggcgagcagcatctgactcatttgctcgctacggatgaaggggccagctatttgggagaagttgcactggtgccgcacgattcaccgatttccaatctcaatcgtattttttacaatacaggtatcgacgaaaatgcctcctgtcacttggccctaggcagtgcgtatccatttaatatggaaaatgggacacaaatgaaccgggaggagctgctccagaacggtgccaatgtcagcctgactcatgttgacttcatgatcggctcagctgagctggatattgatggcgaactgcaagatggaagtaaagaagccgtgttccgcaaaggaaattgggctatttagtccttttctcaacctcaattcaatcaacccgcaaacgatctcattcgtatgcgggtttttttattccctgaatctcaaatcgctccttgttttgtgaaatataaagtgctaaactgagttcaaacaataatttaaacaatgttttaattattgtttgaaaagtcatttacataaaatcgtcccatttcattcatccgttatgattggacgaaacaggaggaggaaaaacatgaaccacccagacaaaaaacaacaaaccaaagaaaaaatcttagacgctacgctggaatttattcaaagggaaggttttgaggcggttacaatccggaaaattgccgacctgtctgctactaatatttctttagttaattattattttggctccaaggaaaatctgctcagtgaagctattgaagtgatattaaatggctttcagcacaccttttctattttggacaatacagcaatgcccccccaagatagactgaaacaatttttacttaactatctgcaggtcattcgtcaatatccagagcttctttcgcgaattattgccatgggcagcacgccctttacatctcaacaagaatacggaaggtttttaaacataatgggatttccaaaggttcagagcacgatcaaggagctgacaggtgagcaacagccggagcgcttgttagcgatgatgctgcaaatatttggagctatttttctgcctgcactgatgagtccaattcttgaatcaggggcagttgtggaaataccttcagtagaggaacaattaaatctgctgttcgaaagatattttgatcaaaaataaatcataggggtgactaatatgaatcttttgagaaaatattggcaagatgcaggggctataatcggtgtggttgtatgtattgttttacttatgaatccagctatcctttcggatataacaggcatgttatggttgagttttgtggctatattgtttcatcaatttgaggagtaccgctggcctggatattttgctggtttatttaacaatgttatgtttaaaagtgacacaccggatcattaccccttaaacactcaatcagcgatgattatcaatgtggcaattgcctatgtgttttatctgcttcccgtatggtttccgcaagtaatctggcttggactcgcaccagtttttatgggattctttcaggtcgtttggcacggcatcgttgtcaatattaaagcaaaaaccttatataatcctggcttgtttacggcacttctcctgcatgttccagtcggaatctggtatattcatgaaatagtacagcgagacatcccaacggcaatagattggattgcgggtacgatctactttgtttttgctgtatacatcttcatcattaaagggaatatatggttgaagaagagtgactctccttactccttttctaaacaacagctgggagcttatggtcgtaaatagggtatattagaaaatcatcaatgtccttgtttacaagttggaaacaagtagaggtattccggaaatgaggttcggttacacttggtttgtacccaagaacaaggaaagagtgatcttataatgaagcatacacatcaatcttatgatcgtaaaaagttggcttacaagctaatcaccactagtgctttattggctataggttttgctgtgatgacaggatgcagcaatagcggggaggaaaaatcaactgctcctactaaagcagaaacagtcacaccacctgctagttctacagatcaaaacacggatctcaatactaatgggcaaggctcaacctctacccatcaagaacctgccagtagtacagcttcatctcacggtaaacacagctccgcagctgctatactcagcgcagccaagcaggggaccttaccgaatttgcctaaaggtcttggcttgggaactagtagcgatttgttatttgaactgtgggggaaatccgagtcaggttctacaggtcctatgagaagctatgctaagtatcatacagacatcatgctggatggaagtgataaagttacagaaattacatcttccgatccagactataagaagttgcttatcaaacaagttgttgacgaattgggcaaacctacggaaaccgttgacacctctagagacatacctgacacagcagaagctaattatacgatcaataacacatcaggacttagttattatttagtattttcctatcaaaccaaaacgaaaaagatcaattatatccgtatatattttaactctaaaacaccataattggatgtatataacagagtcgtttccgtcagaattgcggaggcgactttgttcaaactcattgcatttttaggttatgtcgtttatactaatttgtaattgattaatcactaatcggaaaactgtgctaaataaagggatgaaaaaaacatggctaaagctacgtcaacctctataaatcgccaaaaggaaatcatatctgctgctattgaagtgtttgcagaaatgggctactaccgagctacaacagccaaagttgcggaacgggccaatatttctcagccctatgtctttcgttttttcgctaccaaggaagcgttgcttgttgaagccttgaaggtttcatttgcacgtatcatagaatcttttcacagcgtcattcattcggcctcatctgaacagctcgagcaagagctaattgtagcctattcgcaaatgatgatggaataccgcaatgaaacacttttgcaaatgcaggcgcagacgatccgcgaggatgaggtcgtaagcgtgatgcagcaaggattccgtgaaattcatacgacggtttatgatgctttccgacgggcaggtattgaacaagcaatggaaagaacgatgctttttcttgccagaggtatgctgtgcaatatttcgatgtcgctggatctgccagaactgatgaaaaaagacgattaatttgggtttatgcattagagtcgcgttttctcgcggcttttttgcttttaattttattttgttcaagacatgatttcgtttgcttctgagaaaaaacggccaaataagttgacaaaagaagcgagtctcgttatcctaatacccataggggtatatgtataattgggatttaactaagctaagccccctcaaaaaacagacggaggtactacaatgtcatcaattaacaatatccaagcagatcgtattcttgattgcaaagggctagcttgccctatgcctatagtaagaacaaaaaaggctatgaatgagctcgttcccggaaagattatggaggttcaggcgactgacaaaggttcattagccgattttcagagctgggccaaaaacaccggacatcaatatttgggcactctccaagaaggagatgtaatgcgacattatttacgcaaagcaaatccggctgaagtgaagaaggagcaaatattttcttctacgataaactatgaagagctacaagcaaaatgttctggaaacgagaacttcattttgcttgatgttcgtgaacccgctgaatttgcgcttaaacatatccctggatctaagcacatccctcttggcgaactggagaacagactctctgaactgaacttggaagaagagatagcggtgatttgtcaagctggagcacgcagtgaaatggcttgtcagttattagtttccaaaggcgctaataaagtcaaatctgtaccttcaggcatatccgaatgggctggagagactaagggaagcgaatccatatgagtacgacagcaggaatttatacaaataatcaagaatatgctcagcccaaaacaacgattgtattattcagcggggagctggataaggcgattgctgcattcattattgcgaatggagcggcagcatatgatcatgaagtaactattttctttactttttgggggctaaatacgttacgcaaggatgaaatcgtgagcaccaataagggaatgctcgaaaaagcctttggctggatcatgcctcgtggacccaaaaagcttgcactatccaaaatgaattttgccggacttggtccacagatgatcaagcatgtcatgaaaaagcacaatgcgctttccttgccgcagcttatagagttggcacgagagcaggggatcaagctcgtcgcctgtaccatgaccatggatttgttagggctgcagcaagaagagctaatcgacggtttggaatatgctggtgtagccgcctacttgggggatgcttcgcagggcaaggtgaatctatttatttagggtatcctatttatttttttggtttataatatacctatacgtgtatatggtaagtcaaaaaaggagtgcattacttatggattacaattacagtgatgaactgaaaacgcgcctgaggaggattgagggacaggtgcgtggggtacttcgtttaatggatgaaggaaaatcgtgcaaagacgtcgttagccagttatctgccgtacgtaacgcatcagataaagcgattgcccaaattgtagcagagaatctgcaacgatgtatattggaagagcaagaggctggaggagacacggataagctggttaaagaagcgattcagcttcttgtgaaaagtagataatcctgactccagagtccaagctagcgggcaatgatgtcactatgcacaaaattacgggagccggcatattgcctttaaccagccacatatattggacgtggttaagagttttttgataaacatctgaaagattaagattatataatagccgtaattagtaagttcgctgcctctagttggtagcgggcttttttaatcggacaattttaggaataagcctctgtttatgctgaggtagacaggtgtaaataacacataaggaaaacaacttcttccgggaggcatacttatggaggtatttgttacgattggtgtcaaattgatcatcagcttttttggcttgtggatcattacttttattacaggtcggaaaacactcagtcagttaacaccactcgatttcctaacatcattggtgttaagcgaaattgtgggaaatacgttatatgacgataaggtaaccattgggcagctattgtttgctttggcactatggtgcgcgctggcctacttttttgaaaaggcaacgacccgttttgtgaaatttggctatatggcagaaggtcgaacagtgctgctcgtggataagggccaggtcaatcaagagatgcttgaaaaatatgatatagaatttacacagttgctcaccatgctgcgccagcaaaatattttttctctacgtgaggtctggtatgccacgttagagacgaacggttcattgtcagtcatgcgcaaacccgaatacgagccacctgctgctcaggatatgggaatagatgcacagcctgatctattttctgttactgtcattgataagggaaggttgctaaatgaatctatgcgtgggaaaacaatcgatataaagctaataaaagcgaagacgcgagagcagggatatgatagtatcgacgagattgcctatgcagagcttagcgaggatggaacgctccatatagtgccgatgaaagagaataaaaattaaaaaagtggtggatctatttaaatgaatgatcatctcctcatgaagaggactgtttatttgtcttttttctttttttaataacaataaaggtgaatagtaacaaaggaagaaaaatttgaaaaataggaaaccaggaattaagaacaaattttcgaccgattaccatgtgatgaatatagttaggcgacaaaaaagaaagaccataaataagtgctgcaaggggaagaatccattttttaaatccgactccggttattttttcaagtcctatcacagcaccattaaaaaataaagacattttgatgatcaagccaagaaaaagaagcaaggtgaaaagggcatccattcgttcgaacagatctgctaattcaatcaactgaacggcttccaaaagaggaagtgtgctatttgcagcgatcttgggtccgagaacaaaaatatccaattgattaacaaatgttagagcaagtgcggtcattatataggcaaaggaaacgggttttgtgagattccggcctttatgtacaagcggataaaatacaagaaataacacagtttgtccgaatggaaaggagataagctcaggaatagcggctttaaatatggggttccatccttcctctaaaaccggaagggaattttccaagtgaaagagaccagttgccggaattaatatactaattatggcgtatccaagtacaaaaaaagggaaaaggaataagcaaaataagaaaaatgctttgtagccgtaacgaaccgtgttggatacaaccacgattgtgatcaagatgatgatccacaaaggggtttggcggagcagagtcattacggtcacctcgcctaaatcgcgtatgttccgagaagcttcatatgtaaaatacatcacaaaaagtaaattgatgagtgtacccacatatttccctgtgtaacggcgaaacaacatgaacaaatctaattcaggatcttgatggtgaatagcaagatggagcattagcagaagaagtcctgctaatgctcctatcaacatgactaaccaagcatcttgctttgcttcagcccccattaaaaacaaagttgtacttccaacttcaaataaagacatacaaatgatcagctcggatactcggattgtattttgacgcattgcttcatttcacctctccctgtttatttcatttcaacagttcgttaaaagatttttcgaataatcctggacgtgcaagcttcatttttacacctatttttatatccatgtttgcgaactcttcaggccatgtctcttttatttttttccagtcttttgggtacttgtgatgaattttatttccaacaccaataaggtcgatattcttttgctgtaaggctttccagccttcctgaatttgcagtttgatcgtttctgctgcttgcatctgcaattgacctatactttgcatatctttcatttctctttgcgaagaggctgacagaagatccccggtagctttaacgtcaacgttgaggtaataatgatttaaattcttgattggtgtaaccttaaccttggctttccggatgaggaaagcggacgtaacattcccatccacatagtttacagtagtgtttttaatctggttgtttaaccatgaaacccctatactttccttttcatttaggaagccgactctcttgtctttctgaaaaatgcttaagcccgataacttgagtttatttttggcggaggtttccttgaaaacatcaacagagtctagtttctccggctcggaaccctcaagagatatttctggaactccggctgcactatcggagctaattttcgaaataaattcatacatggatattgcaggggaaattgatcctaattttctatttctttctataatcttttctaaagcttgaccaggaattttctctggtggtacaagcttttttaaaaaattacgagcctctccgttggcaatgaatacttttacagtttctcgtgaatcaaggttgcggaggtaaatatcaataatctcttcaatgccttgttctgctgctttttttccaataacgagtatattattttgggcaaaatatagtttgcgtgggtattccaggctactcttcgtaacggtctctctcaatgtttttccatgtgtagaaaaggtatgtacagcgctttgcgatgccccggtggaagaaccacctgatccagtcgtcatggctgatggaattataatttgataggtattgatccagtcgcccttatgtccatcaattccagttgctgttgtgatggctaattcgttcaattctgttcgatctacgcaccctgtaagtaataaccctgcaataaacagaacataactaactcttaattgccgcaccattgatctctcctatttttgggtatcagacttatgatcaccttcggtatcatccgaactagcagggtattggtgagctgcctgtcttgtctcattatgacctgatttttcgctaggtctggttttcatagcccaccacggagctctgatgataaggtccttcatattagatttaaaggtggggctgtagggcacaaaataatcaactccgaatgatttgagagatacaagatgaacaagaagggggataattccgatcagaataccgaataatcccagagcccctgccagtagcataagtgcaaaacgcaacaacctgactgctgaagccataccaaaatacgggatgacaaagttcgatatagcagtgaaggcaacaacgataaccattgcacctgagaccagtccagcttgcaccgccgcctgcccgataaccagagctcctacgatggaaacggctggtccgatgacccgtggcattcgcacacctgcttcacgaatcacttcaaacattaattccatcattaatgcttccaataatgcaggaaaaggagttccttcccgttgagccatcagcgtaatcaacagcgtggtggggatcatttcctgttggaaagtcgtcaatgctataaatagagagggaagcaacaatgagactagaaaagatactacacgaagagcccttaaaaaagttgaaatgtcatatctctggtagtagtcttccgccgtttgaaagaaattaaagaaggttacaggtgcaatcagagcgaatggcgttccatcaaccaggacagctacttgtccgtctaaaaggctacctgcgactgtatccggacgctctgagtttagcatggtgggaaagagactaagtggttcatcctgtataaattcttcgatgtagccactttcaagtatgctgtctgtatcaatggattgaagccgttttgtaatttcctgtatgacttctggattagcgacattttcaatgtaagctaacatgactttggtttgtgtatatcgcccaataacgtgactttcaaatttaaggtcaggtgtccgcaattttcttctgatcagtgtaatgttggttgagatatcctccgtaaatccttcttttggaccccgaactaccgtttgggtactgggttcctgaatagcacgccttgttccacctgcgatggaaactgccagcgcatatgtacttccgtcgatagcaatgacagcattgccagataggatagattgataaacttcattttgtgagtgtatcatttgaatatttcctgacgggattgttctttttaatagcgaaattgcggtattttcttcaagcttaaaagaagctgtggagactgtctctgtaattaagccctcgatcaaatcggaaagcaagttctgatcaatcagtccttcgatataacaaacggcgagatgtccagcatttacaggactttcggaaaaatcacgaatgataaaatcgggaccttgcccaagttttaatttaagcaaagacagagtatgggataatgatgaatggattggatcggtagcggtttgctgtttggatttttcgatatcctgtgagtacctttttccaggtttcagaacatttctaatccaacgttttaacacaagtgaaccccctctttattgataaagcatatctttgccctgcaacctcaaaatatacgttgtttttatgaattggatacttagtgaaagacatttggaagcctcataattctccaaatttcgcaatcaaccaccacagggtctagaggagtttacattatagaatatttgagttccggattgaggagactaccacatatgggtttgaaatttttcagaaagtggtgatcaggtttgagtttctcagatgatcagctcatctgttttgggtttgaggacaaactagggtattttgctaaggctgctgttcctcctatttatgagactgctccatttttctttgatacctacgaagattatgctgaagcagctaataatgaaaaggagcattatgtctattcgagaggaaccaatcctaccgttcggattgcagaacaaatgattgctgcgctggaaggtggggaggattgcaagtgctttgcctccggaatggctgctatcagtgccgctctaatgtgtagcttatccgcaggggatcatctgattctggtcggacacatatatgaaacttccgtcagcctagccaaatacttaacgaagttccatataaactacaccattgtacattcgacttctacagaagcagtcgctggtgccatcaaaccgcagacccgtgctattcttatggagtctcctacctcattcacattcgatatggtaaatattcaggaggtaacttcgctttccaaagagaagggtatacgcacaatcatagataattcatgggctacaccccttttccaaaaaccattagaatggggcgtagatatcgttgttcactccgcatccaagtacttgggtggtcataatgatttaattgcaggggcagtgatcgcttctaaagagataataaaccgtatgtatgctgaagagtatgagttgattggcggctcgttgggcccttttgaagcctggctactcattcgggggctaagaacactcccgctccgaatggaagcccatcagagaaacgctttgttggttgctcgttttctatcagatcatccggccatttccaaagtgaatcatcccggacttccttctcatccacaacatgagctcgcatgtagacagctcaaaggctatgccggattattcagttttgaactaaaggattcgacttatgaggatatatgtagagtgatcaataaactgcgactgatccggatcggtgtatcttgggggtccatggagagtcaggtgatctcaccaaactacggcttcaataagcagagtctaaaaaaacaacacatgcctgaatcgcttatccgcttggctgtagggcatgagcctgctgaacttttgatacaggatttagctacagctttaagctaaacgaacatttcaggattttatcataaaagctaaagcagcagctcatccaatacataaagagcttctgcttttctgatttatgacgtttatacctgatcaactttgcacttcaagtaggagataagagagtttcggttattacaggtaaatcatcgtgtattggagtattttaataaaaactacaccgtgtagaaatacaaattagcaaactggtaaatattacaacttgcctgataggtatacacgtgataaattatatatccagccagttaaacggctgttgatttgatctttgaaaactgaacaacgagtgagtatggattttgtttacaaaatccaacgcagaaattttggtacatgccattaggttgtatgaaatggaagcgaaaatgagatgttttatctcgtcagtttcaacatgagcttatcgctctttctataaaccaa

SEQ ID NO: 35 - DNA, 339105 bp, Unknown
  Kingdom: Bacteria, Phylum: Firmicutes, Class: Bacilli, Order: Bacillales, Family: Paenibacillaceae, Genus: Paenibacillus
gtgatatagcgcatctccgttttgcttagagaaggaagattattattgatcatttcctccattacggagttaactttttcatttattttttttgtataaaagcaggattattgatcggagagataatttcatgagctttatttactcctgcttcatcttccaagaattctaaatctaatgtctcaaataatgaaactaaaaattcaattacaccttcggcatccaaatttaaagttgattttagttttacacatttttcgaactgtgttaaaacaaaatataaagtagaatcaagagctttttttgaaaaatctttttgttgctcattataatagtattcttctaataagttcgcaattttatattgcataaataggtttaatgaattcatgaaattataaaacaagttattatcaactgtgtctccatgtttttcaaacaagaactctccgcaaataataataaccaaactataaaaaaagcctatgcgataagtctcgtagctaattttctgatcgatgtaataatccattgaaaaagggatccctttttgtaaatggtctattagtaagtttgtatcaaaatagcaagtcgtatcatttgctattctgatttttcttctagccataaaattatagtcatccaaaaattgtttgatggatacttgcttattttggttaaagggcacctgtatatttttatttttaatacatttgatgaataactcatagagtgttgctgaatgtaaaaacatgcttcctgtgttatgatccaaaaagttgactaatggttctatattcatgttattttgaaagctgtgattatatttattttcactatacgatgcatacgaattgaaagtgatagtatctagtaataatttcataaaacccctcctcttattactttgtagtatagcgcaaaacttgaaggcactcccccttcattgagtcagctttcaaatatgtttttttgtattacatataacgttcctgtattcacgacccagcaaatgctgggtgtccagcgaatgccggaccaagagcgaatgctcacagcgtgaatattatgttagatgaagttaatatagatcagaagatttccaatgctttagttctactacctcgaatcctgaatcaataattctgtttttatgaaatcccattagaatcggtgtaatacttctacttcggtaaaatgctttatttaaatcatgtccttcctgtctaagtttgtgtctataagttttactccttccaatcatcttatccagttcagtcaacagcatagtatttttttcgttatgttttacatcttctgttgtccaaatttctgatgatagaggataaaacagcttatttgacatctcgtataactttaagggtttcatcacaaaatcatcaggatgtccggacactttcaattcaaaatgagcttctttttcagtttcaatccacgaaatattcaatggttgaatttgagcatcatcaataagtattccctttgaaccctttatcgcatcgcaaatcaatttcgcataattatccaagtcagcaagttccggtgtctcaaatcttttctgttcattcaaataaagagttatattcactcttacttctcgaaaatatacgtaattgacttttaattcagaagcaactttctccttaaatacatgtctctcacgattaccatagggaataggttcaaagttaaaaattttctgatactctccaaacattgggttattgccgttttcataaccttcgttttctattttcagtatttcattatcgtcaaacataaaaacacctccattaatttcatctaacgttgctggattcacgaaacgatccagccataggtagcccttatccttatgctggttcgtttgttgtttgagcttcttccgtgattatacttctgacaaccgagtggcgattgccccgatgcgtgaatacagtgtcaactggagctattgccttctctgagatgctcactattgatatatgtttcaaacaaaaaagtacataatgctccacttaggttaacagataatacggaatgacttagtgtcggaggtacataatattcattcttaccatgtgaatcaccatatttgttacgaaactccgcaagagcagaaactataccggacattgatccagtaatttgtttgataatcctctcaccatcgatatcaggaaagtattctaatttgtcagcaaccttcctatacaattgtggtaaatcatcacgttctgtgtagttaatattcattctatttaatatccatttacatgtgctctctaacattgacctagctgcagttattgcatcttccgggtcagtactacattctttaattgctctatcccagtcttttttaacatgatccaaactatagttatcaaaaatagattctggttgggagaccgatacaccactcgcagatgttatctttccgttaatataatcaaatccatcgttattcagcaattttattagttgagtaaatcgaacatcttcactaatattaaaatattcattatcattccttaataaaaaagtttcaataaccttaattagcttctgtacatcgctcttattgctcaaatcaagattacttacatacgaatcagcagttgattttctagcgcctgaatgttttgaagaataatcaggctttttaaagactccttcactctcaaataattcagatatttcatttatagtagaattagaagacaaaatattaaaaaacacatcaactgtgcgactactaacaataacacctttcatgaatatacctcctgtaaaatattgcaataattttagctaacgttcttgtatctacgaacccgagaggcttaagggagcgcatgcgactgggtccgaaggacttagcctcgcagggttatctgcctgattccactactcacctcgggcagatcaagggggctcgcccccgcagcgtagatataatgttatcaaaagttattgtcttcttcgaattatctgtatgtacatttggatttaataagttctactctgtgtacatataaatattttgaaagtaaccccttcacaccttcaatatctgctttacatttagggcccattattacttctgcaatgggatgtacctcatgtttaggatttaacggaatttcaataaatgatattaaatcatcttctgtagctctgtatttaaatacatcaggttctgcaaatacttcatcatatccataaataattcttacttcttgttcctcagaaaaacctgtacttttaaaagtcataccatatcgtaaaatttgactcacaacatttattgatcttatgtctatattcgtatttgtaaaattgtattttttatattcctcaataattttttcttcgcttagtttttcgttgattatttctatttgcctttgactgtcgtaaataacgtctttaattacaaaatctttattctcagttgatttaatagcattaaaataatctcggtcgaaaccaatagctactcctcttccatcgttagcatatgacctccactgactaagaagatcaccatgttttgaaaaacatgcaatatgtggtttgaacaattgctttgtccaatattcataaacagagccaagactaaaaagatcgattcgactattctgaagtgtctcttgcaatttatgaactatccaagttatttcgctactatcgtttgtcttaaatgctgaagttaatctaatatttttatttagaaacaatacttataaaggtatccaaactacagtaatgatatattatttctcccatgaaaacactccctccttacgatgtatttacaataatttctgataacgttcatgtattcatgaacccgaagggttgtctgctgaaattcctctccgaaaatccttctcgcagacccaggctccataggagccgcagcttgaatattatgttatgagatgtcattggcttcttcgatttatccccaaaacagtccgttatgcccttcatccacaatctttaactgtttttcaaaatcttcatccggttctatgtcatctatgaagtgccatttccccttgctgtcttgccaatatattttccattcgttttcatctaatctgaattgagctacaggcaactgcacccattgatcacttttgaatccctgtctttcttcaattaatgtcacatgatttcctctgatcttataactgattttaatctggtttttcacaagttctggtactacattttgtatataattgtccatgattttcttaatccgcttctttgtaaagtcatccatggattttgtctctcctgccctgattcgttttactatgattatatcacgatgatttctcataacgttcctgtattcacgacccagcgcatgctgggtgtccggctatgccggaccaaggacgaatgtccgcagcgtgaatattatgttatacgacggtgccttcaatcacccacaagtcttttattacttctttaacattgactcaattatttttcttgtatccccgtcatcaggtatagcattatcccacccgtgaccgtaccatcgatctgtattccttatcaaaaaatcaagttcaatccatcgctcttcaataattaatttaaaaatgtacgctattctattcaccatgaatttatttaaagtctccatatcagtttcagagagttgattatttggatttgcatgcatatcttcaacaggaccatttctaaaagcaaaatgtgtaagtgctttggcaatcattgttaagttttcttcaactaaaagttcagcttttactctatcattcatttcttttgcatgttcggttttaacaagtaaataatcatcaagtatcgagttcctaatagtaattccatattttcttcgtctatatgtaattttcgattcttttacatcaaatagctgagatatcatataatctggtatctgctcatctataaacatcgttttgagatcttcttgcgtaagatcgtctaaagataattcttctcctgcagccttcttcgcctcaaattctttaaagattcccatcattatgacctcctgttttattaatttctccgtactgtcgtataacgttcctgtattcacgccccagctatgctgggtgtccggcgaatgtcgtacccagggcgtatgcccgcagcgtgaatattatgttatgtggtgtaccggacttcttgaatctacttacaaatgatcgcttctgtatttacttatgtgctcttctaatgtctttctcgcttcttcataggttctaatcacttcatccaattcgttcttcaactctttatgttctttccaatattctttctccactttgagtatcgaacaaaataaatctccgatatataaatctcctgatccgaatgggttctgtattaattgctctaaggctagaggtaaaagaaaatctagattcatttgttgcccaatcaaaagtcttaaatcttcattattcaattcacaaagaggtttcttccttaatcgatgtacttggatcactaatgaagaagcaaaattcggttcaccccaatattttccttcaagttcttcaagggttttggttagatctacttgttgcatggcttcaccctcttaaataaatggtttccggtatgtcacataacgttcctgtattcatgaaccccgaagggttgtctgctgaaatgcttccctgaaatccttctcgcagaccaaggctccgaaaggagccgctgcttgaatattatgttatacgatggaatcacttcttcgattaaccaacattcattcttgattctaatctgtcattgttctactatatgctccaataaatctcctggctgacaacttaaagccgcacataatttatcaatcacttctaatgacacatattcgttcgtattgagtttcgccattgtagcagacgagatacctgtcattttcaataaatcctgcttcttaatctccctatcgatcaataatttttgaaaaggtttataactaatcatctgatattcctttcacacatcaagtgaatttttctttaattatatgaaagtatattttctttattgaaaacatcctcaacatgtattgacccaattgtttgatatattaaaattatttttaataagttgaacttttattcataaaataaaattcattggatggtgtttagtatgcataattctttagaagtcttacttgattcactcattcatactcgaattgaatctttatatggcgagcttaccaaaaacaactccagctacaaccagttctcatccgaacggaatctctacttcaagcagttacatgagggagtaccggagaatatacaggagaccctattcctttacgacgatgctgagctttctgttcaagctattttagaacgtgaaatttatttgcaaggttttaaggacgctcttcacctgcataacgaattacatatatctttagattgagagccttctggctcttttttatttttgattctgttgtataacgtattatttacgaacttccgaaagaatgctctcttcgtcatattcacgaacatcgtgaatcctgcacttttctccttattcccgcactttctgcgtttcaatcctcttacccgctcatccgatccaacggactttgaattcgtctaatgtcccgtctgctcacatgtgtataccgctctgtcgtgcgcacactctgatgccctagcagttcctgaatatagcgaagatgaatcccgttctccagcaaatgggtcgcaaaagaatgccttagtaatggatacttacctgtttgtgaatgcccgctttagccagtgtcttttcaaataccttctacgctgaacattccgtcagatggcggccttccctatgccctagaaaaaagcctcttttctgactactccgcccctatgtactgctctactaccgcaaaagccacttctgagagcaacgcttaccgttccttcctgcttcatccgataaaataggtaatcttcatactcgcttgtctccttagtatatcagtcgttcaaaaaattggaaatctaattttgcacaaaaaaagggacttaagatgcaaattcactttaagtccctgattctttcggatcaaatttttgatcctttaagttcaattttcattattataattacttggaatgagactccgaagacagtggaatagtgtaacgttaatctcttgtataaggatacgcggctaaaaagcatagtttctcgccgcttttttcaagcaaaccgcttgtattacaatcatatataaagaacaacgaattatatttaccatctattttactcaagccatttaatagtggagataaaaaagaatcaacgtaggaaacatcttttataccatcatctgccccatccatcagaaagactccttcagcaaaatcttcgtcaaaatcatctactgcatggtcattcaaaaaaccactaaaaacatcctcattctcatcttccgggtatttgatttcaacatattcaaacaactcatcttcagaggcaaagtgaccgtaccagacggacaccatatttttttcaaagcaattcatatcttcaccccgctaatatttcagtttatacctatggtctatctgtatcccgcaccagctaccatgccctctaccccacaacagctgttgaagctaaaaagcccgcgctgatcgcgggcttcgctgtatatttagtcaaaatcatgcctagtaggcttgttactccaccttgaactgttttaattcgtcttgaagcttattggacaattggtttaattgtttggatagctcagcaacctgttcgaagctctccagttgttcctgcgtgctggcgctgacctcttcggttgaagcggaattctcttcggtggtggaagagatgatctctaacgcctgcaaaatctcatctttgtgcttgtggactttggaggtgttggtgctgatctggatcattcgcaatttcaaatcttccaaatccttattaatgctaaagaatacttgcttcgtgtcctccaccgatctggcattttcttctgcaattttcagaccgtgaaccgtatgctcaactgatacgctggttttttcttcaattacacgtaccttcttgtagatttcctgtgtcgccagtgcagtctgctcagccagcttgcgaacctctccggcaacaacagcaaaccctttgccctgttctcctgcacgtgcagcttcaatggaagcattaagcgccagcaggttggtctgcgttgcaatttggttgaccgtatccacgatgcttgaaatctcatgacggctcagatcaatctcctgaataatagacgacatcgcttgtgtggaattgtgattttcttccgcccatctggataactgatctactacagcaagtccctgtccgctttgctcagcagagaattgcaccatcgtttcgatggctttggcatcattggcaatttcgtcaatttggccggataatgctccggttttttgtaaaatgttatccgtttcgatggattggtagttcgttgcattggcaatctcattaattgctgtcgccgtatcgttcatcgtgatcgcggttctggaagaaatggattgcaaatcatttgaagattgattcaagacttgagctgagccacccaccatttggagcatgccttgaattttttgaaccatattgtaaattccttgagaaatttgcccgatttcgttgttggaatgcgtatcaaactgaacggtcaaatctccattttcaatcagcttgatttttgcaagcaatttcgggattgatctcaacagataacggagcgttatataacaaatcacaacgagcaggatagtggctgccgcaaaaccgccaatggtaatccaggtaaacgcttttaattctgagagcacctcttcttcagaaatggttaagcctacagaccaccccgtatctttactggttgcatacccgatataacgacgttccccattatcattaattagctgtactccggactcgccagcaatcattttctttccgatctccccaagatcacctgtgctttcgttaatcttttctttcagcactttattttgatcagggtgatacaaaatatcacctgttttggatgcaagaatcgaataacctgtgcttccaagcgaatagctttgcataacggcaggaatgtctttgaaagcaatatcgacagcagcaaatccgattaattgattactgctatctttaatcggatagaaaatgcccatgagcacattacccgaattgacgtccttatagggttctgagtagtataaaccgtctgcttcaacagctggcttgaagtatgggcgtgtatggatatcgaaatccggtttagaagcaacaccatcattctgaagaaagaagcctttaccagatattcctgcaatccaggcgtcggcaaaagatggctctgcctttacaatggctgccagagtcgcttcggtttccgcagcatgtggagaagttttcaccatttctgccgatgaggtggtttgtaaatattgcttaaaaagattattcgttgacatttgtttgacaagtgatcccttttccttaaacaacgcatcgaattgagtgacaacggcctgcgtcttggtctggagcatggcctcttgctgcttgacaagtatgctttgcgtgcttgcaaacatgaacgtccccaaggttgcaaagacgacaacgataatgactaacaagaccatggctaatgtgttcgcgatgctggatgatctgattacccgcttttttatattttgtgacatgctgccatctccccgaggaatattgagcgaaaagctcttagataatatgtcggaagtttgcagctattttaataggtttttagtatacacaatttaaagttttgcacgggatctagatgttcataggtatacaggagatgcggcgtattttccaggcttgattgcgtcgacgagcaactaaactagattagctatgaaaagaaccctgtagacacgggtgaagaaaaaactggagaatgaacaaaatgggaacccaacgaatagaatacaagaaaagtcgttcggcgagaaaaactcctatgaacgatttttttccttcaaaccaatgtatgtatttatcaacagctgcggatcagcttgaggccattagtggaggaaggataaagaagcaacgagatattagcccctctataagtctatacaaaagcgccgatgagagcggttagactgcccattcatgctttccatgcgccagttataaaccggacagaatactcagccccagctcaattcgtaatcgccgcaacaatgttgttaaccaacgcttttgacgagacaggatcgccaaacgtccatgtcttgctgtccaatgcatagatacgtttcaagcttatccggcttccaagcgttaatcagtccgatcttcgccaatgttccaacgacaactgagttatccgaaaacatgcgcagacttgccgcattttgataagtgaacgcctgtgtcaaactataatgaaactccgcttgagcgctcaataggaacgtattcacttttcctttatccgtctagcacaacggcttagccaggtactctcctcaggtaagaagtctggacagggtaaaccgccgcgcattgtgctgactaatcgcacaaacgcggcgatttcaaagtctagatgagccgatcaacatttctatcagcgagtagatactggttctctttttatagattcacttgacaccgattcagagattaaacataaattatctaaattcaacaatccatttcccacaagctttggatcttcatctctagagtctgtccgcttgattaactgggcatatatttcaggctctgtaaagactctgtcgaattttttctcacatagattaatcaaaattgcagcagcacccgcaacatgtggactagccattgacgttccatcaagcgtcgcataaccacctccaggccaagtagattgtatggaaacacctggcgcaaccaggtctaattcaaggtttgtgtttgtgaaacaaggaaacttgccatccaatccaactgcgcctacttccataacttcgggataagcaccaggataactcaattcatcacgtcttacaccacagtccccccctagaccaccttcatttcccgctgcacaaacaataaggatgtcattctcaacggcttcttttattgcctgatgcagcgcaggattatcatctggtcccccaagcgacatattaataactctgattcgtttaccatttttattccaatttatacaatatcgaatagcatctataatattctgatttgaagcgccaaactcttcaattccttgttccataaaacgttgcatgacctttaacacaacaagttccgcttcaggggcaactcctataactccagaaccattctcagatgcagcaatcgttcccgctacatgagttccgtggccgctataatctgtaacattatcagttttgccttccgatattacaaaattgtgcgtatcaattatacgattctttaaatcgggatggtttacatcacaaccactgtcaataacagctattacgacattctctcctttgtgacctttcttccataattcaggggccttaatcattttaatcccttgtgggattttgtccgcttcgtcggcagtagattccacagtaaaaggtattaatcgaaagtctgacattgaaattgtctcctttttgtgaagtataattttaaaataaagctatgttctaacctaacaatgtatttatcaatcttctattttatagccacttcggaaacagtactgctatactttatcaaggcttcctggagcaagtttagcacttgtactactttgtatccttttccccttcctaaaggtttaagcaataccaggtttagatagccaaatttctcatttgggttcagctggttattaaaatggtgatggtgtgctacaaatatttgattcagccctgcctcaggaggtgtctctaacaactgatccagctctctctgtaccagacgtggctcaatttttatattttgctggctaaaagcaatttctgccgtttgtctcgctcggttaatcggactcgtgctgaccggaagctgtaaagggattttttttgacgtaagcagttcacccaacctccaagcctgttcccggcctaatgcacttaacatgacaccatcatcaactgtattctcaggctgtgcatgtcgaaaatagagattgtgtcctccttggcgaagcagcacaaagggatctaccacagaatcttcagaatgcagcattttgtttagcgcccatcccgttttggacatccctggctgtagcggcaataaatcttgttgctgtagcagctttttcattaaatcccgactgctttgcgcagctatgcttcctgtcgtctccgttgtgatctccacgattgagctgcctgcaacattccaaacctccacactttcctgcataccgccccattcccctttaaacttatatgctatgacggggccgaacaaactcgttttcgctagcattgtggtaaaatctaattctccccattgctcccgtagcagcggttccggtgcatgcttcaggaaaatggacttccaatcatcgggatgatggagtgcggatacatttactttcacctcgtatgaaaggttcaacgattgatgttctccactccaatctacttccttgctccacgaaggatcatccagatcaaggcctgattcttccatttctctcatggattgttctatgttttcactctcggtaagatcaactcgcttcttataagtgatttcccattgatctttgccctgcttgagacgcccgcgcaaaatccagcctgcatggtataaatctaacgcagacgtatctaaaaaatgaatatccagttgttgatgcgatgcctgatccagatgtacaaggtcaacacgcaatttatgctcatctgtcagtacctgattaccatctaagagaaatttaatctcatactgcatttctgtttggttcatagcagttctcccttttcatatatctccagaagcttgcaaaaaactgaaagttttatgatttatcctactggaactgcttcttttattaccggatagaaggttcttgcatttttcgttccatctgttgttcggaatacagtgatatcaagtttttctccattcagatctaccgggatatgctgccttccgtccagaaatgcaaccgtaccaagggccagtagaccttccgcacttgtaccaacaaagaaacctccaatatctttaaaaagcttggttttctctcctgattccttcttttcctccaaagtatatttaatcgttataacttcagccagtttgctagcttctattttatttacctgtacatgcttgatgaatacaatagaatcctcttttttcaattgcacatagggaccatcgttaattagataatggtaccaaaaatggtgccctcccaattttctttttttactaccttgttcacccaggaatacatgttcaaaataagaagtgctttttcctttgattaatttgaaccaaagtgtttttaacatatccatccattcttcatctgaactgccatctgcaagatgtccgttggatcgggcatactctcgtgcaagctgcacaggcttagttcggatagcaaaatgtaaaaactcattgacttcggcctgctcctcagaggtagtcatttcttttgcatctactatccaattgtaattatcatgcagtttagcaaataattcgtaggatttttgcttgttttgcggaatgtggaattccttaaacacggaaatttcatttttttcacttccaggggttgtaacttgatccggggttgggtccatatcaacgataacgtatccttgttccgaatccttttgattgtcactcaatcctttaattagaggaaatataccgttttccttcatatctgcttcccaaatttgttgaaatatcataatctgtccctccaaagtgaatttattttttaacctgtaacatcttttgtatgtatcgttgtgtttatgtataaatattaatggctataaaaacaaattatgttaatttgttaatcattttgaaaatgtttttttggaagatgaaacattgattttacgattaaattgctctcttgcggcctgtccatgattacacaacatcatttggaaaagacagatttttgggggaagagtaagaaaggaggagtataaggccgatcgttggtaatgcatccaaaatgagtgttacatcaattatgctttattcaggcccgcgccaaaatctgcgaaggcctgatatcgttatattttccaaaagttaaggactttcggatcattctcaatctcaatcaggactccgataactggaatttgattcactgcgttaacccaactgcatcgttgtgatacaagtatcgtttttctcatatgtagagaattcagtttcagccgttttaccttcatgattcacgctaatgcggtatgttttatccctcggtagccatagatcaataaaaccattggattgtgatttcatggcggcattctccataatgacattcccttcggagtcgtgaacggtcacattgaacgctccgttttttatttcgccttggcagcccgttagactatgagttgcacaagggtgggtctgttccacatatggcgcaatcgaaacaaaaaactcgttgtcaggcaaatcataattcatggtctgagtatcgtcctctgtgacaatcaactgactggaattaatggaagcggactgggctgttgccttgcctgcactgatatcatgcaccaattgcttgatatttgtcttccccgggttgtccgtcccttctctctgaatattccctgcaattaggtacatccctaatgcggcaacaaccaaccctgaagcgaccaagattccttttttcatctggagttcatctcctcgtctgttttgtattattataagggagaatgcaccataatgggcaaaatggggtgctgaagtcaccagatattcacatatccgtgctgtgtgctcagacatatttatatcacattagaggattaccgatgagcgaaggaacatgagcagctcttctgtctcaacgtaaaaacaccccattactcttgtggagcaatggggtacattcgttttttaacggtcccggttcacgacataatgtattaagtgcttcagaaaagcaatattgcgtgggatctcttccaatgcttctatcgcgagacaatagtgttcccacatctctttactggcaccttcaagaccgaggatggacacgaaattcgaattgttgttatcagaatcttggccaacaggttttccaagtaagagcatatctccttccacatcaagcaaatcatctttaatctgaaaagcaatccccatatgataggcaaatttcttcaaagcagcaatttccgactccttgacctgtgcaagcatggctggcataaccagacaagcctcaaacgccactcctgttttgtaaaagcacaccatattcagctgctccaaggtcaatggctttcctttggaatccagatccatcgcctgccccatacacatatcttctgctttttgggccgagtattgtatcaaggcaagcaccgtttcagcattaaactggtcaagtgacgattgttccccaatcgccttctggatcagatacagaccggttaattccgcggtagcgctattgtgcacctgatgcaaggtctgacgccctctacgggtagacgcattatcctgggaaggaagatcatcaaagatcagggaggcggtatgcatatactccagtgatctcagtagtggcacgattgccgatgcatctagtccatattcgttcacgcccatgacccaagtcaatataggccgtatccgcttcccgtccccttcgagactgtaatttgcagcctcaataagctgttctttcatggccggaatcccttgtggcttggtaattttcaattggttgttaatctgctcacggaccattttgaccgtattgaaaaagtcttctttttccctcgcatcgtttttcagatgggtaatcatctggtcccgaagcagcttatctaagaaatctacatcatccgctttttgtaccatcttctgaatgagattattaaattccggatttccagatgcaaagatctccatcatttcattatacttttcaatacctacacgttctttataacgtttgagcccattcattgcacgatccagtatcacctcacgagccatggcatcggagtcatatacgttatggatcaaataggaaatgaccgcccagtataattcaaagggattgatcaaatccggtcgctgatgatgatattttaaatagtaggtataaggtgttaccgcaccgtctctcatatcgtcaaccatatccgcaaaatcatcagcaagctggttatagataccataaaagaatgtccgttgctcaaagccctcatccgcaggagcactaatcacggaacggacaatcaagcgggatgaagaggacttcaaaataacgggtatataaagctcttcattggtataagtagctcgcgttagatccttaacacgatcaatatcttgagaatgaaaaaagacataggcctgctcgaaaaaggtttgctgtgtatccggtcgctgatgttccttaatatactcaaatgcatccgagagctccgaatgtatgtattgaatcaacttcatatgatttccagtccaattgcccaactcaggcacagatccactgagaagcgcggcacgtatcatacgggaatattgttctttctcttgaacattcagaacctgggaatcgagaagatcatcgatgaaaggataggttagaccataggagtacccaagcctgatggcttcatcaagtctgcgagcacgttccataggcgacactgtatcgtccatttcttccatcacatgcagaataactccgacaatgatcttaatcagtttgtgctgggcttgctcggcatccatctccttgggaatatgggaggatacggacctaagtttgttgatcacccaaattatcgcggtctctataccttccctctgggcccaccgatacaccccggccaaattcataaattccggttggtctcccccgtttgcacgggtggattggatcaagtgtttttttacgtctgcaatgacacgctgaatccgggtatgtgtgtcaggagaatccagagctttgcctaggtccctcatataaatataggagacacttcggtccagataatcatccaatttgcctgtataattcagccattgaatgtatctattatagtcccgagtatcaggttttctttttctccgcgaaaaaaaggataaccatgaggaatgatgaatatgattttttttccacttttgaatgtcttctgtcagggtagtcacataagatttgtctaagacctgatcatacagtaatgcaaaatactgaatcgccttccgctcagccagctgatatcctgtattggcttgtaatttttcattcatatgatgcattacctctacttctcattttgttaaacatggttgcatttctccctgagggtacgaactcggatcatgtttttatctttatacggaaaataatctgtgaggttacgaaatttaatggggtcgaggcgatataagaagtaatctcaagaggtgaatcgtcatgaaatatagtgaacaaaaaaagctgggttctgcttcataagattagcagcccagcttgatctttatagatatctccttagagtgtttggtccttctcgaccttctgccataaagcctcagtcagttcatctatcgtctccttcatcgccagcttctcgcgccaacgactcgggataccacttattccgtaataagctcctgcaatttgcccgtacaccgccccggtcgtatcggcatcatcccccagattcactgccagcagtgccccctcttcaaatgaattcgaatggtggaatgcccacaacgcagcctcaagggaacgaatgacatacccggttccttttatttcgggcggctccttatgccggtaagatccccgaattatttcttcaatggctgccgaataagcgggctcgtcctgccgccacttataacagacgtccgccgataacatggattctttgtccgctcctcgcagacctgccacaaggattgaagcaagcacagcacaagcctccacactttcgactgctccatgggtggttcgcgagctcatctcagcgtacttcaccgcctcttccggacggctcgcataggccatagccacaggtgcaagcctcataatagagccattgccggcagtcatggggtcaacagacccgctgtacggatctccggtagcttcgaagcgatgcagtgctgctctcgttgcaccaccgatatcaaagcacgttcccgtgctgctcatatatcccaagtggtaccaattggtgtatcggcgcatttgatctgccggatcaaagccatctttacgtaccatactctcggccaagcagagcgccatcgacgtatcgtctgtccactggcccggctttaacccaaatacaccgccgcccacgatatccgttacaggttcaaatgtacctggactgctgaattccacagtggttcccaaagcatcgcccacagccagcccaaccagacatcccaaaaaacgatccttgataagtgccattttggttttacgccccttttcaaatgtaataactaacgcatattttcccatctcgtcaggaaggaagcaaaaatgcggtaacgccttttattcgtagatcaaggctgtacaacggctattcggttttaattcaatgaaaatccccgcctcgtgatggtaaacgagtgctgccagagcgaagttctagtctccacagttctgcttgtgtgtttagtgccagcagggttatgctttcctgagagtcgccctgtagtggatgaatggctgtaaggcgtccgatggacggtggtaaatcaggtaaagaaacgtgatggaatggcatcattaaaccccttttattctggataaataataatttatacccgcatttgtgaagctggatttatcaacgaaaaatctgatatcaagcaatgcagtcaatactttcataaaaactcccggttttttcttgcaaaacaacttaagatatgtaatttcgctaggattacttttgagaacaaaataggagtaattcatcaagatcaagttggagatgaactgctctgttggagattgatgctcattgatacagtcgatcagcacctctaataccctatttttattagagttataggcttgtataaacatcgttgcttctacaaacggcttgttgaaatcatcgaatggaaaatcatatacatcatgactacccagaatgaagttaacccattgaccttgtaaaaattttattttttccagcgctgcttgtgtatccatatccatcttacttttgtgaatatgctcatgcaaaatgttaataagaatgtgcagatcataatattgtacgtcttccattctgtacatgatcctattatttttaatcgttaaacgatcataaatgtcgtcacctaaacccagttcaaataaaagatgttgaaggaaaaatagtctgtcctgagcaaacgtgaattcattgcctctctctgctagatgtgaaacttgatattgataataaaaacaaaataagttttttctcctataagcaacatctttatgtatatcaaaaacattaaaaatgagcgaaagcaatcgaatcaggcgttcagcatccagttcgcttcgaatgacatgatccatttttgtaaatagcgacctgtcaaacagatcatgccatcgcactagagaaacataatcctgctcgtttatattcagggttaatattcttaaattttgctcttgatcgggataagaataaaatagatattcatgacttaaatcagaaatacgctcattaaaataagctcttaatttgtaatcgtatattttagaaaatgacatgcttatcctccttacaagtaagcctgagcatattaaactaagtacaaaacattttcgaactcctatattgtaaaattaatctggatagactggcaaggcggcacaattacagaaacatatgttctccatatctatattatgatatctttaggctagaaatgaaacgttattgtcggaggtcatagcctaaaattagaaaggaatgcaaacctatgaaacaattaagtgaagctctggcccgttttgtacaacagcaaaacttatataatgaagcctatgggctgttccaaaaccacgacatccagccccggacggagaacctaacagattgctgggacagccagattcctgtatcccccgtacttgagtatctgtatagccattataaaatgatcgatgctaaggcagctggtacacacaaattgaaaaatgcggcagttgaaatcggggatgccgcggttctcttttttgctgcaccagaacatctgtatcgccaacagctaggctatcgctggattacatctggtgagcttgtccaagaatcttcttcgtggccgccccatcatgtcgtgattgccacttttaatgacgatccagtcattgtcgatactagcgaacccgattcccctgtatatgctgcattcgaaggcggtgcaccgcagcaggtggctgactctttggctaacttctttactgctctttccatcctgattgaaggtgcctgtacctttaagggagaagtgaaagatgaagaaacatacgaaaccaaaacagaatatatcgagcacgtaaaaccgctgctgcatcatctgctgggcgaaaatcaaaccacgtatttaatggaatacctatccctttgttagaaatcctttttttgaagagaggtggagcttatatgatctatatcgcattactgcggggcatcaatgttggcggcaataacaagatcgagatgaagaagctcaagcaaacgtttgaaaatgcaggtatggagcatgtgacgacttacattaattctggaaacattattttttctagtcaaggtcagtccaacgaggaattatcgctcatattggaacaggcgattctggaggattttagcttacccatccgtgtcatcgtccgtaatataaaggagattcagagcattatggaggcactgccgaatgaatggtctaatgatacacagatgaaaagtgatgtattgttcctgtgggatgaaattaacgatatttccgttctggacaagcttcctttaaaaacaggaataggccatgtaatatatacgaccggggccgttctgtattctgtcagcaaagaacaagtcacaaaaagcgggttaacgaaattagtcggcaccaagctgtatcagcaaatgacggtgcggaatgtgaacacaacacgacagatctataagctgatgcaaacggctgaacaggaagagttacgagatacgagctcctgactgtagtccaaaagcaaccttagaagagtaaactcaaaaagggagcctatttacggctccccaactttttttcttcgatgtaatgttttccctagtctttgtgtatgggcctcgttaaattttaaatccttcgaccagttcattcagtcgcgcagcactttccttcacctgatcagactggtgtgccacttcaagagatttctccgtcgatgaaaccatattctcagcaatgtgctgagtggatatagcagactgttcgctggctgttgcaatctcatggattgctctcaccatggtttggatggtttcattcacctgcttagaggtggcgttcaaatcattgaccgtgttcgtatgctccacggcatcattgtaatattgtcctgctgtatcctcaagcagctgataatccttgcctacctgggcttgcaggaagtgcagtaattcttcggcattagtagttaaattctcaacagattgcacaacttcttgagtaacactctgaatttggtctaccgcgtgtttggagccgtctgccaacttgcgaatctcgttagccacaaccgcaaaccctcgacctgactcacccgcacgagccgcttcaatggatgcatttagagccagcaaattggtttgtgccgtaatttctaagatggactgagaaagtaaacgaatttggtctacgcccttggctcgttctagcgcttccttcatcttttcattggccttccggtaaatttccttggctgctttattggattcactagccgcatgcttcaatgtttcggcttttacacttgtatcattggcagactgagctctttcttgagttttgaccgaaatgtactctgctgcccactgcatttcttccgcagaatggttcatattttcggtgtatgccgaagtctcttccatagctgctgacagctgttcgaccgtggcagatacatctctaatccgctcattgagatctgtcatattatgattcgtctggtcactcagttggttaatttggcgtgactcattgataacccccgttatgaccattgaggttgaatctgtcatttgttgaatggcacgagcgatgacagcgatctcattatttcctttgagcaaggtaggatcaagtgctgccgttaaattcccttgggtaatctcctcacagtatttcgtaattgtactcatccgaaaacggatatttcgaatggccgcaaaggagatggtgataagaatagccagcacgagtgccagaaccgtaatcaaaacaattgtacgcattttaatctcattttgcgtattttgatataagttggcggattgctcattgttataatctgaaatcgtagtcaacatcgtaacaattgccgtactggatttattaatccggcctctctcttccgtgtcatacgttccgctattttttttgactgccatgatttgctcaatatcctgataatatgtgtctatactcccccgtagttcctcgtataatttctgttccttagcatccaaattcctttgtgagaattcatttagcccggttgtaacgctatcttttcctttctgcacttgcttatactgtttgtctgtgtactccttattgtcaagtattttggtataattagcccgcatattatagaaatcacttttgacttcaagaatattcgtttggtgttgaaagcgatccacatacaaaataccttgaccctctttagcttgatacataccgataacccctaccaacgatacaatgagtaaacccactaagctgattacaatcatggagatcatcgttgtcgtaacctttaaatctctaaaaccttttccttttttagtcctgtctgatagcttgttactcatccaaacccctccagatcgtctatggataatagttcacgctgcagatcacagaacgtgatgatatatatctatatatcggtagaaagcgcttaaatttataagtaaaataacggtactgcaaaaataagaatattatagtaggcaacttcatatttggacttgctatgtaactcaaaattttagatattcatgggcttaaagaatttgctaaactagaagaggagtccttacacgaagtagggcacatataaacaacgacgctgaatgatgggagagaaagtattgtgacaaacatacaaaataaaaaacaagtatatataatccacggatacacagcttcgccagccgatcattggttcccttggttacaagacaaattacaggaggatggagtatcggtaggtatactggagatgcccaactcgcaatcccccaaacttaatgagtggattgagcatctattacaaaatattaaagttctacataaagacacctattttattggtcatagcttgggatgtgtatccatattaagatacctacagcaagtaagtatcccagaaccacttggtggtctcgttttcgtttccggttttactgatccagtgccgagtctaccgtcattagatgaatttacaaatggccatttggattatcagcaaatcatggattcgctaaaagcgcgttcagttatcgcttcaaaggatgacacaattgtaccctttgcactcagtaagaaactagctgaagacatccaagccgatttccatgaagtagaccatggaggacactttttacaaagtgacggttttaccaccttaccgatggtacatcaagtgttaattgaaatgatgaatgcaaataagtagcatgacaggcttagtttgaaaacttacataacccgcaaaatggaaccggcgaagggttcattattgcgggttcaatacatcaatataatgcccatttttccgtacacagctctataaatgaatgggcaacctgttcacattcgtcatatcccaaactaccagaatgagcaaaaagaacgggatactcattgtttcttttttcctctctcatatcaaacatatagtggtttccgcacccatccatcgcaaacgatacagcacccggcatatattccggtaactcgtaggcaaggttcatttctctcaaatcttcggtattgaaaaactgaaaataacgttctccattttgaaactccccgccgttcgagtatctcaaaaaatccatatagctgtcaggaaattgcccttggggcagatgccagctcacaggatctaaaggtttatattgatcatagaatggagacgactttggaaaagggttcacttgtctttgcttgatttcgtgaatctcttgttccgatagctttatgttccatgttttcaaaaaatttacgatttgttcatccgttgcttccagactttttacaaactgctgttcaaagtgaatactccacatatcagccaacctccatacctcgatgcctctaagagttgttatttctaccgagcaagctattccttatctactaccgcctgccatacttttgtaatgtctataggcgacttgctgctggtctcccctccaccttcctgagtccatagcggcggataatatgcaaatacctctcccggctgaagttgctccatattcttctgccaaccgttccagcggaatgtctggtagaacaagtctaaatctccctcagccaaccagcccaagaaaccggaataggccagctctgtggattcccattctaatgcatctggtgcaaaatagtagatatgaccactacgtccgaatttccctgtatccaatccaaaaaatccacctgctgcatcataagccacaatcagcatcccctcaagcgcaggaacactttccggctcttgaagccggttccatgaggtcaagctaccaaaaattccagagccacctgcacccagcaaggtgatccaaccgtaatcaaacacgattcctcctgtctcataggcaactgttcccaaatacgacttcgtactcacctgcaaacggtacagcgtgtcccccgtagcggattccgattcggccgatacaatgtgatgagaattccggccttctttcagaatatttgtgacctcttcccatgcatggttatccttatccaccagttcatcaacctttaaagtatgcatgttcattccccttcccgcatatcctaaaattccctttcaacccgcgaactgatttttgaaaatctgcatttgatctaaaatcacccactgattcacttcgtcgtatccttttacaattgccgtgacctcatgcttcggatacatccactcggatggtgtcttttcctcatatgtacgagtgtctgacaatccgaccgcatgatgctggaaaatatgaataatcgtaccgtgtgggaaaaatgcttcaatataaccctttaccttagtcccaacgggcagtgcatttttgatttgatgccattcctggttgaaggtgtgaagataattggaccagatttcttcaaactctttttttgtaatttgcgtataatagggctctgtatcatcaatcgctttctcagctaataagaaatgatactgctcgtgcttgcgattagaggcgatatacgtgccatcatcctggatgacaatttgtcgataggctattccatccgaatctatttcaaaataccaggttcccatgcctggctccgggcaatctttaagatacttcatgtgctcctcctattaaaaaatcaaaccttcgaatgcctgctgaaaaggttacgccttctgccttgatgctcgaaacacttgtgtaattcagctttttctctttgccacgagccgttttaggcaaaacaaatgcccggtcacgcgtaagaatctctacatcggtttctccataggtatcctcagtaaaagaaattcgcttgaagaatgacatccccgtccatacaaataaagtatccatctttatttctaccacgtcccaatgctcttccagcgcctccagcccgaagtacggtcgtaacgcgttcgttaaccaactattcatctactcctccagttccgagtacatctcaatggacttaggctcaatttttccagagactataacatagcacggcatatagctcgtttattcatacactgttccagcttggatcaactcctcctgaatccagctacttttggtagacagttggagcaaatcagcagagatctgtttgacttgctcttgcaacacgtgtgattgatccgttccttccagaaagcgactcaaaaaatgaagaaatacgtctaccttcctaagcagcatcaatataggcaaagcatcaatctcgttgtggcttaaatgaacctggcggctgaaaccccggcaaaaatcccgaactgctgtcgcctcctccggttgtcccaaaaatccagataagatgaccgccggctccatgacccgaacgtctagcgtacaaaattcaaaatcaagcagtgcagttactagactatgatcagaatcctttactaacaaattggaagcgttcaagtctccatgtacaagctgatgcggcaactcttccaatgcatgaagcgaatctgtaatctcttcataaacttctcctatcaatcgcagctcttcatgtaaatcctttagaggctcaggcggatgtaaacaaaagccttgaaccgtttcccggttacacaatggataggattgctgcaaagcataatacggtcgatagactggagtcatatcaagattgaatgtcgcaagcacagccgataattcgcccgtagcctcgcccaaagaataggcaaagcttgaatcctgctccaggggtgatatgccttctatgtatttgaacagacacacatatttaccgctttccctctccagttgaacaagcgtctctcccgtgaccgtcggaataggctggggtattctgaatgatagagaatgcttactcagctcctgcaaaaccgcatgctcaaattcaattttatcccgatccctgtgtgtatcgtagacgcgcagcaccccgcttcgtccaccactcttaacaaaatacgtcgtattattccaacccccggttcgtttctgcagcgttccgttccactccggccagtgccgtcttagtattgcttccaaggatgtatcctcccttcttcatgtccatagcatcggctgcccccggcatgcgagaagtatggttataatagctttataggtaatttcattattttagcatagcagatagcctattttataggagagggcgactctaattcacaagaatttaaaccgaaggaggaatacctcttccgcaagctaaccgtcctgtgtttgtccaaagagttttatcctacgtttttgcagtagcattaaggagagttaaaaggcacaatgtgatcgagtctttttaaacaggacgtacacaaaaaaacaggactgattaatcagccctgtcttgtacatcatacccctttagtcaatctggatctgtctgcgggaacgatcatcaccctgacgtttaggaatttcaagtttcaataccccttgatccagttttgccttaatgccttcttcatcaacatgatccacatagaagcgtcggacaaattccccagaacggcgctcccgtcgaatcattttattcgtatcatccttctcttcatgatattcattccgtttagcacggatcgtcaaataattatgggcaatatcgatgtcgatatcttcttttgcaatgcctggaagctcagcttccaccagatacctgtcgttttcttcacgaatatccgtccgaaatgtctgagagttgctgctaaatggagcgaggctcaaagttcaaaagaggctgaaaatactgaaataacccgatcctaagcgatctgtcaaaaatagttttagatttcaatcaatttgaccttttttgaccttttgacttcacaagagactacatattctttgtcagccaactcaggcttgccctgctatcgcttgttccggtgtagaagctgggtacaagtgacaggctacctgccgccccggtgcagcttcggcaaagatgggctgtactttgctgcatatctccatggctgccgggcagcggttatgaaacgcacaaccacttggcggattttctggactgggcacatcccctttaagtacaatccgatcacgttccgcttccggatcagctacaggtaccgcagacattagcgcctttgtatacggatgcagcggctctctgaacacttcttgggtcggtgcgagttcgaccagcttgcccaggtacatcacacccacgcggtcgctgataaatttgacgaccgacagatcatgggaaatgaacatatacgtcaggtcatattgtttttgcaggtccttcatcagattgagcacttgcgcctgaatcgacacatcgagggccgagactggctcgtcacacacgataaatttgggatgaagcgccagtgcccttgcgatcccgatccgctggcgttgaccacccgagaactcatgcggataacgatgggcgtgataaagagacaatccgaccacttcgagcagctcttccacccgctctttgagctgcgttttgcttagcttttcatgcgtgataagcggttcttccagcacctgctgtactgtccatctgggatcaagcgaagcaaacggatcttgaaacaccatctgcatatccgttctgaatttacgcagctgctctgtgtttagcttacgtatatccgtgccattaaacagaatctctccatccgtcggttcgatcaatctgagtattgcccgtccggttgtggatttgccgcagccagattcccccacgattgccagggtttcaccctgctgtacagtcaggttaataccatccaccgctttgactgctcccacctgtttggaaaaaagtccttttttgatcggatagtgttttttcaaattacgtatttcaagcagtgtactcatgatatccctcctgctgtagcaagcagcggcttttgtgtccgggttccacttctgtaagctccggggcctctgcacggcaaatttccttagcaaactgacaacgtggtgcaaagcggcagccttttggcatatcgagcgggttgggaacctggcccggaatggaagccagacgctcctgatcactgttcaattgcggcagtgaggctagcaaactttgtgtatacggatgcttgggatctttaaaaagcgttttaacatccgtttcttctacgacttgtccggcgtacataatcacgacccgatcgcacatttcagcaacgacaccaaggtcatgagtaatcatcagaatggaagttccttcggacttctgtagctcacgcatcaagtcaagaatctgtgcttgaatggttacatcaagtgccgttgtcggttcatcggcgatcagcaacttcggattgcacaccatcgccatcgcaatcatcacccgttggcgcataccgcccgagagttcatgcggataagaagtggctactttttctggacgtggaattcccactttcgtcagcatttccacagccatgtcttttgctttgtgtttgcttacaccgtggtggtagcgggcagactccgcaatttgtttgccgattttgaacacaggatttagcgaagtcatgggctcctgaaaaatcatagccatctcgttgccacgaatcgagcgcattttccgctccgaaaaatccagcatgttttcaccgttaaaccgtacttccccagcgactactttcccaagtcccttggggaggagctgcaaaatggaaagggaggtaatgctcttgccgcacccggattcgccaacgattccgagtgtttcgcctttgccaaccgatagatcgacgccgtccacagcccggatggtgccagccgcagtcttgaactccgtccggaggttggttacttcaagcagttgtgtcatgccctcttcctcctccttgtccatcattgaaccttcatgttctttttatcttagggaataagcttatcggacttacccatcgtttgcagatgcttcatggtaccgtacaatttagtaatatgttgaaactccttttccgaatgaaaagagcattgcccacgtccataagctttggctgtttctacagccaatttggccgccagcgcaatatcgctttcgtggctggcccccgttgcactgcctgggacaggagcagcggccgtgatggctacaccaaccactggagcggaagtggccaccgctggctgcaaaatgctgttgatgtgatacaggtcgttaccataaggtgtgatgtcctgcgtagttacagcaaacgtgacacacggttcgccagtaacggtctgcacaatatcgacgaggtcttcactaatgcgtagcacgtagccttcacgtaccgttggggaaatggcaatacctttatggttaatgacccgattccctttggtcgtatcaatggacaggatcgcttccatttcgggtgtcacttcatatttgttcatcgtcaaaatatctacgggtgaatccataaatggaaccggatcatggggctgagtgggtgcatctggacaaatatgtgtacagataatcacatctccatcaagcacatctcctttggactgcatgctcaaaagtttagccgccgccgaaattgccgctgccgcaccgtcaccatcggatacaaatccgatcatttccggccgtgctccaagtccaccaagtcgccctactacacccaaggttggagaaccgcccccctgaatgcgacccgttttaccggcaatcacaattttaataaaatccgtagttcccttttcaccttgcacggtggagaccgtaatctccgcttgacccagttgttccaaataagctttgacttctgccccgctggcgaacggattatccaaaaggtcataaacttcaaaaacttgtttcatcatacggcagatccccttatgcttctttttgtgttgttttcagatatttaagcgccgtcaaggcgtatactttcgcagattgaatgatctgccataccggagctttttcattaaaattgtgaatggtcgacagttcggcaggcccgtattgcaataccgggatattgtatttgcggaatgcacgtgcatcgctggtcgcccattgcagtacgccataggcctctttaccgctgacttcagcgatagattccacaagctcctgtacaatcggctcggtgggcggggtccagttggcattaccataaaatccgaattgtctgggctccacgtcaatgccaacacttgcaagcaattctttggctttggccagtacatcccggtggtctacaccaaatggaacacgggaatccacttgcactgtgcaacggtccgcaaccacattgactttcgtgcccccctggatcgtaccaatgttcaccgttacatgatcaaacgcttgtccatagcttgggttctctcgttcgcttgcataacgcttggaaatttcaatgatctctttgacttcttccgggatgtccggcttgatgtcccacagttgttgcagcgcttcaatcccttttgccgccttcaaaatagcactttcacctgcaattggctgcaaactgccatgacccggtgtgccttcaacagtaaattcaaaccagcagcttcctttttgcccgatggtcgggttttgcgggcctgaaggctctgcgatcacagcagctgttccttcaatcagctttctttccagcacccaaggtactccaagatgtccccctgtttcctcgtctggaactacaagcaacgacaacgcaccttcgagtggtacgcctagtttggagaacagcgcaacggtaaatattaatccgcccagtccggctttcatgtccgaagcaccgcgacccaggagatagccatcacgtatttcaccacaaaacggatcaaaatcccaacgagtacgatcccctgccggcacaacgtctgtatgcccacagaaaattagtttttttccgtccgccgtttcagcgccataatcagaaatgagattccacatattcggcccggattcatgcacctttgtttctatacctgcttctttaagatagtccataatgaactgactaatttcgcgtgagtcacctggaggattttccgaaggaaattgaatcaaccgcgagcatagctcaagcaattcgtcctgccgtttatctatttcatcaagaactaatgttttccaatctgtcatttccattcagtcccttcacgttttccatttagccaactacattttttacgatccatcgggatcagcttcatccttcaggtgtaaaatgatagccttcggctgtaaaaaccgaaggcataaggtaagatcacaacttactctttattcaatgaatagaatcggataacctcatctgggtagtagacatatccagtgacgtctttgctcatgccaacaacgcgattgtattcatacaagtacgcccatggcgaatcttgatttataagttcttgtgctttgccatacagctctttacgtttattttcatcttgctctttgcctgcttgttcccaaagcttatccacttctgcattagcgtaatgcatataattcgatgaaccgccgctgtacatcagaaacccgagatggtaaccagggtcgttgacgaaggaagtccatttagaaatgtatgctgtcaggttgccttctcgttgctgttcaaggaactgtgcacgagcaacattgacaacattcatctttacgccaatcttggcaagttcagcttgaatcaatacggcatcatctgcccagtcctggaagccggaacccagtgtcaggtcaaaattaaacccattaggataacccgcttctgtaagcagctgttttgctttgtccaggtcgtgcttatagctgtaacccgcatcggtgtagccaggcgtgttactcgctacagagctcttcatttgtttcgcttgaccgtacatgacatcgtcgattaattggtcgtaagggatggcataagcaatcgcttgacgcacttttggatcattaaaaggtttgactttgttattcatggcgaaatatagaatccggttacttgcattggattgaacctttagatcggcgttggtttccagcttcgaaacatcctttgcaggaatctcaatcgccatgtccacatcgcctttatccagcaaaagtacacgattggaagcttccttggtaaacttcatcgttactttgctcagatttggcgctccttgccagtagctgtcattagcattaaagacagcttctgtcgcaggatcccatttttcaagcttaaacgggcctgaacctgccgcatgtgttttcaaatagtcaccatcgccattttctttgacaagcacatcatccacaatggagaagttgtacaatgacaggatttgcagaaacatatgattgggttgggacaatgtaacgacaacggtgtgctcatctggcgctgtagcggttttaatggagctcataccatacagaaagctaccggaatcggaatttttaagccgttcaaaggaatacaacacggaattggcggttagcggattgccactttggaatttaacgtctttacgcagatggagcgtataagtcatgttatccgcggacacatcccatttttcagccagcatgggcttaatggcttccgtatctgccacttctccgctatccgtagactttttaccgtaggtcacaagctgatcatagagcgcaagcacaagggtgtccgatgtaagatcacttgcttcagcagggtccatggttgaccctccctccgagtaagcaagtgtaatcgtctttggtggggatggggcatctgcgcccttctctccagatgaagcggacgggctgttagcattgctcgcacagcctgccgtccatagcaacgtagacaagacgacaattagagaaagactttttttcaacatggcttacgttctcccctttaatgatctatttatttttatttgctagagcgcagtctaggatcaagaacatcccgcaaaccgtctccaagcaaattgaagcccaaaatagctgtcgcaattccaagacccgggaaggttacaatccaccactcaccggaaatgatatacgctcgcccttctgaaatcattgcgccccattcagcaattgggggtttcacaccgagtcccaggaagctgagactggctgaggtgaggatggcaaagcccattccaagcgttgcattcacaagcagtggggcaagtgcattaggcaagatgtggcgaaacagaatcgttccgttcgttacaccaatcgcccggctggcctcaacaaactccttttcccggagagagatggtttgtccgtgaatcagcctggcgaattcgggtatgcctacaataccaacggcgataagtgcactcatcagtcctggtcccatcgctgcagcaatagccatggcgagtaccagagacgggaaagccaacagaatatccatgcagcgcataataatgctgcccattcgaccgccatagaaacctgcgatggctccaagcggtacgccgatgataaatgagatcgacacagcgatcatcccggtccatatgctgattctggctccgtaaataacacggctgagaatgtcgcgtccgtaattatcggtcccaaaccaatgttctacacttggcggcagcagcttgttcgccgggtcggttacataaggatcatgtggaacgatccatgatgagaggatggcaatgagcgtccagccaacgataaaaatgaatccgattaaagcgagtttattgccaaacagtaatcgccaaaaggtcttacgtttcggtatagcggctgcattgggctgaggtacagccgcttttgccactaaatcacttgcagtgctcatccgagtacctccccctacttttgtgcttcattgtcatcactcgtaccggatacgtgggtcaatcaatccgtaaaccaagtcgactccaagattgataaagctgtaaatcagcgcacttacgagggtaaatgcttgaatcggtgcgtaatcagctgccaaaatggagtccgtcacataactgcccactcctggccaggtaaaaatggtttcggtaataaccgctccaccaatcaggtaaccgacctgcaaaccaagtacggtaagcgttggaataaaagcgttaatgagtgcgtgcttatagatgacaattccttcgcgcagacctttggctctggctgtgcgaacaaaatcctgaccgatgacttccagcatgctggaacgcatcatccgtgccacaatcgccatagtgcctgtgctgagacagacagctggcagaaccaaatgggataaactgctttttaaagctacaaaatcaccggtcatcagactatcgagtacataaagtcccgtaacgtgcgtcggcggattgatatcaccgctaattcgacccatgggcgcaggagcgatgccccatttagcatagaaaatataaatgaataacaggccaatccagaaaatgggcatacaggcaccgatcaaggaaaacacgcgtgaaatgtgatcaacaatcgattctttacgggttgccgccagaataccgatcgggatcgccaccagaatcgcaataaccaagcttgccagcgccaactcgatggttgctggaaaccgggtagcaaagtcgcttgccactgactgtccggtgtgataagcctgacccagatcaccatggaacaatcccactacataatgaaagaattgaatgtacttcggttgatccagtcccatactgctgcgaatattttcaatcgtctcgggtgtagcctgttcccccgcaagcatcacagcaggatcacctggaagcactcttgagatcatgaatgtaatgacgacaataccaagcagtgctgggatcatttgtaccaatctacgtagtgtgtatacggccacagcccgtccccccttatccgtaatccctcgtctatttgtcacctttcttttcataacttgttatttttatcattgtactaaggaacaataacggtttccacgtcctgaataactaaaaataatgacgaaatttgtcgttttagcactaaagtgactcaatatgttatttaaatgttatgtatttatccggtttgagaaatcaaaaacagcataatgcaaaacaggcaatccccttttaaaaggaaatcgcttgtttttttgtaaatatggattgtagtattaggtcgatcaggaaaggaaaatcacagtattggaaacgaactacagaaagctgttggatcagatgatgacaccctatgatgaaatgctgcagagtttaataggtgatcacgccgatttttcgaaggtcgattatttggaaaagcacagtgagaaatatggaaagagtgatgcaaattataccaatcgcttgaaggtgcttttggctatgtacaatcgcgaggatcgatatgccccgcataacgaaccgattgttagaaggttgctcgttaatgaaattatagacagggaaacgaacagttttcaggggattggcgatgctctgtattacgccgtttttttactgcaaggtatatccagtattgtcttcggctacagctcgaaccattccgcagcacgctcctcttcttccagctccttgtacaatccttccctccacttcaccgcatcttcgcaaccaatatgaaatagtcaattaagaccttttgactatcattcaaaccagcaaacaaaataggcttcccgtaaatatagcgcggaagcctatgggttcatcaaattatttggccttctgagataccagttcactattcccttttctctttcttatccccaacataatgacggccataacagctaccagaactgctataagagcaaaaggaatatatttatccacccgatatagcgtcgttgtcaaaataggagcaataatcgcagaaatgccttggacagtggccaccagaccagcggctcctccttgctgttctttactgacagaaagagaagccccggccataaatccaggcattagcaagcctgtacctataccaaacataaagaacgcaaaatagtaaacgaccatgctggctgacatgaggaatagcagcataccgacaataaggagcagagagccgagcaaaatcatcggcttgggttgccatttaagccatttcatttgaacgatctgtacaatcaacatcgctgccccagaaaacataagcccaaaggaaaccactcttgctgtttcttcggatgaaaggcctaattgatcttgaaaataaaatccacctataacctggatggtcacaatactaatcatcgtaaccaaacctgcaaacaaatacattcgtagaccaggttgaaaagggttaatccgagctggcttttgctgaataacgggcttggcagacggaattgccagcaaggccactacaaatgctacagccgcaatcacgattccaaaatacagaggccacagcaagcctattaaagtaaaggcgcctgcaatagcgggcccaaatactaatccaagtccattggccgcgctaatgatagccatcccactacctcgatcttcgccctcggtcacgtctcccatgtaagcttgggaggatgacaataccgccgggataaacccgccgatcaagccgcgtgtaacaatcagcaggactaacagcattcccccgctgagccaaccctttaatcctgcaaaaagagtaagcgtaaacagcaagcagcttacacacatccctatgaatccaagcaaaatcacaggcttgcgtccctttgcatcactcagattcccccaaattggagccattaaggccatcgttatggagccaagcgatataattaacccagaatgactttctcttaaccccagctcacgaataaggggcggcataattggagcaatgagcatgagccctagcatagccacaaaaacactgaaaaagacgctccctttgattctattcatcctcgcacactcctccggtatagattctctctatgcagaagtatacggagcataccaagaaactactgcctgtatacggataaatttgcggttaaacggatttaatttagcatataaaacaacggccagccttcagcacagtataagatgatcttaattctatgatccaatgggttccgttgattatagtggccttgacgcatagttcacctgggggccgtaacatgatacgaagtttagacggttggaaagatattatctttcccgaaaagggaagtctctgaaagaaccggtctcttttataaaggtcgctccttcgttgtgaaatgaaccacatcgctctcttcatcgctgactagatgaaagagcttaatttcctggcatgttattacgatataggatgtacagtcttttatcttttgtaactaccgtagttgtgggttgagtctgtatatcgatgtctaagggggaaatgcagtgaacaaaacaaagataggatcaataatgaaggtaagatcgttaagaacaaagttaaccataatgtgcttgattattttaattgtacccactttcgtgattggaatcagttcttattttgtttccaagaatgaaatgaatgaatcaggcaaagtggcacttaagaatagtgtgcaaatggtaattggtatgattagtttcctcaatgggcaagtcgaagccggtaatttaacattggaggaagcacaggaaaaactgcgcatcgagctgctcggtgtaaaagatgctaataacaaaagaccgataaagattaaatatactgtaggtaaaacaggttatccgtgggcagtcaaccaagatgccgtttcaatgatgaacccttcaaatgaaggccagaatttaatgaatgtcgtgtcggaagacggtgtgcatgtgggaaaagagtttgtagaagtcggtacaaacggcgggggattcgtgacttataaatgggctttacctggtacagatcaagtggagacgaaaatttcttatgttgaaaaggatccttattggggatggatcatcggttctggagcatattttaacgaatttaacagcggagcgaccaaagtcctttatattgtcctgattattacgactgttgcggttattctgggagcaattatcgtaagctttgtttcgggacgttttacgaagcctatcatcatgatcgcaaaacgacttaacgcagttgcggacggtgatttaacggtcgaagaagtcaaaattcattcaaaagatgagatcggcgagcttgcacaggacttcaatcatatgattaaaaatattagatttctgatcggtgaggtaaatctgtccacaaagcaggtagctacttcctcgaaagaattgacccttggagcagagcacactggacaggcaaccgagcacatcaccatcgcgattcaagaatcggcggccggtgctaaggagcagcagatgatgctccagaagacaaccagctcgcttgaagaaatttcaataggtatgcagcggatcacggagagctccttggccattgctgactcgtctgcagacgcgatggaaatggcgagcgttggtggtactgctgtacaacatacggtgaagcaaatggacctgattaaccattccgtcaatgaaaccgatgcggttatgagaatgctggatgaacgcactcaacagatcgacacgatgctgcatgccattacggacatcgcacagcagaccaacctgcttgccttaaatgcttcgattgaggctgctcgtgcaggcgaagaaggccgtggtttctccgtcgttgctgcagaggtgagaaagctggccgaacaatcgaaccagtcttccgggcagatttccgagttgattcagaatatgcgcaaagatatggagcattcgcttaagaccatggaacgcgtaaaacaggatgtcgactctggtattaaaattgccaatgaaacggagcagcagtttaacaaaattgtggcgtccaccaatcatatcgcacagcaaacagaagagctcgcgagcattacggagcaaataaccgcaagtgtccaggaaatttcagcaagcggtgaaaacgtatcgagtctggcgcttcaagcggcggacaactcgcagaatattgcagcgtctgcagaagagcagttggcttcaatgcagcagatcaccagcctggcaacgaccttgtcggatatgtctcagaagttacaggacctaacggtcaaatttaaatactagtggaataaactgtagtttccaatatggtttcatgaagagccttcttaccgtgagattagcattagttcatggtaagaaggctcatttttttccgaaaacgtcgcgctaaactgaccattcattttatgaagggcttgcaaatcgtgatctgttaattgggcatggtttttgtcgattttgttcagaattggttcagaagcatttagtatagtaatccagtagtgtaagaaatcatattagcaggttagtcatcatggaggatcttagtctgttcatcgtgacaccagaaatttatggaggaagtttatgagtaaaatcaagtctttttgtttatcttatcttgctgttatcgtcttatttgggacctggacatggattttttctgggagtgctgtgtatgcgacctcctcaccagtacctagtgtaacagatgctgtgtatgctactgaaaccacggtaacgagttggacaaatccttctaaacaaggtcaatccgtaacgtttagcatcaaaaccatctcaaccccacaaattacgaaggatttaactggcaccgtggttcttatagatggtacgaatatattagatacgcttacgatgacgccaaatgggattgcaaatggatatgccactgcgacctataccacaagcaatttaagtgtgggaagtcacccgattactgctatatatagtggggatgctcgatttgtccccagtacatctgagccatacattcaggtcgtaaatgcacctgcgcctacaacttcactgagacctacagtaactacagtattgagttctctgaatccgtctaagcaaggtcaagaagtaagatttagcgtgaggacaacttcaaacccacagacttcgggcgacttaaccggaacggtcatccttatggacggcacggatgtattagatacgcttacgatggagccagtgggcatttcgaatggctatgccaatgggtactacactacaagcgacttaagtgtgggaagtcactcgatcactgctatttacagtggagatgctcgatttgccccgagtacctctgaagcgtatatacaggttataaatggagatgcagacactgggaatactggcggaactggtgctactactggtaacggcagcagtagcagtaaaaaggataagaaggatagtacagatagcagtgagcctatttcttctagcgaaacaaccacaccttcatcaccatcggttttaccgacagatttgccgacgactctggaaatcaagccagttgatcaaccagaggttatgcatgaaaaatatataacaggttatcaggatggcacattccgaccggaccagtcgattacacgagctgaaactgccgcgatgatggctagaattatgaagttggaaacaaaagaaagctcattggcatacaaagatgtacctagcaagtattgggcgaaggattcgattatagcactcacgacacaacacttcatgaatggatatgcagatggaacatttcggccagagcaacccattacccgtgcagaaatggcagcaatactcgcatcctggaagcagcttaaaggaacgcaaaccgcagcatctccttataccgatatcgaaaagcattgggcaagagattcaattaaagcgctagctgaggcaggatggatcactggttttaacgacagcagcttccaacccaatcaatatataacacgagtagaaaccgttacaattttgaacaccatcttaaaacgaggacccctggaaggtacgacccaggctacatggaaggatgtacccgcagattactgggcattcaaaaatattgaagaagcgtctcgtacccatacttcaaccatcaattcagagggtactgaaactatcgtgaattaagcaccaaataaaagctggaatcctttctatacagggttccagctttttatttacctgatattttaaaaaaacggtcaaaaaataaattttaaaataacttctttaaggaggatggcttcactccgtattcccggaaaaattgctctgaaaatgcactcacattgctatatcctacagccatcgcagcttcagtcacattgctttcttggcttcggagcagcttcatcgcataatcgagacgaatttggcgcaaatattcaaatacagtagttccaaagcaggctttgaatcctttttttaatttaaaatcgtttaatccaaccttttgggataatgtgatcagcgagggtggatcaatcatgctggattcaaggatctcccgagccatatgcagctttctgacatcttctttagacaaaccttcgggcataggtgttaaatcaaataattgaatcataaatcgatttaaaatctcaagtgccgctgcttccattaacaaaggcgatttatgcacacttttcaagtctttgatcaaatgttcaatcatcactatacttctgtgatccagttcaaaactaaagtgatggaatgcagctcccttaagaatttgattaaattcaatagctacctgccgacgagccgctaactgtgaagccgcataattaaacaacaaaacaggaatgccaagtgcaaatgattggtattgttcgttaaccggaggatggaaacatgctttgaaatcctgtaaaaaaataagagcaccctgccccatcgggagtgtataatccagaccagccacattcacatgacgttgaccggaaagcgcaaattgaagttcaatcatttgtcctctggaagaaaaattggtcggatacggctcgtgatattgaatgtgcgaatatacaatctcaattccgctgtaagtagtaactcggtaaatatgcccatgacccgcttccggtaacatcatatacgtatgctcattctgttgtctaaacggagttttttccaaataatgctgatatattaatgataacgagtttaaattcataatcgtccacctcaaatgttttcattctgatgctccaaatgagaatcgttatcaataatagtaaccgaatttgaatggtttgaccagacctattggagtaagctgtggagacattcgggggtgtattaatcccaatccatataaaacgttgccttcaatttacccttctcacatgttgggcagcttaaatgatgaggagcattgttttcaatgtgtttctgttccatgacactcgtacatctaggacaagcataagaactcctatactgcgatgagtcggatttcatctctataaacaattcattgcgcatagcctgacaggtcggacacacatatagagcgttataagcatcatatctcgtcgaagggttgcctatgaattcctcaatacgtcgtttaagggcagcatcctgtacaaacgaagcaatggatttcaaactcatatatgcaaaaccaaatcctacaaatatgttccccgtataagtaggtatcacagtccagcttgtacgcttcccccatttttattcctccatatcactcattctttttataataaaaaagcccaccgtaagagacacgctcggctaattagctctaaggcgcgtcagctcttaattccctttattaagactttatctatctctttacaagatttgctgaatgagtgacccgatttctcccgccacttttggaagcatacagagccaaatccgcttgatgaacaatcgtttgttccgtatcctcttgcgtaaccgttgccacaccaatactcacagtaatggcatattctccccaatccatcgaggctgtcgtggagcggtatctttctgctgtacgaatggcttcttcttgatcgttgtctggaagaataattacgaactcctcgcccccatatcgagcgacaatgtccctgtcccgtgacatggattggagtatttctgccagattagtgagcaccaggtcgcccaccggatgaccgtaagtgtcgttaatgcttttgaaatgatcaatatcaatgagcagcagcgaaaaaggtattccagtctcttgaaaggaggctaggctagccagtaactgatcttgaaaatatcttcgatttctaagaccggttaacgggtcagttgacgccatcgtttctagctggagattgatccgtaccagttcctgctgtttgatttcatattctgcgtgcaaccgttcaagcttctggttcgcttcattcgtagcttgatataattcctgaagcttggttttggtctgtagtatatctttctcgtgttcaatacgcttacgcatcacaagcactacacagtcaataacaaattctccatttcgctcctggcgaactccgtttagtagtacaggcacatcctgtcgatcacttgtgcgaaacgaaaagtacatctcatcgacacgcccgtacaactggatgtagggataaaaataagtatgaaaaaatagcttgttggtaacagacattgtcatttcaatcggtcgtccgagcaattgatcacgttcatacagaagcatgtccaacaaagtttgatttaccgattgaatgatcccagtgtccgaaattgaaaagtatccacagggagctttatctaattgaatatccattgcatgactgcctttcatacgatattacacactggctaaatattctttgattaaatcgctcgtttctcctggttgacttaaatgaggataatgcccctttgccctcatctgttgaagcatgctgtttttaagatgactatgtaaataatcccctacctcaatcggagcaatactatcgtctgagcactggagaataagtgtaggaaccgaagcatgctgaagatcgacacggcaatccgaaaaaaatgtaacctctgcgaattgccgtgcaatatgaggatctcttgagcaaaatgccttttccaattcttcggttaattcctgtcgttcaggattctgcataacaatgggtgccaggtaactagcccagccaataaagttcatttgcatcatatccagtaattcatcaatatcactcttatcgaagcctccataataagaaggcaggtcattcacatagcgtggagaaggaccgagcatgacaatgcgttcaaaatattgagggctgcggatggaggcgagcattccgatcatactgctaacggagtgtccgacaaatatggtatttcttaagtctaacgcttccataatatccagcacatcttgggcatacccttgcaagtcactgtattttttcgagtcataatactttatttgagaatctccggaacctacgtaatcaaacaagacgatttggtagttgtcgataaagctagggacgatataacgccacatatcctggtcgcatccaaagccgtgagaaacacaattgtctggctgcctgtgcctattacttttacattattacgtcggagaatatcaacggtcattgtgaatcacctctctgaggtagtatctgttctatagcttctcttccctattatatcggaaaagtttcgattatggataatgactctcattcataaatccagcgttcaatgatcccctttactctttgcacatgttgctgtgataaggaacaaataataaccaattcgtttttcccattcgtatctaaccattggtgaacgtcatcctcttcattaaccgtttcatgaatgattctgatggatttatgacttatttctgacttagccgaaaaaatggggttcatatccatgattttctgaccattagaaaaggaggtgttgtaataaggaatcacccagttctccttatcctgatcttgtactacattaagaaatacacgcacccaataatcctctagttctgtgtaactctgttcattcaacccattcaaattcatacatgtatccactccaagttattcatgcaagtttgtctgctctgaaatttccttaatgtagccggccacctcacatttaaggtattattttcgtttcataatgtaaattcaagcagcgcgtaccgattaaaatgggcacgcgctgacggtatgacttttatgaaacaggcactaaaattaatccagctgctctccattggtttcgatcacattcttataccaataaaagctcttctttctggatctggcaagtgtccctttgccttcattatccttatcgacgtatataaacccataacgctttttcatttcaccggttcccgcgcttaccagatcaatacatccccaaggcgtataccctattaggtctactccatcagcaatcgcttctttcatttgctcaatgtgttgcttcagataatcaattcgataatcatcgtgaatggagccgtcttcttccactgcatctacggcgccaaggccattttcaacaaccattaacgggatttcatatcggttataaatgttattgagggaccatctcaatccctgtggatcgatctgccaatcccaggcacttgctttcaaatgaggattctttaagcccatagataaattccctcccaccttctcctggttaggatcggcactgacacaagtagaggaataatagctgaaggtatagaaatctacgcagccttcttttaagatgtcctcatcctcttcttgcattttgatctgaatattatgatctctaaaatagcgtttggcaaatcccggataagctcctcttacttgaacatctgagcataggaaattgcttaagttttccttttgttgagccagtagaatatcatcaggatgacatgtaagtgggtaggaacacatataagcaatcatacaaccgattttaaagtccttgttgatttcatggcccagctttacagcctttgcactggcaataaattgatgatgcaacgcctgatacagaacctgctcatccttcactgtagcatgggcaagctctccattcccctccggcatcatagctccagccatgaacgcgccaaatgacaaggttaaaatattgatttcattaaaagttaaccagtattttacgacatctttgtatctattaaaaagcacttcacaatatctcacataaaaatctacgactctgcgatctgaccaaccattatatttttgggtcaaatgaaacggtgcttcataatgtgagatcgtaaccaaaggctcaatattatactttttcaattctgcgaatacacgatcatagaactgcaagccttgctcattcggctctgcatcatctccgttaggaaatattcttgaccacgcaatggacattctaaagaccttgaatcccatttccgcaaataagcggatatcctcttgatagcggtggaaaaaatcaatagcttcgtgactcggatagttcactccttcttccagtatagctgtaattcttcgggaagtcgtatgcgttccagccgtaatcacatcagcagtgcttaagcctttaccttcttcattatatccaccttcaaattggttggcagccgttgcacctccccataaaaatccttgtggaaattccaatttagttgtatttttcattgtttaattcctcctcaatttaattaagatcagactacgacggtcaataaatcctcttgatactcaatcgccttcttctctgtttcaatgacatccaggtaattcgtagtattggcaacgataacaggtgtggtcaaaacataaccagcctcttttatagcttccatatcaaactccataagcagctggccttttttaacagcatctccctgtttcactttaggataaaaatgttttccttttaatttgaccgtatctttgcctacatggatgaggacctcaacaccgtggtcacttgtaattccaatcgcatgacctgacgaaaataatgatgttaatacaccatctacaggtgaaacgaccttaccttcagaaggttcaatggcaatccctttacccagagcacctgtcgaaaaggcttcatctgttacttcagataaagacttcacttcaccttttaatggactcatcaccgtctcttgttttactaaaacttctcctttggctgcacctggtgtgctgtcttccttttttgcttctttcacttcatcatctttaaatccgccaaagaacataagcaagaaacctaatacaaagcttaccaggataccgataacagccccataaaatccattgtctattcctgccggactgatatagctcgggatagcgaaaatacccaatccaccaatgatgtagcctttagttcccatcattcctataataccgccgcctactgcagatgctatacagcttaaaataaatggtttcttacgtggtaatgtaatcccgtaaatcgctggttctgtcacaccaaaaatcccggagatgacagctggaatggaaagtgatctcagttttacatttttggttttaaacaaaatcgccagtacgacgcctgtctgagcaaaggaagctcccagcgtagccgcaagaatgggatcgaatttaagtactgctaagttgttcatagcgataggaacaagtccccagtgtaatccaaagataacaaacacttgccagaaagcgcccatgattatgccttcaataattggacttaagttatacacaaagagggttgctgccccaagcagttgacctgcccaggttgagagaggtccaatcacaatcaatgctaagggtacaataactaacaatgtgaaaaacggaaccaaaaatgttctcacgacgctagggattacctttttaaagaagttttctatttttgagcctacataggtggatatgataatcggaagaacggttgacgcataactcatcagaatgaccggaatacctaagaaagtgatatataccggtgactcaaatatagtcccgctaaatagagtgtatagtggcttgcccgaagctgttatcgtgctaaatgtcggatatacaagtgatgcacctatagccatacctataaaaatgttggcattgaactttttagctgacgtataccccaggaaaataggaaagaagtaaaacaaacaatcacctaaagcattgagaatttgataggtacccgatgtagtggccagccagcccaaagctacaaataaggcagtgaagcccttaatcatacccgtggcacttaagacacccaacgtgggtgtaaatacacctgaaatggtatcaatgaatctattgaacaaactcattttttcacctgaggcttcttctgaatctcctgtctgaaaaccgcctacagcagtaacatcagcataaacctcaggtacatggttacctataacaacctggtattgcccgccactctttaccacagtgacaacaccatccatatttttcaaaacctctgtattggctttactttcatcttttagtttgaagcgcaagcgtgtaatacaatgagttagactattcacattttctttgccgccgacatttctgatgatgtcttttgctaatgtctcatacttcattgtaacttcccctttatttgtatttataaaaaaaggcgaaaccaaatagatcaaattcgatctaggttggtttcgcctgcattaccagtaacaatccaagggttattcaattttgtctttgggtcacacgctgaatatgaatcgttatatacagcttctcctcatctgacaataccgtatccaagtatttctcaatcttcagcatgcacccataggcctttttgtactttgctttcacttgcctccacaaaaaatcgtcttccagttctactttttcttttttatttaatcgctgaaagaagaatcttaaatgtgtaataaatcgctcataactgatcgagtgttcatctatggtggtattataagagtatttaataatattcaagatgtcgtgtattttttgagtttgctgagcaacgtctgctaccttgttgtaggagccgtttacttgagcattgattaaatgaagagcaatattacctgcttcatcttctgacaatcgtttgtctgtttcttcttcaataaactccagtgcttttaagccaaccgcaaattctttgggataaaattttttgatctcccaaattagcggatttgcatttttaaacccttcatcaaacattttaaatgcattgttcatgtgatccgtaagcgaaacatatatataatcgctcaattgtgcttctaatatgctttttccatattcgatgatgtcatagcataacgaaacatattctgatggaacatcctctaacaataacttgagtttctctgaagcatctttatgtttaagcacaaagaccttttcaattagatgctcttctacttgttcgcctgcactctttttgaatgcaataccacgacccataacaacaaattcatctcttttttgatctttggctattatggcgttgttattaaatatcttcgttatgatcatctaactgccccccttatcccatcaaatttaaaaaaggatttagatgctgggcgaaatttcagataggtcacaagacggtaatagccgatcaaatcttcgtcgtaaatcaaattcaaatgtattgatttacaacttcactttatgaaaacgcattcataataagagacaaaagccttacgttttccatcattgatctttagtgctcccaaaccgatctgatattccgttctgaaaatggatatagtcggttaaccacgtcccatgacatcatttttcggatgtcgattcgttggtcgacgtcatcatctttgttgttcagcacttgtaaggctttatatcactcacctttctgcgttatggctgggcagatattcatatcatgcaggatatcgtaaagcttgtattctaaaaagaaaaggcaaaacccaacacatggaaattgaattccatgcctcgggttttgccttttcagtaacaatcccaaaatcataataacatcgaatttaagttttgccaacaaaaatgtttgcgctttcttttccggagcaaccacatcaaatacagcacattattatggtataaaatgtcatccaccaatgtaggacatgttaatcttttttttgttgttggctgtctgctccgtacgttcatcggaataccgatctgtgcgttgttcccatactgaagtaatcacatcgagcaattcctggtcattcgccccgttgcgaagcatctggcgtaaatcaaatccgcctgaagcaaacaaacatgtataaaacttgccatcgcacgataagcgggcacgtgtacaagacgaacaaaacgattcagaaactgaagtaataaaaccaatctgtgcgttgccgtctttataacgataacgctttgccacttctccaaagtaatcccgatccatcggctccagctcgtacgcactcttaagtcgttcaacgatttcttttttggttagtacctttttgaagctccatccgttgtcatttcctacatccataaactcgataaagcgaagggttattccctgctccttaaaataagtagccatcggcaaaatctccgagtcattaacgcctttttgaactaccatattgatcttgatttcaaagccgatttctcttgcatattcgatctgcttcaaaataacatcaggcttaatcccccggccattcaaccgcccaaatagctcggggtcgagagcgtccagactgacattaagccgtcgtagccccgcgtcatagagaggcttagcctgctgtcctagcagcacaccgttggtggtcaagccgacatcttccactccgtcaatggacaggatttgggagaccaggtcggatagattcctgcgcattaatggttcaccgcccgtgagtcggatcttttttacgcccagggatacaaagagcttcgtcagccggtgaatctcttcaaacgacagacattcattttggggaagaaaggcgtaatcgtcaccgaaaatttctttaggcatgcaataggaacagcggaaattgcagcggtctgtaaccgatatacgcaggtcacgaatgggccgctgcaacttgtctttcagtggatgaaaattcatacgccccctcctttctagttgtttagcatcgttatcgttatcattagccgccgctgactgggggaatgaaggctgcaatgtctccatcctgtaatacatccgtagacaacgcatactcttcgtttatcgcaattcgtacagactggattggcatatctggatattgatctgttatccaattggataaatcgcctaccgtttggcccgccaaatctgccaattcttctgtttttcccgtcacctcacggagtcccgcaaagtagtacagcttaatcatgactgatctcccccggctttttcttttgacctccgacccactgcgttccatcttcccaaatctctcgtttccaaataggaactatttctttaattcgttcgatcgcgtattcatttgcctcatacgcatccgaacggtgaggtgaagaaacggcaatgacaacggcgatatcaccgatttgaagctcgccaatgcggtgcgcgattgccactcgcgtcccttcccatttctgttcgatttcgcgaccaatctctgtgagttttttttgggccatggggacataggcctcataagcaagatataaggtccgtacgccttgagtccattctcgtacgtgccctgtaaaaatagtcaccgctcctgcttccggccttaggacataatccgcataagcctgcgggataatgggctccgttacgatttcaaatacactcatcttttccacctcccagcctccggacaagccactctccggtgacagactcttttaaatgtttctgctttttatatctacatctcatttaaccgaacagctgatgatatagtttttgaccgttggcaacactccgtacaccgtgtatgagaagccttccgtttttgaataaaatcattcgatgcttaaaagcataaaattcaacgaaataaggggttctttttacacgatctgctataagcctgcccattttctctgcatcatcgagcgtgatcggacgttgtgggtctggaagaacctgtaccacgttccgtccgcacagagccgcatacgccgagcgacgtgatgctgtcagtgcagggaacgtaggatgctctccacaggttggacaatcttggttacggatgcgggaaatccctatgtccatctgcgtattctcccatagatcaaatagatgaaccttgcggcgcatcttatcacgtctgccgctcagccacttcatggcttctgcacattggagggcagctgtcacctggactgcgggtgagatgattccagccgtatcgcaggtctgattgatcgcaggcaacgatggcagaaggcagcgtaaacaagcagactctcccggcacgaatggaaaaacaacgcctgtgcttccaacacaggctccgtaaatccatggaattcctatcttcagtgcagcatcgttgataagtagacgagtttcgaaattgtccgtagcatccataagcaatatacttttgctggcaagttcttgaacaagctcggcatccaagttatcgagatatgtgtgcaaccgcacgtcttctcgtatggctttcagccttttttcagctgccataaccttgggctgcatttccgcggcgtcctgctccgtaaacaactgctgacgttgcagattcgacacctctacataatcccggtcaacaagatgcagctctccaacgcccgctcttaccaatgtttcggcaatggcggaacccagtgccccgcaaccgataatggtgacgacagcagcggatagattacgctgcccttcgccaccaatgggtctaaataagatctgtctggaataacgttcattcattagattgtgtcccttgataatacagccatatgacgaggatcaggctagccagcgccacttgggagaggagcatgaatccaatggaatattggccagtagcggcatgaatcgtcgataacaggatcggagggaaaaagccaccgagaccgcccatcatggatacaattccgttaactatacctgcttgtttattaaaataaaatggaactagcttgaaaatgacaccgttccccactccagcacttacagcgatcgccaagcagcctactgtatacagggtaatccctggtgaaaaagccaaaagaatcgcagcgaccgtataaactgtgaacgtgcctaccagcaggaacaggggctgaaaccgatccgccagccagccaccgatgggacggaagaatgtggcaatcgcaataaagcctgctgtacgcatccctgcatccactttagccagctcaaaattcgataccaggaaattcggcaagtacaccgtgaacgctacaaatgagccaaaagtaataaaataaaagagcgagaaaaaccaaagcttttcatttttgtaaacccctttgatctgttccataataggcgtctttactttagcttcatgacgatcccctaagaagaaattcaaaacgataaaaacaagcagcagaatgagatacagcttcactgtaagggcccagccaatttgtgtagccacaataggggccgagaaggtagtgacggctgttcccaaattccctataccatacattccatttacaaacccatgtttttcctttggataatacttcggtagcgaagtcaccccaaccgagaacacagctcctccaatcccaaggaacaagccaccgataattaaatccgtcatcgtagaagcttcactaatgtagtagacgggaaacaaaagcaaaataaagctaacgagaaaaacgattcttgctccaacgatgttggcataataaccaagcggaatgcgcagaatcgatccaagcacgaccggaatcgccgtaaccatggccaattttccgggtggaatagcaatatcctccgtaatgaacggcataagagaagaaatgataacccataccatgaatccaagaatcaagttcaatgtttgtagcggcaactgcatttttctgatcatttaactcaccttttcaacgttttttctgtcgaattattgatttgaatttatgtccccattgtagccgctagttgatctgttcgaatataggggactcccctttacctgacaggggactccctgaaaatataaaaagccgcttctataagaagcgacttggtctttttaagagataagtgtatttaatttgtcacataacttggttagatcattccgattgatctgttgctctgccataggaaaaagtacagtttcttcttttataaaatgtacagtcagcacttcaaaggcctctcccgcgttcttggctgcctcttgaatgtcatcaagcgtgagcaaactcaaatcgccctccgtctcatgaagaaaatgatcgatatagccctctatttcacggtgctcctcctgtataccgacgagcggtccctgctcaaaaccaatgtaggttcctagcatagaaaagaagtgttcttcttccttttcggtatgtttcttgaggggtaccctaaagtcgataatctgcattctcagtttttccagttgcttgcggccttcttccaaatctagtattctgtgctgctcaaaccacaatacaatggcatgccattcatccatcagataggttagatatcgatgctcattttcaagaatacgcatggcaggtttggaaaagcgcagtttctcattttccagcacgcggatttcctccattcatcggctaaaaatccagcatttttttctttaatgcatattggaccagttcaggccggcttcttaaattcaatttttccatgatcttcgctttgttcgcttccaccgtcttgacagagatgaacagcttttccgcaacttccttgttaccgtaaccttttgcgaccagaggcagaatctccagttcccgcttggacaggatctcataaggatcttctgattgtgacgttgtatcttttttgatgaactcacgaacgagagaagtagccattttaggatggatataagtcccacccccatgaatggttcgtatggcaagtaatagctcctcatctggagcatttttcaaaacataccctgaagcaccattcttcaaaatatgaaaaagatattcttcatcgtcatgcatggtcagaatcagaattttagtatcagggtggtcctctttaatcttgcctgtggcgatcaatccactctcgcctgggggcatgctgaggtccatgatcagaatatccggacgatatttagctaccatcgtatacgcttcaatgccatccgcagccgttccgacaacctccatatccgattggaagttcaaaatcatggaaaatccacttcgtacaatggcatggtcatccgctaacacaattttgatcacgtctttactcctcctcatgtccaatcggaatttttaaaaatactttggttccttgaccaacatttgaaagaacgccaaaacttccacctaccagttctgctctctcctgcatgccatataaaccaagtcccgttccaataggattgctccccttttcaaagccaaccccatcgtcctctacagtcaaacgaagcgtatgatcgtgctcagacaaagaaactttaaccatatctacctgggcatacttcaaggcattgagaacagcctcctggcagacacggtaaatgaccgtttccttttcacttccatatcgcttttggggaagatccgacacaaattcaacgacaagaccaaagctttgttcaaccctcttaaagtgggaacgaaatgccgcttcaagcccaaaatcatcaagtgtggcggggcgaagttccacagacaggttgcggatatcatccagcaatcgcgtcatggatgcttcggtctgcttcatgtttttgatgagctgttcatcattcgtcatgtattttaacacccgcagctcaacaaccgcactcatcaattcctgggcgacgctgtcgtgcagttccctggaaagccgtttacgctcattttcctgcgcttcaatgacatgcttcatcattttgttttgatacaatttttcctgcgtctgaaattgcggagtcaagtccctcaacatcaacacccttgttccatgttcagaatcaatggtgtgaaaagaagcggcataggggatcattccgttgctctttgtttccagataaacctgaaaagaagcgaaatccttggattctggcatattgaaataacaatcaaggcaggtacggggctccgtttcgcttgtatagcccctgcatgttccacacaaagctttttccttcccttcatagagttgaatgaggacgtcatcgctcacaatctcctccgctgccgggttcatagctagggtgttcccttgcccatcaaaaaagaaaatggcttctgtactgttctcaaacaacttcaccattagcgcattcaaagagccagtccctacagataatgtcaattacatcacttccttcccgttcaactctccaaatcccctatgcgccaaagcttccaaatcacgcatcatggctgcggtcatcagcagttcttcccgaaatccaccaagcagtacgcccgcgacgcgagcatcattccataggggaacagccccgagactcttgagcttctcggattgaacgatcgggtagttaaacaggttgtctgcccccacatattgatgaacagatggaatgaaaacggatttcccagttttgaacacgactcctgctatgccctttccggattgcagtacaattcgcttaaagcgatcatttaaattaccggctgcatttttccatttaattacgtattgatattcggccggttcaaccagagcaagcgccatgaaatcataaccgaaatgttcgcgtattcgctcaagctccctttgataatccatcctattattcatcgctctctcctaatagaattaggaaagaaggcagagcccgctttcctaattcgatttatgtcttctgtaaaggatataacttctgcgcacataattcaacggaacactccacacatgtacaagccgggtaaacggccagaatgcaaaaatcgcaaaggccataaggatatgaagcttgaaggacatcggtacgtctctcatcagtgtcgggtcgacacggaatatgaataaaccgcggaaccagattgagatcgtctctcgataatcgaattctggctgtaccgcattcgttacgagagtcgcaaacatccccatgcatacaatggccaaaagcaatacgtttacgatcaaatcagacgctgtacttaaacggcgcacattgcgtattgtaaaacggcgagaggtgagaatcaacataccgaggaacgtcatggctccgaatataccaccaatataaactgccccaatatgatacagatgatcatttacacccagtgcatgcatccaggttttcggtatgcccagaccggacacatgccccataataaccgggatgatacccaggtggaacaagaggcttccgatcatcaattgttttttttcaataaactcacttgatttcgctgtccaattgaactggtcgtttctgtagcggaaaatatggcctacaataaagacgaccacgcacatataagggaaaatgacccataaaaactgctctagcatcatcattgcgcggccgcctcctgttctacgcaagctttaagcgtttcgcgcagtcccttcaccagatgaaaataagggctttccattttttccagcgctttaagcaaatgatatgtgccgtcttccaggatcgcgattggcatgcggaagttttctgtcgtcttctgatcttgcgcccattcggcggcatacagaaattcacacatgagcggaaggtaatctggcagctctccatctggcatttcaagaccgtacatctcatatagcacctttaacttgaccaacatttgtccccgttcttttgcatcttcgaatttaaagtaagtcatatatagtgcacaattcttttgaaaatcaaaggtttccgtatacatttcctgaatctcttccatactgaactcttgcataagggaccagtaggtgttcgcatacgtatatgccggatggttcggatcaaacgatgcttccagaaaagccggatgaaaatccagcttttccgggtacatgagttgctgagcgaaaaacccgaatgatggcttgcattcatacaacttcgctacattaatcacgccaaatacccccgtagaagttttcttcatacatttctttgcccgttttcaaaggctcttccatccccatcgaacttgccatactacagccgtcacatccagagccagaatccatgtttcccatggtatcgccgtaaccggcagatccttgagcccggtacggattcgaatatccttctttatgcgatgtcggaatgacgaaacgatcctcatacttggcaatcgccagaagtcgatacatctgttcggtctgccgcggtgtcatgccgatgcgctcaagacggctttcatcgaaagattgtcctgtggactgggcacgcatataggagcgcatcatagccattcgctgcaaggattccttcacagtttgcgtgtcgcccgccgtcagcatattggcaagatactgaatgggggtgcgcatctcttcgatagccggaaagatcatatcgggattctcaattgagtctttcccttcaaagtaattcatgatcggactaagtggtggtacataccagaccataggtaatgtgcggtattccggatgaagcgggaatgccagcttgtgctcaatagcaagcttgtagaccggcgagttctgcgctgcttcaatccagtcctccgagataccgtcttttctcgcttgagcaatcactgccggatcgcttggatccatgaacaggtcgcattgcgctttataaagctctttctcatcctgcgtagaagcggcctcaagcactcgatccgcgtcatacagcataacgccgaggtagcgaattcgtcctgtacatgtctcggagcagactgtcggcagaccagcttccacacgtgggaaacagaaggtacatttttccgctttgttcgtctgccagttaaagtacacttttttgtatgggcagcccgtcatgcaataccgccatccacggcaggcttcctgatccacgagcacgattccgtcctcgtcccgcttgtacatggcgcccgaaggacatgacgcgacacagcttggatttaggcaatgttcgcaaagccgtgggagataaaccatgaaagacttctcaaagttaaatttaatctcttcttcgattttctgaatatttggatcaagcggacccgttacatgcgcccccgccagatcatcttcccagtttggaccccattccaaatccattttttcacccgttaccgcagaatgcgcgcgtgccacaggtgaatgcttctgttcgccagcgttggtcagttgctcgtaattataagtccagggctcataataatccttcatttccggcatgtctggattgtaaaaaatcttacccagtgctatcttggacagcttgttgcctgacttcagttccagtttccctttgcggagctgccagccccctttatataattcctgatcttcccagcgcttcggataaccgatacccggtttggtttccacattgttaaaccacatatattccgcacctttgcggttcgtccaggttgttttacaggtcacgctacacgtatgacagccaatacacttatccaggttcatgaccatggcaatttgagctttaatcttcaagccagttaacctccttcattttacgtaccgcaacgtacacatcacgctggttgccgatcggaccataatagttgaatccataactaagctgagcatatccaccgaccatctgggttggtttgagatggattcttgtaggtgcgttatgactaccgccgcgtgtatccgtgatttcggagcctggcacttgaatgtgcttatcctgagcatggtacatgaacatcgttcctcttggcatccggtggctgacaacggtccgggcggttacgacgccgttacggttgtatacctctacccagtcattgtcggcaagatcgtgtgcctctgcgtcttcgttgttgatccacaccgtaggacctccgcgaaacagtgtaagcatgtgctggttatcctggtaggtggagtgaatattccatttaccgtgcggtgtcagataacggagcacgagtgaatcttgcccgccttttatttcccgatcgcgagggccgaacaccattggcggcagcgtcggtttgtagatcggcaatgattccccaaattgttggaaaatctcatgatcaatatagaaatgctgtcttcccgtcaaagtacgaaacggaacgagacgttcaatattcgttgtaaatggtgaatagcggcgtcccttcttgttcgagccagtgaatactggtgtcggtataacttcccgtggctgtgccgtaatactttggaaagtgatcctttccgctgcccgatcggccgagatatctttgagttccacaccgtgaagctcttctgcctgctcataagccttttgcgacacccgtccattagtcgcggatgaaaggtggagaattgcattggctacttggcgagctgtctggattttgggcagtccgtctttaatggattcatcgtaataaactccgttcaactttttcatttcctcatattcgtccgctacggagaagctgacgccatgcgcacctgctttcccactagtcaaattcggaccgagtgagataaacttatcgtgaattttagtataatcgcgttcgatgatgctgaaattcggcatggttttacccggaatcgcttcaatctcgcccttggtccaatcctttacaagacccatcggctgtgaaatttcccctatactatcgtgtgcgagcggcgcagtcacaaggtctttatatatgcctggcaggtactcttttgccatatccgaaaagacttccgaaagctggcggtaaatatcccagtccgcgcgggattcccacagtggattaacagccggattaaacggatgcacgaaaggatgcatgtctgttgacgacaagtctgttttttcgtaccaggttgccgccggaagtacgatgtccgcgtacaatggagttgttgtcatccggaaatcaagtgcaaccatcaaatcaagctttccttctacatcttctctccagacaatttcctcaggtttctgttcttcgttcggccgggcaagcagggcatcagatgctccgagtaaatgtttcatgaaatactcttgtcccttcgccgaactggaaatcagatttgaccgccaaacaaagagtgaacgcgggaagttctcggctgccccaggatcttctacagcgaagcgtgtcttacgtgatttaatctcttccacagaatggttgatgatgtcctcgttggacttcttgcctaattgtgcagcctcttcggcgaacagcagactgtttttattaaactgtggataagaaggcagccaacccagacgtgctgcgagcacgttgtagtctgctggatgtctgtaactgacatccccgccaatcggtgacttcaaggtgtctgttccactttcttcgtaacgccactgctctgttgcaaagtagaaaaacgatgtagcattttgctgccgagccgccccttgccagtcttttgcaaaagcaatcgttgaccagccttcgattgggcggagcttttcttgacccacataatgcgcccagcctccaccgtttacaccttgggaagcagtcaacacgacaagattcaagatggaccgatagatcgtgtcactattgaaccagtggttgatacccgcacccataataatcatggagcgacctttagtatcgatagcattttgggcaaattcccgagcaatctgtaccacaacagacgccttcacacctgtgatcttctcctgccaggcaggggtataatgcgaagcttcgtcgtaataatttttggcgttatgagggctgtcattgcgtgcgacaccgtactggctcatcatcaaatcgtacacggttgctacgtaacgttccgagccatctgccaagcgtacttttttggccggaattacacgtttgaacgttccattaccagcgttatcaaagtaagggaatacgatttcttcccattgctcgccatgaccttccacagtgagcgcgggctcaacctttgttccatcttcccgttccagaatcaggttccatttcttatcctgctcccagcgctgtcccatcgtaccgttcggaaccagcatttcccccgccgcttcgtcatatatgaccggcttccagtccgcatgcggcgaagcatcccccaggtcactcgcccgtagaaaacgtccacctttccaggctccctcgtgtggatcaagcagaatcataaacggcatatccgtatattgtttggcatagttaatgaacatcggttcttggcgctctttgtaaaactcatccaaaataacatgcgtcatagcctgggctacggcagcatctgtacccggatttggggcaagccagttgtcagcgaacttcacattctccgccaagtcgggagccactgatacgacttttgttcccttatatcgtacttccgtcataaaatgagcgtctggcgtccgggtaagcggtacgttcgatccccacataatcaggtaacccgcattgtaccaatcagaagattccggtacatccgtctgctcaccccaaatttgaggagatgaaggaggaaggtcggcataccagtcataaaaactcaacatctgcccacccagtagcgaaatgaatcgagctcctgaagcgtagcttatcattgacatcgccgggattggcgtaaagcccgcgatccggtcaggaccgtatttacgaatggtatagatgagttgtgccgagatcagacgcaggacatcgtcccaagtgacacggacatgaccgccttttccgcgagctgatttgtagagcttggctttctctggatcttccacaatgcttgcccatgcttccaccggattggcatgctcctggatggccgcctgccaaagccgcaacagcttaccgcgcatataaggatatttcacgcgtaatggactgtattcataccaggaaaatgtagccccacgcgggcatccccgcggttcaaattctggcatatctacaccgcaggaaggataatcgatctgttgattttcccaggtaatgatgccgtttttgacaaaaaccttccaactacaggaaccggtgcagttcacaccgtgagtcgtccgaaccactttgtcgtgagaccaacgctgacgatatacgttttcccattctctatttttttcctcaaggattgaccaatttcccgaatagctttcgatcggtttaaaaaagttgaggttgtatttctttttcatcgatgaccaacactcctttttagaaagaatcatcccaacgcaagttccaagggaagactcattcgcttactctcattatgtaattcattcatctctgttcccattagggaatgtcctatagcgctacaggaaatccctcgttctatggaaagatacaaaaaaagcctcccctgctaaagggaagcttgtatgaagtaattaattgttcttttgacccgttaacaggagcatgataaaagaaatgagtatgatagagcatgtccacgcccacgccataggaagatgaccagcatccactgcaatataaatggccgtcggaatcgtttgtgttttacccggaatatttccggcaatcatcagcgtagcaccaaattcgcccaggccgcgggcaaaaccgagtatgaaggcagctttaaaagaagggaaaattaaagggaaggtgatgtatcgaaaaacctgccattcacttgcacccatcgaacgtcccgcgttttccaagtcccggtcaacagaagacaatcccattctcagcgtccgatagactagaggaaaagctactaccaccgctgctataacccctgcccaccacgagaatataataggctcgccaaaccattgctccacaaaccgtccgaacccgctttttcgtccaagtaatatgagcagtaaaaaaccaacaaccgtcggtgggagtaccaagggcagcataagcacggtttcaacaaccgttttccctttaaataatcccaaccgcgacattgaccatgccacaagcaagcctaatatgattacgagaacgctggataacagtgcaacctgcaacgataatcggataggaggccaatattcattccaatctatatcttgcatgctcacttcggtatggtaaatccatacttagccataatattcagagattcttgcgattgtaagtatgcataaaagtcttcggcttcttgaatgtgctttgtagctttgacaatcccgattggatactcaacaagtgaataggttttgggattcacctcaaaggcgatttttgccttttgtgaagtcaatgcatctgttttatatacaaatccgacatctgcattcccagtttccacatattgcagcacttgtctaacgtctttcgcttgaaccagcttgttctgtaacgtgtcccaaagcttcgctttcgtcagcgcttcctgtgcgtagttgcccgcaggaacactttcaggaattccgattgcaactttcttcacttctttttttgttaaatcggtaacactcgcgatgttcatcgtcccgtctgcagggataaccgcgaccaattcgttcgtcagccacgttttttgttttttcgtatctattaattgctgatcaacaagggacttcatgtttttggtcgaagcggacaaaaacaaatccgacggcgctccttgctcaatttgtttttccaacgcaccagagccgccgaagttaaaattcaatttgatgcctgtatgggttgattcgtatgaatgctgaatttctttgagcgcatccgttaaacttgctgctgcggatatggtaagctcaatagtttcagccgttttcgaagatgtctggctggaagatccgttctgatccgcactgccaacatttgaatctagttgctgtttcgtaccgcatcctgataataataaaatgatggaaataaccaaaacgaaaacagtgctacttttaattaatttatgcatttggttcggctcctcatgttagttcatcatcaattaatcggtttcgctattagctgtgcctgtctcgtacgttcgatcagtgtacaattttcaagaagaatatgattaaaaatatctgcttccaggtcttctaaccgcttcaatacgagtcggtgcgtaccacaagcttcctgcatcggctcaaagccgtttgtgatcaagcgcatttctttcaggaattccaccaccgtttgatgctcgtcttgcaacttggacaaaattagattcaactcatctgctcgttccactgttgattcttgtaaaaatgcttcaatcatcggaaatacaaggtcctcctcattttgaatatgttccgataattcctgtttaagcaaggtgaacagttcattaactcgcttgagatgcggataacgttcaccgtgaacccgcgttagtttggttacatacggcgttaaggccgatagttcttcccgaagcttcgtatgatactcattttgaatataggcgattagttcttttggttcgagtgaaggaggttgcatttgcttatgctgtgcctgtttttcttccacttcatgtatctgcgtcagcagctcaccagcgtggaggcctcgattggctgctgcttcacggagcgatattttccctccacagcagaaatcaatcctcagtttgcggaacagatctcccgttttgggtactgctttcacaatgtccgccacccatgtttcttccgttaactggctcatcttccattcctccatcttatttcgattttatgcttaactttcattctacgtctcccttaaagccgaaccaatcagggggttccctctttcactagtggaaagagcctgattataaaaaatcagaaagcaattgttcagccgcttctttcccttgagcgatgcaatctggaattccaacgcccccatagccagcaccgcatagaaaaacacccggtaaatactgtgcgaagtcctgtctcatcttcgccatatgctctttgtgtccaatcggatattgcggcatcgatcgatcacacctactgacttcaacgaattctggttccgcttccaggcccattaaatctttcaaatctttgcgcgcgacatccacaagttgatcgtctgtcatctgaatccaatcctgtgcgcctgcatgtccgatgtaggtccgtaaaagcgtatatccttcaggagcagtatggctccacttcgtcgaagaccatgtacatgccgtaatctttttgccttctttgcgggggactagaaatcccgttccctcaaaagcaaaattaagatctgtgtttttataagcaagagcaatattggctacggaaacatagtgaatcttgtgtagccagctagcgcttgcaacgccggaaaataatgtagccgcttcaaaagctggaacagcgcagatcaccgcatccgcatctattttttgtccgtgttctaaaatgacctgataaccgctttccttccttacttcaactacaccttgccccataacaaaacgtacggtatccagcctttcctttagccgctccacgatcgtagataatcctagccgataagaaagaaacatactttttttagcgatatccggcagtttgtcttgtactgctggcttttttcccacccctttagacatacccttaatcaaacttccatgcttttgttccattagtttaaattgagggaaagttgacataaggctcagagaatgagtatccccagcgtaaattccagacagcagaggttctgtaatctggtccagaacttctttgccgagacgccgtttgataaaatcacctagagattcgtccgcatcacctttcttcgccggaatgattaaatccagggctgcccgtgcttttcccagtggagaaataagtcctgtccgaatgaaaggagtcagctttgttgggatgcccagaatgaagcccatcggcattgtatgaagtttgcccttatgcaaaatacaagcagatttggctttcgggtttgtcgataccagctctgcttccagccccaactccatggtcagatccaatattgccgtctttctggccaagaaagcatccggtcctttttcgatcataaaatcgttttggcgaacggtttgcagctttcctcccagacgttcacttttctccaccagtgtaatctccacttcaagctgccgatcctcagccagctttttcacataaaaggcagcacttaaaccacttattcctccaccgagaataacgacttttttagaactttttttcatgaaaacacttttcctctccaaccccgggtatataagcgcaataagggtcactctccaaatagtctcctgttattgcaaaagcccttgctctggagcccccacaaatggccttgaattcacagactccacatttacctttaagtagggacttatctctaagattcatcatgatcggagagttgcgataaatatctgccaggctatcgtttcgtacattcccgcacatgagaggcagaaaaccgctcgggtatacttcgccgatatgactaataaaaacaaatccatctccatcatttacacctttaggagcacgtcctaaaacatctgtcctcttttgtccgtctgctacactgctctcacctgcattgtgcttttgctgcagtacgaccctccggtagtggggagcttctgtagcctttacaccgtacggcatctgttgctgtatttgatacaaccatttcattacggcttcatgctcatcaggagtaatcatatctttctccatgccacgtccggttggaacaaggaaaaataaactccataacacggcctgcatttcctttaccctttctgcaatttgctccagatcatggaggttataccgggacaccgtagtgttcacttgaatagggatattcagttcctttaaataaccaattcctcgcatggttgtatcgtaagaacccaccgtaccccgaaaatgatcgtgaatgtctgcacatgaaccgtccagactaaacgcccaccgcgataacccaacttgctttgctttttctaccgctgctcgtgtcactttaggtgtggcactgggggtcatcgaaaccgatagatttttctcttcaattgcatatcgagccagttcaaacagatcaggacgcatcaaaggatctccgcctgtaaacacaaccagcggatgattcatttcagcgatttgatctatcagcttcttaccttcttctagtgtcagctggcgaggatccggtttgtactgagcttccgctctacagtgaagacactttaaagcacaagctcgtgtaacctcccagatgactataaacggatcagtatgataatcacgcggcgttttcaaaggtatcattgatgtctctccttttagaagtataaaaacaacacaaaaacatagagcatcattgaaaatccaatttccgccatgccaacttgttttgcctttaatccgagtttaggaagccatatggcccgtatcaaaaaaatcaaaaaaggaacaaacagaggtaactttaagcaggtagcaaacaacaaaatcaccaaatgatagatgacggaagcataatggtaacgtatattttttctttcacgaatgatcgttttgacatacaaagcagttccgataaagtaaagcaccaaaagtaagaatagctctgttgctactccccaatcctctcctcctcccatataaataacagggtatataaaagaacaaaagagtagaattgcaacaatgtcattaagtaaagcacgttcatttttcgtttttgcaaaataaatattagccataaaaaagagcaatagaagagctccataccagatcaaggcaggctcaaaccatatcagtgaaattaacaaaggaagtaatatcactccgtatacaacggcgggtttgcggtatctttcactgctgcctgttttgatccattggaggacaggaaaactgaataagtagataaaaaaccagcatacaaatagggggatatgaatgagttcccctcgagaagcagctaaaccgaataaaaatggaagaatgagcatggcccaagctccatgttgattgggtatgtatctgctcatccccttcaaacccttgatccttttttcacaatcttttttatgtctgttatttcggttaatcgattcatcatccattcccccaagattgagttttatcttctaacttcattctaagtattatatgaaattgaaccaattagggagttcccttttccttaggggggaaaatcctaaccgaaaaaataacgctattttcttatgctatactgtactaaaaaaagggtacaaagaaaggatgaactgttatgggaggaccttctttacgtcaactgcatgctcatcatgccattcatcaaggcgggctatctggcgctctagataagacgagagaagtagaggaattactcgaagcaaaagaattcaaggtggcgcgccaggctgccgaccacttgatcgaatattgggaaacccgcattcttagccatgctgatgcagaagaggaaggattctatcaggaaatggtcgagaaaaaaccggaactgcaggaggctgtcgtcaaacttacacgggatcatgatctgctccgaatcattgtaaaagagctcaaagccatgatccgtgaagaagggcttacgcctgaagttcttcagcagttccacgcgcttctggttgtcaatgccattcatagtcgggaagaagaacgtttgttgtttgaggaaccgtcatgatcaagatgtggcataacgattcactttctctataaaaacgcaccgaagaaatagtccaacgcctcctgcgagtatccgtcatctccttgccaagctgctacggaataaaaatcatgattgccgtgctgtcgtttacgaggcgtgtcctgtggaaccagcagtccggcatatccccacacctccatgactacatcacgctcgtttttgctggatggaaacacatccttccagcgcttttccaattgacgtgcactgctttgagcatcacagttctgaacagctttgagcatgttatgaagtatagtcagatcctcatcggaaatctgaacagcctcttcttgactgaacaattcaaggtccatccagcaatacagaaggtggttcagacgaataccgccccatttgattcgttcaaaattcagtacattcaaatcttcattgacatattccttatcagacatcaatttattaaaattacaatccccacagctactgtaattgggcaagacgacaggccgctccccataggtgtgcaaaggaagtcctgcggttaatgcccagctcgataaggcgcttcgtaaatgaacctttttcgtggaaagactgtgcaaaaacgctgctgccactcgctcttttgtagccttttgctggtgcagctcatgcagcctgtttataatctcgttatgtgtaatggtgatcggatcgaacatcaagcccttacttttggcatattcaaaatcctcacccgaaaaagattcccgctcctgcttccagccgctagaggaccagaatgtgttcatcagtatttttttcgcctttttatccacaacacatctcccttactcatccaacaccctcaccttcagcacaaagcgcagggttgtcgtgtattttatgtaagatcactattcatctttatacttaaaagcaatggccgtatttcccgaccgtgggtcaaaataagaagagattttcccccagttcagttcatattccatataggggtaaggctttgtttgacgatagcttggctttacggacaaatgttgctgtaacaaacgatcatgctccctttgtcgctttctctctccttcctcagaccaattatcccacgaagttggaaattcatctccctggagcgaaatctccacgacaattaggtttgtatccttaaagcatacagacaaaaaaaattgccgacacagcaaagaaacctgatcgaaatgataccagatgtagtcattccctagctttcttacagaatgaaaatatttagaataccaagtggtctctaacaactgatcttccgttaaagatgagtagatagcacgctcaccatcgacctgaatgattcccgattcccagtcattcattgctgtcactccttcagctattatgccaatctcctacagttactctctgtcctcatttgtccatatgattgaaaatggcctgccaggcccgatctagcacgcgtgtatgtaattgcttggcataaacatttctaacgatggcaagaacgatccacccacgaatacaacactgagcaaagtgatagagggaacccaatggtcaaacatggcattcgccagcacttgcagcaaatgtcgttctggttgtaaatattccaccgctgcaacgatgcctgctgccagcaatatgatcacagatatgatcataagcattacattgattactttgtatttagcaagccctcgctgaaaaacgcgagttcccgcatattgctaaaacattcatatcttttcactccattttcgacagcttctaaactacgagtatattgggttgccatgctctacaaaacgatcgattccagactgctctctaaatgagcctattagtaaaaatcaaagtaaccccgccagactccttcattctgatgcttggcaaaataaaagctgcctccatccacaatattcaattgggctttggcatctgaggcaatctgaaacacaaattcatagccctcgccaaagtcgatgcctggttgaataaagctgggatagccaccgattttgtgaaccgcatatatttcctctacgatgtccccaaaatagtcgggttcctcctcgtccatctggttgagaacatcgccgtattcctcagggatatcttcaccgtcccagaccggataatcattctctttaagttcggggaacagcggaaatgctttgatttgcataaatgccggaccaaaatctttttcaaccaaatcctctaccgacgtatactcacgaatacacatatatccttccatgtcctcatgatccagtacatggggagacaggaagacggtcaacagcttgacactgtgcatagcttcagggacaaagggcaaggcaggcaaatacaattgcatgatcggagccataacattcccctgtacatcaatgggttgttcctccgttggcaaagccactgtaactctaccaatccagctctgttcaagggaacccgacggtctgcgaccccctgtatgaaaaatagtagcattacgttttagaatcgttcttagcttctcaatagagttgctggacaacgaaatcactcctttctaatctagaatagaaacgcaacaacatcctcgcctgctttaaatccaaactcacttaatcgatcttccatctcttgaatctgatgtagataatcttccggcatagctggcagaccctgttcattcactaatgtcccgccgagtctggcgcgcgcatattcggcactttaccacattgcctcaaacacagtttgcggctgcacggtccgtaccccatccatactgaaaatcaaatctgcaaagcgatcctccgcgagtgtactcaacccaaaaaagccaggctcggttcccgtatgtacgctaaatagttaagcatcaggctccacttgatggattccttttatggtcttcacaggctcatattccaactccacggcaaggatgctagatacatcctcactcccatgttcaggtaaattcatgaatctctctcctaactagctgttttcactttacagtttcctataattctcaatatatattaaactataaatcaccaagcacaaaatagtataaaaacggtgctgggttgttgaacataattttttagaatttcaaagcttcgaaaggggagtactcatgatgcaaaaactttggcaaaaagggaaagatctgtctctgcctattatggtgtccgcatcgctgatatctggagcgctgtctgtaagtacacctgcggcgaatgcggctgcaaccagggaattgcttcagctatctggtcagacgacttactatggagaggttgagaatgggcagcccaatggacgtggtacgatcaaatggagccaatataagcagtattcgggtgattttgtgaatggcaagcgttcaggtactggaaaatatataaatcaatacacggatgcagatggacaaaatcataaaatcgtatacaacggcacatggaacaatgacacgatgagcggcaagggtacgcagactgaaaaagtgacacaaatggacggaaccgtacgttcgaacgagattcaagtaggtacttttcagaacaatggattacagaacggctaccaagtgatccacgctgtggccgatccagactacagcttcacttataaaaatggaaaagaagtgttaaatatcttgcacagtaatcaagatctcgtccaaaggtggcaaaaaggagagctcttctccgtaatttataaaaatggctctgtccaaaaggaatactccatgttccctgaagagactgctaccaaagaacgtcaaagacaagcgtccatcaagtatttcaaaggaattaccgccaaggtcactcctcacttgcagcagtttgaaaagctgtccaagcagattccgctaaaataattaatacgacgcgaaacatgcattagcctctacgcaagaaggcctctctttctaatggaaagctccatttgaaaagaggggcttttttcgttttcgttatgaataacttataagaacttcggatcataacactcctacttttctcccttatgaatcctcaggaactcatacaaatgacttatttttcacttaaatcccctcctttttttgctaacccccactagattcactaaaatataagtaattattttaatcatccgaggtggacatcatggctaaaattatggttcctcctgagaaactagaggcggtttccaggcagttcgcacaggcacgtgagctgggggcacaaatttgcggacaactgtcacagcatattcagatgttggaaaatagctgggcaggaacaacacagcagcgcttttatcaggattttcataaagctcgtggacaaatggatgctttcactcaaactgtcggttctgtcagcacagagctgcgttccattgcagtaaaattcaaggaaacagatacccaagtagacacgggtattaataaaggagatcacagcggacagatcggcagcagtgaagggacaacttccgggaaaaaaggacccgatccagcagatatagccattaacagcatttcagaagccaataaatggcgcgggcaactgggatttgccggaacagctatctatagcggtctggcttccacacttgtgctcaccaaaacagtagaattcaagaaaagtctgaagaatcccactcgagcggttatacataatgcggcatgggtgaaaggcaagggtaacaatgcttttatgcgtaatttaggcaaaagcctaaaccgccaattcgccaaacccggtattgtgatgaaggggttaaagggctttgatcgattagctggaaagcttcaaatgggtaagctcggcctcggattcaataaagccaacagctttcctcagtggacgcggaacgtcatcgccggggtggaaaaaggccgatatggcatagccacccgccaaattcccggcatgattgccaaaaagctgtaccctattaatgccaccatgaatattgtgggcgagggtatcagtctggctggaaaatggaaaagcgggaagcttaccggaacggatgtggctgtatctgcttctaacgtagcgattaaaaccgccgcaacttatggcggtgctgtcgctttgggagccgtaggcggcgctatcggtggtccggtcggtgcagccgtcggtgcttatgtcggcggtacggtgggaagctgggcaggtggaaaagtcgccaaatttgccgaaaaagggatacgttgggccagcaaactatttaaatgacatatacctaacagatcgataaggagcctgactatggataaacaaacggtaattttaacgcttgaggaactaggctttgccttgaccgcactgggcgcagaagatatggcttctggtctgctccaatcttattacggggaactaaccgaagatcgctgggaactgctttttcatgctgcaacgcatagcctgatatccaagggtctgatggaacaacgggatgacgagcaacaacagctcgaatttgatgagttcattgttgaaatgctagctcatctggtacaaagtcgtcagatgctacgtggctacaaggagcaacaggataagcaaaatacattaacgatacaccatggaaatgaacgttttctgtatcatttctccagtcacaatgaactccatttctttcgctggtcttccccagaagactggcatcatgacattgatcaattgttcggcctgcttgcttcgaacttcaatgcgcacagccgatacgtcgatctgaccgaagaacagtggaatgagttaacctcatccaacttcagcatgcagcaaatgacaacgtggaagcttcatgagtcggcccaacaaataatacaagactggcgagaggattttgatcgtaatcagtgtagccttaataatttgagccaaatggtatacacggatacggatgaagatggtccttctgttacgaatctgctatttgttcttaaaggaatgaatgatgtgtggattgtaagaaatacagaactggatatgcaggccatcccatgtctgcgtattgaaagtgtaaccgaagctgactggagagaacggataacatatttcattcaggagtttgtacgcgacgaggcggtattccgtggataaaattgtatatcgaagatctttggcattttggaaggccatgggcagcttgatgtttgtgctgatttgtctgtttttgctgctgctcatttttatcgacgaagatatctcagctctacaaatcttcttctttattacgtccgccattgtcggacttccttttttcggtagctatcttgtggtttgtttgagcagaacgcttcgtaaggatacctacctgttcatctttgacgaacacagcatttccgatggtattcgaactgtcccgtgggctacaatcactaaagtcgaattcgaaggggcctccatccgcaaatggctgcgccctcgctttcccgcctttatttttcatctgaatgaccgcagcacctgggaagtcagcaccgattatgtgttgaacgatatggagctgaaccaagccgggaaacaacttcgaactctcattaaccagcatggcaaaccaaagaaaaaacgttcctgaatagtgtgccattgaatatatcaaagcttgtctctatcatatgcagctacaagagccacaaccactgctgccgagttggccgcagccaaatcaagattggagtcaaaagaatccgccgcttctacaccggcaagatcagacaaagaacggacagccaaaaatggaacaccaaactggtatgcagtctgaacgaccgcggccccttccatatccgtcactttcgcttcaggaaactggctacggataaaatgggcgcgctcagcctgggagataaaagagtctgccgtcgtaatcaaaccgttgacgatctgcccctcaatcctggtctccgccagcgcttctgtcgcaaaagcaagcagcgctggatcgacaggataacttgccggcatctgtggcacctgtccgtaggtatagccgaacgccgttccgtccacatcgctgtaagtcagctcggtcgccactacgacatcgccaacatgcagcgctggatcgagcccacccgcagatccggtattaatgacaagctcagggctaaatcgctcaatcaacagcgccgtagtcgaggctgcgttcgctttgccaattcctgattgcagcagaataacttccttgccctcaagctggcccgtataaaaaatcccgttcgcaatctgggtcatctttatcccttcgatctgcgctttcaaatctgctatttcttcctccatagctccgataatcgctatactcaaagttcttttcccgctccctccatgaattccttgtattccagcttatccttgaaaaacacccgttgctgcgatgcgctgcaccgcctccagcagcctttcctcattgtttaccagactgacccgcacatgagaagctccttcacgaccaaagccttctccaggagcgaccgcaacatgcgcctcgtccaataaaaagtctgcaaaggaagcagatgtatacccttctggcaccttgaaccaggcaaaaaaagacccttggggagcagctacatcccagccaataccccgtaacgctgcaatgagaacatcacggcgccgctcatataacgccgcgagctcccgtaccggttcctgcgtgcccagcaatgccacagctcccgcatcctgtaccgctccaaaaacagtgctgtaggcatgcgtatgataatgcttgagcgcaccaatgatggacgaatttcccactgcaaatccgaagcgccatccagccatgttatacgttttggaagccgtatacgtctcgacgccatactccttgccgccggggatttgcaataaactaatcggcttatgcccgtcaaatccaagagcaccgtaagcaaaatcattcataaccggaaactggtaccgagcggcataattcagcgtctttgtcaggaaatctgcagtagctactgctccagtcggattgttcggataattaatcatgagcaatttgacctgctctgcaatttcttccggcacggttgtataatcaggcaagaagccatgcttctcatcaagcggaatcgtatgaatatgggctcttgccagcgcagcagcggaataatattggggatatgccggatcggtggtcaataaccaatcacctggattcaatagcgcctgtggaatccccattacgcctatggctgagccgttgaatatggcaatctcccggtctggatccagctccacctgatactcccgtttatagaacgcggcgacagcctccagcgtgcttttttttccatgaaaaggcggatagccctgattgatcggttgatcgaccgcttccttcaaagtgctgatgatatgcgccggtgtcggctgatccgggttgccggctgccaaattgattacatctattcccttacttttatacagattcaccttgtcatccattgcgctaaaatagttgtcaggcagagccttgacgagatcagaggatgaaaaaatcacgttcatctccaccttctatccataagatacaggctgacaacgtcagcccgcagaagataataccccatattatttgaaatagcttggcagcttgtagccttcataatcaggattcgattggatgtacttttggaattcatctgaatgatatccttcaataatgtctttgacgaagggcttatccttgttcttgctgtccacagcgaccacgttcgtgaacggatctgtcatattttcaagctttaatgccgaggtcagctttattccattcgatacagcaaagttcccttgtatagccgcaaaatcaacatcctccagtgcacgtggcccctgtgccgggtcggtagcaacaaattgcagatgatgcggattagaggtgatgtcgttcaccgaggtttgcaatggatcaatattgtcctttaacgtaatccagcctacttccttcaaaatattcagcgcacgcagcatattgactggctcgttgggcaggttgatttgggctccctcactgatctcgtcaaggctagtatgcttgctggagtacaatcccatcggaggagtcggaacctgcacagcaccaatcagatcaatattctcccgcttattcatagaatccaggtagagcgagtgctggaacacattagcatcaatatcccccttagccacggctacattgggctgaacaccgtctgtaaactctttatatgtaatcgtatagcctttcttctccaaatatggtgccacaccattcttaaactgatcactgtatggaccgggattaaagctgatatgcagtgttttcttttcttcacccgcagcgttgtccgacgtattcttgctgccgcaacctgaaataaaaagcacgactgctcccagcagcaatataaatgaaatccatggtttcttcattttgatgtctccccctgctccttgatatcatctacttttggtgagttagaatgtttacaatcgctcaaaataccaagtaactttatgcgttttatagatattacaatgattttttattcactgtcaacaacatttaattacgcatcttctgcatagcaaaaaagggggcacaacaggagatccccttgaaagcaaaacactttacacgtttgtcatatacttccgttttaaatataccccataggggtacatttaaaatatataattaaaaccctaaaggagctgtaaatatgagaatgcaatgggctttgctcgctggtacaatcatgattattttgagtgggtgcggaaacagtaacacgccgaacaaggaacacacgacaaacagcagtcaacagcacgacacatcggatatgaaccattccacttccagtgagcttcctaccggactaaaagaagctgaaaacccagccttcaaagttggcagccaagcgactattcgagctgaccatatggcaggcatgaatggggctactgccacgattgttggtgcttatacgactactgcttatacggtctcatatactccaaccactggagaagaaaaagtgaataatcataagtgggttattcatgaagagattaaagatgcaggcaacgagccctatgcaccgggaacggaggttatccttacagcagatcatatgaaagggatggatggggctaaggctaccattgattccgtcgagccaacgaccgtatatatggtagactatacgccgactacaggaggggagtctgtcaaaaatcataaatgggtgacggagagtgagctttcagcccattagacacttacaacacaggcgcttatgatagcaaaagggagcctgacatcggctccctttatacggctttatttgggtttggacaaacctacttcgctaaattcagcttggcatccttgatatcatacaaagcccctttgttggtatctacaagctttttcatttgtttgttggctgttccatttgcaggcacgattgcattaaaaataacaccatttttctgtaattgctcgttgatttcatctactgaaaaacgggctttacccagatctgtattcttatcatgaactggtgcatctgtaatgaatatgatcgttttggaattagaatttttggagaatttacttatagctaactgaatagcttctaatcccgattccttcaaatccccaccagcggaagggcgcaacatattcaaattaccttttaacttgtttttatcggtcgtaaactccaaaaattctaaatctttatctgccttcagattgatatcccgaaatgcaacgacagcaaattgggaacctgctggaacggaatcaacaaagcctttcaccttctgtctcacataatccagcgtccctgtcatactacttgtaacatctatgacgaacacaatatccgtagatttggagaaggtgctggatatctttttcagaatcgttgtgttggattgtgattcggaagcatcttcattttcctccattaattgttcactttcactggttgtcaaaacctgcggtggagcaagaaaaatcacaacgctctgagctgcaatattccactttaccttcgcacctagcgcctcgcttacaaagcgaataggaaccattactttgccgttaatgagcctcggcgccgcattgagacgcactaatttaccgttgatataggcatctctggagcctacagttaacttgatcgttgtatttcctttggttgcagtaacggtcttggtagctccatcccatttcactttcgccccaagcgcctcaaaaacggcacgaaatggcaccagcatacttccgctaatagaggtcgcaggctgctcatattgttgcagtttcccgtctataaacacctcaaccttctgagccttgttattatttatgggaacaaattggggtacagacgctgccgaatttcccgactggtcgatcattttgatataaaagtagtatccacccgtagataaattcaggttactcaaagggtaggtaaacgttgtttccggatcgaactgaatccgtttaattaattgagcatctgcatttttgaccataacgtatgaagtgtacgtgggttgaatattttttattttcaaacgaaccgaaaatgacgtacctgaagagttgatcgtaaatgtacccggaaaattttctccagacgggatagtcaaagggatttccggtgactcatcaaccgcttggtccattttaggctccacgacaggctgggttacttgaggttcaattactttcgattcatccacaggttgagcaacctcgggttcactgggagtgggaatctcttttagattggtctccacctcaggctgcgttactttcggctccccagcaagtggagttactgtagattcatcgactgactgcacagcccctttcatagttataggaagttctatatgattttctgatcctggataaggtgctggtcgtgaatccgcaatcgtaattgtagagttggcataatcaatcgtaaagtcaccagaaggaatttcaatatagttgctatacagacgaattggtgtatcaggcttaatcgtaaacgggagatcgaatttaaacactctgtttactccattaccatcatcaagggtaagcttaagcttatctccatctctgaatactgtcgaattggcagcatgaacactttctgtacacaaagtgaacaaccctacaaatatcgttaaaaacgaaagtaggaacatcattcttttgagcttcattcttatttccccttttgcatctattcttgtcggtaaatcatagcatagggttagatgaagttcatgccatctgattacagttatggatatgcgaactcactttttccatcattcgcgctctgttcatctgttcaatgttcatatgtatctccttggcccgcttcttcaacgtggcatacgtaatatggccgccttcagtgctttagtcccttcttcgcttttcaaataatccgacggtgtttcgtggctgagtgcggggacttttcgatccatccaagtcagcaaatactcccccatatcgggcagcagcacaatctgaatctcctttggaattttactttcggccacttttactcttatagccggatctacctgatcataccgttcctgatagagctgaactatgttggcccagctctccagcttaaactctttcaaatatatgtctctcatctacgaaccctccttagggcctcagacaacgcttctcatgctggagcaaccattcttttctccatagccctcctgcatagcccgttagtttctgattggaaccgataattcggtgacatggaatcacaaggctcagcttattttttccattagcactgcctacggctcggatcgctttttcattcccaatagcaagagcaatatctttataggctgtcgttttaccgtaccccacggacaccagagcattccatacttttttttgaaaatccgtaccttcaaaggcataaggaaacgtaaactcaaagcgctcacctttaaaatactcgtcaagctgggtagcgcattccgctaatacttggattggaacctcttctatagccctcgttaagagctcattccgattagagaacataatagaatagacagcctcatttgtgccctgtatctctatctctccaatcggcgatacatacttcaatacgtatagttcgctcataaaaggatacgacctccttccttttctaatccttactcaactttctatactcactaggagaacaatggttcaagctgcgaaacgccttatagaaatgggagggactttggaagcccgtctcatagcaaatctcaagattcgtaaggtttgtacttttaagaagataggctgccttatctactcttattttttccaaatacgtacgcggggtttcggcggtttcctgtttaaagatccgatccaagtaaaaggagcttattccgatatgatccgcaatatcctgcaatacaattttctccttgtaatgattgaccaagaaggttaccacattctgcacaagtctgatatacggcgaatggtctgtatggggctggcatcttttgcaagcacgaaaacccgccttttccactttgtccaaatcaaagtaaaactccacatttatttttttcggctttttggatcgacaggaaggtcggcagtatatgcgggttgttttcacagcggtaaaaaacaacccgtcatacttacgatcacacgctataattttctcccacatttcttcaaaagaaagattgatgttagccatgatcgaatgctctgtcctttctatagttcatattcgtctagttcaggattttgcaaaatcctcatataaatgtgatgtatcttgaagctctatcaactgttcggcattcttttgcaaagcaactattatcttatcagaaaatgcatttccaaagctaaaccgtttaacacctaactgctgaagctggtggacattcgtcagacccggcagggataaaacattaagcggagcatgtatatgaaacacaacttccctgatctcttcatcactctttaatcctggaacaaaaattccgctcgcaccactatccacatacgctttggcccgctctatggtctctgaaagtggggcatccatctgcaaatatgtatccgttcttgcgtttataaaaaacttttgaaacccacgcacatccaatgctgttcttattttggacaacaggttactgtgcaggcccacttctcgaagtcccttttgcgttttcaaagaatcctcaatattaatccctacaactcccacatcggctacccttaaaacatgctcaacaatcgttgccgtatcctccccatatcctgcttcaatatctgccgacactggaatttgaacatgctcagcaatcgtccgaataacgcttacatgctggtcaaaatcaataagctctccatctgagaatccaagcgtattggcaattccccagctcgtcgtacctatcgccttaaagcctgccttctccagagccaccgcagatagcatatcccaggcgttccctaaaaataaaagttcctctgatgtgtgaagtgcatgaaactgatgaattttgttcataaatatagcctcctgatatgtgatgtatctcattttatcaagagactatctttgtttcgtcctcattcttgcacttatggtctgtaggaatctaggaacaactaggtccatttattcacatataaatcataatttttgaaaaaaacggttatttaagctctattcaatcctatgcttcttatctatactcttgctaaatcaattcgagttagatgcaaatctacgcttttagtctttcacaattacattattataggaggagttatatgtataaaacaaaattccttatgatcttgctaagctttactgtaatcgcttctttctctagcttgtccggcccttcacctagcaaggcttttgctgaagagaatggaactccggtgcagaaaacgatcgatttaaatgagggcttcgaccattcaaatgaagctagtatagagccattatcccttaccagtgaagaagctactagccaagcaacggttacagctgttgatcatgatgctaatttctcaccttcaacacttcagtttctgaaggctaatacaggactcgacggtgagcaatgggataatattatgaagctagtgaacaaaccagagcaagattctttgaaatggactgaattctatggctatgctgaagatataggcgataatcgcggatacacaatcggtatctttggagcaacaacaggcggttcaaatgatacaggacccgatggtccagacttattcaaagcttttgatgctgctagtggagctagcaacccttccattgcaggtggattaacacgtgctggtctgaaggggaaaatgagtggttcgattctaaaactcagcgatagcgatagtgtaatcaagaagaagatcaacgctctccaaaacaatgaagcttggagagaagccatgtggcgtacgttctatgacacctatatcgaatatagtgtacagcaagcacagaaacgcggttttaatactgctctgacgattggatcatttgtcgacacagcactcaatcaaggcgctactggtgattcaggtagtcttgaaggaatcctctcacgctcaggcagtagtacgaatgagaagaagttcatgactagcttctatgctaagcgtacattggttgtcgataccaatgattataaccaacctcccaatggtaagaatcgtgtgaaacaatggagctctctcttagcttctggcgaaacagatcttaagaacgcagatgcagctgtgatcaaagcaacgaattgggaactgaagtaaatataatatacgtcattaggagggcatatcgtatgtcctcctttatctatttttcatgaacattgagttggcgatgactgctaacaacatcccattctcccatacagttcctctcatcattcgagtatgtaggtcgcgtgtacaaatagagagactgtcccagaagcccgaaagttgcaagctcctgaaacagtcttgtaaaatggtttatgaagtcgaaataaggctgttagatgattcgatagccagatggcagtctaccgctactgcggatattacggatttgctgcaacgtcaaacgttgattggtagagataatagattccacatcattcccgcgaatcagatcatccaggtcggcgatgttgcgattgcctctaaacacacggaagttacctctaaaccgcgtgccagtaaagagtacaagggtagcattgctgctggtagaaaagaaacgcagactttcgatgccgtcgagaatgttatcggtattacgaatgcctaggtttcctctgaatactctcctggaaccccgaaaattttcttcgttgtagactgtaagacgtggatacgtttgagatacatatgctttgttgtccatgttgtaattcctcctttcaactttatcttatgcttcaccatccgattggcgcgggcctcgcagcatccatctaaaaatggttatatgattgaatagagcagacgcagacttgaaaaaggaacatatgttctgtataatctagcttagcaatttggaaaatcttgaactaacggagatgcggacatggacgataaatttattgaggaactacgtgaaattagcagaaacgacaagcgaagatccgaatttcttattaagggtatgaaggaaacacttcaggaaagaaaagaaaaaaactttatcgaaagatggatttggcgacaaaaaaataagaagcttatagcgcggaagtttaaatcctagtagatataacaactggatcttcatagcattttacttttcatagcactttacaagtgcttaggtcatagctcatttttaggaggccgagtcatgattgagctactagtcccaaacgacgatatattaaatcaaaatcaatttttggctgatgaagttcgatacaatttgatccatcgaatttgtgagtcagaagggtcaacatgcctcaaaacgtctgataaaaatatgatctttgctcaatcccccggacataaggcttggctatgggtctcacaacaaatcacagataatcataagttgacctatatagaagaactcttacgttatttaaaaggaaccacactatcaggtgtatgtggtgatgccaaaacagtcgagaagttcgcaaaagcttacgcacagcgtcatgctgctcaggtacatacccacatggtcatggaatcttatttctgtcctaaatataaaaagccctcgggcgttgagggaatgatccgacaatccatcacagaggatgtacaattagttgcccagtttctagctggtttttcagaagaggctttaggtagttctattgatccggttagtcaaatatcggttgcggagaagaccatcaggacaggaaatttgtacctttggatagtaaataacatgcccgtatccatggctaatattgctcaccgctctccgagacatgctcgcattaatgctgtgtataccccgcctaatttgcgaaagaaaggttttgccagcgcaatggtatccaagctatgttgcattttggaaaatgagcatttagtacccatgctatatgcagatttaaaaaattcggcttccaatcaagtttataaaaatatcggctttaaggaaggcggcaaaatcactgatattgcgtttgaataagccctcctactgcaagagagtatattattgctcattcaaatcaaacaaggcccgcaatgttatccatcgctgggcctcctcttcacttatctatgcactttactccgtaacacccaatcccgtgtgaactgaggatcttcgtgaaagtaaatatacagctacaatggcgatgacgacaccggctgctccaaaccaagtgatggaagccagcgaaacctgaccaacaactacaccgccaattccggctccggctgccatagcaagctgcatcgtagactgattgagactcagcatcacaccggaagattcaggcacaagtgtgaccagattatattgttgagtaggtccagttgtccaggctgcgaacgaccaaaggatcaataaagcaaatactgcgatcagggaatgagcggcaaaaggaagtaagagtaaggaaataccgtgcaacaccatgccccctaataatgtaaagggtataccctttttatccgcactgtacccaccaatttttgatccgattagactggcaattccgaaggcgagcaatactgagcttagcatatcctctcctacacctgatacattcagcaaatacggtgagatgtaagtatacgcgagtgaataacctcctagccaaaagaaggtaatacctaatcccaaagcaacttcaggctttttcagaagagcaaactgttgtagtaaggggactggtcgatctccttttaagcggggaattgtcatagatataacaattagggcaataatccctgtcaacgcgatgccgagaaatacggttttccagccatatgcagaagatatcattctcccaagcggcaccccgataatcagcgaagctgtaaaacccatagtgactgtagcaatagaactggcctgcttgccggctggggcaatttttgctgcaatgctcagtgctgtaaccacgaccatccccgccccgagggccataagaatacgcgcggcgataaacattccaaaacccggcagaataaaggagaggacattagctactgcaaataatccgagcgaactcaagagcagcttgcgtctgtcccatttagcggttactgccatcagaatcggcgtgccaatcgcgtaagcaagagaaaagactgtaatcagctggcccgctgcggacaccgtaatccccatagttgtcgcaatttgatccaaaatgcctgagataatgtactcggatgtgcctaccaaaaaactaacaattgccaaaatatacactttccacgtgctctgcatttttaaataacgcctcttttcttttgatatttttatatttttacaaatatcgaaattaagactaaaaaaaatttatgttattaggaacggggcatatttctgcgctgcttccacatccaagctgtaataaataaacgtcccctctttacggtatgtgagcagccccgactctgccatttgcttcagatggtgcgatagtgttgaaatagctacactgttcagcttctcgcccagcacagagcagcattggtcactttcctcttttagcagaagtgctattttgagacgagtgggttctccaagtgctttatatatttttacagcttgctgcatctctgttgtatctttcaccctgttcggctcccttctgttccagtcttaatttcgatgtttgtcgaaataaagttatcacaaacatttgtaaaagtaaacctgtttattataaaggtacagcttttttacactctaaggtgtgaatgatgttctttctcatccgatgaataccccccatccataaaggatggagggaaaagtgactgagtagagagggggaatcttggacgccatggcgttaattcgggcttgccgtgggtctgacaataatttcattaacatctacatccgctggctgctccatggcatacagaatggaacgggcaatggcatcaggcgaaatcgaaatacgacggtactctttcattccttgccgggcctcttcatctgaaatactgtcagcaagctcagattcggttactcctggcgataccagcgtcacacgaatatctccccccacctccaaacgtaacccttcagaaattgcccgaaccgcatacttcgttgcgcaatacaccgctgcagttggggttacactatacgcgccaatagaggcgatattaataaactgaccaaatccttgctttttcataatcggaagccctgccgcaatcccatgcagaacgccccgtatatttacatcaatcatgcgatcccattcctctaccttcagggcttctaattttgaaagaggcatcactcccgcattgttcaaaattacatccacacgcccaaatgttttttccgcgtacttaatgaacgcttccatctggtccctcttagtcacatccagttgctgataatcagccgatccacctttagaacgaatctcggatgtcagagcctctagtcgctctgtgcgtctggcccctaatattacatgagccccatggtgagcaagtaaacgggcagtagcttcaccgatcccactgcttgcccccgtaatagctacaactttccctttaatatccaacatgcttattcctcctctagtttaaaatatcactgaaacagattacttttttacttccctgtaaaaaaccatccctgcatgatacaaaacaccatttttgaatacaccatctgccgtaaatccggtgtcgtccacatattcgatatagtcatcttctatgatatagctgcctgtataggcactttgtctctgaccccgtgcttcatcataacggccattaggcaagagttcttgacggatatctccgtcttcagttacccacatccctatatagggatgctgcgaagcgtgtacacttttttccgctttgttactctccatgactcccactcctttgcccttctatttttttctcaattgctcattaggtgttgtatctgcatcttattatgagaggaatgtccatcagcccggtagaagaatcagagcaaattattgcctaatcctccaaagacccttaatatgtaataaactactgaaaatgaaaacgggctactttgcaaagaagggatgtgtcatgatggaggcaaccaaaatagagggttcaaccatggaaaaacaagccgagttggcaaggctcatagaacgattttcacatcaggacggagttctcactacagccataccttcgcttcacttcgtccgaagttcaaatacaaccgttccgatacatcaagtccatgaacctgccttatgtattgtggcacaaggcagaaaagtcgtgatgctcgcagaggaaagttaccattacggcacatccgactaccttgttgtgtcggtggatttgccgatctcggggcaggttatccaagcgtcagcagaagctccttatttgtgcctccggctcaattttgatccgcatcaggttttggatctgatcaaggaatctgctcttcccacaagcccaatgcctgattccagacgaggcttgtatgtaagccaaaccaactctctactgctggatgccgtgataaggctagtgcatcttttggaaaacccgcaggatgttccagtgctggctccattagtcattcgtgagatactgtataggattttacagggtaatcagggggaatccttaaaacaactggtcatcaccggcagccattccaaccggattgcagaagtcataaagcggattaagcaggattatgataagccgttgcgtattgaggaattgtccaaactagcgaatatgagtccttcgtcactacatcgacattttaaagaggttacggctatgagcccaatgcaatatcaaaaacaattacgtctacaagagtcccgccgcctcttgttatccgaatcagcggatgcggcagatgtcggttttcaggtaggttacgagagcccctcacaattcagccgcgaatacgcccgcttgttcggcctgcctccaattagtgatatcaaacgcttgcgctcggatcaggatcacccgaccatttgaacccgttgttagatgaacatctgaaactactggtcttactaacgcttatcccaatcatacatggtaggatgtaaaaagacagcacaaaacagccgctcctccggttgagacgcggctgttcaatatattcctctatgcatgtggtcatcactatttgagcatcaatacggattatccagcttgacgaacaaggctcgaatgacatccttctctgccgaagttagcttttgtcctgcctgccattgttgaatctctttcttgacttccttgggttctctatagctgagagcatacccgatgcttcctataccttgtgtgcggttggttttgtccatatttgccaatgctcgagtcatcgcagttctatctcttgtaaacaaatctcccataagaccagcatagctttcgcttaaagctccatccaatccgtcagaagcctggatcacatttgcaaagctttccgttggaataaaagcacgctgcctatatagatattcgataatttccaggctttgatgttcattgattttgttcatctttccccattggattcctgctaaatggtccgtcatatgacggacttttgcttcatcactgagggatgaatccttataaaaggacagcactagctcctctttactttgctgggtatgctgcgtattgactgcagtttgcttggaatccccattgtttgccccggacggcgccgcagtttcagcatcctgtcccactggatggggagtgcaccctatggttacagccagcaatagtgcagtacaagctacagatacaaacccattaccttttaacatgaatccactctcctgtctgaacaaacaatggacgttataattgcccaaaatccactcataccctactactcgtcacgtcccaccgtaggcttacggatcacggagacgctagattccctcacgatcagacgaggctcgaattgcacacgctcataatccccaggtgtctgttcctgaatccgcttgagcagcagctccgcagccaaccgtgccacctcttcccccatgatggaaactgagctgatctgaggagtcgttaccatagcccacaaattgttatcaataccgactacagcaacctcatctggcacctttacacccaaatccttaaatcgattgacgatccctatcgccaccatatcattaaccgcataaatagcatccggcatatgtttcaggctgtaaaaataatcggctgcacgcagtcctgtctcaaaggaaaaatcatcaccaaaataaacgagtgaagggtccacatgctggagagactgctcataagcgaagtatctctcctcgattttgtccttcgcagcgcctgcataggcgattcttgttctgccgattttaagtaaatgctccatcacgagtcttccctcttgtcgggccagactgacaatatccgctttgacatcttcgcccagcttcttgccatagttaataatggacacgggaacgctggctttgttaatcatgtctaccaacattttgggatacgccagcggcataatgatgagcccgtcgacatgcagcttcttgacctcacgaactgtttcaagctccattctggcattcccggcagtattgatttgcacgacccggtaaccatgctgcttggcggcctgctctacggaccaagcgatctctggaataatcgcgttacgaatgtctggcacggccagtgcgatttgtcgtgtctgacgaactttcaagctctgagccgaggtgttgggcgtaaaccccatctcttcaatcacttgcaaaatcaaggctttcgttctcgggctgatgccctcactatcattaatagctctggagacagtcgcaataccgactcctgcccgcttggctacatcctctatggttactttcttttgatctgtcacgcccaaaatcctttcaagaacggaatcgttttctgactttctaagataaagtcttaatgttgatattataccacagattgagtgtctaaaaattgaagtcgttttcttcttgtctttgcctcacctaaaaaattcgcaaaatctctttgtataaaagtaaggagccaaatatagcactgtagtcacaagtgattatattcacaaaaaaatcaagtgctttttgcattaaattggtttgacaatgtgtaaaaattgtgacatattatttttcggaaacgtttcctaattcattcacttttatagaagcaatgatcatatattcttcaaggagatgacaaacatgcaagcattgagatggcatggagtaaaagacttacgattggaaaatattgagcagcccgctgctctggcaggaaaagtaaaaattaaggtagaatggtgtggcatttgcggaagtgatcttcacgaatatgtagcaggaccgatcttcattccccaagatgctcagcatccattgactggcgaaaaagcgccgatcgtaatgggacatgaattctctggacaagttgtcgaaatcggcgaaggtgtaaccaagattcaagttggcgaccgtgtagttgtagaaccggtgtttgcatgtggagaatgtgatgcatgtaaacaaggcaaatataatctttgcgataaaatgggcttcctcggtctggcaggcggcggtggtggattttctgaatatgtcgcagctgacgagcacatggttcacaaaattccagaaagcgtatctttcgagcaaggcgcattagtagagccttcggccgttgctttgtatgctgttcgtcaaagccaactgaaagtcggcgacaaagctgtagtatttggcgctggccctatcggattgctggttattgaagcgttgaaagcttcgggcgcatctgagatttatgcagtagagctttccgaggagcgtaaagctaaagctgaagagctgggtgctatcgtgattgatcctaaaacttatgatgtggtggaagaactgcacaaacggaccaacggcggtgtagatgtagcctatgaagtcactggagtacctcctgtgctgactcaagctattgaatctactaaaattagcggacaaatcatgatcgtcagcatttttgaaaaagaagctccgatcaagcctaacaatatcgttatgaaggaacgcaatctgactggtattatcggctaccgtgatgtattcccagctgttatcagcctgatggaaaaaggttatttccctgccgacaagctggttaccaaacgtattaaactcgaagaagtgattgagcaaggttttgaaggtctcctgaaagaaaaaaatcaggttaaaatcctggtatctccgcaagcctaatatcgaaaacaaaccagatgtctgctttatacagacatctttttataaaaaaacgctctccttcctgcgacatgctgtcgtcaagatgagtagcgttttttgattaccatttggattactgagttacatttttcagaacatcgtcaatcatttgactgtttgcgattgtacctgtatacaaccagctagaatccttaccaaaatcgtatacatggccttctttaacggctggaattcccgcccatacaggatcttttacaatatcttctttacttacgtttttgctgttcacgataaagatataatccgcatccagctcggccagcttctcaagcgataaattactccagttcgccttagccgttttggaaatctcctgtacgacttgtggaatcttgaatcccaaatccttatacaatacatcaccgctggatagattctggtttacaacatacacatttttatccgttacccacaatgccgctgcagttttttgtcccaccgtctgactcagcttggatttagcctctgctgcttttttgtcgtagttgctcaatgcctgcttcgcttcactgctcttattcagcacctcacccacggtcagcagctcttgacgccaatcattgttcatattagtgcctaccacgtaggttggagcaattttagagtattgattatatttgtcgccttccaccatgctcgcactgtccataatgattaaatcaggtttgaagttcagaaccgcctcaaacggaagatctgaagcaatggtaggaacgtcaatcagttctttttgcaggtaaccttgaactgaatttttcccaaccgaccattgggctacaggtttgacccccagcgcaaccagatgatcctccagataagaagcgatcacacgctgaggctgagccggaatttttacctcatgcccaagtgcatccttcagcaccctttcctgtgatgttggttccgctgatgttttattggtcccttgggaagcgccatcggttgccgtaggacttgatgtgcctgagcacgcgctgagcagcagggtaaaactaagcaataaaataaatgccatggaatgctttgcgtttctattcattcgtaaaatcccttcatcatgattttgataatgattattatcctcaataacagtatgcagggcgccacttatcgaatcaatggaacattcagacatgcttaatggattatccagactggtatctctcacaaaagcagatgaatataggctgtcccggtaatgaaccggggatacacccgtatattttttgaatgcccggctaaagaaatagacatccgggtaccccacactgacagcgatatcctgcaaagtcgcatccgtcttccgcaaaagctccttcgccttgtccattcgcagttgaatcaagtacataatcgggctacaatccgtttgttttttaaataaccgggtcaaatgtctcggactgcattccaacaatccggccaaacgttccagcgttacggactccgcataatggatctgcataaatcgaatggcctgtgtcacaatatcccgcgcagaagttcgagccttcggttcctgcaattgccgtatacattcatatgcaaaatcatagaaccgaccctgagcctgaatcttggatagcgtctcttgatcctgccatgcttcatccagtagttgcagcttttgatacagtataaccggataaggcggtgcaaaaccatgaactatcgaaggatgattatacaccgtatgtccagatagagaagtcgctttatatagtacaaggatatattcaatcccgcattgcgagggtttcatattcagttcaaagcctttgctgccatgcagtatgtatcctgaatgtggcgtatccttccaatcaccatccaaacgcacgctaccctgcaatacaaatacaaaagcctgcgctggaagacgatacggttgaagcaactcttccggctccagtcgaatatgccggacatccatgacacggatcgacgaatggagccatagggacagcagtttgtttaactcatcagcttcatgtcccttgctcatcccgatataggaacctgcctgcttttgccgatcctgcttcacgtatcaaagcctccgcttcataaatatcatactttttttccaaaccaaccttattatatatcatcttttactgcgtctaccatgagacaaatattcctgcacgaaacaaggtcaatataccatttccatggtacaatttgtataaatacaagatttaaaatacatagggggtttgacagcatgagcggttccaacattgcattgagtacaggagctaatgcaccattcggtaaggaagatacagtgcgggtcaccattacatggaagcatgcacctgccgaactggatgttagctgttttatggtaggagcagacggaaaggtttcctcagatgactatttcgttttttacaatcaacccgctgacccgcacggccatgtacgattacagcgtccaaatgacagaaccactgagtttactgtagcgctccaggaactggaacgaaccggggtggaaaaatgtgtgtttgcggccacagtggacggcccaggtacttttgccgatgtggtcggctgctcagttactgctcaaggcaagcaatcccatatcacctacagcatcaccgaagccaccagtgagacatcgcttgtgctggcagaagtgtatcgtcatacgtctggctttaagcttcgcgcagtgggacgtggtttcaacggaggactaaagccgcttgccgaggctcacggtgtcaccgtagaggagacggaatcgccagcagcaccgtcagcggataaagctgacatgaaagaaacttctcctgtgagtggaagaatcaatctgcacaagcagaatgtacaatattcactaaaaaagaaacagatagaccgtgaaaaggcacgggtagcggttgtattcgatgcttctgtttctatgttcaaattgtacacgggtgggacggtgcaaaaagcctgcgaacgtgtgttggctgtagccgcctgtatggatgacaatggtgaaatggatgtatggttttttgcagacaaagccaagcgtgctccaagcgtcacagagaagaatttcgagaattacattcatatgaattatgctgagcctagtgaagatagtgagctagggtggggaaataacgaaccagaagtcatgaaggatatcatactaaaatatacaaaagaagatcccaacgatataatcccgacctacattatctttttcagtgatggaggtatttatgaacagaaaaaaatagaacaactgctgattaaaagctcgagcgccccgattttctggcaatttgtaggtcttggtcaagccgattacggaatccttcgaaagttggataagatgcgcggacgcgtagtggataatgcagatttctttgccttggatgacttcgactcggtgacggacagcgaattatacgaccgtctgctgaatgagtttcctggttggctcaagcaagtgcgggcaaaaggaatattgcggagctaatccttcaccgcaatgcgatactcctacatgatcacttaaatattcaccgagcagagcaataaaggcagaatgaccgcagatagagcaatcatcagcgccagcattctgcctctgttttcttcagtttgtcctctatcgatttcaatctccctaccagatcctatttctttcatttcctaattggatattttcatgtagtataagtctaattgaagtaaccctgtttgggctatgctgaagctatacactatatgaaggaggatttcatattgaaatcaaatgaagcaactttgcacaaaaagctgctcccacggcatattacctttatggctatgggtggagtcatcgggacgggtatttttaaaggcagtaccgaaacgattagcttggcggggcctggagttattttatcctatgtcttcgcgggactcctgctcttggtcgttatgggcgcaattgccgagatggctaccgtctatcccaacatgaatatgaaggattttattcgcaaagcttttggagaacgactgtcctttattatcggctggttgtattgcttcatgtggctggccgtctgtatcattgaggtcattgctgcgggaagcttcctgcaatattggttgccagatgttcctctatgggtactcagtttagtgagtgcagctttcattattgtcgtcaacatgctgagtgttggcggttttggggagctagaattttggcttgcgggtattaagattgccatgattattatcttcatcgccttgggtggctgtatactgttcgggattattcccactgaaactccaccttatctaagcaactacgcgcagcacggcggatttctacccaatggctggttggctatcctttcagcgctgctggtcgttaccttttcatacggcgggtccgagctgattggactgacgttgacggagacagaaaatccggaaaaggtactgcctagagtggttaaaagctttattcttcgcgttgttttgttctatacgttgcccattctcatcatttgtggcttgattccctggaaccaactggatgcgaataccagcccgtttgtacaggtattgtcttctgtagggcttcaaggctcggctcatgtcatgaactttattctgatcactgctgtactgtctgccgccaattcggggatttacggggctacacgtatgctacattcgctggctatcaatggagaaggtcccaaatcactcgcccgcttatcttcaaacggggttccggtaaatagtctcaaattgtgcgcggtagtcctgattgtcggttccatggttgcttatctcgctcaggacggactgttccgtattttgatggctgtacctggctttgtcgtgctgctcgtctggagctgcatttgtctgtcccaattgaaattgcgcaaatcttatccagtggagcctactttcaagatatggggattcccttatgtaacggcggtcacagtaggatgcctatgggtaattgcgttcctattcttgctggacccgcaaaatcgcattagcattagcgtgtgcctggctttcatggcatttctgatcatctggtctttggtgaagttccggagaaagcaggcgtaagcagcacatgattcaatcgtatctatttcctgtttcgtatgcctttcttgcgtttccttttgctgcgttattgtttacactgccttttctaatcgtgcaatatcgcaggcatggctatattcacaaagctagagcatggctgctttatttgatgcttttatacttgatgaacgtcttctttctggtcatactcccgcttccggcatcgcgtcataatgctgcattagccgggggagcgttgcagttgatgcccttgcagttcgttcatgacattataagagaaacttccgtctcacccgcccatccctccagctatgttcatttactgaaggagcgcgcttttctgcaggtcgtttttaacgttgtgatgaccatgcctttcggtatgttcttacgttattatttccgtgcacgatggggatggtgtctgattctgtcctttatcctgtccctcttctttgaggtgacacagctgacaggactatatggattttttgaccatgcgtatcgcgtgttcgatgtagacgatctgatggctaataccttgggcggtatgctaggctttctattaggcgaatggttttcacgcttcctgccccgcttggaacatctggacaagcatgtggacatggcaacgaagcgagtgtcctatacccgacggggcgtagcctttttcgtggattctatcatatggatcgggctactcggcatcatggagtctctgcatgttcctgctgctttctgggtttccagtggagtctactttatgggggtcccttacctgacgaatggacgaactcctgggaaatggctggtgcgtattcatcttacagggacgggacaacggatttccctgtgggggctcttcaagcgttacattctcttgtattggttgtattttggacttaattacgtactgggtggacccgtgctgtggtctcaagtctctccatgggtaagtgttctgatcagccttttgttgttggtgatgaatggatggttctttttccatctggtcatacgtctaatcaagaaagccccgttattttatgaggagcttagccatacttcgcaccaaattatatggcccaagcattatcatcatcctcagaatgacaccgctgattcggcagagacatcgggagaaaataccgtgacatgataaccgaaagactgacaacgtgataagcacccgcgatctacgttgcatccaagcaaataaaaaacaggcgaagcaaagggatttcctttgtccgcctgttttttttgttgtgtatagatgttagttcgttttccttatttccactgtgcaatttgatcaataggcaatcgtgtggacggatgaccatcgttgatacctttacccatggaaatgagcataacagggacataacgatctttttccagaccaaaggcttcagcaatttgatccttttcaaaaccgccaatagcgttggtgtcgtagccatgagcgcgtgctaccagcataagctgcatggataccaagccaccatcgatcaggaccgtttctttgttcacaactggatcaagcgctgcaaaatgggctgctactttttcctgttgcatttctttgacgtcttttggcatatagcccagttctacagcttctccgaaaatttgttcgaaattatcaaagttgttcaaatctccaaacacagcgatcactgccgaagatgtttctacttgacgttggttgaaacgggccaatggtgccagtgtagctttaccttcagggctgtcaatgacaaggaaacgccaaggttgcaggttaatggaagatggtgcgcgtgtagcttccgtcaaaatctcggtcatttcctcgcggctgatcttcacggacggatcgtatacttttacagaacgacgtcccagggcgatttctttaaaatcattcgtttttacagtactggatgtattcgtattattcattccaatctctccttgtccctctgtgggtatagtaatgttaaaaaaatgttgtcagtccatatcagatatgtgactattcatcacttgcagcatatcagctagttggtgccgttgggtctcgtcgaagctctgtagtagctgagctacaaactgcgagcgctcctgcttaaagatgacaatgcgtgcacgcccataatcggtcaggcttaccaaggtaaccctgttgtcctctggcttcgtgcgtcgtgtgaccatagctgtcgcttccagttgtttcaaatggcgcgttacggctgcagcgtcaatgccaacctctttttgcagcagagtttgactaatctcctccacttgatacaacttgcacaatagctgcaatctggatgcgctgactcctgcacaacgctcaaacttggagctaatctgcttgttcagcaacaacagcatgtcaaaaatatactcaggctcggatggtgtctgggtgatatcaatctctcctcccttaagcatatcgctgggcttgatgatccgacctttgatccatcaattattgatctatcaagtaatatacatcctctttaaaaataaatcaagtccctgagaaaaataaagtgctctttgcaaataaaagctgagcgactcacacagagccactcagcttttgtttcattagcttacttgttcaatcatcatgtaataggagataagggttggtataccgttaagttaaacaatcccgtgggacagcattgcgtcggccacacgcacaaatcctgcgatattggccccgacaaccagattgcccggtacgccgtattcctcagccgccttcacgctgttagcatagatatttttcataatatcatgcagcttggcatccacttcctcaaaggtccatgacagacgcatgctgttctgcgacatttcaagcgccgagaccgctactccgcctgcattggctgccttggctggtccaaacagaactccattgcccaaaaacacttcaatggcctgtagcgaggatggcatattggcaccttcgcctacagcttttacaccattgcttaccagcaactgggctgcttgctcgtcaatctcattctgtgtggcgcatggcagtgcgatgtcgcatgggatcgaccagatccccgaacagccctctgtatagattgcgcctggacgctcttgagtatactcgctaatccgcagacgattcacttctttcagctgctttaccagctgcagatcgataccgtctggatcatagatgtagccattcgagtcactacatgccacgactgtagcaccgagctgctgtgctttttcaatcgcataaatggatacgttccctgagcccgacacgacgacgcgttttccttcaaaggacgatccctgagcctgcaacatctcgtttacaaaatatacacaaccgtagccagtcgcttctgtacgtgtgagactgcctccgtaatgaatccctttacccgtcaggacgccaccttcatgtcctccgcgaatccgcttgtactgcccgaacatgtatccgatctcacgtccgcctacaccaatatcccctgccggaacgtcggcatctggaccaatatatttatacaactccgtcatgaagctttgtgtaaaacgcatcacttcgttatctgatttccctttgggatcaaaatccgagccgcctttacctccaccgatgggaagacccgtcaatgcatttttgaaaacttgctcaaaacccaaaaatttgacgattcccagatatacagacggatggaagcgaagtccacctttataaggccctatcgcactgttaaactgtacgcggaagccgcggttgacctgtacaacccctgcatcatccacccaaggtacacggaaggtaatgactcgctccggctccactagccgttccagaagcccctgctgcatatacttaggatgcttagccaataccggaattagcgaatccaatatttccttgacggcctgatggaattcattctcatgaggattgcgcgcgataaccttttcaaaaacggactgtacatattcggctgctgcttgttgactctgctctggacggatcatggtcattatttaatacaccccttttataattagcccctctgttaaatgacggaacgacgttattctgcaccttcgagagtggaactttatgtattcataaaatttagttaactatacatgattttttataataatacatctaattcgcctataaaaaatttttgtatccttcatcaaataactctatgaacctctcattgcctgttagtttattaaagctaaatcccttgattcacgggcttttttcacgatttctaaggccctaacaccttactccacatggcattataatgtgaacaaattgaaactaaaacatacagcacatctggaaaatatggaaataaaaaagaggctcgcgcagggcgtagcctcctttcccattcttttacacataaaaagcttcaagctgacgcacaatttctgcctcgtcatgctctaccacctgctgatgctgcgatttcgagaataattgttcaatttgcgtcgggaactcctgcttgatgtccaccagacggatagcttcatcaaatttggccggatgtgctgtcgcaaaggtcacacatacttcgtccgcgccattatacgcctcatacgcggcaataccgcaagccgtatgcgggtcgagcaaataatcgtactcggctttgtattttttgatcagctccagacactgctcattcgaagcaccgagcgcttcaaaatcctgctgcacccgtttcaaatcctctgcactgatcacaatccgtccatcggtcttgaggctattcatgtattcagataccttggtcgcatcttctccaaggaagtagtacagatatctttcaaaattgcttgccacctgaatatccatcgaaggactgtatgtgcttttaaagtcgcctggcttgtattcgcctgtcttcacaaagcgctccaaaatattattttcattggtggcaataatcagcttatggatcggcagacccatttttttcgcaagaaagccggaaaagatattgccaaagttgccggaaggcacactgacattgatttttttcgtacccgcagactcctgcgcccggaaataagcatagaagtaatatacggtttgcgccaaaatacgcacaaagttaatcgagttaattgcccgcaaatgatgtttagctttgaaatccagatcggcaaacaggtccttaatgaccttctgacaatcgtcaaagttccctttgacggacagattcaatacattttcatcgtcaactgtcgtcatttgcagctcttgtaccttgctcaccttttggtgtggatgcaaaatacagattttaatgccttccttgccacgcacaccctgaatcgctgccgccccggtatcgcccgaggttgcacccaaaatgtgaatgatctcattctgctttttggacacgtaggaataaaactcacccataaattgcaaggccacatccttgaacgcaaacgtaggcccgtggaacagctccaaaatagacagggaatcgttgatcttcttcactggcgtaacttccgggtgacggaagctcgcataactgcgctccaccagctgctccaaatcttcacgaggaatctcatcattgatatacagcgcaaaaacttccagcagcagctctctgtagctcaatgtagcccattgttctaacgtagccgccgacacagtcggaatctgctccggtaccatcagacctccatcgtcagctaaccccatgagcacggtatcaataaatcccttggcttctactcgacctctagtgctaatatatctcatatacatcccccaataaaaattcaattcgaaccttttttcgaatatattattgtctataataccctgtcgcggtgctgtaaccaagcctttttttcatatttcaaagactttctcctactttaccataccctgatgcatcaggcatctgtcatcgctaagcaatttaaacgtcaggaacagcccgtgagtctgaaaaaagaggccgctccagtcattaggaacctgaaatcgagagtgcagccagcttgagcgaaggggatgtgcagcttcccgtaaaacgcaaatcgttgccaacttcctctacctgctgcaacacatcaaagaagttacccgatacggtgatctgattgactgctctgatcacttgcccctgctcaatccagtatcccagacaagccagcgaaaagttaccggatgccgtattcgtacccgcatgcagtccttgcagctcgacgatcatcaacccgcgatccgtcttgcgaatcatgtcctccaacgtagacgtgcctggttccacatacagattatgatacgacacaccaattttaccgttatagctacccttggaagcattagaggtactttccaccccagccttgcgggctgtcttgcggttatggaaatacgtccgtagttctccgtccttgatgatctcgttacgatgggttgcgctgccttcggcatcaaacgtactgcctgcgggaacgttctccatcagcggatcatcaattagcgtaatacgctcgcttgccaccttttgccccagtttcccagccaatcgcgaaaagcctttatccaccgactccgctgaaaataccgatgtatacgcagccagcaattgcgctgctgcatcatgacggaaaatgactggatagttatccgattggatcgtgtgcgcacccagcttggaaacagcctcttttacggctttatgcgccacattcgcgatatcaatttcttccacgctccgcagggaataatcatgccaacccccggtaacggtctcgtcatggtctgctgcaatcacatacacataagcgctcgctagacttttgcgacgatggcagtgtagtccttttgtattcactatcagaacctcattttcacgaatgctgaccgagcaatgccgagccatcacaatccgtggatctgcggcaagcgctgtgcgctccatttccagcgcggcttcgatcagaatctcaggagccgtgtcggccaacgctgcggcataggcaggctgctcagggtagctctcagagcctgcgaacagctcatcctgttcctcgctctccaatatgtccgcattgctgcgtgcctcttccaataaaaagtcgatcacgtccggttccagcttctctgtagaggcatagcccattttcccgttaatgacaccccggaaggaaagcccaccgttttcgacgatggtatattggtcaatctctcccttcagtaccttcactgaggtagagcgtccatttacatagtagatttccatatccgcgtagccgatttcccgacctttcgtgaacaacgcttcctgaaattgctgaatattcatcgcctattcccccttccgtccgccgacggtcatctcggacactcgtatcgtcggctgtccgcagttgaccggaagacttccgctgaccgaaccgcacatcccctgaccatgatccagattgttgccgaccatatcaatattttgtagggtttcgatgcctttgccgattagcgttgcgcctttgaccggctcggcaattttgccgttgcgaatcatgtacgcctcttcgactgcaaaattaaactcgctcgtcgaggtgtttaccgaaccaccgcccagcgatttggcatagatcccgtactccgtattggcaatgatctcttcacgggtagactcaccattcgcaataaatgtattgttcatacgggacgcaggcgcgaatttataggactgtcttcgtcctgaccctgtcgcaggcacacccatctgacgcgagcccatgcggtcgatcagatatccttttaaaataccgttctcgatcagtacgttgcgctgtgtcggcgccccttcatcatcgatattgagcgagccccatgcattctgaatcgttccatcatctatagccgtgacaagcggtgaagccacctgctgcccgatcttattggcaaacacggaggttccatgggccaccgccgtagattccagcccgtgtccacatgcctcgtgaaaaagaacgccgccgaagccgttctcaatcacgacaggcagtctgccgctaggtgcatatcccgctttgaccatcgtggtcgcaatacgggcggcgtgtctcgcattttcttcgatattcagattctccaggaattcagttcctgcatacgctcccggcccgcgaaaaccagattgtctatgctccccagcggtcgcaatggcgcttattctcatgcgtgtatacgtgcgggtatcctccaccagcagcccgttgctattggcgatcagcacgttctggatcgagttactaatcccaatagaagtttgcgtgatggaaggatcgtattggcttgccgcctcatgcgcccgtctcatcatgtcaatcttggcgcgtttctgtgaagcgtcaggaatgatcgcaatcgggtggtggttaggaatcgcgtggggatggagtgtaatggtgtgtgtacctggcgctccaccgccgcgaatggccttggcggccgatttggccagtcgaatcaagctctgttcgctcatatcactggtgtaggcatataccgaaaattgctccttcatgatccgaataccaatcccaaaatcccggcctgacagcgccgtgtccacgacgcctccggtcatgcccagttgtccattcgtacggtcctcgacgaacacctctgcaaaatctccgcccgtctccagcgcggcttgcagcatatcctgaatctgtgttggatgtatcatcacgttcctcctcgtttttgccatgtttcttattgtacggttaagcgttcaagataatatgcgggttcatatttatttcccataactttactatacatgatgttgggagtgggtgtaactatctgggcggcagtgttgtgaggagcgtgaagatttcatgtgtggagattgggagagagaaaatgggaaaacccgatcagaccgtgaagggtcatgtcgggtttcttcattgaaaaaggatttagtggctggattgagaacgtatgtgcatgtaagaccgctagggggacgatcattcttttgatcgctgtagcctccagatttttttgattatattttaacggtaaaaatccgggttcaaaggcgaacactcagcttcttcagaacgattccgtccccttcgctgctgcttgggtttgcttcattttgtttccatttctaactgattagttaaaatacttttctctaaacggatatagtacaaaacatggtttagttcaatctccgttgagtgtaaataataagccgcttccttaactgaatccatgctcaacgctcctgctttggcagcgataatgttaaacgcatctccaagtaatttaatacaagtttgaatcctctctgtgtattgcttttcaagttctactaacttttcatactccgctaccatgtcactctgagaagtcaaaatattccccaccttttggtacgtatatgagtaccagttttacaaaaattatatgttacgtttatgcgtatcgtcaagaaaattttgtaaaataaggtgggaaacctaatggcaaagaaagtagttgtgaaaattaacgaaattacgagaacacacaatatctccttgagagaactctcacgtttatctgatgtacgacacgctgctctaagcgaacttcaatcaggtaaacgtgagagcattaattttaatcatattgaaagaatagccgaagccatggatattgaagatattcgggagattattgatttggttgatgaggtagaacaagagtagttatcatttgctattattccttacccagaaacccataggtatgccgagcaacctcttgaccattagtatttgaatagagtactataaagcccttttccagcaaacgtttgagtttgtcattattctctttaccacgtccacgtccagtttcgatggtcatgattgggaagagatttttctgaacggattgctattattggattttaagttgaaagtatcttaaatggttatgtattctgttctagcatcgaatttcttgttcattatttttcgtgcaaaatataatacatgaaggtttcacttgtttgtttagcatctgttaaagtgtatgccagcggaaattcgccagtttgctctgttacatcgtcaagttgatattgccatatatggtattgtctttttttgattacgttatcctccgatattttagtttaaacatagaactaatgttcttattttattgtatcgtatacatgttcgtattaaaagagtttactttggaaaaagcgttccttaagagaagaaaagtttatgttttgaaaacaagtgagaataggacgaaaagacccagcacatgctactaggccgttgaaacttgaaggttgtcccgaggccacctttaaaatcatgaaaacagaattcgtaaaccaaatgaactttcatagccttcgtcacttggaactggaattctgtgatgatgtgaacttgtataacaaacaccagatacatggaactctggattatatgacatccatcaattacagaaaatagcccttaaaaaagttgtttaatttactgttaaaaatctaacacctcccttttgattagccagggcgattaccttggtcatcgcatttcctcccttcgacgtaaaaaagccgactgcgctgaatttcagggcaatcggctcttaataaatatctatataaaaagagagcgtccggtaatcctggcgctctcctggtcacacgagatgattttaatttcaagataagttattcctctattttaaataacttattttcctgagataattctacaacaatatgggctttatcaagtaggcttacaggcaacttatccttcagaatagaaaccactaattgaatattttctttacttacataatctgcaactttaatcagttgattatcatgcattaattcttttttgtcatttagaaggaagtgcaaactcggtattttttcctcatcagcaaataatatagctgcaagatcaaagcataaaatctcaccctgttttttgcctgagcttaaattagcattgaatgcgctgaatttatatatctgctgctggctctttttatgaataactttatcatacttcaatgcatacttctcaccgtacaattcaaaagaaatttcagaaaaatgtttattaaacttatgaatttggcctcttaacttttcttcaaaacttcctgaaaataaaacatcatcaattactttaatttgagcatcaatctcactaatattttcctctacttcatctaattgcgagataatactctcatattcacccttaattctatacttatcattcaactcagttataatcttttctaactcctcaaaggagtcacctttagatatagtcattgccaactctctctcctgagataacaatgtatttaagttcttttcttcagtctcaatttttacagttaaagaaggtaaatcagcagttataaacttaattttttctacaaccatattgttgtggtacgctactaactcttcaaaggtcttttgtaagttagaaatatttgcattagcctcagcatacagtacttccaattgcttcaagtcaatattagctttgctattttcaatctcttttttagcctcttctatgaggttctttctaattttcattttacttatgtttgaactacttttatttatttgaaattttacaaagttaagttgatctaactgattttcaaaattttcgttcaaattgaaatttgattttttctcatttaattgagctatttctgcttcaatcatttctaaagcaatttcataagctgtttttgtttgctttttttccagtctttccttgaaggcttcttcttgttttatttttgccactaatgcttgcttctttgccccttcatcaaagtcacaacctaataagaacaaatataaagtctcatattccacatcagaggtatacttgtccaaagtcttaagtgtattacttatattctcatccttgtatctaatattgtgagagatgatctgtctgaatgtgggtttctcagccttatggtcgggaaaaagaagcccctgtaactcgtcttcaaaatccttatcaagtattgacttcccattaattttcctaatgttcttttttcttggcagaaaattgcgttcaattactacttcatctgatgcctcatctgataaatcctcaacaagaataagagtaatcaatacttcttcggttacaagaaaatctttaaccaactcatagacttcctttttattctctgtatcagaatatattattgaagcgttagaccctaaacaaaagtcaattagctttaatactgttgttttccccacattattcccagtagatttatcatcattggatggtgtttcgtcaatgattaggttcaaaccggattgaaaagtcagctctcttattgtccctgcgcgactcgttattttcagtgtttttatgaacataattccacccatccatcatcgtctatctttgcagaatcaattagataaagccaatctaaacaaagcatgaaagtgggaaaagacatgttatattggcttttaatcctatgatacagatcaaatacttgttgtttggcatgttgtttaagttctttcaaaactaaagatccattatagtaaatgctaagctgtggatgtatattatccggcaataacatggctatatccctccggattcttaaaaattttgcatcgtataaaagcatctacgactaaaatacagacgcagagttccaattcttcatacggaatttcaatataatttttgctctcgataattatcttggttatgttatcaattatactgtagaaaagttctttagagttagctttttcatgttgatgcattgtatactgctttttgataatttgaaaaacggaaaagcttttattcgagccttccctatcaaactcagcatatttttcatctaacttttggtaaaatatcttgtaatcatcaattgtgtctttgacatccgataaatcattgaaggttattttcttatcaatctcaaaggaattaatctctggcgattcaatacagttagcaagattctcatttgcaagtatgtttatgatggtcgcaagattcgtatctactttaagtagatcaacatcatttccaagttccttttttacaaactcaaatacctcacgctgtttgtcgatttccatgctcagtataacatttaataatgtgtttatatccacaatgtcatccgtgggagaaaaagcagcattatgtggattaataaaacccatatcccgaagtttggttgcatccttagcaattgaaacaaaaatgaaacggtaacctgaatacctacggaatatatccttatttaacgagccttcaattttttgttttgtacaggttgaagatacttgagcaacaactttgtggtttacatccaccaaatcaataccttcaacattctgtttaagtatattcatattaaccaacgtaagtccaaacaataaattcattaattcggcaaaaaacgtctctgaatatatattcaaatccaataaattgatctttcctcgtttttcaattcgtcttgccaaaacctccagcttttcttctatataattgaagtatttacttcgattcattagtcatacatacccctattcagaaatgattttaaccacgttcattgactattcgacaaatcattggaaattcctcttcctattgaagttcaataaaaaaagcgtctaataaagacgctccatacactttactacatgtctacacactcgacgtcaaaaaccaaggttcagcacgaccgaaacctcgattttgtccttctcaccttattttgaaatcagcgccatccttcgtgaaggtcatgaaacccgcaaagtgttgaaaacaaaggatttctacgtatctattcgtttcccgtgccccttatgcatgaaaataatctatgttcccgcactcaaccctaaagcgattttttgaatgcaggaacatattcaaattaccctctagccctcgtacatcaatgcttattatcccgatatattactaccacgcacttcacatgtatcgagatgatggaagggatatactacctatcacctcctacttatatgttttttctactttacacttctctcctatatcacctgcttccaaaaatacacatagtaaatcccccaaccaatgggccattctgtaaactaaatctctcttttaaccgataaatacatatgctgggttgtttattaaatatcacctctaaacctgtatagcgcacaaaccttgtaatacatatctatcttgactcacagttcaagatgacgtgcttcacttggaaatacccatcacatatagaaaggagttatgaactcacttgagcgtattattagatgggattggatatgaaagcctacgcttttatggtccctttcagccactacacattgaacaacttcaaataacacgcgccattaacgatcatgcctatttacatatcagtggcatgctctccgaagaacagggagcagcttgtatcggtcaaaatatggagcaagagccgattgtgatccgtcagttgaatgatcagggacaatcgttgagaagactgtttcatgggattgttacacgtatgtccgtacactgtgtgcgaggcgtgtatacatttgaactggaagccgcttcccattcgtaccagatggatattaagcgtaaaaggcgctcctatcaagatattcaccgcacctatgatgatctggtcactgcgctggttcgaaaatatcaatacggagatgccattgatacggtaagcaactatgccaaactagagacatttgttttacaatatgatgagaccgattgggcgtttttaaaacgtctcgcttctcgctttggttccgtacttgtgccagaggtaaccgcagcctcgcccaaggttttcttcgggatgccagaaggcaagcagcataaggtggaacgggatgtattttatcgagtacgaaaaacgtttcatgagctggatgcggaaaagcccggagaacgtgctggctcgtatgtcacgaaagcctgcaattttatgcactaggcgacctcatcacgttacctattggacaagacaaagagctggtcgtggttcgagcagtgacaaccttagcagatggcttactgcgtacccgttacgatcttcaagccgaacaagatatccgctatgcgcggtatgaaaacgatcaggctactggaatttcgctgacaggaacggtgctcaaggtacaacaggattttgtacagcttcaactggacattgacccgaagcaagatcctgccaaagcgtgctggtttccggtgtccacccgttatgtcgccgaagaacatagtggctggtacgatatgcctgagatcggggaacaagtggaattgtatctgcctacccaccgcgaacaggatgcctatgtcacggactcgctccgacaacaacgccacgcgaatggacagcccgatatgaaggtgtggcaacacgtgcaaggaagcggcatagaaatgtctgagcgagaactgaccctgtccacctcggatgaattttcaattacactaaatgaagatggtggcattaccgttaacagtccggggaatgtgcagattcagggtggtcatgtgaagctgggtgcaggtgaggaactatcattggaagctggcacggcgctatacttaaaaggtggagccagcagcatggtattggatggtgagacggataccaaggctccggtgatttatcaggaaggtacagtgaaggctcctgttttcgtagccgacctccctcctgttccagaaccgccactcatgagcataaaagcatatgaagcagctcaatcagcagccagggattcatctagcagccaagcctctacccctaaagcaaaagtcaccagtccagcagagcttcaacaggcgaatgccaagatggggacagtatccaagctattaggctccattccagtaatgggaaaagtggctggcgttgttatgggagcactaagtggacctgctgcgggtgtgattctgcaagccaccgcagcaatccctgttcgtagcaaaggaacacctaccgttagaaacagtagcaaggggaatggagttcatccgttaaaatacttggctggtttaacaatgcagggactggtcagtcaatacgagtatgagcgagctcaggaagcctattataacaagtggattttggggaaagtgtatacaagtgctcgtcatgtggctcattccggtggaacattggagctggttcaaaacttgctgaaagagtctaagatgatggttcatgcgtatcagcaggttcctaaaagtgttcgtgaaaaatggattagggattatatgaagcaacaacctcctcctaagccgctttccccagaagaagaaaaattacagagagcaagaaagtatgcgcaaagtattcgtgactgggaagctaatcgtcccgaaccccctaaaaaaagcattggcgaggaaaccacactctttttccagggcatggaggaaacagttcaagcgaacgttgaaggcttgaaacagttaaaagatgctcttatcgagcatcctgtggatactataagtactatagtgtcgggccaatatgaagaggcaaagggagatttggtatttgctaaaaattatgttttggatcaggaaaatgccagagatgagtatctcaaaggtttaaaagaagacgataaacggatgttagagaagggccaaagttacatggagggtgagacattagctgggatgctaattagctctcttctgggtaagggaaaaataaaaggtggaaaagggacacatcataattccaaagatgtttcagaaccaaaacccttgaagccaacgaatgagccgaaatcgagtctaactaaaactgaggggacgggtaaacctaaaaccagaatagatattatgaatacggttcaagagacattgagtcctgctgcgaagaaaataaaagaattagacccggatgctaaagtggggtataggggttctttggcaacaggtcagaaaggcccacataaggggaacgcgccatttgatccaacggactttgatattgatgcatttattgtcagtgataagctggcttcaaaatttcggattgatgatacatggaggtcaggggcaaaaattaaagaggttgaacaattacaacggcaagccgataaaatccttaaagaatctttagatggtctaaggagagtggataagaaagggagaccagacaagcttacttttcgtatatttacgcaagaagaatataaccaaaaaattaaagcaggtactcaaataattgatcatgattaggagaaaattaatatgaaaaaatacccttactttatttgttccctaccaatagaatctgaagaagatatctttggtgttgcaaagattatttcagataaactggttggtggtattccatttggtggattagaagattacatttatgaagaagttccggcagtatatattaatgcaaatatattgggttttgagttagttatacaagggtatggaggagatggtggatatttattagaagtcaatccaagcccatacaatgaaagcccagacgatactgaaagagtgacggtagaaataacaagatacattgcctcacttttagaaggaacggaaaaaataaaaataaaatatgaacaaattaatgaacagaactatattgaaatttctgaataggtcatttttttacgattaaaaaactacccaaagcttattcctacttgaattatgagtggggatgggctttttttatgaaacaatgacttgtcatccctctccatcagagttaacatacacactcaaaccgcaggaggggaagagaatatggatgagaaaattaatttactatataaaatgcgttttatggaaaacgagggggacaatatagaggtatttgagaatattctgaatgaaatgtcccttgaaggaacgaatgatataattctcgatctctgtacaatcttcgaagatgaagttgctgaaccgctagctaatgattatcttattgaaactatattttatattgcaaaacgtaatgatttagaagaaggcttatacaaattggctacgggtactcccaacatgttaccccatgcggaattttgggcagagagaatccaccggacacttttaaattcaaaagaattagtaatttcttacggtaaagctttggagaaactagaaaattcaactaaacagacaattaaagaaattttaatggtgattaagaatgacgctccagatttatatttagataaggctaattctctattagaaaaaataagttgaaaatggggatctggctgaattgtatatacacagttagccctataatagatttttcaaaatatcgtcgtgatcacgatcacggtttagactgtaaatttaagttaaaatacaaacaattttaattttatttcatctaaaaccaaagataccgtgatggatcacaaagaaaaaacaaggaagtgtacaaagatgaaaagaactgatttacctcttgtctattcatgttctggatgttcctccgcagcacaaaccgctaacatgatcgctatacaaatggatcgagaaaaagttgcagaaatgtcctgtattgctggtgttggtggtgatgtcaaaccacttgtcagaacagcaaaatcaggacgtgacatcattgcaattgacggctgtcccttgtcctgttgcaagagttgcttagcaaggcatgcagttcaacccaaacaccatttcctgctgtctgactttgacgtacccaaaataataggtgaagatcctaatcccgatcattataggaatgcttacacacaaatcttagaacaaattggacaataattcttaatcaaaataaaagtgtgtatcgaatttttactggtggctcctaacacatctttaagggtcaccagtattatttttatacagcaacatctttttaataaggggaataattatcgaatgtttaaatgaatttgtctcacaatttaaaattgacaaaattcctatgtgtccttgttcaaaagaagattttttatgtaccagacttaaagagcaattagtttgttaactgttcccaaactatcaagctttatttcttaacgtcaacatgtaatgttccattgatcgtagtagtatatattgccccccccccagaaacctggtacacaaattctcaaaccgacgttctaaaggagtggatgtaatgtatgaaatactaaataaaatacaaataaaaacttgatatatcgctaataaatcataaaaagacacgaaatacggtttttaactggaaagtaagccatgatccagtaaagtataagcggaaacagcagcatttttacaaaataaaaaaacattcaatttcttcccttatcatatgataatttgcttcttacctcttcttgaaatgcagtatccgttaataatttgtaaaaaaacaaatccagcttctgcttgagccaaatatgatccaccccagaatcatcttgaataaacatggctagttgaatgtcatttccttcccgatccgtacaatataaagcctctgttagaacagaaatggtagatccacctttgtttccaaactctattaacttggagttatccacttgtcgctgaattagcatttttagatatggatttatagtagaaggaaccaactcccccttgtgtataagcttcatgaggtaagcatattctttagtcgttgaacgaggaagtttgcgcgattccagcacttgaagctttcgtacataattctgcctggtgttccatttctgaatacattctatcccctgatcacgatttaaaatctgatgaatttcaatagattttttcatatattcctcgtagctcatctcacttatcttttgtatcgactctttaaagcctatgttttcggtctcttggatataaggagacatgaatcccgcagatgaaaaaggaaagattttatcatgggaagaaagtgagagcttcataatattctcatttatcttatccaaacccattttttccatcagaaattctgtattggcattggaactatatgctaacataccgtgagtaatatccaataacgtaattttcccttgaacctctttatggtttgagcgaatggatttgatccagttatgatgagcgctaccatcggaaccagggatataaaatttatttaattcctctaaaggaacaagttcctgctcgtctaatattttcgctgcaacttggcgagcaaattcgatagcaatgatcactttggccgtgctggcaagcggcattttaacttctgagttatagctgattttctccataccatttttgatcataaacaaagatgctttactcggattttcctttaaaaaacttagaacatccatttctgtttttttattattttggcgctttgcaatgaacaaaaacagaatacatatgagaacaaatattaaaattatagctactaaccataaaattattttcatactttgctccttaatggacgcgtttagactgaagttcacataagtcgtcacagctccccacgggaatcacttttcttttagaagctatataatcatacaaataaccacctatacccatttttttgaaaataattataaagggaaccgcccaccaaagatacggtattcttgtacaaatttgtgcaatagagtcaattcaacgttgtattttactggaatcattcattgagaaactatgcattcacctttctaattcattaacaaacaggacaccaaccatcatagaaaaccagaatttgtttgtgttgaaagcttacatatcctaatcttcttgtttttcttcgaattgtaatggatattttccggaaactgatctttataaaatggtataaatttttatattttcaaatcgaaccccttttccaaactttttctgctatgcattaatcgttattattgctcttcaagccttatgtaccagacttgaagagcctctctccatttatcaactagatcctcattgaagagcaaaataccaatgcttcctataacatcattttagcagatagtcactttaatacactttaccaaaaaagtgattgcctttattctccactaaagcttttagcccattcagcaaccctacgactactttcttcttctgacaaatcctcgatcctggtcataatagaccatcttactccacaaggatccaatatacttccgaatcgatcacctgaaacaaagtttgtaactggttcccttacttttgctcctcttgctaccgcattttcaatgacctgatcaacatccactacgtaaattccgaaagaataacacgcattctcttcatctggcggcaaaaccaattgatatgccggattcgctgctcccagctgcaaaaaaccatttccaaaatctaattccgcatgaacaattattttattgccatgctcatcaggatattcagtaatatccttaacccttgcattgaaaaccgttttatagaactctattgcttccgaaggattcttcactgtaataaaaggggtaatagatgtaaagccgttgggtgttcccttctttgtatatttacctgacactcctgtatattctctgctttcagtcattttgactcctcctttaaatgatcgtaacagttctattttgtgcttatacctttattggattgaattcatcaactcatagtaatatttggatgcgcgagtcttatttagactataccaggcttctaatgttttagaagaaaacacacccagagctttcaagacgtgtacggaaaattccaacggagctgttccagatgcagtgatcagttttccatccgttacagcagactccgttttgtaatacttttcgcccgtgtaggtgggacaggtcattttgagatattccaggtcattgcttgtatgccaacgtgaattcagcaatcctatctgggcaagtcccatggtagcaccacaaatcgccgccacccatataccttcctctaaacatctttcagcaatttttaagatcggttgatgaatggtttctgtccatgtatttccaccgggtaaaatcaatatatccgtactctcaatgctgcactcatccagtttgatgtcaggcaggattttcaatccccccattgtggttacaggagtcttttctattcccacggtaactattttggatggaaacagcccctttttataatatctccccgagttcagttcggcagttaagtaaccgatctcccagtctgccatggtgtcaaacacataaagatataccgtactattcattcacaagttctccttatttaataatttatcaagtgataccaactctcggtaatccatgattatcctcattataaaaaagcttcactgacatctgctgtcagtgaagcttttaacgttgataatattccattaactccgacgcaacagtaacaagctttttcttcaaactctgtggttcgatgacttgaatggacttcccgtaggttaggagtaaataagggacatatgtatgaagtgatttttcctcaagcaaaaagattgcctgattggatacccgctctttcagatgatgccccaaaaaccaatgcagacataagtcatccaatgcctctgacctgcctccgatcgttaaagaaattaaaccgtccttacccactaaatcaggtaacagatttttcataaaaaattcacgggccgaaaaagcttcggaacgcttaaataggattggagtacgcttgatttgtagaatccgatctgcccgaaagctacggatctcatttcttaggtgacaaaatgcaacagtgtaccatttgttgttccagtaaaccattccataggggtctatcaccctattcttgggttgttcttcatggcttgtgcgataatccatttctacagagaattcgttggctacagcttgctccaattccgccaatatcggctgaagagaagggtctcccatgcgattaataacttcaaatccggctaaatgacggctaagtatactttcctgctcttgattcgaatacattttcaattttgatgttgcattgtctaatgcctcactcaaagggtatccagcctcttttgcaaaaatagcagcatgaaggagtgcctttttttcctccatatcaaatagtagaggcgctctgataaaattattcagcaagctatacccgccattatgacctgtgtcggatattatcggcactccactggcacatagtgcatcaatataccgatagactgtccttatatttatttctaacttttcggatatttgttttgcagtcatttttacgcccgaattcagcatccatagaatggccagcatattatcgttttttggcataacatgaatcctcatctctcattaaagttcaatcttttataaatatctttttatactctctcttactacctattatatgcttttttccaccttatacttccctctcatatcttctaattccagatttacacatagtaaataccacaatgaatgggtcattctgtaaactaaatctctcttttaaccgataaatacatatgctggatttatcaataaccacattactagctgggaatctcataataacatttaccaaaaacaactatagaaggagagatctatggataacatcgtgacatacggtcatatcgaaatcatgccttatgagttcgtccgccttcatgaatttaaaatcttaaaaacagtcaatgaccatgcccgaatgatctgtacaggtatcatttcggagaaaaagcgagagctgtacgtacgtgcttcggatgaagaaactcaggtcaaagcttttgttacggacaaaaatggcaatcgacagcccctttttcgaggcattgccttggatgtggaggaaaaagtcattcatggggtccattacctgaccgtcgaagccatatctcatacctacgagttagatattaagcggcatcaacgctctttccagaaccccaagctcacctatacgggtctgatcgaaagtattgtatcggactactccaaagccgaagccatggatgttgtgtcccataagaagcccatcggcacctttatcatgcaatatgatgagaccgattggcaatttctgaaacgtatggcctcccacttctactctccgctcattcctgcggtgggctatggagtgccgaagttttattttggcctgcctatgggactcagtaaaggagaaattaaatctaccaattataaggtcaccaaacgggttgcggattttcaaaccgcttcagagaaccatatccctggcgtacgtgatgctgattttatccaatatgaggtcgagacggagaaattactggaacctggctatgaagtaacctttcaaggtcataagttgatcgtagctgaggtgctaacggagatgaaagacggggtgctgacccataccgccaagctgtcaccacgaagcggcttacgtccaattaaagactacaatcgctccattatcggcgcttccattcatggcaaggtactgagcgttcgtcgggacaaagtccgcgcccagctcgatatggatgatcagcaagacccgaacacggattactggtttccctactctaccatttatgcatctgcggataacacgggctggtattgcatgcctgaagacggagacagcatccgcatctattttcccagttataaggaagaagaagggtacgcgatcagctcggttaaaagagaaccacaaccttccggtggaaaagcttctgttacttctggacatgccacagcttttgcttcgtctgctggatcaaagtcttctgcggcagctcctgcgccagatcgaatggctgaccctgccattaagacgctgcgaaccaaatacggcaaagaaatcatgctcgctccggatcaaatcgttatttccgggaatggcatgtctattatcattaacgataaaacaggcattgatattgtaagtggaaaaaatgtgagtattagcgcggcttcggatattgttatgagttccggtaacatccagctttccgccggaaaaatcgagctgtctggtaaaggcaacacgattacgctggatgacaaaaccaccttctccggcacggaaattaagatgaactaacggaaggtgagaactagcagatggataaacaagcggcgttacaccattttaaagagcatcactttacacctttgctggacattcagttggacatgctggaagccatgtttcatcgctaccaagctcaactgattttcgatttcaaagaatcgttcagggatttgtgtatacacattctgagcatgcagcaacaaggtcaaaaagaacccattggatatatccactactcattcttgcgcactcaaatgctggagcaatcctacctctatatgatcgatgcttactctgctgagtggtacgaagatgattccgattgcaagctaacctatgacgcatcatgggcttacgcaccgatgagtaccatgttggaaaccttggagcaggaacgaaaaatatatatggggacgatcacttctgtggacgttgaacgactgatgctggaatccgctcctttttttcaccagtttgtgaactccctcctgcgcttagggatggcagaagtggttcaaatgcctgagtatctcgccatttataaagctaatcgtgtagctatccgaacgggcgagtacaaggatatcagcgagaatctatatgtcgaagatcaggaagcacttcttgcagatcatgtgaaagagcaattgatacattccagtgaagaagaaccctatgtttacgaaaacctaaagcggctttctcttccccaccttcacctgatgcaaaaggatttgcgctataacgattttagccacagtgacttacggggaagccagtttcacagctgcatattgatcggaagcatctggcaacgagcgaatctggaaggaggcaactttcagggatgcctactgaccgatacggattttagatatagcgatttgagaggtgctaacttcaatagtgccagcggacagccgtatcgggaacatggagttcgggtgccggggctatgtgggcttcatttcgaacacgccaacctggatggggctgattttacagatgtacattcgtttgaacatgcatattttgagggggcttcgatgaaaggaactcttgtcccacgaaagtaccaacagtattggaaattaagcgaagcacagcgtcaatctattgtgtggacggaataaggaggaatgtgtatgcgccattattatgtgctggtcgatgatcatcgtatttcccgaaacattaaaccgatgaatttagacctttttaaaacgccatttgttggcatgcctccggctcaggttttagatgttcatgcgacagaagatgccgagtacacggactggctaccgttttcaccctcacaaccgctattttccgattctatgaaacggattctagaactatacaatacacaagctcgttttaaacaggtgtatatcgtgaaccgggaacctagccgtcaagaattatattggatttcatctgttccctctgtggatggcatttcagaacagactgaattttatgcgcacgaccaaaccttaaaacgacttgtgctggatagccaaaaggtgaatggacatcattttttccgactctccaacgtgagggaaccttattttatcattagcttggaggctgctgaaagtttgctgcggcggagtttgagtggttttcggctacaaaagctagaactcttataaggaggttcaaccttgacggagcattgggatgaattttttttaaaactgcatcatcaacaaacattaaaagagcaattaagtacagcggagaacgatgaaagctggatgatgatatctattgaagaagcgatagagggaatttcgaaaggctcactaaccctaccgaatgaacaggaaattcgatttcaaaccctttctgtctttgaaaatcaacacaccatttccctgcctgactctcttattccagaagttcgggctggacagacggtagatccgtcgaaaagcttcgttgttcaggacaagctgggtggaatcctgttaggtctgcaccaaagcaggcaagaactggaccccacgcaaatagaaatctatcaacagcagatgattgagcaaacgagtcgcgcacaaccaagtatgaagctcgtggatgaaaaggctctttctattcaagataccatcattggttgttatgaagctatttttctagtttccccctctccctattatcagattgtctttgtgcgttcctggcatggcaaggctgtgatcggaagttgccaatttaagctggaggatgctcccctctgggttcccttaacctatgccatgctgcacaccgcaacatggtcggagctttcttgattttataccttttattcaaggaggtacttgtatgtttttacctttacttattaaagctctagctcaaggtgcactcagcggagaacattcttatgtggtgagaggagccaagctacagtgcagtcaaggcacagaccctggtgtgctcaatatgatgtacagccacggtgttttcattaaagataaacccgttctgaacgtggacgatgccatttgtggagccaatattagcaaaatcaatgcttttggattgtgtaaattgaagcagggtcttccctgtgaaccggagattgcgtttgggtccaagtggacaggcggtaaggaagacgtattgattgagggggcgcctgccctactcaacaattcgaccttaatgtgtagctgtcaaggtgtacaagaggcgatatcctccttttttggtgcagacagcacgggatctggtggtggaggtatcatctccattacagatgacggacaggatggttgattttatcaagcaaggagattaaggatgaacatcgtagcgaaagaccgctttacctatcagcacttacatgtcacttggccctatggcaagctgcgtcttcacaacgtccatatgagtcacgagctgggagaacatgctagactggtgatcacgggtagtctagaagccgatcaagcagacacaatcattaccaaagcaagcagtgacgacgaagttgagctatggtattccgatgccaaagatcagaagcatcccttatttatgggacaactatactgcttagatgtggagcacagacatcaggagatcgtggtaactctcgacgtcatttctcatagttttaaactggatacgcagctcaaaaaccgctcctttcagcacataaaccagaaatatgttgaaatcgtcgacgcagtgctggccgattataagggctcggacaagattgatgaagcttttgagaaaaaagcgacaggccagtttatgttgcagtatcaggagaccgattggacttttttaaaacggctggcttcgcatgtgggagcccttctcgtcccaaatatcgtttcacaccatgcacaaatttggatcggtattccgcaagcgagacagcatattcatttgaaagaggttccttttgcgttgcagcgcaagattgctccctatctggatcaggaggcgaatggctggaaatctgcccatattgcagactatactcgatatacctttgagtgggatcgaatgctgcaattgggagatgaagtggagcgcaatcacgaaacctacgtcatcaccaaacgtgaaggacagttgattcgcggcttaatgacctggtcatatgaatgcgcattgtcgcaaggcttgaaggttcccaaaatatataatcgaacgatcattggcgccgctattgaagggaaaatactagatgtcagccggaatcaggttcgattgcatttggatatagacgatcagcagaatcccaaggatgcccaatggttcccctattctgctgaaggtaatcaggtttggtatctgatgccggaaaaaggtgcgcaggtgaagctgtattttccaagtgctgacgaagacgatgcgatggtcatacaatcggtccgaacgaaaccatccagcgttgctgtcccttcatctcacgcagctcaaggtgccgtggtcgaatcgcctgcagtacgccaccagcgtaaaacagccgatcccggggtcaaatcctttgcgaatccacagggaaaagaaatttccttagggaactctgaactgtcgatgagtgcgcaggaagggtcgctgtacatctccatgaatacccataacggtgtcagtctgaacagcacccaacgtatacaaattcaagccacaggcagtcttagtctttcggcaggtagcatcctgctgcaaggaaccaacggcttacacttgaatacaacaaccgatacgttggatttggagcaggaagtcaacagcgtcagctctgagattcaacttaaagcttccctccatcaatactacccagaaccgattttgtctgactttgagaagcaagtcgctgaaaagggaatccaaagtgtgctcggagcacgtgttaaggaaaacgtaggcgccacgctcaagggagaatgggatgcgggtatagagtttttaggcggtgtatgggactcagttgtcgacatagcggatatgggaaccatggtaatgactcctttcgttatgccgggaaattacactggtaaaggttttctggaacgcaatgagacgctcgagggtattaagggcggtgcaaagtttggctgggactatattgccgattcattccaaggaaaaaaaacaaagaaagatgtggttcacgaccttgaaaccgtgtgggacggcataaaaagcatacccgatccgattgagcgaaaattgaataatttcttccctaatccattgaccgataccaaacaggaaagttacgacgcaggatatgacagtatcaaggccgttgaacgtgtagcagatatttatgggtttgtcaaaggcggcgcaaagttagttagaaagctgggtaagttgggtaaagaagaagcctccttatctaagggactcaaggaagctgaagaaaagaaagccggtaaaggaggaacaccagggttattcggagattcagcaaaggccgactctgctctagccaaggttggagatggaaaattcaaaacgaatgccatccgttttccaaccaattttgaatccttagggagttacttgcaaagtgtagcaagaaagatgaacttccgtataactaaaaggttacccattttcgaaactgctggaggtcattatcggtttcatgatcctagtcctgacgtcccacattctaaaggttccggtgcaaaaatttcgcctgagagacaaaaacaaattgatgcgttagaatcaggagagtatacgggtaagagcactaagggaccggagaaagagcctaatgtaagctacggaaaagtatatccaacaagaacaattgatttaaaaacagaaggtcatattatcgatagagtaagagatttaagaactagactctcaaatagattaaaaaaagatggaaattttgcatactctgaagtggacataccaggaatagataaaaaagaattttatgcacacagtggcttaaatggagataataaagcgaaagactatgcagatttctcattaaagccaacaaaaaaacctaaatatgaggcaaccaaagcgccggataaaagtggacgtgtatataaaagagacatggacactgagtataaaatattaaatgatctagcagcaagattagataaactaaaagactcttcaaatgttcgtgggaaaataaaaatgttcactgaaaaagatacttgtggtagttgtagtagaattattaatcaattccataaagattaccctggtattaatattgaaataatccacaacaatgatgatatgattatcccataaaaatagaaaggtgatagattaacatgaaaagaaactatgaagctttatttggtgccttttatgagaaatactttgattttaaaattgaaaaaatgagtgacgctgaggccgtcgcaagaacttctggagaatttgaaggtattttaaacaaaggcgaaatggagaaagccgtagtatacattgctgaaggaaagatttatttaacgcattcgaaaatattttttaaagcaaaagaaagattagtagaggttttaaattctttaaatctagaaaagctaaaattagagataacctcagatgaatatgaagatttattagaacgtagggatatggtcttagatgaaattgataataagcagatcgattatgatccatttacgagatggtattatcatgatatggaaaaggaagtaagacacttctttagtagcattattactgagattcaagataaccatgaaattgttgagaaaataatcgaacgatttgaaaatgattgtgataacacccttagtgaaaatattataattaaaactacattagcggaattattaattaggaataatattaaggtagatgaagatcttcgtaacataaagagtgagctagaacagtttaatattgaagatataggactacaattatcagaagacgagaaaatagatttaactttacgcattaaagaaatattaagtaaattaagtgggatttagtataagtgacagcggccagtcgtcggaaataaaccggagactggctttttttattttgtacgagttgggttatattatgttacatagtctcgaaggtctcagactttagcaacaattcaatggaggtgttaacaacgggtgttctcttttcgaacatgtctatgatcatcattataaatatttttaagttgttaacagtgagcacctacttcgaaataattctattctctgttttagcttgtatacatgtttaaatatccatttaagtgtccaattcaatttaaaatctgactttctatttaatacaatccctcgatatcctaatctacatccgttatgctgcttcttagcgatcaaggcagagcgtaaacatatcaagctagaataaaataattagcttggcatcgtcaagttccatctaaaatgcacttgtagttaatagtacagcagaatttgaaggctatacaagtcatcactgctctactttctctattcaacttagaaggaaaataatatggaatttgcgctgaaatggtcaaataatatatccggacgggtaaggctcaaacccgaaaagatattaggaatactgttcaagatacactgagttctccagtgaagaaaatccaaagaaattgtccctaatgccaaagtgaaatatagaggttctttggctactgggcagaaagatctacataaagggaatgcgccatttgatccaactgactttgatattgatgcttttatcgttagtgataagttagcttcaaaattctcttctagctctactttttggagagctgggaccgacctaagagaagatagacaattgcagaaggaaattgataaaacacttaaagaattttgggatggcttaagaagagaagataaaaaggaagaacggacaagttcactcttcgcatatttacgcaggaagaatacagtcgtagatatcaaaaagggggtcatttcttttatttggggtgttccttttattggattagaagatcatatttacgaagaagtgcctactgtatatattgataattctattttgggacttcagatagttttacagggagccggaggcgaattggggtatactttaaaaattcgttctcacacagataatgatgagccagatgacgcaagtgagatagagctagatataatagggtatgtcccctgcctttttgaacggactgatcaaataaagataaagtgtgatgaattaataacaaggattacattagtataattgagtaaagaattcacagtgtctctgataaaaataaagtgggtttacatctaaaactacaagatcgtacactacaacatatcaaacactttaaaaacttgacaaccatttgataaattttcaaaggcttattccaacttgaaccgcgagaaggatgagctttttttctacgcaaaacaatacatgcacccctcaagaaacaggaagaatgcagttggtagatgagaatgttcatggtaaagtaaatcatactgatggaaataaaatatggggtaatggcgattaaacctctaataaattaaagggagaattaaaatgggatatgagctaaaatggtctgataatataaatttagatgaaagcaaattgagaggtcttgaggagcgatggaatatccgctttcctaaagagtatgtagaaattgtgctgaatcatgatggatcggtaccctatataatagatcaaaatggtgaagagattacgggcgttgtagaagtacctgggaaattaacatggtctatacaactattatctctaatagaaaaagaagttcttggagaagtaatttctccaattgagctggcgtatgatactttgagcgaggcgttaccaaaaaatatatttccctttgctattaatggatctggagataaatttttatttgattttcggaaagataaaaatgaaccccaaattttgtttcaaaaccatgaagatttaattttagaaagtgaaataaccgaagaggaattagaagaaaaatcacttgaagactggcaagacgaaacattagattttgtatgtgaatcattcgcagcttttcttaaattaatttctcctagagactaaaaggattactctttaaagctactgccctaaacatagctataaataaatgaacttaattatatagattcgggagtgaattatttagagaaatcattattaaatatatattaaatgcatttactctttttttaagatgggtcactctaaaattttgaaagtccattccaatttgaatcataagaggaatggactttttcaatttaaagaagaaataaaaaatagcagtcccaccaatctccctgcaccaaaacaataacttgccatccccctagcattcatcggacaaaccgagaggtttgttccaatgtttacactagagggtactcttctaaccctgtggaatttgttttatcccttaaccgatcctgccgcaatcccttccacaatccggtcactcatgatgaggaacactagcaaaatgggcaaaatgctgatcatcaacgtagctccgatagctccccagtcggtcgtatattgtccgataaagttctggacaccaacggtcagtgttttgttttcgtccgagctgatgaacgtattaacgaaaataaactcattccagttatagatcatgttaataatagatgtcgttgccatgacaggggttgtcatgggcagcacgattcggaagaacatccggttgacggagcagccgtccataacggccgcttcttccacttcacggggcaaggcgtaatagaaacccagcaagatcatcatcgttgtcggcagattaaaagcaacatacgacaggatgatggagagtgaagtatctgttaaatgcagtttgagaaacatactgaacaacggaatcaaggtggaatggactggaatcattagtccgaccataaatagcccgagaaccagctgacttcctttccaccgcatacgcgtaatggcaaacgttacaaagctggccagcagcaccgtcaacgccacggatatgaccgtaatccacacactattgaaaaaataccgcccgatattgccgctggtccacacattcatatagttctcccaatgcggctggggcgggagtgcaaacggcggaaggttaaacacttcctgattatttttaagcgagaacagcatcagccacaccagcggtaaaagctgcgtcaccgccaagatgattaaaatgatatacaaagcggcataaccgacccgagttaacattttgccgcgggtagcgactccaagcggatagttggcggctgcctgggttttcatatccgttcctccctcttcctgtcctttgttaccctcatctattagcaagctgcattatgaatactggatggtgtcactcgtagccgtaaccttgcggatcagccacgtagcgattagacagatgagcagcagggcaaaggctgtagcactgccgtatccaaaatcaaagctgcggaatgcctggtggtacatgtaagaggccatcacttcactggctccattcggtccaccgtccgtcatgacgtagatgaggtcaaaatatttgagcgagccgacaatagacaatatgatcgtaacgttaatcacctcgcgcagcaggggcaatttgatacgagtcgcaatctgccaggcactggccccgtcgattcgggcagcctccatcaacgtttcgggaatgtttttcagcccggcataatagatcaggatataaaagcctgcatattgccaaataatcggaatgaacaaagcaaacagcaccaaggacggattagctaaccattcaggcggattgtggactccgaccgacgccagtatggaattgaacactccgttcgttggatgatacattttgagccacagctgtgcgatcgctacagatgacaacagcatgggaatcagataaattttccgcagcagattcgctcccttgatttttcctgataaaatcatcgcaatgaccagataaccgatcagactgatgcctgaaaacaaggccaacagcagcgaatgccaggcactttgccagaatgcactgtctgtgagcaaatgttgataattgtccagccccacaaaggtcatagagccgattccattccactgattcaggccgtaatagccggtcagtacgatgggcacatatattacggcgaataacagcagcagagaaggcaatacatatagagcaatgacaagcttattggacatgaccttttccacggtcggacctccttaggtggtcaatttcaattttctttctcgatggcagccttatgccgctcggcaaattgttgcggtgtcaccgctttaccaaacaatgcctgaatcatattcaaatgtacctgtgctgcattcggcttcatctgtacatcggcgaacaaggtaatgctgctggcttgattcagtccgttcagcaaatcgacatacagcttgggcaatttttctttggaggtgtccactttcgtcgccggaattacgcccgcctgtgtgaccgattgctctccccacttgactacgaagtattcaacgaacgctttggcctcttcttttaccttggaattttccgaaacgaacaaacctactcccggacctcctacccaactgttctcgttgcccttgccgccttcaaccatcgggaatttaaagaagccaatttgatctttaaatgcttgcgggattgcaggattggtcgtaaaattcggcaattcccaagtagccattaaatacatagccgctttgtcgttcataaactcggattttccctcatcattggacaagccgttaaatcctttgttaaaggcattcatatccacaagcgtctggacttcggaggccgcctgaattaaaccagggtcatcgaacgatcctgagccgtcaatcgcttttttcagcgtttcgttacctgctatacggtccgccagatacatataccagagcgagccggtccagcggtctttattgcccaatgcaatcggtgcaactccgtgatccgtaagtgttttcacaacttgcttaaattcgtcaagtgtcgtaggtaccttcaagttgtatttttggaatatggctttgttataataaataggtgtaatgttcaattcaatcggaagcgcatacgttttgccattcagcgcataagcttcggtcgttcccggtacgaatttgtccttcagcttggaaccattcaacaggtcatccatcggcgtaaataatccacctttaacgtaaggctccataaaacccgctgcccaggtgatgccgatatccggcaattcattggaagctgacaggactttgagtttgtttttatattgttcattctccagcacttcctgctgaatgacgacattcggatgatccttttggtattgatctataatctgagtcacaagcttgctctgctgtgccgaacttccctctggccacaggtgcatcattttaagtgtaacctttcccccttctccactggaaccgccttgaccatccttaccagcaccgcaaccggatagcaccagcataaatgacagcagcagggtcaacccagcaaaccatttttgatgtgagcgcttacgcaaaccatactcgttggacatcgttagacctccgtttattgtatttatatttttgtaaccgttatcatttgtaagtttagcacttcattcctgcttccaacagggtacactcattgggtataattccacttttattgggtttgatctgcctactgtcagtcaatattctctggtcctgtacgcatctgctgcctgtagcggctaggacttatcccctcggtcgctttgaatactttaataaaatatttatctgtccggtagcctgatcgctcgccgatttgggcaatcgtcaactgggtatgcagcagcagctccttggctcgttgaatccgcagtcgatgcagatattcgctgaaggacaaaccactttgctccttgaataaaacactaaaatagctcgcattcaggtgtgaatgcgcggcagtctgcgccatcgtaatggattcgtgaagatgctccgccatataggtgaaggcacgtcgtaccggatcactaagagtagccgcctggagatcaagctctagcagaacagggtcagccagcttgtccagcttttcgtaccgctgccgctcctcttccagccgaagcgcttcattgaccgcattcagcagctcctgcttatcaatcggcttgagcaaataattgacagctcccagacgaagagcctgctggacataatcaaactccgcataacccgagatgacaatgatcgctggtcgtcgtgaatcccgttccagagagcggattaaatccagaccactgaattccggcaaccggacatccgtaatcaacagatgaaccgtctccgcacgcagtatatttaatgcttccaaaccattatcgaatgtcacaatccggtatttcccggcggcccattgctccagtgtctggtgtatcccctgacgtgttcgctgttcatcgtctacaatgacaatggttttggatgaaacactcattcctaccgccctccatattcatcaggaatttcaaaagcgaccacagttccttcctgctcagcactatgtatcagcataccgtccgttggataagatgcgctgtcataatagagagcgagcctgcgctgcacattcactagtcccataccggttcccttgctctcgcaggctgctccccccatcaacgctgtacgcacagccgcaagttcttccattgtcattccaggtccgttatctatgaccgcgatcttggtccaacccggtctggtcgaaggagtgacactgatttcaacgcgaccgttgccgatgcgattttcgacaccatgcaaaatggcattctctagaataggctggatcagcagtttaggaagcggaattctggctgcctctgaaggcatatgaatttgccagctcagacgttcacccagacgcatctccatcagttccagataacgacggatttgcgccatttcttccccgagggtcacccaagagtcatggtgagccggttcgatcacataacgaaatagccgcgacatagacaccatcagcccggcaagctcctcctctcccttctcctgtagcgaccagttgaaagcatccagcgtattaaaaaggaaatgcggattgatctgcgcctgcagagctttaagctcggtctggctttgtaaaacctccttctcgtaaatgacatggatcaattcattgatatcgacaatcatcgtattgtactctgcgttcaattctcgcagctcgaccgctgctgccggttctggattcagagccaacgccccttcccgtgaacgacgcatcgcctgaatcaagtgacctatcggtcttgtaatcaacgtagacaacataaaggacataaacaggaatagcacggcaccaagagatgcggaaatgataagtgtagtccgtaaaaccgtaattccgtctgtgacgacgctaaccggaatcagaatcagcagcgaccagcccgtccgctccgactgctgaaccgccttcacatattcccgctccccaatatgaaccgtctgtgtcttgctatgcagtacacctgacaaatccgtctggttcattggttcacccgacagaagctggccttgacgatctacaagcagcatggtttcatccgcttcttcattgaccgctgacgcaccattcagtccaaaataacttcgctccatacgggtaatcaagtaccctccacgtgagaaccagcgatccaccagacttacctgccgaattgccagcagtgaccgagggtcttcgggatcaataccgatccagaccagtcttcctttcatctgattcgcttcacggatgtctgcctgtccgatacgttcctccagactgccctctctaatcggaaacaacatctttccttcggcggtatacagctccagcgagccgacactcggcatatatgcctgatagctatgcatcacttgcagcagggattggcgctgtccgaaatttaccttgcccccgttacgctcctccagcaaaatatgctgaacagacgggtgattcgcgacctgctccgtcaagttgtccatctggccgattaatgcatccagcctaccgcttgcttgtaccgcggtctgaccaatatgtcgctcggcactgtcttttaacaggtgagatacattgagataaatgaacgcacccgccacactcatcataatgagcatcactagtataaatccgataaaaatctgattacgtaatgtgtttaatgtctgaaaccttgaccttgaacgcatatgccttctccccctgaaccatcgcagaaaaaatgggtgctgataacgctttccttttcctattctatcgcatcattcgtctttgttggcgtattttcagcagagattaatcaaaatgggcaggaatgctatgaaatagaaagatcgtagggtaaacgaaagaaatgactcccgacaaatgcaggagccatctactgaccagtttaaccgaagcttctttcaaatcacccaaactaaggtaccgtccaggctccaaagcttggatataaaatagatatcctattggagcgcagccaaaatgcggtcgcacagctccatcgttttcacgttgtcccgtccacttgaatcaggcgtccgtccttcttggcagcagttcatgaaatgtgcgatttcaccaacaaaaccgcgcaagtacaaatcacggtatccgcccgacatcgcggaggctgacggtgtcagaaccgtatcgttttccgcaagggatttccaaggaagctctgtatgactctccgacttgtgaatgatcagtgtattcacctcatccgcgttcgcaaaaccgtgatcaaaggttaccgtgatcccttcactctcgcgtgtccatgctgtcatacctgcgaagtatacgctgcccactacaccattttcaaatttcagggcaatcgtatgggaaatacactcaccgttatcgttcgcaaatccggtaacctgtaccacttccccgaacaaataacgtaccagatcgaccatgtggaccgccgccagcttcatgaaatcttcgccggttttacaaaacagggtactgtccacgagaaatttcgcctgaaatgagcgtgcggctccaagcgagccaccctcaattaattcttttaattttatgtatacaggtgcgtagcgcttcatgaagccgaccatcaggacaacgcctgctgcttctgccgcatctgcaatttgggccgcttcttgcgcattccaacccagtggcttgtctacaaaaacatgttttccagccttaatgcagtccagtacgagcgaaggatgatctgccgcttgtgcaatcacgacaactccatcacagtcttcctgctccagcatagccttgtaattgtcataaggtgtgccgctgcttccaaaccgctgaagtgctgtcttcgatctgcttagatctctagtcgcaatcgcctgaatttcagcacctgccccaataacagcaggatatatatttgttgaagcgtgaaagcccgccccgataaaacacagcttcgccttgctcatgttagtccctcccatgtacacactaaaataatccgatcccatcgtaccatattgccgaagtatatatacagtgtcataaagataaagggcgtgattcttaaggagaacaagctaaaaaaaccttaacaaagataattccttatccttgttaaggctctgtctgcatcaccagtaatgatccttaaatacacattcaattacagggttcagacattatcttgtagataacgaagcccatttttgctccagccactgatcaaattcagcacccttgtcgccttcgtagatgtcataaatatcgactctcatcttgtgcagcttctcgcgaaaatcgttataggtatggtcggctggcaggctttttttaatccgcaccagaatcttcgtcagacccttaacaagttcaccctctttgcgcacaggcggctgtacattctcgccccattcctgaagtctgcggtaagcggcttcctgaacggcatataccgtatcattattcaaacggtgtgtcagcaagtcaatcgtctgctgattcttccatgcacccagatcatttaccgcggctaggcgtgttttccaatcggaggttcggtttgcagctactttaagctgctcatatacttctgcaaattcttgctgagtttcattgttttccaaaatcatctcatccttttctaaaaatcactatattactgttcatcacgattgccgtttgttaaatataacatacttgcaggtcttcttctaaaaaagataaaaatgaaatgtatcggacataccagaaggcatcatccgcctcagttgactgccgcggaaaggcttcgtaaatccctccagatctcggggtagataaaccgtattttgtaaggggatttacagaaaatctgcacgtgctggtgtaaatgcatctagcagaataccgccatcctccagtgggatacagccatgaagagtatcggatggaaaatgaatgctgtctccttctttgacggtctggacttctttggtttcgccattatcgatcatgaacttaaaacttccctttattacataagtgacttgctcatggacatgcttatgcaacaggatctcccctgtttgggctttagcaaacatcactttgacatacataagctggtcgctgtgggccagcactttccgggtggtattactgtcaacgatgtcaatttgaatatcttggtcgttaaaaaacatggataattcctcctctttttaagcacaaatgatttagataagttattttgaaaaaactcataaatcgatttagtttaaaaccagcgaaaaataagccaaagtactccggaaagggtagtaaagtcgggatcggcgaacgttaccccttcggcacccaaaaaagaaaagagcggcaaggtgagagccggcagcagacagagcaagaatccattaagacaactggaaataacagctcctctgaaaccaccgctggaattgccaaatatcgcggctgcaccaccagcgaggaagcaggccatgatccccggcacaataacaggcaatccgataaacgggaaaagaaagacgcaggcaacgcctgtgaaaaagctgaccaagaagcctaccaacgcggaattgggtgatttatcgaacagtaccagaacatccacaccagggattgctccaggtgcgaacacttgggagaagcctttgaaagcgggtacaatttcagttgtgaacagcttaacacctgcttttgcgatatacaagccggcagcaaaaatagctgactgttcgaggatgaagacgatatattctttgccatccgataatttgctgacataatcagaaccagcaaccagtccagataccagtaaaagcacaagcatcgtcaaggtcgttgcaacattgggatcgcgcaaaaaactgatacgatcattaattttcacattttcagtgtcattttcacggttgccaaaaactttccctaaataggtacctagaatgtaagaggtcatggaagcgtgagcaatcgtatattcatccgatttaataatgtttttgctggcatttcggagtaggtaaggaaacaccgccatatagctcccgattaccaaagaaccgacgatgatcgtagtcagcgaactaaggcccagacctttcataacggctgtagcggcaaagctcataaacaaaatcaagtgaagagacaaataaatgtacttgaacttggtcagacgggcaagcacgatgttaaggatcatggaaaagagcagaataagcgcagcatccgccccgatctgatcaatggttagtgccataatggcttcattgctgggtacgacacctttaaggttgaacgcataagaaaaaatttggctaaatttagtgaggacgcctcctaaaatgccgccgccgaccttgatcatggtgaagcccataaaagaaagggtggttcccgtaataatttctgatactttctttctctggaatataaggccgagtaatgtcacaatcgcgataatgatggatggctccctgataatgctcataaacatttccatagtgatctccgactttcttttattttttttccattcttactaaatcgatttagtaatacacgaaaaaaatttcccttccgggaatgtaaaaagaagcagaatcatttttgtgaattaaatcacaactaactccatacattattcgtctaagctccattcctcccctctcttcaatcgcaacatcactaaaatcaggacatacataaatgaaagggtattcatgactcgaatcataagaccattatagctctttattttctttttacaatagaattcataaaaacgttttcaaaaagataaaaaggacttattcaatcattcagttcagtttttggacagattctctgtggttaatgaccggattcattcggatgatttctgacagctcctcatgatcctgttctttttgatcaattttctccagcagcagcctcgcacttcttttccccatttcaaaactcggctgggaaacggttgtgatcggtggattataaaaagatgcaaaggatacatcatctatgccaatcaaggaaaagtcattaggtatggtcagatgattgtttttggcataaatcagtacctgctccaaaatcatgtcattcgtagcaataattgcagtgggcgggttctccatgtggaatagttgtccaatcagatgaggcatttcatccaatctgccgcttttgatgtagttttcattcactgggatgtcatgtttgcccaacgtatttcgataacctgacagtcgctcacttcgtgtagtgatcgcttttttgcctaaggggaatgtgataatcccaatgtggttatgaccatgctcaatgagtgcttcaaccgcaagctcgctggccttttcattattcaatagcactgtgtctacgctgatttcatcgatttttcggtccacaaacacgaaaggatagccattcttggcaagggaaacatataatttcttgttctcttccgtcgggaaaatgataagtccatccacttgccgagcaatcatcgactggacatactttttctctttgagcgaatcatcatcggtattgcagacaatgacctgaacattttccagttggcattcatcttcaatggcacgcacgacttctgtagtaaatctcgataaaatggttgaagaaataacccccacaatgaaggtcttcttctgcttgagactacgtgctacctcattgggtatataactgagatcctcaatcgcttgctcgatcttcttcttggtgttttcactcatatagttgtatctcttttgtagaaactgcgaaactgtactcttcgacaccccggcacgttctgcaacttccttcatcgttgttaccataattaccctcctttctttttctgcatgtcaggcgtgttattttatcaaatatatattctgcaacctgtatgtaaagtgaatttcactttattatataccttcttttacagcaggaaaatataataaataaagagttagagcgagccatccagcccataaacaaccgctcccacaaaagctggacacttagcttaaccatccgttgttacgaatctattgaattcgaacgaaatcttagaaagatacgaattttatgaacttgtttgatggaagatttgaacataaaataaaaatgtaatcggttacaatttcttttaaataaaggaggaagcagaattatgaagaaaaaaggaatgaaaaaaacatttttcgtcattgcctccctcgtaatgggcttcacactgtatggctatacccccgcttcagcagatgcagccagtgtgaaaggatattatcacacccaaggaaacaagattgtagacaaatccgggaaagaggcggcatttaacggtctgaactggttcggtttggaaacccctaattacaccttgcatggactgtggagccgctcaatggacgacatgctagatcaggtgaagaaagaaggctacaatctgattcgtctgccttacagcaatcagttgttcgattccagttctcgtccagacagtattgattatcacaaaaaccctgatctggtcggattaactccgattcaaattatggacaagctgatcgaaaaagctggacaacgcggcattcagattatccttgaccgtcaccgtccaagctcaggtgggcaatccgagctgtggtacacatcccagtaccctgagtctcgctggattagcgactggaaaatgttggctgatcgttataaaaacaaccctaccgtcattggtgcggatttacacaatgagccacacggtcaagcaagctggggcacaggcaatgcctccacagactggcgtctagcggcacaacgtgcagggaatgcgattctgtccgtgaatccgaattggctgattctcgtagaaggtgtagaccacaatgtacaaggcaacaatagccaatactggtggggtggcaacctgacaggtgtagccaactatcctgtcgttctggacgtaccgaaccgtgtcgtatattctccacatgattacggccctggtgtgtcttcgcagccatggttcaacgacccggccttcccgtccaacctgccagcgatctgggatcaaacctggggctacatcagcaagcaaaacatagctccggtactggtcggtgaattcggcggtcgtaatgttgatttgtcttcttctgaggggaaatggcaaaatgcactcgtagactatattggtgccaacaacctgtactttacgtactggtccctgaatccgaatagcggcgacacaggcggtctgctgctggatgactggactacctggaatcgtccgaagcaagatatgctgagtcgaattatgaagcctgttgttttcgtagcggaacaagcgaaagcgaccgccgaataagcctatcgcctgctccgcgtagtatactcattgtaaaagccgctttccctccttcaggatcaggttatgccagacctatgaagaggtgaaaagcggtttttttaggtaaacttacatatacgtataatagatattgaagattgacaatgagctatttactaaattatcattaccttttaatgtatttcataatgaagaggtggtgctcacaaaatgtttggaatcgtaaattatgaagtatttttgcttactggaatcctcctaaatctaattcctggtgcagacaccatgtatataatcgggagaagcattgcacagggcagaaaagccggtgtgtattctgttttcggtatcattagtggttctttgatccatacgttgttagttgcttttggtttatcaattatacttacaaagtcaattatcgtattcaacatgattaaagtaattggagttatttatttagtttatctaggggctagaatgctattagataaaacaaatgcaagttttagagcatctgaatccaataaacaacacagcaacagaaaaacatatctacaagggatgttgaccagtcttacaaatcccaaggtttctttgtttttcattgcctttcttccacaatttattgatacaaaggcttctgggcccattccatttatcattttaggacttactttttcgttcactggattgttatggtgcttgtttattgcctatttttcctcttacattacctataaaataaaagtcaaccaaaggcttagcagctatttaaacaaaataaccgggataatcttcatcggattaggattaaatcttcttcgaacaaaggctcctcaataaacctgaataattgttctcaaatgttccactaacaggaacgtttttgaattcatcatatgaccgcctatgctaaatggtggtcatattttttcaagaatcaacacagtacaataacagctaagctttcctcccctcttgacgccttctttccagttttacacattgtaaattacccattgaatgggtcattttgtaaactaaatctctcttttaaccgataaatacatatgttggatttaaatttaggaaggaagatttcatgtgattatttggaagggttttggtattttaaacatcgttattccagggattttatttgttattgtcgggagtttagtatccgctctagggcttgactccatagattcccggctaccgatggcttttgtgttcattgtgtcgggggttattatctggtacttgggaaaagcgcttaacgccgactcggacaaagtgctagtcgatatggaaacggggcaacgttatcgaatgggaacccagcacagtctgttttttatccctatgcattattggggccctgccggtctagcgatcggatttattttaatcgttgcatcgatatttatataacgttgattgcaaacatgagcgattccaaacaccgcaatgcgagctagttgctcccgatgcggtgtttttccttttcgcaggtcaattatgatcagataccaccatggtttacctgtagccaatggatttggggcaggcaggtgaaaacctagctcatgtttcgccccagctgctccaccttgctcagccaatcgttgcgctgctgatccgataatttattcatgagatcaatcgcagtagaatgcactggtttgacaccacatagatgcagcgtggaatccttcatcattcgatgcccaggctgtccctggaaaaatcggtagtaccagtgtggaccgtccatcgttgtaatgaggcgggccgttcttccttttagaagcttgtcaggcaggggttttcctttttgatacttaaacgcaaatcccggcataaaggtgcggtcaatgaatcctttcattaatgcaggcaagctgccccaccagatcggaaagacaaaaacgagatgttctgcccatttaatcgactcctgtgcttggatcaaatcaggctccagcggcaatttattacgatatccacctaatagatttggattaaaatcaagctcggatagctgcaacaaacgaacctctgcccctgcagccttcgccccttttacataggattgagccagcgcttctccataactgccagcgacaggattcccttgaatcaccaatatttttttagacatataaaccacttcctaccttcatattatgattttagttagaaaacactaactttatatttaaaaagaaaaggtcactactgacctttacttaataaagcagttaaacgttgtttgacctctgctgcaaatggaaccaactgctgtggaagttcaccttccaggctggacacggacaagcgtgtaatagctccaatgatgagcacaccggatagctgagcatcctgcttcggcagttcaccttgttgaatcccacgttcgatgaattcagtcaacgcctccagcggctgacgcacattctggctctggcttgcttcaacatacagctcatgatgctgtgatagtagaagcaagccatactggtcctcatcatgcatattcagcacttcatccaccagttgatggaaacgactgacgaagctcccactctgcttgcgatagaagtcaattaatgtggtgtagctattgcaatattgcccgaatacttccaaagccatcgcatctttactcttaaaatgcttataaatcgcggcatccgtcacaccggcagcctctccaatttctttgactgaaatcccgtcaattcctttggttgcaaataagcacatcgctgcctgcagaatatctttctttttgctgtctatatgtgttttcttattcataagcttatagtaagcgataactaactaaaatgcaaattatatttatgcaggctcattccctcttcataccttcatttaaaataaattgaattcaacctaatacaccatgtttttatacgtgattaattataaacaccttaaattatacgtgtatcaccccattttattcatataaaatagatatgtaaccgaataaaacgggcgctaggacaggtgggactcattatgcttgagatgcacgcagtcacccagcagggaaaagactcaggcagtcttggcctatgaagcgacgagcacatttccccgctgcaaaaaagtcgtgcaagccatccatgaccaaggctccaaagccggtcttcagctttggcatgtcggacgcaaaggctcgttgccccaagaaacagctctatctgcctctgggttgcctcacctcaaacagtatcatccactggatcgcacactaaattggacaatttccacaataataggtgtgccggagagaattgcctctccttcgttaaggcgaatcgtcagcgatgaaggtgttaggctatacaatgtgctttcttgtatcatgccattaatgtatagattggcgtaactgttgcttccgacattaaaacgctgaaagacctcctgtacaccatctactgaaaattgatctgccataatcgtgattgaagattcaattgtagcaggcgcaaaataaaaataccgctcagccgtaggaacaatttcaatatttgaaatgtcagctgccgggccggttgggcctgttataccttgggctccagtagggcccgctataccctgtgctccagtagggccaggtgcacctgttgcacctgaaataccttgaactccagccggacctggcactcctggcgctccccgtgttcctgctggaccctgtattcctggtattccttggactcccggtgctcccgcagttcccggtatgccttgcgctcctgctaaacctggaatgccttgtactcctgtcaaaccagtttcaccctgtaaccctgtcaaaccgggaatgccttgtgctcctgccgaacccggaacacctcgctttcctgtctggcccattcttttcctccgcttgacaggaatatttctacaccgtcgttgcatgattagttttcgatgctttttggcatggaagcccgtttttgttctacctttgaatgaataacttgttttacactttttacgtttgttgatcttgcaatgtacggttctctttccttgccttcttagtgatgaatcgcgtctcctcataccagccgtatacacctccttctcacatgcttatttatgtattgtatgcatatccccctttagggttttaggcatttgtagcatgccgatcccaagtatccgcttccatttatatttgtagcaaaatagggcttctccatttaccctattattaatagaaaggttaatatgccgtttccaaataggttgaaaaatcatttattgattatgagccagcgaatggctcattaccagtaaagaaaggagatgagaactatgccaatcataaaacctgtgttcacagcagtagctacagctccagtgtcaacaggtggtgccgtaaccactactatagccccagccacgactcgcttttttgcaaccattacagccgggatgatcggcgcaacaacaacaactgttcctgccgcaagttttgtagatgacgcagatgctccagttgttgctttgccgacattagcggctacggattcttctaattattatattaacggagttattcagcagagctccttattcactctaaccacagcaagtttggtcattgcctccgtagatattacaccaggtgtcccagttgttatagaaataacagattttagcagtacaacctccaccatatcaactcagcccaccatctctgcccctaccgtaacgattatcacttaagacgtttcatcattttgattcaagatggactgaacggtcattcacgctgtacattaccccatataagctagaaaagaccgattcagatgtcgatatctgaatcggtcttttagttcaagatgattatataatcgttttcaaatgactgggtactgtatgattaaggcaaaatagcaaaggagcgcaccggaaatccaggggaatcttgaatgctcggaacgatattatatatgaccgcgcccgtcgggggtagcttgtccaaattcgtcagcacctcaacttgataccgatcctgctccaatatgtaatattcccctaccagcttgccagcattgcgataagctacagaggaatcagtatctagtgtttcatgtccaatggcagctacattccgttcttctaccaaaaagcgtagcgcttccagcgaccagcccggacagtgtgcatctccagcgtcatccttgtttgagaaggcatctgaatcaggccaacgtttgctccagtcactgcgaaaagcgacaaaggactgatcagcaatgcgtccatgctctttctcaaagtccaaaatatccgcaaccgtaagttcatagtcagaattggctgcaacggctgctgaacggtcaatgacaactagcggcaaaaccagttccttcaacgaaagctcatgcaagtaacgtttgcccttcacaaaatgaacgggtgcgtcaatatgagtcccatactgaccgggaaagcagtattgttttacaaaaaagccatcatcgtgggtaaacagggtatccacctgaacattatcgaatactggaaaatgagggatttcaggataaaaagcgtgggacaaatctacccactctttttgcttcaacaacttcaagatatctgctaaatgctctgccatgatgcccattcctcctcagctttattacaagccattttacctaaggattcttcaaaaatctataaatcgaaatgaaatcgttaacattctgagaaaaacacataaacaattccatatattcatatatacatttcctatttcgtgtgattgttaacgttttcattattacatatacgtcttgattggaaaaagaaggggtctattgaattatataaaaaattcgacaaaaattttagtatgtaacttttattatattaacaaatactggaacacaaagtatgatagaaaatgtagaaaccacaggagcacccgggactcccttcgttcatctactccattaatccaatatacggaggtattttatgaaaaagagattttcactcggaatcgcagcagctctactgttcactactctggctcctataggtgcacctgctcatgcagccagcgatattggcaaggagacgctcagcagcaaaaacggatgggcagccttttctacaggcacaacaggtggagctacggcgactacctccaatattttcaccgtaacgaatcgcaagcaacttgtcgatgccttaggcaaaagcagcaacacagcgcctaaaattatttatgtcaaaggcacgatcaatgccaacgtcgatgacaataataaaccgttaggattggacgactacaaggaccctaaatataattttgacgcctacctcaaagcgtatgacccatccacctgggggaaaaaggctccgtccggcacattggaaaaggcacgtgaggcttcacaaaaaaatcaagccagtcgtgtcattattgatattccgtccaatacaaccattgtcgggctgggtagcgacgccgtcattaacggcgcaaacctccagctgaaaaaagggacagacaacgttattatccgtaatattgaattccaggatgcctacgattatttccctcagtgggacccaacagacggcagcacaggcaattggaattcggaatatgacagtattacagttaacggcgccacacatgtatgggtagaccacaataccttcaatgatgggtctcaccccgatagccaaaatggcaccttttacggtcaagaataccagcatcatgatggacttcttgatgtgattaaccaaggcgatctggttacggtttcttacaatcatttttacgatcatgataaatcgtcgattattggcaacagtgacaacaaaacagcagatgaaggggctttacgtgtaaccttgcatcacaactattatgaaaacacggtacaacgcacaccacgtgtacggtatggacaagtccatctgtacaacaattactatacaggtgatgtaaaacgctccgaatatccttcactgtatatatggggtgcaggtaaatcctccaaaatcttcgccgaaaacaatgtcattgacgttgccggtttatctgcagctaaaatcgtgactgtctttggaggaactgccctgtcagatacgggcacaatcctgaatggacaagctgttaacgcaggctccagcgcgggtcttagctcctctgtaggctggaaaccatcgctgaacgataaaatttccccatccgccagtgtgaagacagaagtcacttcccaagctggttccggtaagctgtaaacactgcccgctaataccaataaccacaggcgcatacaacctgcgatattacaccaaaaaggctgtttcctccgtagaatgattccacacggagagaacagcccttttttatttctcattggtttagttataaattacgttgcatattaactgccgtattgttctaccaaaaccggcttttcaaatgcgttatccagcttgcgaagtttagcctttaccgcttctggtggctcaaccgcaggcgcatctggatgcagcaaccatgattttacaaagtgcgtatcggataattgaaagagtggaggctctttctcaaagtcaattttcatagcataagaactgcgggctgcaaaagcatcccctacaggtgggtgaagcagatccggaggtgttcccggaatagctgccagcttctgaccatggctgtccaaacttggcatagaagcgagaaggccccatgtatatggatgtttcgggttgtagaaaatttcattaaccgtacctgtttccacgatttgtcctgcgtacataacggcaacacggtccgccatcttcgccacaacaccgaggtcatgcgtaataaagatgatggaagtatcgatctttttctgaagatccttcatcagctccaaaatttgagcttgaatcgttacgtccaacgctgtcgtcggctcatcggcaatcagaagtttcggattagcagccaatgccatcgcaatgacgacacgttgacgcataccgccactaaattcatgcggatattggttaaaacgctgttcaggatgtggaatacctaccagattcagcaactcaataccccgcttgcgagcagcatccttggatattttttcatgcttgaaaagcacttccgtgatctgcttgccgactttcatcgtcgggttaagcgaagtcattgggtcctgagaaatcaggccaatttccttaccacgaattttttgcatctgtttttctgttttattaatcagctcttgtccgtcaaacataatttgacccttttgatagatgcccggaggggtcggaatcaacttcataacagcttgtgaggttacgcttttgcctgagccggattcgcccacaatcgccagcgtctctcctttattgacatgaaagtttacgccacgaatggcctgcactagtccctgacgggtcttgaaagatatcgttaagtccttcacttccaaaaggcggttcatctcatcactctttcatttattattcatcactattattgaccactatctaaaaaaacgacgtccaggagtcaaggtatatacgattaattttactcagtttagtacctaccagtcaagcaatatctaaaatatcatcaaaaacctatcatgatatgttagataaatgggatattaggccgaaaaaacgatcatttttacccatttttgtactcatttataacatgtgctggatatagctgaagcgtgctccacccaatggcgaacgggtgcagagtagctctccgttcaatcgggtagcaatttgacgacaaatagccaatccaagacctgtgacaccattcgagcccgcatagaatcttccgaacacctcggctgcctcttgttcggtcagccctcctccatcatcatccacatgcataacccatacaacctccggtgttgtccctgtctccaaatgaatgacaacctccgtagaggtgtgccgaactgcattttgcaacaaattcaacatcatacggaacaattgctcggccggaacggccacatgcaggccctctccctccactcgaagcgagatagaacgttcagcagccaccggcatcaatagatgaacagcatcctccgccatgcttttaagatcaaccagagagacaggccattcctcattcagcgcttccagccttgatagctgcagcagcttttccaccatgtcaattaaccgctgggactgcactttgatgatactcagcccctcgtcctgggataccacttgatcctgaatggcatatacatagccttgaatggacattaacggtgtccttagctcgtgagatacattttgtagaaattcaatttgaccctggtggtgctgctgaatacgggcggacatggaatgaaaagtaccgatcagctcgccgatctcacttttatccgcctgcggaaaatcactatcctgtggctgattcggttcgtagttgcctaccgcctctttcaatcgtttgagtggacgcaccagacgtgagacaaccatcagaccaatgacgagaatcaccaaaaaacccgcgatgatagacagtaatgtggttctcattaacggtacatacagtgctcgcaaagaagataagggtgagtatacaaaaatacgaaaaggctgtccgggcaattcttcattcgtaaacagtacctttttaccttgaagcacagctaccccttcatgtgtagcggtcagatcctggggagacggatgaaccgatgcaaaaaatccctggcggatcaaaagcaaacgctcgatctttttgccttccattccagagacgcttgagtcgatgatgcggttatccgtgcttaaaataaagtaatcggcagataaaagcacgcccttgataacatagttcaattcagcattatccagtcgatcaaagcctccgtcgctcataatatggacggctttgcgcgcctgctcatgaagcttggatttggcctgattcaccagaatgtcgtcgataagcctgatgaataaaacgaccgtaatacagacggtaataagcatggcgatggacagggaaagcagtattttagctctcatcgtacgcatggttacaactcctgaactgttgctttatatccgaaaccccatacggtgttaatgacgagcgtagagtggtattcagccaactttttgcgaatccgtttgaccagatcatccacgactctcacatcacctataaaatcatagctccacacctgctgaatcagatgctccctgccaaaaggtctttccagatgattcgcaagaaacagcaacaggtcgaattcacgtgaggtcaaatttagctcttgtccgtccactgtgactttacgaaagtcagcaaaaatacacagattgcccgcatggcaaagatctgcgcttcctgccgcttgtctatcgtccgatgcagacattccggccttgctcagtctcagcatcgctttaacccttcctaccaactctcttggattaaagggcttggtcaaaaaatcgctgcatcccagctccagcccgtgaatacggtcgttttcttctccacgggcagagatcataatgatcggcatttctgtaaaatcacgaagctgagtcagtagagaaagcccatcaatgccaggcatcataatatcaagaacgagacaatccggacggttcgtacggatatgctctaccagtgttttaccactggaaaaggaagtgacctcgtaggattcttttttcaaatattcagatattaattgcaaaatgaacacatcgtcatccactactactatttttgtcatggccttaaccccttgccgttgttctggatgcttccatcctctctttaagcttaacagaagcccagcagaatagacaaaagacgggtataccgttcccggtcccgtctttcttatcatgaatcgctgctgtatatgccaggcgagctgaaagctaattacacatcaatcttatttcttggttgttactactttagcagctgtttttggcgctgttttcactgtttttgctgggactgcttttttaactggagctttgtgagtcacttttttagctacgacatgatgtgcacgagttttatgagctgttgctttgtgtttaacaacattatgtttttttgcatgatgtttaactgtacggtgctgcactttcactgcttttgttttgtggctagccacttttttcgcaacggattttttagcaggggctttcttcgctttggttgttgttttatgagctgttacagcttttttaacaggtgctttcaccacaggtgttttcgtcacaggtgcttttgccggtgttttggtagccggagtcgtaaccacaggagctttgatcgctggtgcagtgctcgctggagtcgttgttgctgtagcggcgaatgcactgcttgctcctcccagtacacttactacggtcaatacggctgctgcatttttagtccattttttcatgattgaatcacctctcctttaaagtatctttagcttatcaggagaattcgggataattgtggagcaaatgtgtgaaaagtatatgaaaaagcgtgcagccctgtatttagaaaatacatgagtctgcacgctatgagttttacaataaccattttcactaaccaatggcgatccaggaaataataccatagttatgcgcggtttcgttccacttggttacgacgatcactgctccattcggggtctgagatttcagcgtcgcatgaaagagagggtggttcgtcatcgctaccaacgtgtagtctgggtttacaaaaggctccccgaatacaatggtcacttccgtctctccttcactacctttcaaaagaaacggcgctctgccaaactgctgcaatgcgggctgattcgcacaagtacgaaccggagtgatgctcaaatgctccggcttcactgcgttcagttccagctcacgtgagcctacagagccttccaccagatgatgaccttcaatgctctgctctgccacatgatggctttgtaccgcagcagcctgcagatgctctggtcccacagcttccgggctcagtacctcgctgtcgacggcctgagcttgcagatggctgcgagatatactgtttgcctgaagtctgtcgccacttacaccttcctctggcaaaagtccggagagatgaatatctgtggacagctgagccagtgtcaccgagcccggttttaggtgatgcgaatcaataacttcctctccaatgtggtggctttcaatagcttcctcagccacatggcgggactgtatcgttccgtctgccagcttgctggacgtcaccgcaccttcctgtatagcatcctcagctaccgcctgccagcctacatgctgtggctgaatagcccctgcttgcagatgttccgactggattgaatccagcgcgatatgcctggactgcaccacgccctctgccagtgcggacccttggatcgccccatcggccaaatgctgagcgtgtacggcatgctccgtcaaatgcacggagtttacgctggcttctgccagattcgaagcacgcaccgcccgaagcgcaagcttctcagcgttcacgctgcctgcctgaagcgcgtgaaccgatacactcccgggggcaatatgccgggtcatcactgccgaagcctccaaatgggcagaggtgacagattcaggagccagatggctcgactggacggcctcttctgccaaatgattggcttgcaccgcttcgtccgtaatatgccacggctggaccgaatgaggagatattttggcagccgtcacgccagcatccgccagtttgtcggacgtaaccgactcatcctgcaaagcatcggttgatattgcttgtgatgcgatatgcacaccctgaatggttccaaggtgcagatggtgcggctgaatggactccggtgcgatatgcacggacttcaccgccccctctgccagcgctctgtcctgtactgcgcccgttgccaagtgccgggggtgtacggcatgctcagacaactgtgaagggccgacgctgccttccgcgagattcgtcgcttgcaccgagcgtgccgccagcttttccgaggtgacgctttctgcttgaagcgcacgacctgacacactatcaacggccagatgtctcgcaaacaccgaggaagcctgtaaatgatcagaggtgacggattcaggagccaaatggttcgactggatggactcttctgccaaatgattggcttgcaccgcttcgtctgtaatgtgccacggctggaccgagtgggcagacagcttggcggcagtcacgccctcatccgccaatttgtcggacgtaacggattcatcctgtaaagcatcgttcgatatggcctgtgaggcgatatgcacaccctgaatggttcccgtttgcagatggtgcggctgaatggactccggtgcgatatgcacggactttactaccccctctgccagcgctctgtcctgtactgcgccgggtgccaaatgccggggatgtatcgcctgcgcagacagatgtgaagggccgacgctgccttccgcgagatttaacgctcgcaccgagtgtgccgccagcttttccgaggtgacgctttctgcttgaagcgcactactggatacgctatccgaggccagatggctcgcaagcaccgttgatgcttgcaaatgggcagatctgacggattcccgggccaaatggttggactggacagcctcttctgccaaatgattggcttgcaccgcttcgtctgtaatgtgccacgactggaccgagtaggctgacagcttggcggcagtcacgccctcatccaccagtttgtcggacgtaacggactcatcctgcaaagcatcggtcgatatcgcgtgtgaggcgatatgcacaccctgaatggttcccgtttgcagatgatgcgactggatggactccggtgcgatgtgtacggatttcactgccccttctgctagcgctctgtcctgtactgcgcccgttgccaagtgccgggtgtgtatcgcttgcgtggacagatgtggagggccgacactgccttctgcgagattcgtcgcttgcaccgagtgtgccgccagcttttccgaggtgatgctttctgcttgaagcgcactactagatacgctatctggagccagatggctcgcaagcaccgctgaagcctgcaaatgggcagaggtgacagattcccgggccagatgattggactggacggcttcttctgccagatgtttggcttgcaccgcttcgtctgtaatgtgccacggctggaccgagtgggctgacagcttggcggcagtcacaccctcatccgccagtttatcggacgtaacagactcatcctgcaaagcatcggtcgatatggactgtgacgcgatgtgctctccctgaatggttccaatttgcagatgatgtggctggatggattccggtgcgatgtgcacggacttcactgcaccctctgccagtgctctatcctgtactgctccagctgccagatgccgagtgtgcaccgactgcgcagaaagatgtgaagggccgatgctgccttccgcgaggttcattccttgtaccgagcgggctgccagcttttccgaggtgacgctttccgcttgaagcgcacgaccggacacactatccggggccaaatgtctcgtgagcaccgaggaagcctgtagatgcactgaggtgaccgctcctgcagccagatgtgccgaatccacggccgccacagccaaatggttgctttgtacagcttcgtccataatatgtccggactgcacggcatgggcagacagtttggtgggagttacgcttccctccgacagtttggcagaggtgaccgattcatcctgtaaggccggagtagctatagcctgcaatgcgatatgctctccctgaatgaccccgctttgcaagtgctccgattggatggattcgggcgcaagatgtacagactttacagcgttctgggctaattccgtctcctgtactgctcctgcagccaaatgctgagtgtgtacggcttgcgcagccaaatgtccgggacccacgctgttttctgccagattagaagcctgcacagcacgggccgctagcttctcagaggtgacactttctgactgaagtgcatgaccggatacactgtcgggggcgaggtgtttggtttggaccgatgcagattgcaaatgattagaggtgaccgattctggagcgagatgattcgcctccaccgcttcaacagccagatggttactctgcaccgctttatccgtaatatgccacggttgcacggaacgagcagacagcttagaggaagtgacactaccctcagctaacttaggagccgtaatcgccaaatcattgattttatccgtggccacactttccggcgatagtttcagtgaagtaacggcatgatcctgcaaatgatgggagtacaccgctccgctggccaaatgcgcggtttgaacagcgccttcccctagtatgtccgcagtaacggactgttcttgcaaagccgaggttccaacactgtcttccccaagatgtttgctcagcacagaactctgggccagatgggtcgaatcgacggattgagcctgcaatgcctttccacccacactgttgtcggcaaggtggttttcacgaattccccccgttgcaatgtgtgcgtgtgtaatggcttgaggggcaatcttatttccagttaccgctcctgtggcaattttaggttctgtcactgcttcgtcagcaattttgtcagacttaatcgcgctcgaggcaatgtgattttccttgacagcctgattcgccacatggtgttccaacactgcccccttccctaatttctcgctcgtcacagccccggaatgcaaatgttgctccgtaaccgcctccgatgcaatatgatcttttcgaatgatttccgactggaggtgtacggaagagactgcctccggagaaatttggggaccttgtatggctgctgtagcaatatgtctggtaagtaccgcctcgtcggcaattttgtgtggtaaaatgctctgatccgatatcttggatgaagtgacggattgatcgacaatttgcaatgagcctacagactgatctgccagtttattggactgaatgctccgatccgccaggtggcgggctgtcacttggcccgttccaagctgctcttccccgatggagccaggactcagatgctttctttcaatcgctccagcctgaatgtgtgcactggtcactgcctcagactccagatgacgcccgctgacaacgccttcctccaattgttccttgcccacaattccattggatagctgcttgcgattaatcgaaccgggggccagatgccttgcatgaacggcatgctcggtcaggtgggcactctcaatgctgccagcttggattttagctccatccacagcaccatcccgcagtttggaagtggtcacagattgatcgcccagcttggagctgtcgacagcttcattagccaaattgttcgattgaatcgtaccactgcgaattttatccgaggtaaccgcctgatcttgaagcatatctgaagacacgatccattgcttgaagtgacgactctcaatggagccattcgcaatatgatcaccgctgataatcttatcagccagcttctcaggagtgatgctgccatctcgaagtttttcaccaccgatggagcgatcctgcaatttactgcctgacaccgatgcgtccgacagatgttccaccgtaatggagtctgcggcaatcttcgaagaagtcacagcaccgtcggctatcttaatcgtttgaacggcataatccgccagagattccgtgtggatgctctcttgtttcagcttgctgaaatctatggaagcgggagcgatcttctcacccgtcacagcgaaatcgctcaaatcgtctgtatagatgaaagcattgtttacatgtggagccttcttattgctcaaaatttcctccacatcaattggatcaggttctggttctggctctggctccagctctggttctggttctagctcttggggttcctctatcgacacttgagtctcctcagcatccgcaccttcaacctctgtctcatgcgaaacctcgatttcaggttcgacaacagtctgtagctccggctcctctttggttgggggaggcggagaagcaacttgatgaagtcttgcttctgtctccctctccgcaggctgtggcttcacgcgctgtatcatacttaattcattcatatccgggtcaattacactatagagcggctttttgtttcttatggttttgcggctcttattcttcaagcagctctctcccttctcgtatttatcgttacagcatcatatgcaggcccttaggcacttgccaccccgtgcaaggatacacttttgggtaaaaaggatacttactgaaatccacgtttgaaaaaaaaaagttaaaagttaaaatagtaagggtgaagatcgctacaagaagagaggaattacaataacatgattatcaaaccaagaacacgtggctttatctgcaccactgctcatccggtgggctgtgcccaacatgttcaggagcaaattgactatgtacaggcccttcctgctatccagggaccccgtaatgtacttgtgatcggggcatctgccggatatgggttggcttctcgcattactgccgccttcggtgcgcgtgccaatacaattggtgtatatcgccctagtaatgctacggccacacgtacagcatcggcaggctggtacaattctgctgcatttgaaaaagctgctcaggaagctgggcttaaatccttaagcgtgacaggcgatgccttctcggatgaggtcaaagccaaaacggtggaagccattcgcgaagaactgggacaagtcgatctggtggtttacagtgtcgcttcaggtcgtcgtacaaatcctcgcacaggcgaaacgtttaattccgtgctcaaacctattggtaagccttacacaaacaagaccgttaacttccacaccggggaagtcagcagcgtgacgcttgaacccgcaacagaagaagaagtacaagcaacggtagaggttatgggtggtgaggactggaaattgtggattgacgccttgcgtgaaggcggtgtattggcagatactgcaacaaccttctccttttcgtatattggttcagatattacgcaagccatctacagagaaggcagtatcggaagtgcaaaggatcatttggaggagacagcgcatcagctgaacgatcagctgaaagttacaggcggacgcgccttcgtcgcagtcaccaaaggactcgttacccaatctagctccgctatccctgtcgttcctctgtatatttctgctttatataaggtaatgaaggaaaaagggctgcatgaagggtgcgtagaacagagctaccgcctgtttgctgagcgtctgtacgcaccagaaactcctgtagatgaagaaggacgtattcgtattgatgattgggaactgcgcgaagacgtacaggcagaggttgaaaagatatgggaggcgctgacgaccaacaatatctacgaattgtcagatcttgaaggatatcgtcacgaatttttccaactgttcggctttgagtttgagggcgtagactatgatgctgacatcgatcccatcgtaaatattcctaacgtgcgctaagtcttttcatatcgtcattatgtcagaaaaacaaaaaaagctgttctccagcagagaaacatttcggttgcatggaggacagcttttattttttaattaaaagggacacttgtgtgcgcttcaaactgcaaaatgaagcaaacattgcaattttaaatttcatttgatattgtaccagtaggcatagcaaagtccctcttcctgacaagagggtaaacacagttggacaagtcctaccttgactgaccgtgatactatttgctcagcccatcacaaccatataaggaggtgtacaacatggcaaaagacgtgctgtgtgaagtcaattcatgtacgtactgggcccaagaaaataaatgtagcgctagctccatttatatcgtaagcaacagacctgaagacactcacaaatccgaagaaacagactgcaaaaccttcgaagccaagtaaatctttgaattcaagcctaagttttataatgaaggagcccatgcccgggttccttctttcttatgatattctaacaaggatgataattattatcaagtcctttttcggtacagaaaagcgctattcgatccacacaatcatttctctgctcaacgtttggttgcaggcttactttataaagtcatgccgaaaaggaccctgctgttctctctaaaaacaaaaaaagaagcgtcgctctgaacgattcgcttcttgtgcttgaccttttgtaattgttcttgcttggtcggcttcattcgtatgtgctgtgaaatctcgccataatggtcattcgttttgcggctctgtgccgcacaatagattccagcgcgttttgccttgctcagcgctttttgtgtttgagtacgtgccatacggcttcactctccttctttggactccttttatcataacatccaatagtcaaatcgtgaatggtttgtctgactcaagcattcttcaattcattaaatgtctgaaaaaacatctggatcgccactggaggccgctacaataaaaacaataactataaaaatgatgatcagtgtataaatcagtgtaccgataatactacataccaatccagcaatggccatacctctgccttgctcgccatgacggttaatttccttcagggaaagactggacaaaataatacccacaattccgataatcaacccgatatagggaatgaccacagataaaatcccgagcaccatcgaggcaacagctttactattcgtaggtggaactactgggggcgggttaaatggggcgttataatcgttcgtctcctgaaaaggatcggaagatcgaggctccttgtacaaatcactcatctgttaaattcaactccaataagtaaaatagcaattatataagttctagggtaccacaatcttacaaatcaggacagtacttatttcaattttttaaattagaacgttaaaaagaagaaacctagcgatattagcactttttgaggtaaccgggcatacagtattttacctgttacagatcaattgcgctccatgagagcatcctgccaaggaggtcggagctatgctatatcgtgcaacatcccgcagaaagggctcgcctcaccaacgtttaaatgcagaaacacttaggaaaatatccgctgccatgctacccttttacaaagctattgcaacccgacgtgcttttgccgtccaatggtcacgagctgtcgttcagggcaatttggatcggatgaaatcccttctctgctcagtagcgccatttgccgccaaacaaggcttaggcacgaatggcataggctactttatttcctttttagctcagccaccgatgctctattatacgaatggaacgacgattccaccagggactgtgcagtttacgtttgagccgagagttcatcgcgccatcgcaaaagccgtttttccgctgtatcgcgaattggcacgtaatccatgttttgcttctgccttagctaaagcgatcaacagacaagaccagcgtgcagttcatgtcatgatccgtagtttgattctatcctctgcactgaaatccgtacaaattgaggatgatggctttgccttgctttttaagtacccctttagcaagtatccctatcgcaatctgctctttcgggagttcacttaaaaaggtcgctactagcgtgcttgcttgagttctccaatgagctcttttccaagttgtatagccatatctgtcagcactcggatttcgtccttggttgcatgatccaaatgtgccccgcagcaaatggcaaaattgcccgcaaactcttttcgcaagcaaactgcaatttcttcggtaatataaaattccttatggttttgtaattgcacagtttgaatcggctcgagccgggcccctgctgtaatcgttcccaaatggggctgatcaccgccagaaatgagtacaatgatatcttcccccataaaataggcatccagcacaagacggatacgtccgctttctttttgcaaatgaatcatataatcctctcctgctaaaaatattattgtgaaacgattcactttatgagcattattcattgtatcgcttcctgaacggctcgacaattaaaaatggcccacagcaacctctataaaccgtggctgctgtgggccttcattgttattctaaaagaagccttccctttcctattggctgttaacggattgtgatcgtatgcacagtcttaccgcttgcgccgtcattatccgtcaccgttagctctacggtatacgttccagctgtggtgaatttatgcttcaccttggaaccgactgccgtatcgccatcgccaaaattccagctgtagctgacgatttcaccatctacatcacgggaagctttggcgttaaattgtacatttttgttcttcttagctgattcattagcctgaataatggctactggcttttcattggatgtaggtggattcggatcagggttctgtcctccaccattggttacatacaattttcctggcgcctccgtctccacttcatttcccgctgcatcccttacccggatcacgatgactccgccttccagattcagagaagatgaagtgaaataagtaccttcatagtggcctgacgaagtttcatttattggaatatcgttgcggcccaaagtggacaggttgaaaggcagctccacatggaaggatgcctccaaaccggatgcactgtcaaaggatactcgtaccggctgccctggagtaatacgcacatcctccgcagggctaatgttttcaagcttcggcagagctgtatcgacatacaccgagcgcgtaacggttgtttcgttttcggcaagatccttggccgtcaccgtaatttgattttcgccttcgttgataagcaatcgcttgttaaagctgccatcacttccaaattcagcgggctcaccgttaatcgacaattcggtgaggaactcgtcgtacacggtaccgataacactaactacacccgcgttcgtacgggctccttcatcaggagaagtcaggatcaggcccggtttagtctgatcgagcgtcacaactaccgtttcggaacgatccgttaatttgccgtatacggctgcttgaacacttagcggattagcacctggctgaagatcaaccgacaaactgaactgacgatccttcactttcgttgtgccagccagctccttaccgttaaagagctgaatatcggctccttctgccggggaagttcctgttaccgtaatcgactcttcctgcgtatacgtagccttcgtaggagtcgtaatcgttggagcattcaccggatatctgacgatagcccggatcatgtagttcccttcctcctcaggtgattggctccacgctccgcttacaccttgccagctgcgaagtgcattcgggccactctcatctgtagcaagacctggcgactgtgtgcctacagcagactgtgtatatacgatatagaagtcaccttgaaccgtcaccggctctggaagctgcaccgtcgtccattgtgtctcatcccttacggcagtcccgtcgaatggaccagccagtaatcgtccaggtgctcctgccgcaccggaggcgtcatagatagaatattggaatgccgttcctcccggattcgggaaggcagagttccagaacaaaagcgatgctcctgtcacttgagccacttccgactcaggcgtcattctgactgcccatgaattgcctgccgcgttaaaggctctagcattttctcctgtcccatcatcgtaggcaatgcctccctggaacccgatgaaaggtttcaacgtgacattcgctaccacactaccgttcggaggagcagtaacggatacactgtcgctataataattctcagctgaaatggacaatgtgtatgttccttccagcacgtccagcgtaaattctccagcctcattcgtctctaccggagcaatacgcgcatcctccagcaccaacactttcgctttttggatcggttcaccggattgcttgtcggtaatgaccccatgaatcgtaccgtgaggtacggcctgaagactaaagtttgctctgatgactttgttattctcaatcgtgactgctttcgtttgaggcacataaccataggcttcagccttcagcgtatagtcgcctgctacatgggtgaagctgtatttgcccgtggtcggatccgttttcaccgaacgtccggtttccaataccgtaaccgtagcgctggctggaagactgtcgagaccgacacgtccactatccaccgttgtttctgccggcttcactttctcctggaattcactcttttcagtgcttgtaattttgtacagcgggaattgttcttccgctttttccagcttgatattcgactcaggtacgatgtccttggtcactatcgcagctggaatgcccagcacacggaaatcgtcaatgtaccagccgttcttgttcacactgttatccgatttcaaacggaagcgaatttgaatctcattgccggtgtagctatccagattgtaataaactggagtccactttttcccgttcgtgttgtgagagaacttgcccagctcgctccacgtgtcgccattgtttttggacacttctacataaccgtaatcatagccggcctcaatttcaaaccagtgattgaaggtcagtgttgcgttgcgtacagcctgcaaattaattttgggagaaaccagcgaaaattcagctccgttctcataattgctatcaagatcggttgcccacacattgggtctggacgctgcgctctctggtcctacttccttgggaatgccgcgttcccattcatccttggtaccggaatgagtccagccattatccgagctgccgtcaaaatgatcgctatacagcgtatctggcacgtctactctcagagaagcctcattcgacttgattccttcattgccactataatcctcagccgccactgcataatgataggtcgctccaccgaccgtgatggtatctgtgagtgtcagtgctgaggttgtaccgatggaagtataatttttgcctgattgggtagaacgatacaccttgtactgctttacatcatcatcggaggaagcattccaggccagtgtgacgttgcccacagtatctgcttcagcagtcaaattgctcggcgcagcaggtgcaacggtgtctggctcctgaatcgacagatcgtcaatataccagccatctttcacaaccgtattgtcactcgtaaagttgaacaggaggtataccttttgacccgcgaatgcccgcaaatcaagatattgtgttttccagccgttgctggtgccagtaaacgataatacctgctcaaacgcattctgattgtttgtggttgctacgtacactttgccgaaatcagaattgttttcaagatcgtaccaatgcttgaagctgaccagtgccccttttgagctctcggtcagatcaatcggaggggccataaaataactgttggagttggtctgatattggccttcgagattagtcgcgatgacctttgtacccgaatgtgcgcttttagggccacttgtcggagctccccatttccaaacactgccctgtccaccgatattaataccggcaatgtctttttcgaagtcttgtgtgtagcctggttttacgcctttggagattttaaccttgtatacttcagtttcaaatccattattaccataatcatttacacgaatatagtattccagaccagcgctgtccaccaaaaaagtcgggatagacgcttgatatgtaccatctttgctgtcgccggaggtccgttccaacggaatatatacatagtttgacgtacctgctgttttggcaaatgcctcaacggctgtcacgccgacatcatccgttacatgagcagtcagaggtatatcaataccctcgaatgccgctgcgggcggtgtatgctcgagaacaggtgcttccagatcgtcgccacccgttacaactttaccagacacggagcccagaccttgcatgaccgaaccgactgcatccagcgcattaatgacaccatgtccgtagccattatttggcgaagtaggatatgtgctgtccgtgcgcggtgtagctgtgttcatcaaaatttcctcaagctgatctacggtaagcgaatgattcgcttgcagcaacagagctgcaaggcccgcaacatgaggtcccgccatggaagtaccgttatacccgcctttataggcgccaccagccacagatgaccggatattaacacccggtgcggaaacttctggcttcacctcaccatagggtgatggtcctaacaatgagaagctggccagattatcattgctatccgtggctccagtagcgaaggattccggatagtttgccggattggctaccgaggcaggtccgcccggattggaaagagaggtattacctgcggagaattcggggaagatttgagcatcccgccatgcctgaaccacaggccggaaccattcatcaagacccggtccgcctccccacgagttgttcactacgtctggagcaagctcgggatgaagattcccttgggcatcttttggcgcaagcagccattgaccgccatccagtataatcgcatccgtcgtttccggattaaaaatccgaaccgcaatccacttcgcaccaggtgcaacgccaactcgattcgttccgttttcctcagagccgaccatcgtgcccatcgtatgtgtaccatgggaatcgtcttcctgatcgaccggaagcgtcgcatgactatgcggatcgtaccagctcagctcgggattcacgacattgcctgccgcgtccagcccccgccatttgcgatgaagggccggatgtgtataatctacacctgtatccagattggcaaccacgattccggttccgtcaattcccttttcccacacttgtggtgcgttaatatgggatatgttccattccaccgtagatgggtctacagcgttcttacctgcatttccaggcttagccgatgttttgccatcgtccttctccagctctacagccttctctaccgttgcagacttcgccgttgctgctgtggctgtttcagccgttttggcatttgctccctctgcttgcttgtcaaccgtcaccttttgcagataacgcgtttcattcggcaagactttatcgacctcaggcaactgcgaaatatgatccagcacctccttggtgcttgttacagccaatgcattgacaataaaaaagcttttatattccttcactccgccgctctctgattgcttatccaaataattttcaagcccatattgggttcttgaagccgtttcacgcagagaactgatcacatggctgcgcgcagccattttggcagcggaaggtgttattttctcaagtgaggccttttggagtgcatttttagaaaccttgttggtgtctacctgttcttttaatttgaccagataggtaacatagttattctcctcaaactgtttggtcagtttcggggataccttcgcggtcgtgaccttgtgcgaggctgatttcagctccagcttggagccatccggtgtgttattcgccaaagcaggttgaacaaaggaaaaggccattagcaaagatagtccgatagatagtggtttcttgaatcgtttaggtttaatcaattacttctccactccttttactaggtttaatgtttctggaataacctgtacagagtaagacctcataccttacacatcaaacacacgggttgcgcaacacgatgtggttggcgaccacctccttcatagaatatagaggcacaaaaatatttggctgttcataggtggtggtacttcataggtgagtttacaattccaataggaagcgatgaaatttagtagaaaccaaggagaaaaagcaggagaacttcgaagaaaaacatgttatatcattacattttatattaaaaattgatatataatcatatattatggaatagtataaagttatcaaaacagatatacaagtcatttttttgcatttttcttgaaattctatgacttttatattcttttatgtacgaaaaccccttttttgcggctacgtaatagtgcattacacggttaacaggtgtatgcaatctctgtacgagccgctcaaagggattttcgggggtctttcttaatcctatctttcgctctatatcttgttcattggaagtcgcttatgggatttttgcaaaatcctcacttaagtacggagttcaccgcagcaagcgcgtcgatcagaccatatccgtaaccattgttcggtgaagtccgatactggctgtctgtcagcggcgtcgctgtttttgaaataacatcctccagttgatccacagtcaacgatggcttggcctgaagcagtaatgccgctaatccagcagtatgcgggcctgccatggaggtaccgttccatcccccctcatacactccacccggtacagaagaacggatgttgacaccaggagccgaaatttcaggcttcacttcgccataaggagaaggaccgcgcagcgagaagctagccagcttgttgttaatgtccgtggctcctgtcgcataggcttccggcagatttgccggattggctacagacccaggtccgcccggattggacaatgttgtgttgcctgcagagaactcagggaaaatctgagccgctctccacgccttggtgactggacgataccattcatccagaccaggtccgccgccccaagagttattcaccacatccggtgcaagctcagggtgctttttaccgtttttatctacaggagcaagaatccattgtccaccgtccagtaagatggagtcggtcgtatctggattgaatactcgaaccgcaatccatttggcgccaggggcaacaccgatttcattcgtaccgttgctgtccgatccaacgctcgtacccatcgtatgtgtaccatgtccatttgaatcagtcggcagtgatgctccatcaaccgcatcataccagctcagttctggattaacgacctgaccggaagcgttcagaccacgccattttcttttcaacgccgggtgagtatattcaacgcctgtatccagattggcgactacaacgcctttgccgtcgatgcctttggcccaaacctgtggtgctttgattttagagatattccactcgacacggcttggcgttaccgcatccttatacacggattcttccactgatttttgcgcattctcttccgtcacagccgtatctacagcggcttgatctgcaactacttggtcagctgtagattcctcaactacgggctgggcatccttatctatttctaccttttgcagttcccgcttttcatccggtaaaattttgtcgatctcaggaagtgtggcgagattttccatgacctctttcgtgctggttaccgcaaatgcgttcacgataaagtaactcttgtactttttgacgtttccgttattgacttccttctttaagtattcctccacggattgttgcgttttttctgctgtatccatgagagagttcacaaccgttgtacgtacagaaagcttagcagcagcgggtgaaatttgctctgcagaggccttttggaaagcatgcttggcaactgactccgtatccacctgatcttttaatttaaccagataggtgacatactcactggcactgaattgttggttcagcttggcagaaaccttggcggaaatcgtcgatgttcctgctgaggtggttgtgctggaatcaccatataccggagaaatcagagaaaaagcaagaagagcggtaaaactgaccgacagcgtctttttgatatttttcgacttaatcaatactttccatctccctttacttggttttttaattctcaaggacaaccttccgggcagctacgtcaaaagctcacaaaatagcctctggtactcacctcctttaaaaaatatagattccgccggggtgatatccataggtcatcattctgaggtgaacaacccttggtgcagaccgtaaagaacgagcatcgggtagaaacaggtggacaagtttgaaaatgataagtgaaaaaaatgaagagaaaggtaggataagaaatttagaagtaatcgaggaggttaatgtgcaagtattaaaatacaatttaaaacaaaagaatgaaacatatggtatcttttgaatctagtatagtgtcataaaatcagatattcaagcatttttttgaattttattcctttttttcttgaagaagagaaaaatctcttccattttcgaagcaaatgcaagtcttccttgtgcacttggtttcggagattagaagagatttttcggcattcagcaacaaattttatctgccgctatttactggtatgggaaccgaaacggctccatctggaaaggaagatttggtttgctgcgatctgcggcacagactcgtacattctcggaaagccatttgcctgcatccacagcaatgatcctgattcaccagcgcaagggcagccgtcagggcctctcctgtatgttcgaaaaaatgcttttgtccaatcatatcgtagcatccggttttctgtagtaatgccagcggttgaggctggagcccggaaacaagcaccgttccgccagactgccggtatttctgaattaatgcggtaaagttaccttctcccgtcatatccataaaagggaccttccccatacgcaacaacaaaatcccttgtaggtggtcagtccgacctcccacacctgagttttccaataccgaggctgcaccgaaaaataaagggccttccacattgtaaatagccacctgtggacaatcatgctgatctgtgaccatatgggcgcctactttttcatgttttacagaaggatcaggaagtaccttatctactgaaagtgtattgctcatacgtttaacaaacaatacaactgccagaattaaacctacctccacagccgttgtcagcgtcgtaaaaactgtcagcaaaaaggtgacaaccagcacaatagaatccgctgtccgcgttttgagaatgtgcgcaaaatgcttgcgctcactcatattccaagctactaccatcagcaccggagccatactggccaacggaatgttagacgcataaggtgcgaaaagcaccaggatgaggagcaccacgaacccatgtacgatgcctgacataggagaaacagcaccgttacggatatttgtggcggtgcgggcaattgcacctgtcgcaggaatgccaccgaacagcggtgtcagcaaattagctatcccttgtcctaccagttcacgattgctgttatgccgggctcccgtcataccgtcagctaccaccgctgaaagcaaagattcaatagctcccagcattgcaataacaagtgctggcggcaagagtttcacgatcaaatcccacgtcatcacaggaatatgtagctcaggcaaagatgctggaattgcgccatacgcagagccaatcgtagccacctgccctggaaaaagtaaagctgccaccagtgttgacaagagtagaccaaccagtgagccgggtatcttgggccattttttaggcaccaaaataagcgcggcaagacagatacaagccgtcaggatactatatacattcagtgaaggaagtcgatggatgagctctgccatggaaggcagaaaagtttcatgccgctctaccccgcgcaagccgagaaagttagcaatctgaccgctgaatatcgtcacggcaattccggccgtaaagccaattgttactggcttgggaataaacttaatcagtgcccccagccttagcacacccattaaaatgagcataatgcccgccataaaaccggctatgagtagattctcataaccgtattgcatgacaatagccagcaaaatcggaataaatgcacccgtaggtcctccgatctggaattttgaccctcccagtagcgaaaccaaaattcccgcaacaatggtcgtatacagcccatattccggctttactcctgatgcaatggcaaacgccataccaagcggaatcgccacaatcgctacaatacttccggaaatgagatccttacgcaaagctcctgcgttatagccttcgaaccttcctatccacttcattcctgtaacccttcttttctgtaatagcattacttctcgttacgtataccttccagcaacgagatcgcttcgaccaaatgattgtcaaaaatccgccgcgccaccgcaagcagctccttcaaaagcggatcacgtagtgaatacacgaccgatgtaccttccttgaaactgttcaccaaatttttggctcgtaaaacggccaattgctgcgatacggcagaaccttcggaaccgagcgcagtctgtagctcgttcacattccgttccccttcactcagcacctccaaaatgcggatgcgcagagggtgagccaatgctttgaaaaagtcggccttaaatttctggagatctccttccatgcctgctccgtccccctcacagaattgtcctataaacgttcaacaatatctgaatatttgaatatttagtacaatatcagctttgggccaattgaactatgatgttactcacacttcaccgtgagtaaagtcacatttccccacacttctacctttcagggttgacagcttccacaggtttccattaacatagcaattaactttaagaaaagggggccgacagacatgactgagctttacatgataacgacagacaggcagcatagcacaaccacatatttgagttttcgtctcatcggccccgttcgggcgacatgatgggtgatatcacgctgtctgacggcgtgattagccaggcttttttatttttttatgctattggaagaacaggttattttacgtatttatgatgtgttgatcataaaatgtaatgacactttcggtgcaggaagccgtagacgacaagtctgcggttttttttgtttttttaatcttttatgcaagtatttatgaatttacttgaagaagggaattacccatttatatgaatatacaacatacaaccgactcgtccttgcataaaggaccatacagccatctgatgaagcttccggcaggtgatctaaccgtatatgcttctcagcaacttttctcctcactagattacaaggtgttcgagatggctaataacaatttacaaattccgggtatccgctatatgggatacacaccagatgtacatgtaggcgtcggaacctgcatcggtacgactgctgtatggggaatagaggacggctatgtatctccctccatcgttggcagtgatattggctgcggcatgcgcgtacacctgaccaatctgcacaaggatgctttgaaggaaaccaagctgcgccgtaagctggtcaaaaccatcgacaaatacttgcccatggaagcccatcagcgcgggcattattcggatatccgactggagcatattgtacgcaagggtctgcacggcttacccaacaaatatattccggacagctacactcctaagaaatccacctcactcacccatgtagagcacagtaagttctcctttgacgaggaggtgctgaatcttgtcgaagatcgtacgtggcatcgggctcaccgacagctcggcacgctgggtggaggcaatcacttcgtcgaaattcaggcgattgaaatcgcggaggaaaaccgcgaaacagctgaagcttggggtatgttcgacggtcaggtggctgtgatgattcattcgggatcacgggcttggggtggagcagtcagccaggccagttcatctgccattgccaaggcaatgagccgtctcgggctcggtacctccgacccaagactagtattcgcaccgctggaccatcccgaggctgcacattatgtcgatatgatgtattcggcgctgaattatgccgtggtgaaccgacatctcatcgcatactccgtgcgtgaagcctttcgcgatgtctttggtacaaagtgcgagttgcgtactttgtacgatctaatgcacaattatgcttgggaggaatcccatccggatcacggcagcgtgtttgtgcatcgtaaaggtgctacgcgtgctcttccagcaggacaccccgacaatccacggccttatcaggcgacagggcatccggccctgatccccggctctatggggacagcctcttatattatggtaggtttaccgggcggtcagcataacttccactccatttgccatggagcaggccgtattcgttcgcgttctgcgaccaaacgactcgtcagtgtggacgattttgcaggagccctgggtgtagggacagacgacgaaattgtggtcaatcaggcatcactggaaagtattatcgacgaatctccacaggcctacaaaaatgtagatgatattatcgaaagtgtcaccggggcaggactcgcagcagttgtagccaaatgcaagccgctagccgccctgaaaggagccaaataatttgagtatagacatcccagctatttacgaatttgatgaacgtacagatggacgcattaccggttatgccgcttatgcccgtctgatcgacggtatcagtgaagcactctataaccgctacggcgtaaaatacgtgctgtatgccagcgatgatcccaatattgagtattgggatctgctggaggaggacattcgttcaggtagccccgatctggagcatgtggcacgggtcttcgatcgtttggaggaacgcaccatccagtatgacgatgacgggccgactcctgaatacggcgtgcatctgtcgatgcgtaataacgtattcgcctatcccaagtggggcatcgcgctggcgcgagttccctttttccgtgagaatggcgtgtacaatgaagattacgtatttgcgataggcgatcaggagctgcaaggcttcctcgcgggagtacgcggtcgtgaacgtaagcagaatatgaagcgtgtcaccgtttttaccgacacaagccgtggactttctcggcaggcagagccgataacccgcgcaattacgcgagatgacgtgattttgaaagcggaaatcaaacgggatattttccgatcacttgatcagttttttgaagcggatcgtaccttctatcagacttataacattccttacaagcgcggcattctactatacggccatccaggcaacggtaaaacaacacttgtaaaatctattgccagcagtgtaccgggtccggcagcctactggcaaattacggagtatacaaccagtgaatcggtcaaagaggtgttcgaggcggctactcgcctggctccgatggtgctggtcattgaggacattgattccatgcctcaggaggtgcgttcttttttcctgaataccctcgacggtgctacatccaaggagggcatcttcctgatcggaacgaccaattatcccgaaaaaatcgacccgggtctgatgaaccgggcagggcgtttcgaccgggcttatgaaattagtttgcctgacgaagcgctgcgactggcatatcttaagctgcgcaacttccttgtttttgcaggggaaacaggtacacagaaagcggcagccatgactgacgggttttcgctggcacagctcggagaactgtatgtcagcactgctctggagtggcatgagcagggaaaagccgatattgaactgattattaaaggtatgcgaggcgagctcgataagagccgcaagcaggactggttaaaaaatgtggccgaaggacgcgttgggttcttctgatttatccttccattgccttataaagaaatttatgttatgttgataaacattaaagtatcgaaagggtgaccttaagccaatgatctactaatcctattccaccaaagaaataatcgtaattttacgaattttctggataggattagtgtaggctttgggtattaacaatatgcgcattgcttctttgacgggagcagtgtatcttcttgttcgtacgtctacctcctatccagaaaccaatggatcaggaggttttttgcatgaaaagaatacttggaatcctaatgattaatatcttcatcgttatggtgggcgttggtttaattacccccatcctgccagaactgatcattgaatttggtgccagtgggcgggcgatcggtttattggtagcagcctatggagtgacacaattcctgctctctccaatgactgggcaactgtctgatcgatatgggagaaaagcattcatcgtcgtaggtggcattgtttttgctgtagctaaatttatctttgctatcggagatgagttatggatgctgtatacctcaagacttctggaaggaatggcagcagccctgattattccgcccatgatggcatatgtggcggatattacaacaaccgaagaacgtgccaaaggaaatagcctgctagccgcagccatgtcattcggatttgtcatcggtcctggacttggtggtcttcttgcaggatatggaacgagagtgccgctgtatatagcaacgggtgcggctattattgcagttattttttcaatgatttgtttacctgaaagtttgacgaaagaacaaatgaaggcagctcgggcaagaatttctcggaaggaatctatgtacaaacaatatgtgagatcgttaaggtcaaagtatgcgatgctctttgtacttgttctggtgatgacctttggactcgctaattttgaatctgttcttggtttatatgtaacgaaccgcttccaattctcgccgcaagatatttcaattattctaaccgcaggtgctgtgatcggagtcggtatgcaggcactagttgttgctaaaataattaataagtttggtgaacaaagggtgatcaaaggttcgcttcttttcacctcagctgcttatattttgtttcttttcgccatagatttttggagtatctttcttctcacttcccttattttctttgctaccgctatgcttcgtccagctcttaatacacaattatcgaagatggcagggaatgagcaaggatatgtagctggtatgaataatgcctatatgagtgtcgggaatattgtcggccccactctagcgggatttttatttgatacaaatatgttcgcaccattcatagcaggctgttgtattctattgggtacttttttgcttacattaaaaatgaaataaaagaggacaaatgatgagtaaaaggcagctacgggtgcggggcttatttttcaatgcccgcctgtagctgcctttttattcagtctaatcgcttatatttaacaaacactcaaattccctttattctgcttccccgcttagacgattcaaaaactgaatagcccgcgaactggtcggctgctccaggacctcatgcggcgtaccctgctcaacgattacaccctgatccatcaaaatcacatggtccgccacctcggctgcaaatttcatttcatgggtgacaataaccatggtcattccttcagcggccagttgctttatgaccttgagcacctcgcctactaactcaggatcaagcgcagaagtcggttcgtcgaacaatagtacctcaggttcgaccgccattgcccgggcaataccgacccgttgctgctgtcctcccgataactgatgcggataggattccgctttatcagccaaccccactttttttagcaattccaatgcacgtttgcgcgcctcgtccttgctctttttctgaaccgtgacttgtccctccatcacattttgtacggctgtcatatgcgggaagagattgtaggattgaaataccatccctgtccgcttgcgcagcgccaaaatgttttcttgccggagcttcgttcctttcgcaaaattcagtgcaatatcccctacttggatctctccttggtcaggaacctccagcaaattcaagcagcgtaaaagcgttgttttaccagagccggaaggaccgatgataacaagcactttccccttatccaacgtcacgtcaacacccttaagcacttccagcgagccgaacgatttgtgtatattccgaatttggatcaccggtacaatctcctttatctgacggaaaaacggcctagtcgcttctccaggtaattttgcagcacagtcaaaatggtgctaaacagcaggtaaataactcccgcctcggtatacaccaatagcggttcgtatgtggtagctacaatctggttagccgttctgaacatttccacataggtgatggtcgcagccagtgaggtatccttcaccaagctgatgaatgaattagccaacggaggtacggacacacgggatgcttgcggaagcacgatacgacgcaatacttgccagcgcgtcatccccagggagtaccccgcctcccattggccttcctgaatggatatgatagccgcacgcataatttcagagctataagcccctacgctgagagtaaagccgatcactgaagcaataaacgggtccagtgtaatacctacggaaggtaaaccatagaaaataatatacaattgcaccagcaaaggagttcctcgaatcacccatacatagaagccgaaaatcagcttgagtattctccatttggacagccgggccaacgctgtaatcagcgccagcacgagtccaagagcaaaggagataagcgtgagcggaatcgtaaaagaaacccctgcttttagcagaggcaataatgaatcgataatgatttgtatttggcgatcatccattgtacagacatcctttgaaaagataggtttgggaagattcggttcgacttggcgaacgttgggtcttcatttattatttggatacgtcggctccaaaatatttctcggaaattttcaggtacgtaccgtcagccttcatatcagccagcgctttgtttacttcattgatcaaatcttcgctgcccttattgaatacagctgcgctgtgtgaagcatctgaagattcgtccacctttttaattggtgcgtcaggcttttgcttcttcagatcaagataggataatccatcattgacggtcgcatccacccgtttggaagtcaggaggtcaatggcttggttgaatccctctgttgccacaatttctgcgccgttgcttttcgcgatttgagtcaggttactggtcagggactgcccagcctttttcccttttagatcagcaaatttctggatgtctgtattgtcttcgcttacgatcagaactgccttggagacaatatacggatcagaaaaatcatatttttgcttgcgctcatctgtaatggatacttcattgaacaccgtgtcaaaccgcttggagttcaaccctgcgaatatgccgtcccattgcgtctcgataaactccggttgtacacccaggcgtttgctcacttcagtcgcaatatcgacatcgaagcctgtcagtttccctgcagcatcatggtaggtaaacggagcataggtgccttccgtgccaattctcagcttgccgcttgcttttacagattcaagagtagctgtagcagtggtatctgcttttccattattagatccgttatctccggtagatgcattattggtactggcgcctttatcgttgttaccgcatgccgaaaccagcaatgccatcacgatgagtacaatcggcaaaaaactaaattttttcatggtatccacactctttccctttttcttgataacctaacacgcggctggtcattgaatagtacatcattcattttcacgcgtcaatgcttttatccaataatccctatgcataaggtaagttatatatctttgcaccctgaagttattctaggttgactctttcattggcaggctattcattacaactcccctcacagcaactttttctgtacccttacgttagagatttcgtataataggttttaatatgcagtttagaaatataccggagtgtgatcatggatacccaaaattcaaccttatcctctacatcacctgaaggaagtcactcggcctgggctaccttcacttcacctttaaaacaatccaaagcgttcaccttgttgtggcttggacattggatcgcaatgttggggagctcagtcaccacagtcattttgccactggttatctattccctaacaggctcgactactatcatgggactggcgatgactgtttatatgttgcctaacgtacttattctgcctttcgcaggcatgatcgtggatagaattgaccgaattcgtctccttctgtttacgaatatcgcccggtttggactgatgttcattgcggcggtgctgatgtttacaggcgggatgaaattgccggttctattcgttggcctagcgttgtacggattgatggacggtatctttaatcctgcttattctgccttacgtgcacaggtattcacaccggacatacgcaatgcagccaacgcacttagtcagatcagtatacaagccgtccgtctacttggccctccgttaggaggcttcattgtatctttttcctcacctggtgttggctttggactggattctatcgcttatctgatatcttttgcctgcttttggatgttaagcgctcatttggcctccatcatcggcaaaggtcaggtagatccagaacagcaagatcagggtaggcagcattttctcaaggattttatcgcaggctttaccattctcaaaagccatccttggctatggattacgattcttgccttttccttcattaatatttgttattcaggcattatcgctgtactcattccgtggctgttcaaggttcatcatggctacaatccagtcgtatacggcattgcgatggcaagtagcggcattggcgctatgctgggggcctttgtgtatggatcacgcaagcattggaagcatcgcggtctactcgcttacttaggagcttttgttagcggtcttgctttactactgttgtctgtagtcacctggatgccaggactgattatgagcatgatgctcgaaggatttggcattatgatatttgcgattatctgggagacaagcctccaggaattagtcccagccgagtcttttggacgtgtagctagtctggatctaatgttttcctttgccctgctccctgtcggctatctggcagtaggtgctgtggcagataagcttggtggtatgttcacaattggcatgtttgcaaccatcggcatgtgtatcgtgctgggcgttctaagtgttcctcatatcaggcggtttcaataggaaaaattcgtcacttttcctcaaaaaaagctgctcccacaggttcattttcgaaccttgcggaagcagcttcttttccattttagccttgcgccccatagggctagtctattcaatgattcgtaaagttagcctctactccgtccaacggaacggaagatcaagcttacaatcacgaccagcacaatcgcaccaattaatgcaggaacgatgtagaacgatccgatttcaggaccccagtctcccagaatcaagctacccaaccatgcaccgataaaaccagcgatgatgttacctatcacgccacccggaacatcacgacctgcgataattcctgccaaccaaccaataataccaccaacaatcaatgcccataaccaactcattttgcgtcacctcgtttaagtttttatcgttgtgttctattattaaccactcgaactccttttgaacacacagaagacaattggttaatattaccaccgaacgaaacactgatttaggggctatgataccatcctacgtgcctctacgactatttatacaccccttgtgtgaaaagtgtgtctaatatgcgcttatccttgtattcctgctttttttgtgccatcctcacattatggcttcattaatgtcacttcatgcataagttacaaaaataacagattaattaaggagtgaccccaactggagtgtcgagtaggatgtgccgcctgctgtattgccattacgatttcttcccctattcctggcatgccagatggaaaaccagctggtgttccttgccctcagttaacttccgattaccgttgccgattgtttggcaaacctgagcgcccagttgtatgcagtggattccatgctgatgaggatacgtgtggaagcactaatgaaagagcatttgagctgctaagagagctggaggagtcaactttaccgggtaaatcttaaggagaagttcattctatatgaaggagaattttaattatgaatgttattgaaaaaagaattgccgaattgaagcaatatcggcccgatcttaccgccccgaaggatatagatttattctgggccaaaacattggaagaagttcacgccaaacctgtacatgcgttcaaaactctcgtagaaacgccatatcctcatattcttgcttaccgagttacttttgagggtgtcgatgatacgcctctgcatgcctggtatgtacgcccccgatttgccggagatcaaaagttgccgtgtatcgttctgtttcatggctatacaggcggaaaaggctatcctgaagattattcctcttggctcatgcttggctttgcggtattggccgtagatgtgcgtggccagggaggagaaacgggagaccgtctgggtgatcctcatggtacggttaaaggctgggtaacgaaaggaatattggacaaggatacctgctactacaaaacgattacaaccgatgcccttagagccgtagattgggtagcggagcagtcggatgtcgattcggctaaaatcgcaatcagtggcgccagtcaaggcggcggactttcattaatggtggctgcgctcagcgataaagctgccattacggtagcggatatccccaatatgtgtcatatggattttggtatgatgaattctaccagttccctgacggaagcagctgaattcgccaaccgatttccggagcatttggagcaggtactacatacattaagttattttgacgtgatgaatctggctcatcgcattcgtaccccgatcatggtatcggtagggttcaaggatacggtgtgtatgccagagacgattttcgccgcttataaccgtattgaatcaccgaaaacgattgaaatttatccgtttaccggacattgggttgaaggctttcaaagacgcaaaacggcagaatttttagttcagcatttttcttaattcgatttccaacgctcgaaagtacaatatatagaatgattcctccggtgcacaaaaaaagaacaccacgcatcaaactgcgtaatgttcttttctactgcatcggggccagtcccgcttacgcccgacaaactcctcgacaactcacacgaaacaaatcttctaagattacgatgcagctcgctgttctgctgccgaatcccctgcccattttcgcacccaaacaaaatccataatcatcagaccaaacgggatgaaggaggcaaacataataaaaagaggccgccgtatagaccagtgcagtgctgtttttccatagattaaagcaacgaggagcaacaaaaagctcacccggtatatgttaccaatcaccataaccgcctgggtcatgcccgcagcttgcaggggctggtgggtgaatagtatcgccaaataagctatagcttgaatccagagcatgagtcggacacgccccaaaggtgttcttaacacaaatttaatcccctctccataagcaaggatgttctctcatcctttacacatcctttattataacgaaaaggttcccaaactccaacctatccatttttgagttttgacctaatgagttgtgtctgatacagttgtgtaagaggtgattataaatgcttaaattgggtatattggaccaatctcatattcctgaaggcggtactgctcaggatgcattatccaatacaacagatttagcgcgtgaagctgatcaactgggatatagccgttattgggtatccgaacatcatgcgtccaaaacactagcgcactccagccctgaggtgctgattgcgcatttggctgctcacacatcacgcattcgtgtgggttcaggcggtattatgctgccacactatagcgcgtataaagtcgccgaaaacttccgcttgctggaggcgctccatccaggacgcatcgacctgggaatagggcgtgctcccggtggtttacccctggctactcgtgccctgcaggaaggcaagtatcaatctgtcgaacaatatccacagcagattctcgatttaatcgattacttccatgattcggtgcctgacaatcatcgatttgccggtcttcatgcctccccgatgatatcgaccgttcctgaattatggttgctcggctccagcggagagagcgccagattggccgcgatgatgggtgcctcctatgcctttgcccaatttttcgggactccaggtggtgtagaagctaccgcacgttaccacgagcaattccagccttcgatcctgggtgataagccccattccatggcggcagttacggtggcctgcgcggaaactgaagaggaagctgagcagctggcgtccagtgctagtttgtatttccttttgctcatgcaaggtaaagaaatgagttctcttccgtcggtgaaaacagcaatgtcctatccgtacacggagttggatcgtgagcggctgcgtcagtctgcagcctggcgcgttgttggtacccctgaacagtgtaaagaacaactgctaagactggctgagcagtatcgtaccgatgagttactggtcgtttcatccattcatgactttgataaacgtattcagtcctaccgtctgctggccaaagcttttgctttggtatagacgcaattgaacggaggctgagcttctgaaacattaaaacccccgcctgcctatgatggcaacagcgggggtttgtcgtagagaagggttcattggaaccaacccctctgcactatggaagtaattcaagcaccacaaaagtcgaatatcatatggtactttggtagtatataaaccgacactaaagggtgggtcgtccactcctaaagttccagtatccatataccaaagacgtatgctttatactccaaagcttagaaagattgcaccctaaagtcccatatctttactcgtttcgataaagttagtaacggttaaattctaaggttctataccccaaaccagcttaccctgctgatatacagtgccatggtcccagtctgcgaatgctgtttgggtagcaccataggagtaatcgttggtctcatcaaaattgctccaatttgcagcatgaatccggggttgaatttctccactttccccgccaggctgaatcgttcccgctccatctgtgaaagaaatctccacatatttatcagccttggactttggattcggcaatgttacaaaagttgcttttaccttttcagtgccaatcctagcccagtccacaaaaaactgttgagcttgtttgctttcatctgtgtaatagtagcgaatttttagatcactcagctttacagctgtttttcctgtgtttttgatattaaattcaggacggattgcgttatccttggcgttcgtgtcaccagtgcgatactgaagcacaatcccttgatcgttactgcctggtgtacttcctccgttgccgttattgccgccgttgttgccaccaccgttatcaccgccagtattgccagtattgccatctccgccgttatccccaccgttgtttccgcctccaccattgttgctggagccttccagaatcgcctgttttacgaatttgccggaagccgacaattgcgaatcaggccatccgcccttacggtcagcaccaggcaacagcgcagcagaggtctcatttttatctgccaaagaccagttagtccagctgattccacggcttgcaagaaaatcagtccatactttggattcattcaggaacggaccaccgttacccgaagcatcgcttgtaccccactcggtagcaaatatgcccacgcctttgttcagcgcataatcgacccgatcgcgcaagtactgtccatgcgtacccgcatagaaatgtacggtatacattgtattcttgtctggaagtggatgatctgctgcatcatgtacatcctgactccatgtgcctgttcctacaataataatattgtccgggtccttagctcgaataacctgagatacctcagacgcataaggtcggatttgattgttccagttcacattcccattcggctcattggcaagttcatagattacgttaggcaaatggccgtactgagtcgaaaattcattaaaaaaagctttggcttcatttttatgaatgttcggatcgccatctgaaagaatgtgccagtcaataatgacgtacaagcccagtttctgtgctgcctcaatcgcttccttcactttatttttcaaagaagggttggcaatataaccattttcttcagtgtacagtgcaacccggaatacggaaatgccccaatcgtcccgtagccatttcatagagtcctgatttaccagatccccaaaccattggacaccgtgagagctaatccctttgagttgtacaggtttaccgtttttatccaccagtttaccattctttactgaaagttgtccgtaacgttccacaggggtcgtcccggcagcctccgctgtttgcgtattccagttgaatccgttcgttaacgttaatagcaatactgctgttagcatcaccgctactctttttgcgatccttgggagaacccattgcccattcatcatttacacattccttcctttttataaagtagatgagacttatcagtacgttgttctccgctctttcgccccctccttcatacaacaagaggatcaggtccaaacatcgatgtcacttacctgtatatggatgatactactattatagttagtttcatgttacatttcgactctatgattgaaaatgaacaggaagtcacggttttgggatgtgttctgcttggttggctactatagaatactaaagggacaaaagactcatttaccgatagcaaaattcggagaatttttagttgtttgataaaaaaagactgcttcccgtgccttggctcggtagcagtcttatagatgatcttatatgtgatcgaataatgttacaaatttcgtcttaacgtaggatctccctattacccctgagcagttgcttgaggttctttggtcgtctgatcttccttcatatcgccgccatccgtcgcttgatctgtcagtacagtctcagatgagttacctattaccttgtcaataagttgcagccaaggttcttcactacctccacagctctcaatatcaccgagcagggactctagcgtggttccttcttctggcaaatcaataactaaactgtcttcgtcaacttggatggtgcagcaggttttcattgtaaatccctcgcttaattcatatttgagcatgcagtaagctagctcagatgggatgaactcccatggattccgggataagccctttgaatccgtctgaaattataaacctaatgcacatcaattgcaatgaacaaaccttgaacttttaagaattagcgagtgttacaggcaggaatggatatctaaacgaagtgttcgtgctagtaattttggatttatagaattagttcaaacattcagcaagctccgtaaaaatcactccaagtgcataagcccccgcgtctggataaccaaggcttctctctcctactgttccggcacggcccatgcgcgccacgatgtcttccgtctttttggcccctgatacagcggcttgagcacctcttacaaaggctgtcttcacgtcaaaatctaatttcgcgctctccgcccagctatccgcacatggcactaatgcatctataagcgttttatcgccaacggcggctcctctgccgaaagaacgttcgcctgtggattgtatgccttgcaccgcagcctgcatcatatttgcgaattcagaaacggtgagttcggtgagttcgcccgcagatcgtgccgctgcgcgaaatgctgagccccagatcggacccgaagccccaccgcagtactccatgatgacgagcgagcatgaatgaagaaaggctcccatcgtcaaagaatcttgattcaggatgtctctccattcccgtttcagctgacgaaatcccttagcaacgctcattccaaagtcgccgtcacctgcatgagagtcaagatcgcagaaagatacctcattcttgatgataacctcgctcatcttatcgactaagtagataagattgttcaacgtaactttgttgttctcaataaccacgaaggtagggtccgtttctacctcaaaggatacttgccgattttcgtctgctacagttgaaatatccgtgaattcgacatgatcaacaggcccagccaccttgaacgcaggtgcgttgctttcatgggaaaggagcgttttcagttcgttgtccagcttcatgatggaaaccgagatacctgccatatcgatactcgtcatataattgttgacaaaagtgcgatcgatcgtgatccccttcgctgctagttcgcgagtgaccgaatggttgaaaaggtacagttcttgcagaggcgtaccgccgaaaccattgatcaacagggcgatttctccgctgaagccagtttcgatctgcatgtctcgaaggagatcggttaccattctgcctgccagcgtatccgcatccgtcagcttctcgcggctggtcccaggctcgccgtgaatgccgacgccgtactcgatttcatcatgcccgagctctaatgttggcgtgcccttcgccggcacggtacacgaagtcagggcgaatccgatactacgtacattcgcagcagctttctcggccactgctttaacttccgccagactccggccctcttccgccgctgcacccgcgatcttatggacgagtaccgttcccgccaccccgcgccgtccgactgtatataggctgtcttctacagcgatgtcgtcctcaacctttacatagtccacttccagaccgtcttcagtggccaaatgggcggcgtttctaaagttcataatatcgccgctgtaatttttaataatcagcagcgcaccttttttcccagttgttgctcggatggcctgatatacttgaatttgtgaaggagaggcgaagacatcaccgcagaccgcggcatcgagcatccctttgccaacgaagccggcgtgggcgggctcatgcccgctgccaccgccgctgatgagcgttactttctccgcgttcaattcctttttcttgagcactttgtattttggcagaaattccaattcgggatgcgcaagcgcaataccactgcacatctcaaggaccaaattttctgcacggttgatgacctttttcatgctactttacctccgctttgtactggctcccgatacggtcggccgcagcgattgccgctgcaacctgctccactgtgaccggaaacggcatggaatgaatcgattcctccagaatgcaagcctttgcagctacttccatgagttcttcctggctgatatgatcgacgccgatatcagccaagcagaccggtaaaccgacggctaaacagaaatcaaggacctgatgtaattcttccgtgggtgcgttttcgagcaccagctgtgcgatcgtgccgaatgcaactttctctccatgataataatgatgcgtgacttccaaaatcgtgagtccatcatgaattgcatgggccgccgcaagtccaccgctttcgaagccgagacctgagagtaaaatattagtttcaatgatattttcgagtgcttgcgtaacttggttttcatcacatgccgcttttgctttggcaccatctttcaacagcatttcatagcatagcgttgcaagtgcagtcgccgcattcgtacctactgctggcgcacactgtccttcgcgcactccgttaggcagtccggcattgaccctggagtaagaacgagaagtcgcacgggcttcaaagtaagttgacagtgcatcacccatgcctgatacaaggaatcgggttggtgcattagcgataacggtggtgtcgactaatacgacactcggactttgcttaaaataggcgtaatcgtcgaaagcgccttctggggtgtaaagaacggccgagtggcttgtcggtgcatccgtcgcagcaatcgtcggacagatgattagcgcttccccttgagccacgcatttcgccgcgtcgatcgcttttccaccgccgagacctacgatacaattgcatccgtttgcagtagcaatttcctgaagtctggacacttcctgtctggaacactcacccataaaaccgctttcaataaaggttacgttatatttacccaaagtggaatcaagcttatcttttacccgcgccacatcgtcaggatgcgcaatcagtaaagcggatttgccgaaggtgctcacatagtaacccaaatttaacaattcgttttcaccttgtacatatttgcttgggctgataaaagcttttctcatctataattcctccttatgattgtgctggcttcgttctgattaagactataaccgaaccatgtaaactttacattggaggaatcaaggaatatattataatttacaatcgtatttttttgcactgaagatcacgaattgtacttttttgttattgcttacagaataatttacctataagggatgagaatcttgatacgtgaacatttgagcatccagaaaatctttgatttgaaaaagtgggagcagttgcaagattcattagcatccgttaccaaattagccattctcaccgtcgattataaagggaatcccgtaactagccacagccaatgccaatcgttttgcaagaaggttcgccaagatgagaatctccttccctactgccaaaaatgtgattctcgcggtggacttgaagcggtgcgttccaacaaaccttatatttatctctgtcattatgatatcatcgacatcgcggtaccgatcattatcgacgataagtacatcggcgccgtcatggcaggtcaggtccgcttagccgatccttcgagcgccttacatctcgagcaaatcctcacctcaaaaaatgaaaaactgtacagttccaaatgggaagaacttaagaacgactacgccgatctgccgtccatgacctatcaggaaattcagacgatctccagcatgttatccttattgtgtaattatattgttgaagaagcgatgaacaaaaatcttctcgcagaaatgttcgagaaggcgtcggccacacagtccactccacagttgtccgagatccttcctggctactcgttggagcatatcgaaaaccttaagaaagaaatgaataatttcttagcagatgcctatctgaattcctcaggagatgtggatatttcgtgcggaaatcccgtactaaaacccgccttcgaatatatttttgagcacaaaggtgaaactttttctctgaaagccttggctgacttgtgccacattagcccaagctattttagtcggctgtttgcgaaggaaacgggggagaacttttccagctatctttcccgcctgaagattaaatgggcgaagcagttgctcgaagctacagatattccggtatcccagatcagtagcgagctcggcttcaatgagccggggtatttcattaaaatattcaaaaagtatgagggcacaacgcctgcggtgtaccgaaagtattacaagggataaaataaacgaaaaacagatgattcacgggtctaacgtcaccatgatcatctgttcatattgttgtgctcaagttgcgtatccagctcgtgcttctcaggctgcctgagattatgttttgcgtcatgtttactgaatctgcactgcttaatcccttcatccccgctcattttgaggtgcattgtgcacatggttggcgtcggtaaacgtagaaaaacagatcaatcatggtggtatctggatattaattaacacaccttatgtaaggctattgcgtttaatagaactttttccagacattctgtacctgcatcttatttcatgaaaacttcctataggtaaaacaattaatgttggtgaatctagggtaaatctatttattcggcactgagtggagtctatgtaatcagccaccgggactgagaaacgagccaaaaaagaccacattttaatcggttagcttatacagtgcaatttgtatttcagcattagccccagtggaagcgcataatcacctgcattcggccaactaccagccttcgttcaacacgttgcttaaaggctttgcaaatgcttctggacgcataacaaactttcctaaaaaaatcctagcctcatcttgagctttcggtccttgagaggcgcactttccagcttgtccttgcccacagaaccatacaatggacctctttcccgtctccacctccttagtcagaatcttcgtgatgccctttttactatcgggggcatacatatctattctcatcgtctatttaacatgtctgtttcagtgttgttatttccaccgtcgtagcaaccgcactaactgccctataatcgcttcatactctgtttgggcttgagcgattaaccccaatgtttcttttacttctagtacctgatttgttattttctttttgtgattttgaacatgcaaaaagactcattcctcctctttgttcaagttggaataagcctttgaaagttaccaagcctattattcaggttttaagtgattggattattgtatatgttggacaaacttattgtttcatgcaattaaatttacacaaacttcttaatactactaaatgacaaacaaattaacattttcttgaaatcaagatgtactcataatgtataacttacgctatccatcagtatttttacgatactaaaaaatttagcaaggatcaagtaaagaaactgacgcccgttaagtaaccacggctagcttattgctgaagggctattctcttaatgtcagcaaagttaggtattgacgaccattctcacaaggatttttattatattcaatatcatctcttaatttacactaaaaattaatacatattattttttcctttaaatacatttaaatatattattcattttatttgctaactcaataatcatctctcgttttgctatcttgttaatccattgaatgggaatttgctgaattccataatatataccagccaaaccaccagttaccgcagcagtagtatcagtgtcattacctaaattcacagcctttaatacagcgcttttataatcatttgttgttaacaaacaccaaaagcttgcttctaatgtgtcaataacataccctgaggaatttatttcttcttcatcaagctccattaagttttctataagtatccttttaaaaaattcaagttcaagggaaaaaggttctttcttgtaaaagaaattcaaaatgttgttcctcataatattaaaagcttcttgaagggagagcccttttaaaagtaataaagcatattcaacatatattgagcatgctaaaattgatctaggatgagcatgtgtaatctttgatacatcatgaataacttgatacttatattcttcatccccaacatgttgtaaataaaatgataacgggagaattctcattaatgatccattaccgttatcattaacttgcttaccaccagtctctgaaggatgcctaccttcaattaatttttttacagattctgatgtagttcttccaatatcaaacacttcaccatgcggagtccaatatgattgttcataccattttttcattttatcagcaatatcagtaatataataaccattacatagactatctcctaggcagaaagtcaaagagctatcatcagaccaagttcctgctggttgttcatgagttccgtaaccaatcatatcaaaaataggggattttttcaaactagctcttgaactaaattccgccggtagtcctaatgcatctccgacacacacccccatcaaaccatctaatactgtattaggtattactgtattccctttactactcagaggcttaaatttagttgttctgtatctttcctcaattggagaaaagcttataccattatcatttaaatattttgatctatgaaggactaaattatttataatttccctaggaatcccttgtggaaacgctaaacaactgtcattgcctttaaaactagtacaataaaaacactgcgaaacactacttacttgaatatcttcatcaagttcccatcgttgagtcatagtcaattttttgttatcttttgactctggtaccattagttatcgagctccaattcaatatttttcatcccgtcttcctcccaagcttttgtaatcttaaagctatgtccccgtccaagtaatatttcactttcgatgtcatcaagagccccaatattagctacagaagtaccctttttaactttaattatagcaaaaattccatcatcgtgagccatagcaaacatctctgctacacctggatttgtacttgtagagacaaaagcgtcatcagaatacttaaaggattgaatttccataatcctattccaattatcccctatttctctactactaaaacctcggtataatatcatgtcttctgacaatatacctttgactattgctgaatctaataatggtacatattttttaagattttcattcaaactgtcgtaccgaagccctctatttaactccttataaatatcattgcctttatattttattaacgcattaatttcagcttcgcttaacgaattaatccaactctcgggattatgaattggatcatgagtttcaactttccccgtccccttagtttcaagcggcatctcctgtggtttgctcactttgggagctgtaagtttaatacttgaactggatggcttggcagctatattaatcttccctttggagatagatcccgtctgattaatctcgggagaagtaaccttatacttgcctgctccacttgtgttcagacgaggtttaactttcactggtttggtagtaacattcatcttctctttggagatgactttcgccggattgaccttgggagaagtaaccttatacttacctgttccgcctgtgctaagacgaggcctaactctggctggtttggtagtaactttcacctcattggagatagctttagctggattgatcttgggagaagcttgaactttcattctttgtttgagcaacgatagcatttgagcagtcttgccgttacttgtgagttgtcttgccgatgtgtacacttttcccatgttcgatttcactaaagggcctaatccagcaaaagctccaccaaacgcccctccaagtgtcgtccctgtcactaaggcttctgctaattcgtcactctttgagcgatcatgggtcagagaaaggccaacagattgtaatccaccagatatgctccctgtaagaaccccgttagaaatcttttgggatacctctttattcattactttccctataccgtttgctaatttattttcaacagcttgtcctgctttggtggccaaagtgctttctgcaattttgactgtacctgaataaaatccttgccctttgataccagatccagtcggagttaaaaagttccccgcaacgttccctgcaaaatcacctattttatctaccgtttcatttcccgttgatgctacctcatactctacgggactgccaatagcagcagcagatgaagtactgaaacgctcaattgctttacccgcagtagtttctagtagaaaataattaatcccatcaaccccaggaactagaatattcttcttcatccatttcaatgtagggtttgaagggtaagtggctgttagctccctttgtcttttctcatactctgagattttctcttgtggtttaggtagtgcattcactctctttacccattcatctaatgctttcttatcccccgcagccccacgagctagtaaagaattagtcaatagataatgggcattcaatggattaggaggagcaacatttttaggtacgcttgccagtagcgataaacctgctttcgtataattctttttatatacgtttacgcccgtatttaaagccgttgccacagatccaactatgggaatcatacctgctacacttagacacgtttgtaccttgttaagtattccgtccaaaatccccgacttcgggttcatcttggctacggttttcccaggagcaggcttgctctgagatgccttcatttcattataggcttgtaccgtcatgagtggaggttctggtacaggagctagatcggcaacatatacaggacgctttataattccatccagattgacttgagatgagcgaaaatcagtctctccatcaagtatcaaactgcttctcgctgcctgcatatatatagactccccagcctgcatactcagtttagtacctgcatccaacgtcaacgtccttccagcgtagatggacagttcaccttcactttgaacttgcactccattttgatctagttggatatacaccttactcatcttcgccgtcaccaaaacttcagatggacttagcttcagttccttacctcggtttgtcccccaatacttgacgtcaggatcagtcaatttgggagtggatgacttactacgccgtacagaactcttcacaaatccttccgactctcgttcatttggaaattgcaattgtactgtatcacctagctcaggcataacgtaccatccggtatgcccctctgctgagaatcctgtgtcgtaaggaaaccacgttgccttgctcttatcttgtcgttcatcaatgctcagatgtacacgcacttggtctcccataacctcgacaactttaccttccaaggacgccccacaaatttgggcattacaatagaggttttgatgtattccctcgctctggaccaatgtgtattcatgcaatagtaatccacttcgtattttggatacaatccgggttacaacaagctctttgcctcgaaaccgcaggtgatctcccggtcggaaatactgtccactttctacagtataacaggtcatatgtaatgaggctgatgtctcaatcgtgtcctctgtttctcctattgctgcaaaacttcgttttgtgctgtataccacctcatttaattcacctacattcccttcaggtataccgaaccaaaacttaggtgtttcagcagcaacttctggtaccaaaacacctccgaaccgggaagccatacgttttaaaaaagcccaatccgtttctctatattgtagagtaaattctcctaatttggtattttgagatacagtatcaataatatccgatccttcatacttggaaagaatctgtctttgtaacttatcataggttagattctgatcttgaaaggatcgggtaataggctttatatctagttgaatcgtatgtgataccgcttctatctcaatataataaatatcacgaactgttttcaaatccacatgcgtaatttctccatgaaataatatccttacacgcttaccaagttcatctttttgaaacacttctacagactcggaggcaccctccatttgaatcaaacgagcctgctctccttctggaaaaatcccccgaattcgtaggaaggcgtgatcatttaaatttcgttcaatatgcagttgttctatatgttgtataggataaataccgacaaattctaaactctgataactcgatattttctcaacttggctcactgagtatattccccctctcttacaacatcacctaaaaaaattgcaaaatatctattgggattaaaaattcaatccaaattctggccatcgttctcaatacttatgaacccacagtataaacatgagtttgaacactggtctgttagcgaagcctgtccttctaccaagacatctttttttccacctatccatggctttgtaatcattggaatacagggggcttttttcacaccgtaaatatcaaccatattgctatttaaaactgcgggattagtaaggctgaaacaacgtccgaaacctgaaatattatcacccggcaaatagtcactcacattcatctgcgctttatccttgatatacactccatgactaaatggacgcttgagtcgcgtcggttgcgtaccaaagctacattttaatattgctcctgcaacaacgtaacctttcttgtcagctgaattggcctgtaaaatcatttgttcttctgccatcctactacctcctatactttaagcaatcagtttgttttcacttcactaccgattacactagtatcaccaccgagcacgatgttgctgctctggctagatagggcaacttcctctccagcagaaatttttatttttttaccggcactcatatgaatatttcctccagcagaaaaactgatagccttgtcacttacaatctgaattccacttccttgattcaactggataaaaatggccccatctttacctgtaattacgatttcatcaggtgtcattcgaatttccttgccatgcggtgtacgaaaaatcttggtatcaggactgtcaatcttgttgtatccatctttagtgcgatcttgacgggccgaactactagcaaaaccctcttgctcctgatgtgctggaaaatacactcttacagtatcacctatttcaggcataacgtaccatccactatgtccttcagctgtataacctgttgcataagggaaccaatgcgctttatctttagcttgaactacatctatttcaagatgcaccttaactctgtctctctgaagcgctataaccttaccctgcaacgataaaccgatcatttgttcattaaaaatttccctatggcgaagaccttcatgtgaggtcaatgtataaatacacttcaatattcctttactcatttcagttagtgctttatatataaacaaggttttcccatgaaaagtaacctgattccctagttcaaggacatgattagtctctacaatatagtctataaaatggttttcttggatagtagctgtaccattttcagaaaaatagcggaaggaagacatacgtttactaatggtataatgataattttccaagttcactggggcattaacttcttccacaccaaaatagaatttaggggtgctaaacgtagaagctggcatgagagatgtatgataacgtgaagcgatccgtttaagaaattcccaatctgtttcgcggtactgtattgttagttgatttaatgatgctcctgcggttgctgagtcaataatatcaattccaggataatcgttagcaataaccttcaataatccagccattttcatatgtttatcttgaaatgaacgactcttcttacatatgtcaagcttgtaggtatgagatatagcctcaacttcaagatagtatacccctcgtacgaatttcacttcaatctccaacactgtaccactaaatatcaataaatactcgccttcctctgtaatctgggatacctcgattaaagaatctgcctcagtcatttctacgtaggtgtccttcagttcttcgggtacaacagcagtaaattttaaacgtgtgtgatggttcaattgcttctcaattgtcaactcctgtagattaactaattgatagggtgtaatttgcacattgctgtatgttgtacttaaaaccttcatattagttcaccttccctgttggcctgaatttctaaagaccccatcataccttttgctatcggccgccacagtttaacctcttcttccatacagctaaaagtaatgataagagcacgctcctctaatgtgacaaaacaagccagattgtagagcggtgtactcaaagtgggcgttataaattcacaatatccagccaactgatttttaatattgataatgccgtctccgtaccattccataagcttttctgtatttttaagaatattgaccatttcatttttaaatggctccatctcggactccgaaagctcacttgatgtatggttaaatgtaagatttgttgtacccgtattattcgtaaaaataagtcccggtcgatggcaagatggatactttaacaaagcatcttcttcctccattttcttaaacgttttcggcatggtcatggatatacgctcattcagcaaaatgcgttcagttaaagaaacagtctcaccgtttaaatgtattaacgtctgcagtgaaatcgttgaccagtcttttacagatacagataacttctcttgctttaatgagttcattaatgctaagatttgctcgtccatatactccatatcatcagctccttggcctcattatcaacccatcgataatatgaccgttttccaaattgattctcttactcaatagctactatgactctaaactgctaatctaccagcatccgttgaccacctgagcgagcgacacccatgttcatacggcgtccccctttttcctccaatacacgagacatgacctgatgtaacttactggaatcgtagtctcggtaagctgtccctgatcgggatgacaaataatgaagaacggcttcacgttcaataaagccttgatttagacacagcatcgcaaaggacagatcaagtggatctgacgttccacgactgataagctcacgtgcgaacattttgaaaatacaggaaggtagcgtcggcaaagttgtacctgcctgttgtacttgaataaggttaaatgtgttgaactctgttgccaaatcggcaaaatccacataatcagatcgtaatagagcgcctgttttgagcttaaatctgcctaattccagctcacgctgattaacttgttcctcttcgagagcaatttcacccaaataacgctgaaaatcggcagtggattgctcttcttgaaatttgattttcaacaccgatagccgccccgtggccgcatacggcacttcctgctcctgctccagcaggtatagtctatccttgtgcttcacgatgcctctaccaatggtcagcgtgttctccccgacagttacgttcattccggtgataataccatccgaaaaatcctgataccggatatccagaaaactgcgtgggtagtctcgcaggttctccagcatctcggtttttagaatacggcccttctcaaacttcggaacgatatgtgttaacatggtgctcccctcctttctctattcttctttatttaggggaacagatagccgattcacaccgggcgcaggaggtggaacaggaactgcatcatcgatgggttgagctttgcttactccaagtagtccagtaaataggcgaatattcttttctaaaaatctgcgtatattcatcttgctccccctgtttgaagactacggttcattatgatcttagaatctatttatctacctttacatcccaactccgcgcccagcctgctcgcgaaggatatacttcaactcgcgtttgtccacaacataggtacgggcaatcagatcgtggagggcctgttttctcgccgtaaaggctgccataataaaaccgacgaacaaaatgatgactgatagaagcttactccagtagcgtgcacttgcacgtccaaagctgagcttatggttaaactcatctaccacaacgatgccgagagccagcttgcccaccgttgctttgcatttggacgattccataagcgcataatatagccatatagctccccaattcagcaaggtctgtcctattgttttcattgtaaaaatataagtcgatccatctgagagcaaagagctttctgccggagacggtacccaatcccctaaggtccgaatcacaagccagatcaatccaattatcataaatacaaaccatagaataaggctatcgatgatataagccaaagttcgtttccaaaaacctgcatacagcacgttatcccctccaagtgttgtgtacttttctgatttcagcattttgtgaaatccttaatttactatttcgtaccgtcaaagaaatccagctcggagagatcattttcgaaagcaaaaaagcgtttgggtcccagatgcagcaattcatctcggcgggtaatcgggactacataaaagccccagcggctatctccgacaaaaacaaaatatttcgtttccccattacggatggagtccgtatcatcctgcgggatatcccgcccgtacagcacggcaatttcctcatacggcatgggttcaaaagcttctggccgactacggtacacatgacgctgacgcagcttgccgccgtcggccgttaggaagaactctacctcagccgcatgagacggccgggaaatagaaccgcgtacccggttgctttccaaactcgcaatcagctccttctcgcgtcccgtatgcgtccatgcgctgaccgtgtacggaatagccggaatatgattggtaatgacaggctcaatcgtgcccatttttttagcgttcaggtaacggatagccccgcgcagacaggccattttcaactcaggtactctgctgaggtcctctgccttttgacgaaactcaatactgcgccccggtacaaattccttgagtgcttcgcgaaatacgtcaatccggcaggactgcccggttagcttgataatcgaataatcctgcaagcgcccctccagataaaactcatccagaaacttgcgcacaatattgtagatgtctgccttaagaagttgctgtatctcccgaatgttaaacaccacatcaggcaacccatattcatcacgaaatcgtccgttctcgatgactgataccagccaacggtccatcactgcaatgttcaggtcgctttcagcagataatacctgctcggattcgaagcggctgcgtaagattcccgtacgcagaaaaaattcctttttcatattttctgccgcgctccataacagatgaaaattactcagtacccgctgatattcatcccgtgtagcatgttcatactgtttgaacgcggtgggcaagatggcctctgcctcacggtagcgttcctccagtcccgcatatacagcatctacaccaaactcatccacatgacggtataaatctcccgaaggaatgccgatcagggcatcaatatcggtgtcaggcaaacgagtctcggcagcataataacctgcaaatacaattttcataaactgcataatccgatacgtcagattgtttccaccaaaattggtatccccattttcatacgttgtgtgaatatccagcttgtaagcaatacgtccgtcctcaattcggaatcggcaggaagacaaatctgtcgtgcctcctccacaatcaatgacaagtgcctgatactcctcaccgtccgcaaaagtccctcgttccatctggtctgccagcgtgttgtacagcacagccagcccttcgtccaacgcatcctccgcttcaatctggtaatccggcaaaatatcgctaaacatctctataaactggggctgcagcttgaccggagcagaaaagtgcaggttgcggaaccgacacttaaattgctgctcggctgtagcaatcacataacggataaaagcagctaaaatatcgctgcgggaagcagttgccgtattcccctcggaatccattaattcctcgattcgcttataatcgttgacccaacgcttgatcccccgcaatactgtcgcacggctgcctgccacgtcagatccacgtagtgcatcctccccaaatacataaaggatatgttctggattggagcagtctgcgacgcgaatagcagtcggcaatacttcaatccagtcgccttctgccccttctgggccggggaatgacacataattgatggcgttcagccttaccgtgctgctcatacctgtatcaggagccgtaacgtaggaactatccaaataggcacctgctgtggtgttcgaggtgccaaaatcaatcgcaagtaccgcatctgttgtttccgtgccccgaatgatcagctctgccaccggaacccggtgaccttgaagcttcagcggcagcattggcttatctccatagtagaggttataaaaatattctgattcctgtcttcgcagaaatagcaggctataactatgattggacgtctctcgcagttcagcgtcgcgatgacgagaaagataatatacgcctgctcgtccctcatccttcaccaaattcaaaacaccgcacagttctcctgtcgcattcaccagcagcacattagatgagctcagccaaggcaaatcggattcgatccggtagttgtccatgcgacctgtgcgtacaccctgatacagcgtgattttagcgggaacccggataccgctgctctcctgccgacggtcgttccagtttcgctgtagtgccgattccatgcgttcaaaaccaccaggattcggccttgtgatgagtagatgctcctccgcactccgaaatcgcaaaatcacgcgaatcaattcttcacgtgccaggcgattggcaaagccctcgaccagtcgttccttatcgcatatcccgcgtaactgaaaggtcgtcatttgctccaattccgcccgcgtgtatttcgccgtgaagcgtatgctttttcgatcggtgagcgggtctagcaacctgtatgtatagggtccgttcatcgttcacatgtcctttcttagccatttagccttaatagagggcgatagcgtctattttcatcgtaggatcttcctctaaaatgccgaaatgacttgtccaatacaattccgtcgtaaaacgtgccggaagaaacaaatccagaatcaaatccactttaatccgtgacaatggcgtctcctcttggccgatatagatgagtaattcgtctttttcctcacaattggtgtaaatgattgagcgatgaaagacgcgccgcatcgtttcttttagcagatgtacggcttctcccgtctcatacaggcgcagcagtccttcagcaatcgcgtcctgatcctcacggtttaattgtccaaagccttcctttaccttcaggccaaaaatgccctctgcaatatcacgccgaacaaaccggatatggtactcccgccgattcatcccttgatacaagtccatttccgccagaaaatgcatcataatatcaaatagcgattctctcagctccagatactcttcagcatccggtggaaacagatcccgaaaaatagaataaaagcggtagtacggattgatttccactacctgctccaaatgggaagtattcaactctgccagactaagctccatatacggagagtagctgacagcgggtacgaagcggaatttatctacatccagcccctgttccctcgcgcgcatgagcaaatcccagacgtaattcacacccattctccttcacacttgtactccggaaaatacatctgcacttccgataccagaaaactcattaaatcggataaaatataagcaggcgcggttggcgaaacatcgtcagaaccacgtctgaaccccaaacgcatgatctgcttgccttcctctgtacgtacgttatcgctgacaaacggatttaacggatacgtctgggttttggttacaaggttgcttgcatcatttctccctgcacctccccagatgtccacacgttccagctccagcccctgcgctgcttcaaacgagtttacgatgcgcatgatttccgctttggcacggacaatcacggcctgttttcctgcatagcggcccaaaaagctgtcctgtcgccgattagacaataacggataagtctgacgactaagtctcgttgtaacaggcttcgtaaccttcaacacattccattcgccagacttatcgcgtggtgtgacaatcgtcagttcctcttctgtacgcttgatataccgaatatcgccttcagtcccatcaatcaaataaccatgctcaggacctgtttttcgcaaaggcagcacatgctcatagttcacacgatccatagcgggtataggaaaaccgctgttctttagagatagcctttcaatgttccaaagcggaaaaacgtcgcccttcttaaaaacgtcgaattcctccaatgaaattgtaatttcatgaatttcttcatgggcggccggatcgccgtctccaccaatcaatacacagtccacaaacttataagcgtacggatgattaattgttttccacggcatgccattttgcataaacgtgtgatataactgctcaatttccaaaatataagaacggttatgctccagacgaaaacgaatcggataattgccggtttccgtgaccaacattcctgagaaaattcgcttgctgcgcaccagtgctgagattcgttcggtctccatctcaagaaaaagcgtaaacagcggcatcgcaccgccttcgcgtaccacctctgccacacggctgatgtccatctgtttttcctccgtatcagacggtaacacaggatataaaaattcatgaatcgggtcatagtcctcacgcgatgtcaatgacacgtacacatcaatcttttcttctgtattctcaatttcctcaaatacccgccgttctagctggcgggtcatttcttcctgatattcgacgaggttcataaatacccccgccatcatatttttcagtaaacgtctctgctctaaatcgtccatcttgctcaaacggtcctgtaccagctctttcacgacgtctcactcctttccggctccagcattcattgaacatgaaaaacttaacctccgttcgcagcagcccgatcttggttctctgaatcagacgcccctgctgctttagaagcggaatcagcagttccttgctctttgttggtatccaccttggccgaaggggcagttccatcgcctgtgcccatactctttgcagccgaagtggcttccttcttcgcgggtgtagttcccgctgaagccgttggcgcagccttcgtttgcgattctgcagcaggggttgcagcagcggaagatgaagctccacccgctgtgtcccctgcgtccgtgtcgttcaacgctccgtcagacaatcccaatccagcaggaagctgaccatttttctgctgttccgcgctctgcttttcctccgccttggcaatactccgctccaatgccagaacactttcaagcttatcaatctcctgataaatttcctgtgccccgctataggcatcaatggctccttcataatcgagatccttcatcatccgatcccctttggcctgaagtttgccagcttgaatctccttgagctgctgctgaatagctgttaatttatcgttggcctcggtaattttcttctccagttctttttgcgcggacgtataaccggattccatcgcagccttgtttgctttcttgtacagcttaagcgcattcgtgtaatcgccgccctgaaatttcaaatctccgtccttcatccagctcgctgtctcggcatagctgtccaattggtcgattttatgctcaatatccttcacattaaacggtggatatagcccggcgcttttccgtgctttctcgtagctggcttcagctttggtaaagtccgccttttccacgtagccgtctccgtccaccagcaattgagatagtttctgctcggctgtatacagtcgcttatgaatcttatcgttaattttaaccgccgcgtttttcgcttcgctgtaggacttgagcgccttcgcataatctcctgtccttgcataatcatctgcggcttgggctgattcgatcatcgtttccagtgcagctgccttattcgcagccatacgagccagcgtaatccatgctcccccgcccacaacaataaaaacaagcaacgcaatcaaaatccgtttgatcaacttgcggcggtttttaggcttttcctgaaaaactttatttacataaatggccgcagccgtgtaattattcaccgtccggtgctgtttgcttagcagaacctcttccaaggtgtccgtcagcatgaccgggtccttcgcttcctccagcgcccccagcatttccgccagctcgacgtcctcccacatccctgaggtggcaagcaggattacatctccatctgcaagctgggactttttggcgtaatgggcatgaactccattcggatttcccaagtattccagcagattacctcgttcctcatgtgtgctggtcgcttcgtctggaatgcgtccatcatctgccaatgactgagccaaactatgatccttactgcgaaaattaagccttccattgcgaaaatgatatagccgcacattaccgcacgaaacatacaccattttgttatagttggtcactaccatcagcagactggctttaagccgaacacgacggctttcaaattgcagccattcctgcgcttcacgcagatctctcatcaagcgccgtttggacatggaaggcttctccatgaagttttccagcaccgttttgacaaccatttctgcgctgcgcagctcctgatccgaatccagaccgtctgcgaggacataacaggccatgtcgtccgtctccatgaatgcaaaatagtcccggttgtctatgtaagagcccgcttccgacacaaaggcggtactaaaatcgctgttgtccttgcgcatcgctacccccgtctttctcatttcatcctatcgccaaaataagtactgtcgcattatcctgacttttaaagcctttatcattaatggcgtcgatcatggcatccgctgtttcctgcggtgttccacccttgcgcataatctcttccaattcaatctccgtcagcgcctcctgaatgccatcgctgcacagcagcacatgatcgcctgaatacagacgaatcggtgcattacccagttccatgctctcaaagccctcatagcccaagtagttgaccagttgattgcgcactggactcgttttggcttcctccgaggtcatttgtccagcaagcactcgttcctccagcagtgtttctgctgtatgcttggaattgactgtctggaaatgaccattgcggtagatcgtaatcaggctgtcgcccaccgctccgtaatacagctgatagccccacacaatgaccgcagccagcgtcgttcctccgccctgtccattcaaattttgcaaaatgccgcgattactttgagttgccgcctctgcaaaatatccgttcaaattcgttgcatcttccagcttggcaaacgccttcgtaaaagtcgtcacagccaaggtactggacatacgcccattggccagcccactgataccgtctgcgacaacagccagcgtaccgacaggtgtcgtcatactggcgaaataatcatcctgctcgctccggctcccgatcgtttgaccatttccgatctcaattccactcatgatacggctaccggaacttcgcgtcagtcgtatacggatcatgagcagaacagcgaatagtaccgcagctccacttacaacaaaataaggctgcatatcattacctccctgcaccattgcccaattccgtcctagttttcgttatcccactcaaaatgggcgccacacagcgggataaagataaatttgctatgtcccagctgaatcacgtcataggcagccagctctgctggtgaatataccgcctcgttattgtggtacgccaaacctgatgaatcgcctggcagcaagtaaaagttacgtttcttcggatcatacacaatgaccgcatgatttctacgggaaatcgtgttgtccccgataatgcggacatgcatttcctctgcgcgcccgataaagtttttctccgccataatgcgataatcttgacccacctgtgctccttcgatgcataccagccatccggttactggatgaatgcccaccgtctcgcccaaatacggcattgttttgtcgttatctcctgcgacgtttgttttcgccactggctctgcgctcttgggtgcagctacatttactaccgtgttgcaataaggacacgtatttccgtgctttcgtgtactgaacatgtgtccgttcgggcatcttgtcaaactcatagtcggttccttcccccattgtcatgattgtcttttcagcgatctgaggattttgcagcatccccatctatttaacgagcagtctcgtattggcaatatataataaatcacctgagtaaatccggtatggctcaccgctttccagcttcttggttacactttcgttggcagaccgcaagcctgtaccattaccggaatccacatcctccacaaaccagtcgctgttcacccggttgagtaccgcatgctccacacttaccagggaggcataatctgtacctaccaaatcaatatccgcctccgaacgcgacgttgttttaccaattaagagcgacgtttcgccttcgatataccattctttaatggactcgccctcttcatcaatcaacaccagcttggcaatccgctgacgttgcgcctttggcttggccacgggtacaacggacaccaggttgcgcaatatgtatacaagcacgccgattccaatacctatcgcgaccacggttttcaaaccgctgtagcctgtacgattaaacacataaaaggcgatcgccagcatcagcccgaacatggcaacatctatgatgaaaacccatctgttctgcgccgttttcactgcttgcttcccccatttctatcctgaaatcatcactttttacgaataccgaaaaattggttaaacatcgcggaggtatccgtcggatcaccgggttttttcgtttttttccctggtgagccctccttcgttttcggatgaaaaccaaaaaattgctcaaagtcagttcctatatcagccggattgaatcctttggctgccgtacgcgcaccgctggaggatgcagaccctctccctctctcttgctgttccccgccagctccctcagtttttcggatgagctcggcatcgtatgcctgccgcaatgcttcgtcacgcaaggtattgtaagcctcgtgaatcagcttgaacttgcgcgttgcttcctcgcttccctggttggtatcaggatgatactttttggccagtttacggtaagcctgcttaatctctgcctccgaagcatcccggctgacaccgagcagctcatagtagttggtcattgtgtgatgttcccctctccgaaaaaaataaatattaagagacccgtaggcctcttaatatttatccaccctgcacttgtgtgccgggtgagtgtgtttttaagctgcacttaacgtgaagacgttaagcttaaaccggatatccgccgtcgattgtagccagctcggttttgtctttcttttgtttgatgtagagtgtaaatgcacctacaccttctgtgtcgccgaagtgctcggtgtagtctacaacgaaagcattcgggaagtggattttacgcacaacttgatcagctgcgataacttctagtgttactttacggtagctgtctgctttttcagcaggaaccagagaccacaaagccagtttcagcgtgtcatccgcgctgtcaccgtctactgctgtgatgattttaccgctgatgcgcagcgtggagcctacgtcagtggagcgtgcattggaatcgtccggtgtatcggtgtcataaataaccgtttggatgttatccaagcccagctcgattgtttcttgtccttctactttcaatctgaatcccatgtgtgttgcctccttgaaattaggtaatatgatggcgggagatgcaaagcttctccgcgatttatgtataaaggcggttctggatagaaacgcctctaacatctttcgtagtgctcggatcatgatttgaccgagctggttcccttagtgatcatgacttccaggttcttcacattaccgttgaagaccagatcgatatggcacatattgcttttctcatcaataatgaagctcatatcgtctccgtcctgaatgatcgagttaacagatcctctgctgctcagccacttgctcttctggctactcggattgttactgaagaagcggacgatattttcgtgtttgaagtcccctgtctggtagcgcaaaatacgttcaatgtacgtgctgaccagcgtcttgtagatggagtcaaaaccgtcctcggacatcgccatgcttctcgccttgtagacggtaatccggcggatatccttatcctggatctgagcattctccgacgagaatacaaagccgaagtttttacggttgatggcatccttgatcgtgttggtgaatccggtgatttccttggccatcgtcgttaccgtgcgcaggctgttatctcctgcttcgatgtcgaagcgtacgccagggaagttcttattgacggttttaaacgtctcacgcaggtattcaggacactgataggaagcgaccaagccagcagcaacgtaggctgcacccacataaacgccctcgatccacagcttgagaatatcctctttctccttagagagctgtacaccgtcttcggtctgtagcattttgctgtcgataatgacacccgatttgtccttcggaataatcgtaaagttcggtacacaaggaatggcaaattcgctatattctctgcgaacgagactggcgcatttatcgacatatttgtcgatgcccgctgtcgccatactgttgaaagtcgtttcttcaccggattcaaagttaaagaacatttgaattttgtaatccttcacgacttgcagcagcatcgagagcgattccatagaatttccgccctgctttacgaccttctcgttgcccttgaagcgttcacgtgaaacctttaccttaccggctgcctccagctcgacagatggaacgataccgaaccagatcgtgtcgctgaattcattcttagcattcacagtgttcaggtacgtttccaggcgcgggatattgctgcttttcaccagcatgtccagcttgttgttcgccaccagcattgtcggcagcatgcctttgctcttcgttgcatattgatcgaagaacattttgacaccgaggattttctctacaagcggcttaaccgcctttacgaaatcgtccttggcatttttatagaactccagatacgtgttgtagttttgaacttcaaccgctgtatccaccttcgtctgaacagctggcagtggcacaaatgtgcgaaccaccaaatccttcacatagtcagaaggcgtatctgtgatggagttataatcttcttcgaatacttgggagagatcgccagtgctgttttcatccaacagcatcagctcagtgctgtcgctcttcggcgcttcaataattttcagttcgccgctttccccaatggagagcatacccacctggatcagctcaccggagttttcctcttgggcgccaccgagcagaaggcgggttttgatgtcctcaattgccagtgggagcatagccataacgttgttatagttctgactcgcttcctcgaacattccattcagcttgtcacccatgtcgagtttctttggatcgccatcatccagcttgtcgtattcaccgtacatatagtgaatctctttgcggacttgacgaatatcatccataacctttttcggtgaaatcatatccagcatattttcaaatttaaaatctacattggtgattccttgactgcgcttggtatcaatgagcgtaaacaacattttcagaaaatcattactttgatttacacgaatttcagaaatgctatcctcatcaattccctctggctttttaagggtgtagacgactttttgattggccgcgttaaaaaacgaatacacggtcggtgaaaacttatccaaaaattcgtcaaagctgcgcaccagaaggtgctgattaatttccttgatcttctcatcgctcaagctgtcaatacccttcacatcacctacaatggtgatcaggtccagcttttccgggttaatctcttcaaaaagcattgtccggttggtttgataaatgatttccatcgctgtcggcaaatgaacaaagtatgagttataggtccattgctccatatacggacatgggatgtccaatttgaaacggacgaaactcatttttagttcttttgcctcctcccccctacttaacatttaaattcgtcaaaggattgagcttataccacatttaaggtacaggcatgtaacctcgaaaatcggtccgaagcgttattcggcttttaacggcaaagcatgcaagtgagatgtatttccaaaataaaagtcagataacacagaaattttaaatttatgatttcgtattcctaacttcaatcccaatttttgccgttgatacgagagctatcatacaaagcacccttcagttttgtcaatttctgtagtctcagattgaaacagggcattttgactcattttatgcgtgaatacgtaatttttatgatatgttagacctgttttttcagggaaatattcacaaatggaactcaattaccgatagaagttcattggatatttctgataagcgtaaaagaatcaaattcatggctaatgtgagggttatcagctattttgatcctttatcccttatatcccaaggattaggagagctgatccccccacgttggcctcggcgatggaggagcttatgttcagaataaggaaactagggattatcgttttcgtgacttttgtactatttttacaaatgagcctaaatggggtcatttgcactgtaaatcaggctaatgcagcatctttgggtgctgtcccgatcgagggttatgatgccgtttttgtactggataccagttattccatgagggataccgatcctgaaggcattgcggccgaagtcatcaatatgtttatggatttgagtgatgcagaccgtacgcgcgtcggattcgttgcctacaatcaccacgtggtcgcctcgaaaccactaacttcgattgccgtggcagcgcaaaaatcccagatccagcaggaaatcagaacgctaaaccgttccggttatacggatttgggacttgggttgcgtaaaggctcggagctgctagcggcaggagcatcccaagggcgtcagccttttatgattctgttgtctgatggagagactgattttggtgcctcctctggttcacgatccaagggtgactccaataacgatgtgtcctctgtcatcaaatctgcacagaccaagggatatccggtgtatacgattggtctgaatcatgatggcacagtgaatcgacaagaacttgaacggatcgcttctcaaacgggcggagcttcttttattacgagtagtgccgaggatctgccggaaattctgaaccgtattttcgccagtcaaattcgttccaagctcgtcccaattgctgcaattacgactactggcgagatgcaagaattaactgtaactctaccggactctagtatggaggaagcgaatctggtgcttttgtcggagcatccccttctggaaacacagctatattccaattcagaaaatgtccgcaggtacaagtcgagccgttatgcgattttaaaaatcgagcatccacaggcaggtaaagtgaagttgaagctacggggcatacgcggagatttggtgaaaatcaatttacttggcagctatcgactggaagccgaagctaccatgggagcaaagcaagcaacggcaactcatggtgacaagcctgtgcagttgctgaaaggtcaagcgacaccgtttcaagctcagcttctgttgccggacaatcaaaagcttacagatgaagccgtatatacgtctctccaagcccatattgtagttactcccaaggggggcacagccaaaaaggtgcctatgacctataagtcaggagcctttcataccgaatatgcgttccctcaaaccggggattatacatggcagctatctctggatagtccgcaatggtaccgtaagggaattgtacataaggttcacgcggccaatgcagcaccacaggtcttaaaagacctgacgattcacctggtaaaagaagacggcgattcccgtcgaagtttatcagattttattgttgaccccaatcatgacaagctgaactataagctggatgcagaagtcgctggggatacggtccatgctgagattaacggtaatgatctgctgctatccgagctccacacaggtgactcacagctgaagattaccgctaccgatccggaaggcacatccagcagcgctacgctaaccgtttctgtacaatcccggtatacagccattaaatggacggtagccatcagtgtcgtagtagccgctcttctatattggttcttgcggccgaagccgcagtttgccggaagaatcgaaggatattttctcgctacagcaagtggacaggagattccggtaaaatcttggccgctcacctcctttccgggtcgtaaggtcagcttgcaggaattgttccgtacgcttgacgttcacgaaccgttgccagaagcggaacggatcgtattttccgcaggtaaaaaagggagcctaatcgtaaaacatgatacacgctgcgccttacagcatggaaagatcagattagcccgtaacaaaaaagcggtcatggagtacagcgacaagctgtacattacattcgaggatggtgtcactgaaatcgagctgcgatacaaagcgattaaaccgaatacttcagtgtacaccgaccatatccaagctccgacaggataatgtccgtcacaacgtaaaaaaagagaagcgtcgtctcttacgattaatgaaccgtaagagtagggcgcttccctttttttatccaatattccgcatgtagtgcggctttaaaccatcgaagtgagcggcaacgcttgttagcctgtacctccagacctcgccgaatgacatacggcagcagagaaagtcccgtattttcaatctgaatccgctcggaatgatctgcaaacaatcggcccggcacatctggcggaggtgttccttttcggcaataatacagcgtggcggccaaactatagatatccgacacaggcccctgctgcgaacgattagagtaaaattccagcggagaatagcccgccgtggtgaagatcggatgctctttgccttcaaaatgcacagccgaaccaaaatcaatcagcttgatgttgccattttccccaatcataatgttgcccggcttaatatcccggtgaataattcctttgtcgtgaatgtactccagggcatcaattaaaggtagcaccgtgtggtacaaaaaagtgggatcagatgttggcacagcttcttctttcatcattcgatccaatgtcttgcctgcacagtattccatgaccagataggcagttccattttcctcaaagtgatctatataaccgacaattcccggatgacttaactccttcaacatttgcccttcacgcaaaaaataatgcataaactctacgtatttggattgcatagaagcaccgcaagtgaccgtttttcgatccatccctcgcaaagccagggcattcggaaaaaattccttcacaatgaccttttctcggttatccaacagccttgccgtatacacgatggccagctcactgcgggacaaggcgcttcgaatttgatatgtatttcgcagcttcgtattgcgggcaagcagattcccgcttgtatccacgatcatgactcgtcctcctgtcaggttcttagcttatgttttttgtatatatcggcttattacacatctttttattataccgtaaaatagattattggaaaaacaaataacctgccataatctcccttagagaaatgacaggtcttttggcattcatctggttcttttttctcaaatcgtttaacccagtttcgttccaggcttcatgctgcgcacactgttcgtatttttcttccgttcactacgcagtttgcctttgccttgttctggagtgcgaatggtgagggcaattaggaacgatacgacacacagcacagcaatcgtggtaaaggtcgggatgaatccaccgagcaaggctgcaataaatgaccccgccagcgcacccaggccaaagccttgatacacaataccatagtttttgctttgatttttcagaccgaagaaatcagctacaatggcaggaaagactgtaatgttgccgccgaagcaaaaagcaattcctgctacacaggcaaagaataaaccaaaattcagcggtaccagacttaacactgtgactgcgaccgccgttgtcagcaacgcacccgctactactttcagacgacctactttatccgatagcgcacctagtatgatccggcccgccgtgttgaaaattgcgaccatagcgaccgcattagcggctgttgctacatctaggccggccatccgtacgccgatatctttgacgactccaatcaggtagagaccactcatacaagcggtaaagaacattacgaacaacaggtatgcctgcttggtgcgcagcatttctttaacggtgtagtcccgctgtacaaccccattttgtaccgaaggcttgttcacgactacagcttctcttaccaggaaggaaccacccacaatcataatcagcacgatcattccccaatataaaaacgcttgtgatacgccaacggactgaatcaacgaaccattaatatacttgaatataagactgcctgttccatatgccccaaccgaaataccggaaataagtccttttttctcaggaaaccatttaatcagattcgacagtgatgtaatatatgccgttccatccgcaaaacctacgacaatacccgccaaaatatatagcagggacagcgatgttacctgcgaactgagcatgagaccggctcctaacacgacacctgcacacaaaatcagacgacgtaatccccatttatcctgtagtttgcctgcgaataatgtagcaaacgccagtgcaaaactggtaattgaaaatgtaatggcaaccgaactgaggttccagccaaagcggtccaccaacggttgattaaataaactccatgtgtaaatggttcctaatcccatctggacaataattgttccaagtacaaccagccaacggtttccgctgtttgttttcatataaatctcctcttttcattccggctctacagcgtcaatttgttatcatgataaccgggaatccagtacgctttgcgcctgtggaggagcaagtcggtaaggattctctctacatggattattataacgctgcatgtcagccagaaatcatttgaggaatgaaatgcacatatagcggaatgaagtgcctttaaagccgcataatttgccgaaattccttggccttgctgcggctcaccggaatttctgcttctagtccacgcaaacgcaagagatacgtatgattaaaccaaggtacaatttcacggatctgcgacagattaaccgtgtaagatcggtgacagcggaaaaagtcctgctgcggcagccgggcatgaaattccgaaatgctcatcggcatcgtatattcttcgtgccttgtaaagacacgggtcaccttttcctgcgcacacgcatagtaaatatcgtttgcatccgttacgatgattttgtcatttttcagcagattaatacgacctggcgcagcaatggtgctggcttcggcagctcggggttgcgccgtctggacaggctcctgtattggaacgttctgctgctcataagcattttccagcttacgcagcatagatgcgatccttttttcatcatatggtttgaggatgtagtcgaacgcctccagttcaaaagcctgcgccgcatgttctttataggcggtcgtaaaaataatgtagggctttttggcaaatttgctaatgttctgtgccagtagcatcccgtccaatgaaggaatgttaatgtccagaaagatcgcgtccgtctcctgatcttgcagaaaccgaaacacatctagcccatcctcgaaactatcagtcacctcaatgttgctatgagtctgaataagatactccagctcttcacgtgccggaagctcgtcttctacaattatggccttcatgacttctcctttggtatgtcaaaataaacttcggtgcccggctcatgctttagaataataactccctcgccgtacataagcttgagtcgtctgtgcacattgtacaagccgatctgtttagccggaacccgatcatgatagaggttatccacaacatcatcccgtatacctaccccggtatccgccacagaaatacgcaccttttctccacgatcctttacagaaatagttactgtacctgacccctttttcttgaggattccgtgattaatcgcattctcaaccaggggctggataataagactaggaatacgcacagacacctcatccattacatattctacctgaagccggttgccgaagcgtgctttctcaatttccacgtaatcagacacctgctgaagctctttatgaatttcgatcaaatcatcattcagctccaaattatagcgcagatagcccgataaattaatgatcagctctcgtgccttatccggcttggtgcgtgtcgtagaggcaatggcgttcagcgcgttaaacagaaaatggggattaattttcgtttggagcgcctttagctcggctttattcgccgcttccttaatttgctccacacgcgacacttccattaacgtggaaatgatttgagacaagccaatcgccatcgtttgcaacggatacgtgattttataagctttgcgatagtaaatcttcaaggttccagttacttctccccgctcctctaacgggataatgagcagagactggatttggggtgttttatcgtctgcaatatggttgcggatcgtgattttaccgctgcggattgtcgatttagtcacatcgctaataatctcatctccgatgtgataacgctcttcgccaaaaccgacataggccagcacatctctggtatcggtaatcgctaccgcgtctgccttgatatcttcttttatgatcgaacaaatggtatgcaaagattccgcattaatggagcgaaaataaggcaacgttttgttggcaatatccaatgccagcttggcctgtctggccgcgatattctccttttccccttccacactctggattaatagaacgattaaaccgatactgacttctccgataatcatcggtagaccaattttggaaacgatgtccgcaccaaggccatggggttgtgccatcaccagaatgagcagcatcgtcaatgcttcgcagaccatacctgcggcgataccgaccagccatctcttggaacggttaaccctgcggccgatatatcctgacaccacacctgccaaaatactcgtaatcagacacggaatcgaggtcactcccccgatatcaattagataacgatggatccctgatacaatacctgtaacgatcccaacccagggtccaaacaaaataccgcccgccataattgcaatgattcgaacgttaaccagcgaaccttcgacttcaatcccggtgtacgtaccgaacagtgcaaacatgcaaaaaatcaacgttagtaaggttagctctgccggggaatgactgttcttttgcaaggtttccttaaagcgtgggatacgtgtaataaaaaataaacaaatcagtaacaacgctgcgcgctcaaatagctgcatcagcatttccaacaaggcgttcacctgcgttcctcccaaatcaaaacggatatcctacataggttatgttatcgtgtacgtcgttcatacacaccatacccaagtatcatcaagccacatacgaataaaataataacaaatatattgtcaacaaaactcggcatatcaggttctgacatagagatgcccgaactatttaatttaacaggtacggaattcgcagcccattgaatgaccgatataaagcgctccatcgtataaatcactccgctacccaataggctcaacacgccgatcaacaaatatttaagctccataagaatttattcccccttaattacaaagcatttaaactgccacaaattataccatcaacttccatctaattatagcttctagaaatcccctcttcatttcccttcttcaaacgcagtaaaaaaccggagagtaccgcttgatagcgatactccccggatctctagtccgataatgaagcatttcggttatttgcttttgctgatttcggtaggaatgttgtccttcttctgatcatgtaccagttcttttaactggataatcaacgtctccagctcattaaatccggtcaccatattggaggttatatttcgttgctcctctactccagccaaaatttgctctgacgctgcactcgcttgttctgtaacgcttgaaaactcctccatctcttgaacgacctgagatgagaattgctgcatactattcgtactggcttccacctccacggcctgcagcagcactttattggcattttgcaggatatcctccagtacaatttcggtcgaatgggccgattccatactctgctgtagtctttgctgtcccatgtcaaattggcttacgacagaatccatctgagttctcagttgggtcaaaataccttccattgccaccgaggtattccctaccatttcagccaaattacgcacttcgccagccacgatggcaaacccttttccatgctctcccgctctggcggcctcaatggatgcattcaaggacagcaaattagtttgtttcgagatttgagtaatatctttgagcatggcagacatattatcactttgtgttttaaactcgtccaattcttctttggtacgactcataaccagacccaaatccttaatttgagacgttaatgcaagcagttgactgctccctctgctcccggcacttttcgtatcttcggagagctgcttcaattctcgggaatgatcggcaacctcgcgcacgtgctggtcagactgagccaagttatccgttacctcagtgatattcgaagcttgcatttctacccctttggcaacctcctgaaacccgatggcgacttcattcgtcacgctgccggtagcatccacttgattcctgaatcgttctgtgaagctatgcaatccagctacagcctgtctcacttgttcaaacaaaaattcaatacgttgccttgtggcatccatatctttattttgctcttccgttttcttaaactgcttttgatttaacaccgataccactaacaatagcaaaccaatcagtaaaacaataataaactcgtgtatataacgcaaaggaccggtaaccgggggagttgctggcgtaccgatggtaatttgtataaaaatattacacagatttaagaccattgctatcaaaaaatatcggtaagatgggtagagcaacaacaatgaacaaataaagatcgtagtcattgcctccacgctagataagtttacaaatatacatattaatacgctatacaacgtaataatccaaggaataaggcggattcctttctttttcatattcagaatcgtcaaaactgcggcgactacaaatcctacaccactagacatccacaccgatggattagataatgccgggatggtgctgctcaaggtcataatccaaaaaataatgatcaccaatttgtttctttgccacaacaattcatttgttctgtccatgattgtgtacgcgctccttagatatatattaggtatttataaaataaaaatgtaaatgccatactatatatatcgtcatatcagaacgcgtattgaatgaaaatcgtacgaacaccacattcccttttaaacaccaaatcacaacaggacaactttttaaagagaaagagtatgtaagtgtaaaaaaatgaatgcaaaaaaatcgccccctggcagggagcgattttgaatacctttttgatgatcttctgcaattgaaaaagattcataagccaactgaaaacattaggattccttgttttcggaagcctcttcagcgccttcagttgccgctgcatcaccttccacagcagcattttctacttcaactgcacgcggaacgataatagaagcaagcagttcttcttcagggacgtgcagtgttactcctttagggagcttcaagtcgctagcgctcagcttgtcgccaacatccagtgcggatacatccacctcaatggtagatggtaaatcagcaggaaggccttcgacttcaacttccgtttcctgaacttgcagaataccgcctgtttttgtacctacaggtgtaccctgataatcaatagaaacacgcacgcgaagcggtttgtttttggcaattttcaaaaaatcggcatgcagccattggttgtcacgctgttgataatctttaataataaccggaatggtttctccaccttctacagtgaggttgaacacctctgaacgtccggttttgactactttattaaattccttggcatcgacatgtacaggggttccttcaagctcagagccgtaaaccacagctggaatccgtccttttaacctcaattcacgaatagccgaacccttcttctctgttctcggctgggcggtcagttgaatacttcctccattagaactcatgatatacaacctccttcaggttaccttacaaatgattttcctccaagaatcttgcctgtttaccagtcgtactacaggatataagccagcaagctggcaaaactaaacaagtccataattctattttaccccttttttctgaaactgacacacgtttacataaaaaaatagcatttctcgaaataatcgaaaaatgctactttcgtatatatagcgaccaagcatacaagtctatccggcccgattatcatttaccagtagcaaatattcttctctgccactatgaatcaatacctgcatcacagactggtttaggtctatatcaatatagcgatctgcctcaacatccttggcatcccagtgattaagccggacaatgtagccaattcgctgtatatcaggagacacctgaatacgcgctattgcacgaccgtcatccaaatcacgaaattcgacatgtccgtcgcggtgcccagttccccatacccatacgttccagccagtgtattgtcgatctgcacgctcgtagatcagttcaatcgtgcgaaatggagcgacttccctatcgtttccaagcggcacatctgtcaacgccatggctgtacctgcaatttcttgatctgttccctcatccgagtcttccaattcgttctccgcctgacgattaacctgatcttgttcagtcaaaaaggagactcctgcaggttcttcctgatcatataacaccatcatcgaccagcgcgatacagtcacacgatggcctaccacttcataccgtgtctcattaccagccccgtgtgcgtccacgaccacatgccaacgatccgattccgcaggcaataatatcgtttgctctgtatccgagccgttataaatcaccacaatatgattccaggcatcgccgttagcatggtgcctcaaagcaaaagccaccacatgcccactgctttgcagcacttccatatgctgctccaccaactcacgatggtccattcggaatgccgggtggttgcgccgcaatgcaattaaaccttggtagtaatcaaacactgggcgaaacctcgccttgttatgccaatggatggcattcaccacatctgagcttcggtagctattatggtctccatatttggagcgcagcagttcatcccctgcatgaataaaaggaatgccttgcgatgtgagtaccataccgttagccaacagggacttgcgtacggtttcgttctctagcaagttatcttcatccagttcccaatacgggtctgcttcggcaacagcttgttccggtgtcctcccatcctgtggcttcccctgctcccattgtggaaaacgacagtgctcccgcaaatgtcttaccgtcaaaattttatcccacagattgagattatcgtgggcagttacataattgacggtctccgatggctgagctgtgaaatcatgaatagccccaaaagcacctttgagcacctgttcttcctgatgttctgcccccgtggcaaacccgctcccagtaccgtcgctatctcccttaatagcagaacggtagttgtcgttaaaaacggcaaagcctttgtcgcgttgcgttccttttagcgtaagcaagggttgcggagattctcctcccgtccaaggctcaccatagatcagcagatcgggacgcacttcagagcgaagctcctgggtaagctgctctacggtcggtgtatccatcagccccatcagatcaaatcgaaagccgtctatatgatattcctctgcccaatagcgtagtgaatccttgatatacttgcgcaccatcggacgttcggttgccacctcattacctacacctgatccattggtgagctgcccttgctcatccgtgcggtaataatatccaggtacaacaggctcaaatggcccctgttccaccgaataagtatggttgtacacgacgtccataatgacaccgatgccggcagtatgcaaagactgtaccaacagtttcagctctcgtatgcgtgtctctggatcagccggattggaagaataagacccctccggcacattataatgctgcggatcatagccccagttatattcagtttctaattctgcaaagtcattcaccgtatgaaaatcagccactggaagcaaatgaacatgtgtaatgcccagctccagcagatgatccagcccgatgctgttcccctcagtatccttcaatcccgtatacgtaaaggcctcaaaccgtccctgagcagcagataagtctttttttcccgtattaaaatgggtatccatcgaaaaatcacgtacatgaagctcatagagaatggcatctgtcggccgcttaagggtaggccccgcatccaattcccatccgtccgggttggtttgagccaaatcaatgatcgctgtacgctgcccgttggctgatacccctgtggcatatggatcggcagcataatgaatggtgttgtccgcccactccagcctgtacatgtaataatatttgttccagtccccttccagctctatagaccatacaccttgatcaccacggctcatgagaaattcctgaccaccgctgtgctcctgaacgttcccctcctgatcgtacacccccgcatcgttatacaacgctatatggacctgctgcgcagtcggtgcccataccttaaacttgctgcccgcaggcgtataagtaagacccaaatcatagccttcatatatgggatatgttgtgtgctcaagctcattgagctgattgaaatctgacattcctgttcaccacccatttctgtacatcggcttacagcctctgttcatccatcatttatgatgtttatgacttgtcaatatacctcaggattttgtaaaatcttcacctaataggctatcaaaataagacaagtttgaaaagctggatgatttaaataaggatgacgcttccatttcaacgcacactccattttatgacaaaactatgaacaggctacagcttttgcccttaaggtataacaatagttagaaaagtcaggacaatctacggttattcatttcaaaaatatcgtctgcaatccgcatggtagaacttcggtgcgaaacaaggacaatcgttttatcttgctgctgttcctttaacgattttaaaataattgcctcgttcaggctgtccaaattgctggtaggctcgtcgagcagtaagagaggcgcattatgaacaaaggctctggccagtcccaagcgttgacgttctccaccggacagcctgtcccccaattctccaactcggctgtcatacccttgaggcaaggtcataataaaatcgtgcacggatgccttacgtgctgcttccaccacctgctcatgtgtagcatcaggctttccgattttgatattagctgcaattgaatcatcaaacaggaacgtatgctggtctacatagctctgtaaacccctcaaatgtcgggtccccatttccttcaaatcatgtccggatagcaaaatttcaccttgctgcgggtccctaaatcgcatcagcaactttagcagtgtagacttgccggagccgcttttaccctgaatgcctaaaatccgcttatgcggtatcgtgagacttacatcattcagcaccgtttgaccatcgtatgcaaaagtcaccttgtttactcgtgccccagtaaagggaacactcatcccttcgatattttccgcaacttccggggtttcctccaatagactcaacactcgttccccgctcgccagcgtttgaagcaaattgttggacaagttgctcagtgcgacgaccggaccaaatgaactaaacagtgcaatgacagaaattagcatacctgtaaagtcaacctgaccattagacataccgtacaagccagccagcagcatcaagaatgagaatccaactacagccgcatctgtgatggctcttgtgatgccttcatgatgcttcaagtccttctgcttggcatccaattgatccgtacgacggttaatctcattcaaacgttgttctccttgtccatattgcacaatttccttcatcccccgtaagctgtccaaaaagtaactgctcagcttgccaaagctgcttcggtattccatcccctgacgtttgcccatacgtgacgtgagtaagggaataaataaaccgacagttaggtaagcaagcgcagcgacccagcctaatagaggctcataagaaccgataaaaaataccatgagcagtgaagtgatgatgccgatcattacaggcgctatcgtatgcgcataaaatacttccagcagctcaatatcactcgtaatgagtgatatcagattccccttgtccttgccttccaatttggctggagcgagtctgcgcagggcttgaagcaccttgtcacgcagtacagctagtagcttgaaagcgagataatgaccactcatttgctcgccataacggaatacgccgcgcagtacggcacaaaccacgatcgacgtcagcaaaaacaacatggtgtagcctgtcgtgatgcccgttgctgtaagcagagcaagggctccatacactataatgccaatagcacaaataaaaccaagcactcctgtcacaatcgtgatgagcagtacaggtaaaagaggtcccgccaataccaataattggcccatgatccgtaatccgtgtctacgcatatacagcccctccttttgcaaactgctctacccggtgttgactgagatacatatccgcataatgtccctgctggctcaacagttcatgatgcgttccggattctgccaccaatccgttttgcagcacatagatacagtcggattgaactacattttccagtctatgcgagataagaatcactgttttttgacctgccagcgcatgtattacctccataatgccttcctcactctcactgtcaatgttagaggtggcttcgtcaaaaatgtacacacgactatcatgcagcaatgctctggccagtgctagccgttggcgctgtcctcctgacagatttgccccctgctcctccagttctgcttccagtcctccttctgaaagaataaaatcatacagcttcacttgtcgcaaagcttccagcatttgttgctcatccgcgtgctcattgcccatttttaaatttgcttccactgtgcctttaaaaatatagctgttaaaaccaatccagatcatgtgacgcatgcggctttcttccgaaatatcggtaagctcggttcctccaatcgtcagacttcctcgatacccctcgtgatgcccaacgatcaatccggctaccgtacttttaccagagcctgattccccaacaattgaaaccaagctgccctggggaatatccatggatatatttcgtaaggtatctctttcgtcgtaggcgaaactcacctgtttcagtcgaatatctgtgttttctatgctttcttgtccttgtataagatcctctgtactcaacatttgaaatattttgtcactcgctgccattccgttcatggcgatatggaagtaagaacccagtaaacgcagcggaatgaaaaattctgctgacagcaaaacaatgatgatcgctcctgccaagccaatatggcctgaagaatattcacttatcgcgaccagtacacccgcagcagcaccaccaaatgcgataagatccataatggccacggagttaagctgcatagtcagcactttcatcgtcattttgcgaaagtcctcagctgctgtgttcatttcctgatgtttatcctggtctgttccgtacattttgagcgtagtcagaccttgtacattctccaaaaagctgtggcccagattgacgtaactgccccaatatttccgaaacagctttttagccatcctcataatgacaatgatcgacactggaattaagggaacgcagatcaatagtataatggctgctttgaagctgacaaaagagagggttatgaataacgttacgggggcaagcagactgtaaaatagctgaggcatatatctaccgaaataggtttcaagctgctctaccccttctacagcaacctgaataacccccgaggtggaggtatgatctgtatatgcgggtcccatcttcagcaacttgccgtaaatttgcgagcgcagcgtttttttagcatttaccgaagcacgataggataacatactggctgcataattgctcaggcagcgaactgcaatagcagcaataacaatgaccgtcatagatagaatcagcttgcgagtcacttgtccttcccatgcctgctgcataacaaaggccataggcaacacagcggctatactccccaaaagaccgatccactgcacaagcacacccaatacgatatatttccgagaatgttccactagaccgagcagatggctatcgaccattttagaccttttttttggagtaggtgtaggtataggttcagatgaagatgaaggcgttatttttgctgcagcatttcttattgttccgatgcggaatataaagtaataatatttaaaaaggatgaccaagacgatgagcgctttcccccacacattaggcgtgaaaataaagcctgtgatcagcatcgctgacgctaagcccaatgtcatgattttcgtagacagcttcaacgaccttgtttgaacaaaactctctagatgcttttggtacagagaggtattcgaaaaccactggtgaatcctttcggacccccgcataaagaaaaaggtcgctagcagcagaaacggtgtagtcggtagcaacggtagcactacaccaataactccaagcgccaaaaataaaaaccctaaggtaatatagatcggtttcactataatcctccctaatagttataatagtaatgatttcatttcatagataatgataatcattatcaatataaacaatttaagcaggttgttatgtgatataaatcacgtatataaaaatcctcttgaagcacatctctacagaacacgttagtgttgatgtgaatgctttgtcttcaagaggattatcgaaagtaggtgttgataattcgttgttttatgaatttataatatcatattgctccaatacctgccgatgtaacgggtggtctgcggttatggaagtataacgcgtcagcgccgcacccagtccttcactgcggatcacctgctgaagctcgactgcctcggggtcttccgtaatatcaaatttacaggcagcagccattcctaacgccagatgatccgtagggatgccatactcctgcgcttggagcgcgggacgtacaagacgatcatttggagacagcttgcgcaacggtgaacgtccaacccgagtaacatcgtctgtcagattaggattgcggaagcgatccaaaattttagagatgtacttcttatgctccccttgatccaaaccgaagcgcttcacaagcactgctcctgtctcctccagtgacccttgtatcgaatccaccaccttgctatccttcatggcctcctggatggtagcataacctgcggtataaccaagataggctgccacgcaatgccccgtattcaccgtgaacagctttcgttcaatgtaaggctctagatcctgcacgtacaggataccttcgatttcttcatgctcaggtgccatttgtgaacgatccaccacccactcgtaaaaaggctctacctgcacatgtaacgggtcctcgtggtgttggatcggcacaatccggtctacagcagcattggggaaatataccgaagcctctgccttggcacgagtcgcctcatccagtagcgcaaaaacatgctctttcagttgggcgctgcctccgattgcattttcgcaagcaatcacatgcagcgggcctgcccctcgctccacccgccgcgctattccctcggcaatacctgctgcaatatgcctgaggatgctaacccctaccgcggtcgttaccagatcagcatggtctaccgcatccgctacagcggatgcatctctgccgtcaatcgccgttacattcgtgaccagctccgtatcctttgtatcattggctaactctacggtatattgtttacgacggcgtaactcggatacaagggtgtcgttgacatctgaaaagacaacctcatagcctgcacgcgacagaattaatccgataaagccgcgaccgatatttcctgctccaaagtggacggctctcatagctccagctcactttcgaacagatctataatttcctgtggggtcaccgcgttgcgaagtttatccatattttcttcctccgcacacaccacagcgatactcgtcaaaatctccatatgatcgccgccttgtgctgcaatgccgatcaccatatatgctttctcttccccaaaatctacgccttgcgggaactgaacgatggagatgcctgtggattgaataagcgtcttggattccttggtgccatgtggaatagccagcccattcccgatgtaggtagacacgatctcctcgcgttccagcatcttgtcaatgtactcacttgaaatatgtcccgcatccagcaggatttgtccagccatacgaatcgcctcatatttgtctttggcggttgcgttcatttttactttgtctatcgtcataatactcacggtaggttcctccctgtccctaatttactgtggaaaaattcagccagctcactcgatatataattgacaatatgatccctgctaccgtgttccagtagcgtaaccatgtcttcctgcaaaagtaatgcactaatctcgctcaatacctccaagctttctctcggcagctcacgaggccccaacatgagcagcacgcattctacctgttcacctgtatccgccaacagcggctctgccagcttatacaaggtaagcgaaggcttgggaatatagtggctgcgcgtatgaactaaagcaatggaggtatcagagatcacctgactaccttggcgctctctttccatgagttgagcagcaaccatagaaggctctgtaacattcccccgccccgcctccagcatgcatatcgcctctacggtcgccgccatatccatccctttattttccagcgtatatacttgaaattgctgtacaatgtgtacaatttcctcgagacttttccgcagaccggtaagccactccatatcctggccaggctgaacagcctgttcctgctgatgatcattgagatgatggagtgtaatatgctggatgaaatgacgcagacggtcactctcctcctgcgttagcagcggactgatcttaagataccgatctggttcaagcggtagctctactgtcgaaatgatcagatcataatcctccttgggaatccgcgccgcctcgtaccatgaagccctatccacaattttgatctgtgggagctctttggcgagccttgttgccagaagtctggatgatccaatgccgctcgtgcagactacaatgccccgcacctcccgacgcaattgtcgaagccgctccagcgaagcgccgaaatgcatgacgagaaatccgatctcttcatcaggcactttcatttctgtcatgctcgccgcagcctttttcactgagtcaaataagctgctgtaatccttgcggatttgctgaaggagagggttacgaatcgacctgccttccttcaaacgtttgaataccggagccatatgggcaatcagtccttcacgcagaacacggtcctctttcaatagcgtgcctgtctcttcctccacacgacgaatcaactcatgaaccgactccaacagtacgagatcatccaacggcagtagtcgggtagagtgatcctcggcatcacgaaatagcagcctgagataagatcgttccggctctggaaattcaatatccagcgcctctgacaactccgtgcatatgcgttccaccatagctgtgcgaagcatgatattttcatctgaatctgtttttaaatacgagagaagaggatctataacatacccgagtcgcagacgtgccagcaaaacgcaaatttgaattagcagctccatgtatttgctttccaccatgttttccaaccatttttcatggggctgccagagggccttttccacgattagcaggttatctctgccaatcatctccagcaacttgtcggcaacacgggttacaggacgaagttcttgccgggctgaaaacagatcggattcatccaaatattcgagagccagctcggaaatcgcccgtcttttgtctgtctcccgccctgtaatctcgaccccgtacccccgtctgcgcacaagcatgagtccacgttccccaatccagtcttgcaattcgtctagatcatgactgaccgtagttaccgtgactttcagatctgaagccagcgccaacagcttgatcggctcccgtgtatccagcagcatgcagagaaccacgatctttctctcctcagccgaatattcgtctgacttcgtatgcagcaattgttttcgcaggcatacaagccgagctggatcagcatctatacagataccgatccctgactttttctccagcttcacctcatgagctgccagccaatgctcgactgcacccagttcccgatgaaccgtccttgtgctgacattgatcttcgtagcaatttccccggctgtaacctctttggactgctccagaagatattccacgatgtcacgttgtcgtttcgtaatattcataagcgcataccgttccttcccaagctcatccctccagcaggagacgtacattgcatacagtccgcctgacttcgatggggattaagaatcggatttcagacgttcaaccagcgcttcgtattcaggactcttcagaaaattgtcaatggaaatgtgctcagctttcggagctactgttttagcccggtctgtcaacgttttttgcgtaatgacaatatccgcatcctgtggaatttcactgattgccgtattcgtaactgttacgcccacacccgcctgcttcatttttttgcgtaaaatcgaggcacccatagcgcttgaacccatacctgcatcacaggaaaagacgattttgttcacttcggatttatccttgagcgttcgatctgcagcaatttctgcagcacgatcagattcgtggttatcttccattacagtggcgttagcacttgcactcttgctttgatttttcatatctttcaggcgggatgcagcttcctccagcccctcttcttgttgcttaccagtcttgagtaacactgcggcaacagcaaaagatacgaccgcagcagcgatcaccccgcttagcattggcaaatatccgccttttggcgtcattagaaaataggcgatgatgctgcccggcgaaggagcagcaaccagtccggcacctgtcaacatgaaacagaaggttcccacaacgcccccagctatagcagcaagaatcaaaatcggcttcatcaaaatataagggaaataaatttcatgaatcccgccgaaaaaatgaatgatgactgcgccaggagccgacgacttcgcagagcctttaccgaacaggcagtaggccagcaaaataccgagccccggcccagggttggattccagcatgaacagtacggattttcctgttcttgcagcttcctccaacgcaatcggacttaatactccgtgattcagcgcgttgtttaaaaataatacttttccgggctcaataatgaggttgacaagcggcagtagccctgcgttcacgaggaactgtacccctgccgacaatacttgactgatcatttgtacaaccgggccgatcgccacatgggcaagcagtgctagaatggcaccgataatcccggccgaaaagttattgaccagcatttcaaagcctgatctgactttgccttcaatggccttgtcgaacttcttcaatatccacgcagccagcggaccagcgaccatcgcgcccaggaacatcgggatatcggctcccactatgacacccatcgtcataatggcaccaatcacacctccacgttgtccgtgaatcatcgtgcctcccgtgtaaccaatcagcagcggcagcaaataatttttcatcggatcaaccagttgtgcaaaaccttcgttcgggaaccacccggtcggaataaagagtgccgtaatcaatccccacgcgataaaggctcccatattgggcataaccataccgctgagaaaacggccaaaacgctgtacggcgacacgagtgcctccttttgaacttggctttgcgtccaatgtactcatattcaaatcctccttgtaggtaagcatcactaccttttcttaaaattcatactaaatgacagcgctatcttcatcaacgaaatgaaaacgtactttcgtcatgaacgttgatgacaacatttaaatttaaattatccgagaaggtattatacctgcataattcttcttaatatgacctgttgctatagaaattagtcgaaaaaccgtgctggattatgtatgattcttactatagggacaaccctctaaatcggaataaaacacgtaattacgtctgcaaaaagacaaaaaaatagccgctatgtcaaatcatagcgactgttgtatacaaaaatcgagcagacaaataacactcttattccatactacattgctccattactgctcatcggaaatcaactgctcgtattgatccgcagacagtagcttgcccaatgcttcctccacatctttacccatctctacttcgatcatccaacctttttcatagggagattcattcactagctcaggcgtactttcgagcgcttcattcacttttaatacggttcccgtcaccggagcaaaaaggtcggataccgtcttcaccgattcaatcgtaccgagctccgctccctgctcaatcgttactcccacctcaggtaattctacaaaaacaatatcacctagttgatgctgtgcaaagtctgtaataccaatccgcaacgttccattctctgtgcgctgaacccactcatgttcgtctgaataccaaagttgctgctttacttcacccatcctgttcccctcacttccatatgaataaaatcgcttttgctcacctgtattagacaggttaagattatgacaacaagaacactcatgtcaataatactaacaaaaatacttcatatcacctcatatggcgtactatataaaaatatgatagcttataacaaacgcttacatatccttatttatatattaaatgttttttctattgtttttgatgacatttttattgacattttgaatgaatttgcgtattaatgggttatagcaaatgctttgggaaacaccccgacaactgcaaacgcggatgaacgcggagggagagactgccaaaaagattcgcatagctgttgcggcttatgaaacataagtgcacgcgaatcggatcaagttgttatctgcaaagccaggtaatatactgttgatcccgaaggtagcgccgaaggagtaagcctgcattgcaggtgaatctctcaggcaaaaggacctctgccggacgcatctctggagagcattcgctattggagcggatcacccaaggggaaacccggtacataccggggtaactttctggtatcaaggacagagctgaaaaaagagtgtagactgccgtctatacgtttttttcggcctgtcttttttgtttagccgatcacaccggataggagtggaaaaatgactaatttgcgaaaaacaccgctatattcgtcctacgggacgcagtctggggttcgttgtattgactttggcggctgggagctccccgttcagtttagcggcattcaaaaggagcatgaggccgtccggcaacgtgcgggtttattcgatgtatcgcatatgggcgaatttttggttgaaggcaaagaggccgaagcttttctgcaaagggtgaccacgaatgatgtcagccagttggaaccaggtcaggcacaatattcactcctgtgttaccccgatggaggggtagtagacgacctgcttgtttactgcaaaggaccggagcgctacatgctcgttgtgaacgcctctaacatcgataaggattgggattggctaattcgccatatgcctgcatccgttcacatggagaatgtgtctgatgcgatagcattgctggcgttgcaaggaccggaagcagcacgtattgccgcagccgtggcagatacggacattacgaatctggcatctttccgcttccatgagaatgtgccattgttcggagcaaaagcactcgtctcacgaaccggatatacgggtgaagacggttttgaattttacgtacctgccgcggaagcaacagccgtatgggagggtttgcttcgttccggtgagtcgtatgggctgattcccgctggacttggtgctcgggataccctacgctttgaggcacggttgccgctgtacggacaggagttatctgccacgatttcaccactcgaagccggtctagggttcttcgtcaagctgaataagggagattttatcggtagagaagcactgcaacgtcagaaagatcaagggattcctcgcaaattgatcgggctggaaatgatggatcgcggtatcccacgcgcccattacccggtattcgcagaaggacaacgcatcggtgaggtcacaacggggactcagtcgcccaccttgaagcgtaatctcggcctcgccttggtagacagtcgttttagcgccctctccacaccgctggaggttgagattcgtggcaaacgcctgcgtgccgaggtggtagcagcacccttttataaacgcccgcgctgatcttaaactctcctcatttctataaagcaaacatgtcagatatgtacttccgggttttcatctcacacttttttattagctaatttacgatttaaattttgcttttcgaaaggagccagaacctatgaagcagcatcgttatctccctatgactgaacaggatcaaaccgaaatgctgcgtgtggtcggcgtttcatccatcgatgatttattcagtgacattccagaggccattcgatatcaaggggaactccctctttcttctcgactcggcgagagagccttaacccgccacttggccgagcttgctggacacaacgccaatacagacacacatgccagctttcttggcgcaggaatttatgatcatcatattccgtccgtcatccagcacatcacttcacgctcggaattctatacagcctacaccccctatcagccggaagtaagccaaggcgagctacaagccattttcgaatttcagtcgtatatttgcgaattgacgggcatggctgtagctaatgccagcatgtacgacggagcgactgcactggcggaagcgggctcactgtccgccgcagctacccgccgtaaacagcttatcgtatcaaggtccgtccatccggaagcacgtcaggtattggcagcctatgcacgcggattggatttggacatcgtggagatcggctgttcggacggcgtaacggatgctaatgcgttagcggcggccgtatcggaacagactgcggctgttttggtccaaagccccaactttttcggagccgtggaaaacctgaagccgatggctgatctcatccatgcgcacaaaggtcttttggtcgtcagtgccaacccactggcacttggcttgctggagacacccggcaaacagggcgcggatattgtggtaggagatgcgcagccacttggcatctcctcttctctcggcggtccgacctgtggatactttgccgtttctcaggcacatatgcgccgtatccccggccgtattgtgggtcagaccactgaccgtaacggtaaacgcggcttcgtgctgaccttgcaagcgcgggaacagcatatccgccgcgaaaaggccacgtctaacatttgctccaatcaagcgttgctagctttatctgcatctgtatacttgtctgtcatgggtagacaggggatcaaggaagtagccgagctaaatttgcataaaagccgttatgctttagagcaattgctgagcttgaagggcgtaactgtctcatttaacgcaccgacctttaacgagtttgcccttagactgcctgagggtacggatatgagcaaactccaggccgaactgctagctgctggatttatcgctggctacgatttgggccgggactatgaggaacttgctggtcacatgttgattgccgtgacggagcaaagaaccaaagaagagattgaccaatttgtacacaccttggggggattgctatgacacacaccggacaggatcagaaacaagggctgttgaaggaacacgatcaagcgctcatttttgaattgagccgtccgggtcgcatcgcctattcccttcccgagtgcgacgttccccgtcgcccggtggcagagcttttgccagattatgcgctgcgcagcgaacctgcggcattacccgaggtatacgaagtagacgttattcggcattataccgccttgtcccggcgcaatttcggcgtggacaacggattttatccgctcggctcctgtacgatgaaatacaatccgaaagtgaatgaggatgtcgcccgatatacaggcttcgccaaaatccatccatatcagcccgaggagagcatccagggtgccatggagttgctgcatacgctccaaaatgatttggctgcgttaactggcatggatgccgtcacacttcagcccgccgcgggcgcccatggcgaatggaccgggctgatgatgattcgctcataccacgaagcacgtggtgagcgacgtaccaaggtgctcgtgccggattcctcgcacggaacgaaccccgccagcgcaaccgtcgcgggcttcgaaacagtcacccttccctccacccctgaggggctggtggatctggatgcgctgcgtcaagccgtaggcaacgacaccgctgcgctcatgctgaccaacccgaacacgcttggactgttcgagaagcaaatcactgacattgctgccatcgtgcatgacgcgggtggtctgctctactatgacggggcgaactccaacgccatcatgggaattactcgtcccggcgatatgggcttcgatgtagtgcatctcaatttgcacaaaacgatgagtacccctcacggcggcggcggccccggcgctgggcctgtcggcgtaaagcaacggctcatcccttatttgcccaagccgcttgtcgtacgtgattcgcagggggtgtaccactgggaccgggaacaaggagattctattggacgggttaaagccttttacggcaacttcggtattctcgttcgtgcctacgcctatatccgtagctacggtcctgatggcttaaagcgtgtatcggaatgcgctgtgctcaatgccaattacatgatgcatcggctcgctccacattttgacctgccctaccctggacattgcaaacacgaattcgtaatgtcggggcgaagcttgaaaaaatttggagtgcgcacgcttgatgtagccaaacggctgcttgatttcggctaccatccgcctacaatttacttcccactgaatgtagaggagtgcatcatgattgagcccacggagacggaaagtaaggaaacacttgatgcttttgtcgacactatgattcatattgcgcgggaagcggaagagaaccctgagctggtgctcaatgcaccatatactactccagtcacacgattggacgaaactaccgcggcccgcaaacctgtgctgaattgctcatgcagttaaaaacaaattctacttaaaggatgcaaaaaagccggtatctaaatagataccggctgctgtatgtacacagcaatttttttgttggaaaaagatataacctttgaaatgtaatacccttccttagccttcgatgctttgaaccaattcaacaacctgttctgctgtttgcatgtccagagcttttgtagccagtttttccatgtccgcacgggacaacttggatatttgactacgtgctggcagaatggaagttgcgctcatactgaactcatcaagtccaagacccagcagcaacggaattgctgttgtatctcctgccatttcaccacacataccaacccaacgtccttcacggtgagcggcatcaataaccattttcaccagacgcagaatggatggattgtatggttgatacaggtaagaaacccgctcgttcatgcgatccgctgccattgtgtattgaatcagatcgtttgtaccgatactgaagaaatctacttcttttgcgaattggtcagccaataccgctgtagaaggaatttctaccatgatgcccaactgaatttcttcagatacggatacaccctcggctaccaacttttccttttcttccaacaaaacagctttagcttcacggaattcgttcagcgtagcaatcatcgggaacatgatgcgcaggttaccatgcacactcgcacgcaacaaagcacgcaattgagtgcggaaaatatcctggcgatctagacacagacgaatagcacggaatccgaggaacggattcatttctttcggcaggtccagatatggaagttctttgtcgccaccgatatccaaagtacggactacaaccggcttaccttccattctttccagaacggttttgtacgccgtatactgtacttcttcggatggaagcttatcgcgtcccatgtacaagaactccgtacggtacaagccaacgccttcaccaccgttgtccagaacaccagctacatcattaggcgtaccaatattggctgccagttcgacatggacaccatcgacagaaactgtagcttcgccgcgcagcttgcgccactcttcgcgttgcttgtcgtatgccacctgtttagcacggtattccgcaacaatctcttcggttgggttcacgaatacgtgaccatccaaaccatcaacgataatcaaatcgccgcttttagcttgagacaatatatttttcgttcccacaactgcaggaatttcaagtgagcgagccataatggccgaatgcgaagtacgtccgccgatgttcgttgcaaaacctttaacaaattcacggttcagctgagctgtgtcggaaggtgtcaaatcttctgcaagcacaatcgtttcttcggcaatttctgcaggactaacaaaatgaacaccaagcaggtgattcaggatccgcttggttacatcacgcatgtccgatgcgcgttcttgcaaataggcacttttcatgttttcaaacatggaaatgaactgtgtagctacttcattcaaagcatagtcagcattaagctgctcgtctctgattttagctttaaccggatcgatcaattcaggatcattcaggatgagcaggtgagatgcaaaaatttctgcttttttctctcccagctcctgaagcgttttctccttaatcgattccaattcggtttgagattgtaccaaagccgcatccaatctcgcgatttcagcttcaacatcaccaaccgcgcgtctctctacagcgtaattcggatgctccaagataaacgcccgggcaatggctatgcctgccgaagcggcaatcccggaaattttaagcatgaacttcgcccagcccttcgttaacgattacattttcaagagctttcagtgcttcggctgcttcagcgccttcgcagataatgttaatagtatcaccttgttccagacccagagacaatacacccagaatggatttcaaagttacttttttaccgttagcttcggcaaaagattcagcaccgctgaatttgttagctgtatttaccagtgcagttgcaggacgtgcatggataccgtcttcatccgtaattctaaaagttgtttgcataatttgttcctcccactttcctaaagataatatttgtttacacgcagtataccagatcattgatgagacggcctaagccgcctaatcaactaatccgaaacacatagagtttattttatcgtaattataccatcttcgccagccttcaatactccagttttgtttaaagttaccgaagaaccttctggaaggttggtaaaaatgacaggtgaaatgatggatttagcgtttgccttcacgtattccaggtctactttcataataggctggccggctgacacaagatcgccttcgttcaccaaaacgtcaaatccttgccctttaagcttcacggtattcaccccgatatgaacaagcacttctttaccgccatcggattgaataccaatcgcatgcttgctcgggaatacattgaatactttaccataaacaggggacacaatcgttccatcatttggcacgaccgcaaagccgtcacctgtcatacgttctgcaaataccggatcgggaaccgtcgagatatcaaccaattcgccgttaacaggcattacaatatcttctacaataatggtttgttgttcttccccagcttccttctcctcttgtggagcaggttgcgccggagctggtgcaggtgtacgtccagccatgatatctgccatttgagttttaatggtgtcggaacgtgtaccgaaaattgcctgtacgttgttgccgacttcaaggacacccgatgcgccaagttgcttcagacgagctttgtcaacgttcgatttctcattaacctcgatccgaagacgtgtgatacaagcatccagatgcttgatatttgatgaaccaccgaaagctgccaaaatgttgtgcgggagctcatcactactaccggctgctgcgccatccacattttctgtagcttcttcacgtcctggtgttttcaagttgaacttccgtatgatgaaccggaatccgaagtagtaaatcactgccaaaatcagaccgacgatgattacataccaccaaggcgtacgggttggaatgatcccgaaaatcaggaagtcaataaatccgcctgagaaggtcataccgattttgacatgtaaaatttgcatggtcataaatgacagacctgcgaatatacagtgtactgcaaacagcagtggagctacgaacaggaaggaaaattccagtggctccgtaatacctgtcaagaacgaagtcaatgctgctgaacccatgatacctgctacatattttttatgttctggtcttgcttcatggtacattgcaagcgctgctgccggcaaaccgaacatcatgaatgggaatttacccacttggaacgtacttgctgtcaacgccactccatcacgaagctggctgaagaagatctgctggtcaccgtgaacggtttgacctgctttgttaacatattcaccaaattcaaaccagaacggtgaataccagatgtgatgcaaaccaaatggaataagcgcgcgttcgataaccccgaacaggaacgccgacaaagtcgggttggaatacaccataaagtgagatactgcgttaagtccttgttgaactggaggccagatcagaaccagcgcaagcccgacaatcagtgaggacaccgccgttgcaattggaacgaaacgcttacccgcgaaaaagcccagatacgaaggaagctcaattttgaaaaagcggttgtacatggccgcggccagtataccgatgattatcccgccgaacaccccggtttgaagcgttggaatacccaacacgttcgcataacccggtattttttgagcaatcagaccaggtgtgacacccacggctgtacccaaagtaatgttcataacgaggtaaccgatgatggcagccaaaccggctacaccttcaccgcccgccagaccgacggctacgccgactgcgaacaacagggccagattatcaaaaacgatttgtccggcattcatcatgatcgtcgctaccgattgaacccagcccgcatttaatgccggaatgtactggagaaaatcaggattgaccagcatgttaccgatacccaataaaagccccgcagctggcaaaatcgctacaggaagcattaatgctttaccgacacgctgtaaaacgccgaaaagctttttaaacataccttccacatccttctctgaaatttagaacagaggcaaaacaacaaaaaaggcatgagccgatttaagtatgttcgaaaacaaccttgggatatagcttgccccagtaggctgtaaacaatcataacttaaaacaactcatgcctgatcgaatcagtaacacgttaaatgttcagttgttgtcttcctcattgcagaattgattatagcaccccgctaaatgcgaggcaatacttttttattcctgttttatcacttttattgctccccctgctctttgcgttgggacaaccgttgcagatgcattgtcaaataactaacctcagccgggtacacagatttacggagtcttttctccataatttttgtgagcttccaggccagcatatacatttccggatactcctcattcaaaagcttgtccaatcgataaatctcctgcacaatttctccccggcgcacacgttcaatcgcaaacctcagatgagtcagcagtcgagaataatcaagggattgaagaggaatacgataatccagtgtcgtctcgacaacctgaaccatatcagcaatcagacgagaatccttcctaacctcggagatatgctggtttgtcatggcactataaatatgcagggccacgaatccgatttcatcttctcccagatctacatccatcttatccctgattaaagcaacagcctgctcagccatcttgtattcctgaggatatatttccctagtctcatacaaaaacggattatgaatcgtaattccctgtttatgacggttgatggaaaaagcaatatggtcagttaaagcaatcagtatgtgctcatttagaggcttcttagcttgaagctgaacaagatgaagcacctcaccgatgacctcaatgagcttttcatccagctcaggaagcaaccgtttgtattgctcctgttcttcatggctttttaatataaataatttttcaactgaatccaacggcataagatcgccgggtctgcgattgaaaccgattccttttccaatcacgacaacctcatcatgctcgggatgcatccctataatcacattgttattcagcgctttggccacttttaggctgctcacatccgcacctcttttatcagaaccttgatcctaagaattatagcatgaagctcagaggaatccacgttaaagtaccaaatattcggctaaaggtcaataaaaagaaaacgcttttcatcacattgccgggaaatgctgtgatgaaaagcggtcttttggttagggataaatgctccccaaagacttatcgttattctttatctgttagcgctacctccaccgaggctggaagaggctgcttattcgcttcaacggaaggcggcacggaatgaatgccttttttccccgtggtcaaccccttgattaactgctccacatcaataccggatacactcttcagcatctcgggtgccgtagccatcagttcggtgacataattgctgacacgcgctgctccttctccttttcctgtatcaactacagtgagtttatcaatggacgcaatcggttcggcaatacgtccagccagatcaggcaacattttcacgataatatcgagcacggcagcctctccaaacttctggaacgcctccgccagtttttccttggcctctgcttctgcaagtccacgcaaacggatgacatctgcgtctgccgtaccttttgcgcgttctgcatccgcttctgcttgcccgttgagacgtttttgttcagctgacgctttagcctgtgtctcaatcgagtattgcagcgattcagcctcacgcattttacgagatttatctgcttccgctgcttgctcgaccgcataccgatcggcttctgccttctttttcacttccgcatcatattgcttttcacgtacctgtatttccttggattgaagatcaatttcccgttctttgcgcaccagctcgaccttcatctgctcttcgacagcagtctgcttggcacgggcctcctggatgtgataagcctgatcggcttctgccttcgctgtatcctgttctttcttaaacgaagccactttcagttccttctccttggctgcctccgcaatgttggtatcccgcagcagttcggccttctggccttcctgttccgcacgtgccttctgaatccgggcatcccgcacagcctcggcttctgcaatctcagcatcccgtttcacagcggcaattctcggcttaccaagcgcatccagatatccgtgcttatcacgcacatctttgatggtgaatgaaacgatttgcaagcccatctttttcagatcacgagcagccacgccctgtacttcctgcgcaaaccgatcccgattacgataaacttcttccactgtcatcgaaccgaggattgcgcgtaaatgtccctccagcacttcctgagcctctcctctaagagcctccaatggcttcccgatgaactgctcggctgctgtagccacatcctcaatggaactgccgaccttgataatcgccacaccatccgcaatcacgggaactccttgctccgtatacacttccggtgtggttacgtccagtttatgggacaacaaagagatgaattcggactgctggaaaattggccaaatgaaggcccccccgccgcgtacaattttaattttgcgtccagagtcatcctcggaaatatttttatttcccagaaaagagcccgtcacgatcatcccttcatccggtcctaccgttttgtaacgggcccaaaaagcgatccctaatataacgataacgatgacaacaatcccagggactaacacaatatcttgcaaatttgacactcccgatcacgctcccttcaagataatcgaatgcgccgtctatgtgtccaggtacgctacgcggacgacgccctctgcgacctcaaccacgacgatacgggttcccgcagcaagcggtttgtgatcgaagctcgatgccgtatgtatggtgttgcctgcacccaagcggatcataacttccccgtaaccaacctcaggtacaggaatggtgacctcaccgatccggccagtcagctcacgcatggagaagccgctagatacctccgaattcgccatgggtttgataaacgcaaagaacacgagtattccgatgacaaacgcaatccctaaagcaagcacgacgacccaccccatgctcagcccagtatactttgtcagcagtactccagctccgccaaaagcggtcatggctccaagtaaaacgacaggtctgaaccaatcgaggcccggcaactccaatgcaccatccagccaactaccgagtacatctccaatcagcacactgactacggtaaagatagcgccccctgccaataaccaccaaaatatggtttccatgcgactcctccttccatgtccttttcagtctggtttccagtctataactatgtttacgtattcaaccttaaaaagtttcaaaattttcctccgatatcccagatcaaacccaaaaaagcacgttcgtacgtctaatgacgcacaaacgtgcttaaaatgatacaaatatcggtttacagagaggctttgtaaatttcgactacatcttcgcgattaagcttgttaaagccaccaaaagatccgaatttcacagctttatcagccataacatcgatttgggacgcatcaatgtcgtaatcagccagacggcttggtgcaccaatcgagttccagaaatcacgcaacgcctgaataccttccagcgccacttcttcatcactcttgccttctgggtttacatggaatacattgacggccagttgtttgaagcgttcaggcttcacatgcagattgtgcttcatccagttcgggaacagaatagccagtcctccaccatgtggaatatcataaacagcagacaccgcatgctcgatattgtgagtagcccagtcacctgtcagccccatgttcaggaagccgttcagcgccatcgtaccacaatacataatcgtttcacgcagctcgtagttttccagatcgttgaccagacctggagccgcatccatgaccgtacgtaaaatcgtttcgcaccagccaagttggaccggagtattggattccaaatggaaataatgctccagcgtatgtgacatcatatctacgattccgtaaacggtttgattttgtggcagtgagtatgtgtttacagggtcaagaatagaaaacgcagggaacgcaaatacgctaccccatcccaatttttcctgtgttttttcatttgtaataacagaacccgcattcatttcagaaccggtagctgccatggtcaaaactgtacctaatggcaatgctgcctgtggtgccgctttacgctctgcaaaatcccacatgtcgccatcatattttgcaccaacagcaatggctttggaacaatccagcacactaccaccgcctacagccagaacaaggtcgatttgatgttttttacacaattccacgcctttatgtactgtagataagcgaggattcggttctacaccagccagttccgttacctctgcaccaatttcaccaagcaaacttattacattatcgtacaaaccgctgcgcttaatgctgccgccgccatatacaagcagtacacgtttaccatatttaggaacttcacgcttgagagcctccaattgtcctttaccgaagatcaattgtgtaggattataaaattcgaatgctttcatcgcaaacgctcgcctccaatagttctaaagtttaatgttaagaaactactctattataaccttttcggttacaggaaacaaatatgctttattttcagaaaaaaaccacactccttgaggagcatggttccatgtcatatcttgggagggttctcgtagtgtattatgtgctgcaccagcgattttattctcccaaagtatatcccaattgtttcataaaacgaccaaacgcctgctgcccggactcattccgtttatacactcctgcatgctctaaaatttcactgaatttcagtccaacctcattttgtacggtacgaacagccgtttccttgtcaggcaaacgaccgaaccgagtgtttaactgataaatccagtctgcatgcttaaacagtggatgtccttcctgctgcatagccacagccagtttgtcatccccacacaaaatatctgcaatcccatccagttcatccttgagccgccccggtaatatggcaagtcccataacttcgatcagaccgatattttccttcttgatgtgatgcatctcgcgatgaggatggaaaataccttccggatactcttcactcgttcgattgttacgcagtacgagatccatctgatacctgccttcggaatctcggcgcacaatcggcgtcacagtattatgtggaatcgtttccccctcctgctctgtatgagagaggacatcagctacaggatcactataaactttccaggcttcaaaagcagcatttcccgcctccaacagcgcctcggcatctgttgacgtaaaacggatgaccgacatcggccagtttacaatccctgctgtaacctgcgggaacgcttcattatggtatacaccgtccacacccgctttttcaattgggaatgtatgacgaccaccctgaaaatgatcatgggtcaggatcgatccgccgacaatcggcagatccgcattggagccaataaaataatgcggaaacgctttcgtaaaggccagcaatcgccgcagtgtatccttcgtaagcttcatcggtacatgatcatgatggaacacgatgcaatgctcgttgtaatacacatagggtgagtattgaaaaaaccacggctccccattcaattccaccggaatgatacgcagattttgacgggacggatgatttactcttcctgcatatccgacgttttcacggcataattgacacttgggataaacaggcggcggcaaaagcttcgccatcgcaatttctttaggacttttttctggcttggacaaattaatcgtgatttccatatctccgtaagatgtcgactgattccagtacacattgctggcaacccgatccattcgaatgtagttcgaatcgatggataattgataaaaagcatctgtcgccgcctctatgccacgttcatcctccgtttgatgaaagtcacggatgacttcagacggtctcgccatcaacagtcccatgattttggaatcaagcaaatcgcgatacgtatctgtgttttcagggataagtcctatggcaaaaccataatctatcaatacattaagcacaggctggagagcttcgggggccataatgccccctgcttccccacctgaataaggctccgaaaacccaaactgctccaacagcagattacggctgtaatctgtatcttgcggaccgatcaagcccttgttttgtgcgaatgcaaccagttgttccaccgcatatagagccgattgctgcacagtttcgtcgatgtcatgggccagatgccgggaatgttcccggccttggcctttatctgtggattggcgctcgctcatatgtcatcgtctcccgtctattcgtcgccgtagccgtgagggtgcgactgatgccatccccatgctccgctaataatatcctccaattgggtacgtgctggactccagcccaacaccgaacgagccttgtcagaagatgcaaccaatatcgctggatctcctgcgcggcgcggctctgtaacaactggaatgtcgagtccagtgaccttgcgtgccgtctcaataacttctttcacagagaagccctgtccattgcccaagttgaatacgttgctgtcattgccttcgcgcaagtaatttactgcacgcacatgagcatctgccaggtcactcacgtgaatgtaatcccgaacacacgtgccgtcaggtgtcgcataatcctcaccaaacacagcgatgtgtggacgttgcttcaaggctgtctggagcactaacgggatcagatggctttctggtcggtgatcttcaccgatcttgccgctctcatgcgcaccagccgcattaaaataccgtaaagacacatatttgatgcctaaaactttatcaaaccacgacatcatgcgctccatcatcagctttgtttcaccatacacgttggttggctctgtacggtctccctcttcaatcggcaccttttccggttcgccgtaggtagccgcagtagaggaaaacacgattcggcgcactccagcatccttcatcgcctccagcaagctcagcgtgccaaatacattgttgtcataatatttaccaggattttgcatgctttctccaaccagcgaattggctgcaaaatggataactgcatcgatactattttcagagaacagtttggacagtagttctttatccctcaaatccccttcatacaacttgcctccaagcaatgctgctttgtgcccggtttgcaaattgtccagcaccacaacttcttctcccagatccaacagttctgctacggtatgtgaaccgatatatccagctccacctgtgactaaaatggccatgttattcgtcctccttcagttcttttactccgtctcctgccttgcatacataaaagctggcttccagccctgtgcgggtctgataagcttcgccgacttccttcacaaaacgttccacatcgtcctcatgaaccaatgaaaccgtacaacctccaaatccggctcctgtcatacgagcacccagcgtgccaggaatgcgtcgtgcttcttcaaccatgacgtccagctccgtgcagctgacctcatacaaatcgcgcaatgaatcatgagaagcattcattaactgaccaaaagctgcaagttcattcgctgcgagagcatcgacagaggccagcacacgagcgttttcctccaccacatgctgtgcccgccgacacactgtttggtccgcgatgtgatgctgaagctctccgaaacgtgcctcatccagctgagcgaggtattccaatgacggcttctgctgctgtaaaatggacagtgcttcggcacactggctacgacgctcattataggctgagtccaccaaaccgcgacgcttgtttgtattgccgatcacgagcttataagcccccgtgcggaatggcactttacggtactccaacgtatcgcacatcagaagaattgcatgatcagctgctccgttcgctacagcgaactggtccataataccgcaattgacaccaacgtaattgttttctgcccgctgggacaacaaagcgatttcgaccgtatctgtttcctgtttttcgatcgtgagaaacgcatatcctgtaacaacctcaatggaggctgaggaggataatccagcaccattcggtatttctccatgatagagcaggtcatatccgttagacggatgaactcccttttcagccaactccaccagcacacccaccggatagtccacccactcatccgttttgtttttacctatttctccacgggggatagacacttcatacgacaggtttgtcgaagcaaaatgaatttcatcatcattgcgcgcacgaaggattagcgtcgttccgaattccagcgcagccgggagtacataaccaccgttatagtcgatatgctctccaatcagattgacacgtccaggtgcatgaaatatccgcagttcattgctgctttcaccatatttttcaataaaatgtttctttaattcagtagaattcatatccgcatccacctcatataccgttagtaaaggccctcctgatttccctgtaacatcttaatcaggttgacatctcttatgatttcagtataaatgaaagcgtcacacaatgtaatgcatccatgtgtttaagctatggataaatgtgacttggatatgtacaatgtaagtataccgcatccgctaaaccattcacaaatgcaggaaggatgaccctattttgcaagcgtattcatatagttatgccgtcgcctctaatccggtgttttatgaaaatagcccgctgcatgtgctttttgcaggagagagccaaaccaaatccggtcatgccgtggggccgaaaatctatgattactatctgctacactttgtagaatcgggcagaggtatcttccgaacggaacagcacacatatcagcttgaagaaaacgattttttccttattcatcccggtcagctggtgagctatacctctgatgaagaggaaccgtggcgttatcgttggtctgcgtttaccgggcaccatactgagcaggtggtgcaggaggccgggctacgtgttcaccagcctgtctttcatgcttccgatcaaagtcccatccccggttatttggagcaaatgcaattggccttttatagcagaaaatctagttctcatctatcagccttgggctatttgtatctgattatgggggaagcaggcaattacctgagtgactggactgatccgtccggggcggattcgcaaattcaacgtacagtcaagcagatggttcaatatatgtccactcagtacgcacaccccgtttccattgagcaaatgtctgaaggacttggttataatcgtgcgtatttgtcacggatattcaaaaaggaaacggggatctcccccgtcacctatctgcttaagctaagaatcgacaaatcacgtcaactgctgcgtgaacgtcctgaactatcggtagagcaagtggccgcttcggtcggactaaccgatgccttatatttctcacgtcaattcaaacgcttctgtggtcagtctccaaccgagtaccgaagcaaggttaagcagtatccacagtcgtaaaacagacttaaacagcccgcatccttcaaacggatacgggctgttaatttatattgtataagagaacacgaaattaggccgatgactacaaattaactttcgccattaggctgtgccgccgtcctgtcagttcccggcattcagaatcgaatcaatccgatccaattcctcctgagaaaagtccagattggataaggtagcaacattttcttcaatttggcttacacggcttgccccaatcaagacagaggtcagacgttcgccgcgcagagcccaggccagcgagaattgagccaaactttgtccgcgtgcagcagccatctgattcagggcgcgtaccttacgaagtgtctctggcgtcacatggttctcattcaggaaaaccgaagtactcgctgcacgtgaatcctcgggaattccgttcaaatatttattggtcagcaatccctgcgccagcgggcaaaaggcaatgctgcctaccccgttttcgtccagtacatcttgtaatccgttttcaatccagcgatcaagtaaggagtatttcggctgatgaatcagaagcggtgttcccaactccttcagaatgcgagatgcttctgccgtttgctccgcactataattggacacacccacatacagcgctttgccggaacgtacgatatgatccagtgctcccatcgtttcttctagcggcgtatcaggatcaaatcggtgagagtagaatatatcgacatagtccagccccatccgcttcaggctctgatccagactagatatcatatacttgcgagatccccagtcaccataaggtcctgcccacatattgtagcccgctttggtagagatgaccaactcatcccggtacggtttcatatcactggctaatacttgtccgaaaaattcctcagctgatcccgcaggagggccatagttattagctaaatcaaaatgcgtaattcccagatcaaaggagcgcgtaatcatgctacgaccattctccgcgttgttaatcccgccaaaattgtgccacaagcccagcgaaatagcgggcagttttagacctgatctccctgtacggttatatttcatactttcataacgatcttcgccagctaaataaaccatgctatcccagcctctctcgaaacattgtaatgtccatcacaacatcatcatagcgcttttatccaggcattgacaagaaaacgattacagacctaattgatgagcaagtttttccataactttaccgattggatcagtgatcaaaagatccgccttatgatcataagaggtgggatctgtattcagcagcactgtatgtttaccacgaaaataagtaatcaagcccgcagcgggatgtactgtcagcgacgttcctccaattaacagcagatcagcctgcgaaatagcctgaacggattgaataatggtatcctgattcagctcctcctcatataaaacgacatccggtttgatgattcctccatctattggacatttaggtacaacctcagagctgttcatcacttcatctaggctgtaaaagcgtccgcattccatacagtggttccgatgcaccgagccgtgaagttccaatacattcacactgccggcagcctgatgtaagccgtcaatattttgggtcacaaccgcttttagacagccttgcttttccaatgacgcgaggaaatgatgacaaccgttcggctccgcatcgggatgcagcattttgctgcgatagaagtcgaagaacacttcaggatgcttcacaaaaaatgaacggctcagcataacctcaggcgaataaggcaatttctcctcactttgatacaggccagctgccgaacgaaaatccggaataccactttccgtcgatgtgcctgcaccgccgaaaaaaacaatattctgtgattgctgtatccattccgccaacgtattaactttcataccctacgcacctccagttcttcatatccacgaacaaccttatccgcatccagcaaatgaccagaacgttctgcttctggcgcaaatccaatagcgagccgcactccggcacgtttgcccatctgcatgtccccattgctatctccgatgactaccacgtccgccggcgacaatcctagtaatgcgcaggctttttcagccatttccgggtcaggcttaccatatgtaaccctatcatgtccgataatctcatcaaaataggatgtcagccccatccactccaaatgctcctgtgcagcctctgtactgtcagaggtcacaaccgctagcttcagcccggcatggcggctttgctccagcaatgtccgcaaccctggaaacaccttcgctgcccgatgtcgccgaatatcagccatggccgttttattaaagtcgcggacaagccgtacagcttcattccacggtacaccagcattataaagctgccaagccagtacccccgtactttcgtccaccgtccccatggccagcgggccagaagggtcgtaaccgatcacacgtccctcctgatcgtgaacagtacctagaacggtacctttttccaccgtaaaaccggcacctgccacggtaagatgctgctccatcatatccagtatagaacgagcccaggggccccacaactgaataaaatccagcaacgttccatctttatctaataaaataccacggcatgggtaccgctccccctgcacgatcagctcagacatgcagcacacctcctttactgattcttagaagccacatccacactctccttcatccagtcctgtaaagccgttaccgtctgattccattgctccgcagcgctaatttttgcaggattatcccctttttggacaccataactgccgaattgggcatgatttcccccttcgactgtaaaatacagcgtgttggctggtaaataagttcttccactttggacattttccatctggatgactccatcatcacttcccagtagagaaataacgggcagatttttatcctttaaattacccttgttatccgggtaggaggcgaggaaaaatacacctttgacctgatcaggatgtgcagctgcatatcgggccgccattacaccgcctaacgaatggcctccaataacaaacgcttctttcggatatgcctttagcacttcattcgctaaatccggggagatcaatgtaaggttcagtggcatttttgcaatgatcacatgatgacccttttccgccagacggcgtgccaacggcgcataactttcgggcttcaccaacgcccctggatacaaaatgactccggttccgcttcttttttcaggctcaaaaccaacccaatgttcttgttcatttactttcacagcatccgctacttcggctaatgcagcagcagctgtctcgtcaggctgataaggcgtaaataccttccatgccccccaccctgcgatcagtacaatgacaatcaggatgcctaagagaattttccatattttccgaggaccacgtgtcccatatgaattgtatgatcttcttgttcttcttctcattgtaaaagttcctttcgccttttgtacctcgaaattcgtaatttgaatataaaatgtgtcgctgtattcatcagcgtaactatagccttgttagggtaacatcgttgtacatacagggtcaaatcagcatacatttccaggtattagcccatctttctccggtgttcaagcattcgccacataataaggacatggtagcgcttactgttgtgaaaaaaatcacaatgataaagtccagagtatcgtaccttgttccttgtaaagaattattttttaaatagtttagtcggcagaagccgttcggagggaaacacatgacgacaagccatgatgtacaaggggaaagcttctttctcaatttgcgatttctgttgatcatatgcgtatttgcaggaaatgccctggagcctctagtcggttcacttcaaattgcccaacaatggttcagctggatattcatgttccatatgccgttgtttgtactcgttacaggctactttgccaaatcatctttgaccggacccgcaggccaaaaagttctgcttcagatcggtatgcaatatcttatttttcaatcgctctattcgatcttggatgttgcactcttccacgttccccatatccatcattctttttttgctccttatctgctactctggttcctcgccagtcatatctgttggagactgctgatgctcgctcttcagaaagtaccgcctgtcttccaattaggtatatccgtgctgctgggtatcctcgtcgggtatctccctgtggatggtatatggctgagcgtatgcagaacctttgtttatttgccttactttgtagcaggttatcatttgaattatgtggacgttcgacggttcttcacaacaccagtccgcatagtcgctggcattgtatctcttctgcttatggtactggcgggaacgtcgtatttcggcatcccggcaggctggctgtatggcaatatgacttacggtgaattgggccataccgaatggtacgcaggaatttaccgcatcggcatttatggtgttcaatggatagcatcgatggcgtttctaagctttgttccggccgtcacaggacgtataaccgagatgggacgacggacactatatgtctttttactccatggcttgatcgtccgtaccgtcgttgcaaagggagtctacgaatatatagatactccagtggaagtcatgttgattgtagtgtgtgctgcaggtctgtgctgtatgttgaccatgccttgggttcgaactgcaacaaaacctctgattgagccacaggtagagtggatgctaaagccagctccttatccttttagacggtccgcgtaatctttttatcccttttttatttaacattgaacacgcgacaacccacttacagacgaacatgtaagcgagtctcccctctctttactccacttagagcctgtttcatacaggcgtgatgtggtaagtaaaggatgcgcgcaacaaaaaacaacttttttattaaggagtgatttgtaatggcacgtaatcaaaatcaggagaaaatgagtcgcgaagaagcaggtcgtatggggggagaagctacttccaagaagcacaataaggaattttatcaggagattggtaaaaaaggcggggaagcaaccgcaaactctcatgataaagaattttatcaggaaatcggcaaaaagggcggcgatgctacagctgagtcgcatgacaaaaatttctacagagacatcggtcgtaaaggcggcagaaattaagctgtagtgtcatattccgccctcctttaacataaaaacaagcctgagcccatccgctttattgcgaaatgggcttttcatattttacctgatacgcaaacctatcagtatacatatttctaatagaatcacattctaacctcttctaaatgcaatatatagacaaataaaactggtcatatctatatattgttgattacagaacacttcttgtactttttcaaaatcttcatatatgtagaaaaaagctcacatctatgatagactctttagaaaacatctgcgctatcacggcgtccattgaacgccatactatttttatactttggggggaaaccagcatcatgacagctaagacgaaaatgcgttccgatatgattaaaaaaggctttgaccgcgctcctcaccgcagcttgctgcgcgcagcgggtgtcaaggaagaagattttgacaaaccgtttattgcggtatgcaactcgtatattgatatcgtaccgggccacgtccatttgcaggaatttggcaaaattgtcaagcaagccattcgtgaggcaggcggtgtacctttcgagtttaacaccatcggtgtagatgacggcattgccatggggcacatcggtatgcgttattctctgccgagccgtgaaattatagctgactctctggaaactgtcgtttccgctcactggtttgacggcatggtttgtattcctaactgtgataaaattacccctggcatgatgatgggcgcattgcgcgttaacattccaactattttcgtcagcggcggtcctatgaaagctggtaaagacaagaacggacgctctatttccctgacttccgtctttgaaggcgtaggtgcatatcaggctggtaaaatcgacgatcaaagcttgcttgaattagaacaatatggctgtccgacatgtggctcctgttcagggatgttcacagcgaattccatgaactgtctcgcagaagcgatgggtctggctatgccgggtaacggcaccattctcgctgtagcagaagaacgtaaagaattcgttaaacaatctgcacgccaattgatggaattgattaagctggatcttaaaccacgtgatatcgtgactaaagaagctattgataatgcatttgcattggatatggcaatgggcggttccacgaataccgtattgcatacattggcacttgcccatgaagcagaagtggactaccctatcgaacgtattaatgaagtcgcaaaccgcgtacctcatttgtccaaattggcacctgcttccgactatcatattgaggatgttcataatgcaggcggcgtaagcgcagtgctgaatgaattgttgaagaaaccgggcgcactgcatggtgactgtattactgtaaccggaaaaaccattcgtgaaaacgtagagggtcaggaaattctggacactaacgttatccataaactggacaacccttattctgaacgtggcggtctggctgtattattcggtaatctggcaccgcaaggctccattatcaaagtcggtgcagttgatccttcggttggtggttatcacaaaggtcctgctatctgctttgattcacaggaggatgcactggcaggtatcgccaacggtaaaattaatgaaggacacgttgttgttatccgttatgaaggtccaaagggcggacctggtatgcctgaaatgctcgctccaacttcacaaatcgtgggcatggggcttggtgccaaggtgggtctgattacagacggacgcttctcaggtgcttcccgtggtatctccatcggtcatatttcccccgaagccgcagaagggggacctatcgcttttgttgaggacggcgatatcattgagctggacttgaacaatcgtaagattgagctccacattacggacgaagaattcgaacgtcgtcgcgccaactggaaaggctttgagccgaaggtgaaaacgggttacctggcacgttattccaagctggtgacgaacgcaagtaacggcggaattatgaaaatctaaatgctttgccaagataggattactttatgaacggctaaaaagcctctcgatccctaacaatggatcgagaggctttttttattaggtcaattgcttgatcctgtatccgctgcttgtgaagccctgactgatgtctgaacaggattagcctcttcggtcacttcacggttgagtgtatggacaacatccctctgatcagtttgatcaagagcttggtctgagcggagtgaacctccctgatggaaacggtcaaacaaggtatccattggcatcacaatcagtttcggtaccattacatcttttttttcactcaactgttctgaacccgaaggatggatgacactaaataaaagctttaaatatacggtggacacatgcttgaacagtccttggggaagctctcgaacttgaaatcccaacttctctggtccccgatgaatcatacttactgcatagatcgcctttacaccattcattccagaatcatgtacaatccgttgggcaagatcaggaagttgtcttttcacaatccgaatcaattgaatagctagatgcaccatagactttgccgtcgaacccaattgaaacaacattttattatcaaaatgaagctcgattaccgggtcccctttttctagccacctgccgttctccatatttacatttggcccatgatagatacggcgacgataataaaagatcgtatcctccttgcttacgggacgaagacggaacaaagcgtggaataaccgctcgtactgtagccatccgaataccagcgttcttttaaaccagcccgtactggacatctcggaggcagtgggtttattgacagactgacggcaaaacaatgtatccacccgtacgctacgtaattgccgttcttgcgcgaccatcagtagcttctccagcgcgattagcatattctgtggcgcttctacgtctgcccccaatgtcgtaccacaatcatggagcagcatcacctcgccacccctcagctttttgagcattctctccgctaattgtttcgctccgatgctggccttccagtccccgaacatggaagaccataatacgattcgacgaccattggttttggaaatatcaaaaaaattcacaatcccccaaggcggacgataaaaggtcgttccttcgccagttactcgacggataactgactctgtctgggcaatttgtcttctgacggtaacaggccgcatcagccaattcgatttgtgcacataattatgaataccgatcagatgaccttcatcatgcatgcgtttcagaagttcagggtatttttctgcattcatcccaacaacaaaaaaagtagccttggcatcaaaacgcttcagtaaatcaagcagctgtgatgtatacactggatcaggaccatcatcaaaggtgagcgcatattcttgctcacttttaccgcgccggaacacccggaacccaaatatacgactaaccagcgccggaacaaaagcataaaaagttgaaatgtaaaacatccataacagcaaagtctgcacgttttatccccacttttctattcttaactcccaagcaggctacctgaggaaaactcacttacttatatgttatcacaatgacgtaaacatgccgagatttcgcgactgcatatggtcagcattgaggtccaatttagtgtacaataagtaaaaatcttaaaggagtcgttgtatacatatgcttccattgtacaaaaaatattggcgtaccgtttttgatatcggactgatcgtattaaccgtgtatttaattatgttcgtatccagcaaactgtatcaacttgcggcacctgtgttcctttcgttcgtcgtgttctggtgcattgaacctgccgctcgttattttcatcgtaagggaatgaagaagcccttcgcctctgcgctctccgtattgctgtttatcatccttttacttgctatttttttcggagtgggcctgattctggttacgcaatttacgaaagtcgcgcaaaacctcccacattatacgcagattatccaaacggaattcacgcggtatcttcatctttctcaagataaaattgctgctttacctccgggtgttaccgaacgtgtaaatgattattttgcgactgctaccaccattgctacgaaatgggcacagctagggttatcctttttcatacaattcctcagctctttcactgtttttatgggcaactttgcggttgcgatcattttagcgttctttttaagtatggaaattaatctttggaagggcattgctcgtagtaaaacacccaagacactaaaaacggcttacctttttctaaaaaatcacgtacttaaagctatctccgcttttctcaaggctcaagctctactggtagggattacctttgttctcgtatttataggtttactcattttgcaagtggataatgccctatcgttagcgctcgtggcagctttgtttgatatcctgcccttgttgggtgtgcctgttatttttattccgtgggcagtgtatctgttcatcacaggcaataccggcctggctgtaggcctgcttattgtcatggctgtcacggtgatcgtccgccagctggcagagcctaaaattactggtaactccatcggtgtttcatctgcctatctgatgctttcctttgccattatatcgttatccatcttcggattggccggattaatcctgtcccccattctgatcattttgctcaaggaattatggcagcaaggttatctgcagcaatggattcggtttccgacagaggaatttgacgagcctccgtttatcgttaaaatccaggaggaagatcgtgaagctacccgtggaactcaggaggattgagctaacagatccattacttgaccaaacagtgctgtagcttgatttgcagaatgtgttgaagcattttgcacaaggacggcgaccgcataacgaggccgctctatcggaccataccctataaaccactggtgattgatagggtgaccgttcttcaaagcttgggcggtacccgatttgccggccagattccatgatttattacgcaaggaggcacccgtcccctgtgtcacaaccttttccattgcttcacgaagcatgcgagccgtcgatgtctgaatcgagcgactaccctcggatgaaggtacagcatgagtaggtagttccagtaaggtgctaccgtctgcgtagctaatgctttttacaatgcgtggtgcacgtacttgaccatcgtgcagcaaggtgacgatgagattagcagcttggagaggcgttaccagcacatcgcgctgaccgatagctgtctgtacacgtacgcccggatcagacgcgttcgtatgggagtcgaatacggctcccttttcttcgtgatccagcggtctgaattgaggtagccctgcaagattccgctcctgccagcccacagttcggcccaatcccaatgcagaggctgtggcctgaatttgctcaggattaagccgttcaccgagatgagcgaacacactattacaggatacggcaagcccttcctccaggttcagggtaccgtgtccttcttttttccagcaagccaaaccgtacttgccataagttccatgacaatggaattgttcctgcggttggacagcacctgattcaagtgcagcagcagccgtaaccaacttaaaaatggaaccgggcgttaccgccttgagggcacgattagaccagtctgtttttttctgcggatcaacatgcccgggattataaaaagggcgagacaccatcgccagtacatccgcgttgcctgcatcgagcactaccacggccccttctgccaaatgactagattccgtcagcttttcaatctgttcctgtataggtagatcaattgtagtttgcacctgtaaaggatagtgaccattggatggagcactgacacgcagcggtacatgagtcaatggacgacgctgcgcatctacaaatcgggagacgaacgtttcaccgacgccgctcagcagcggctccaacgttctttcaagccccgctgcccccatcggcagttcactcgctcggtcggcacgttcatacagaaagccaagccattgcctgccattgggcaaatccctgtaacgtttcgcataaggtacaagctcaataagcgaaggggctagcttcagtagcttgcctgcttcatgcggattgatttgtacgggctctccgcccccatcacgccatatgagcggggattgcagtcctttccagcgtgtcagtagttgcttcttgttcgtacgcagtagcttagccagttcttcgccatgtatagccgctttgccatctacatcgggaaaaagcactggcgcccatacgactccgccagtcaagggttgcccatgccggtccgtaaactgtccacgtccagagtcgatagaaatgccctcctgtcgctgacgtgctgacatttccttaagcgaatgccctccataaacagacatatgaatgcccgctgtcccctgaatccaagccagtcgtaataataaaatcagcagtagcgtcatcacccccaaggccatatatgcaattcgacgttttcgtatgaaactgctaccacgcctcggcacacccatccttctttcatcatttttccagtagtatgtcctgtagttgaaaaagaaaacccactcaacttttaacgtgaatgggtttccgaatttatttgtatcttgtgatgtctgcttctggactccaatctaaaatctcgtctaatgaataaaagaccgtaataaaaatagtaatggccagcacaacccaagctacctttgtgtttgtattcatcttttgctttccttcgtgagggatttttaagcacatccactaataaaaagtacaaaaccacggagatcagtgacattcctgattcccatgggtttgttatatctacaccgtaaatcgcgaaagctgttccttcaaattcaccgatactccttccagcttatccgacaaacctaccagttgattaccgatattggcctgctcagtgctgagcgaagcgacttcctgcgaagtagccgaggattgctcggccaccgcacttacattggtcattgcctcggacaaagtggtctgcgattcactcagatgatgaatggaggcggtaaccgttctcaatcgtagcgcgaactctcccatttgctgctgcaccgattggaaaatgtccgttgtttcctgcacggctcccatctgttcccggaacagcgggtacacctcagataatgcctgtaccgtttcattcatttcattgacgatgttgttagtaatgcctgtagccgtacgaatagcttgacgtgattgttcagccaactgccgaacttcattagctaccaccataaaaccacgccccgccgtccccgctcgtgccgcttcaatcgtcgcattcagtgatagaatattcgtttgtttcgcaatatcctgtagtacgtctagcaccttaaatacatctgaagttgtctgcttcagttcatctactttgcccaccagagcatgtgtagtttcttccgtaacccgagtcttgcccaatagatttttcagctgaatggtccctttttcactggattgttcaacttcttgtgcgaccagactcatttcataattggaagccatcaccgtgtccatttgctgagatatattcccggttagtccgctgccacgttcagcctctgttgccaaactggcggcgccatgagcaatctcttccgttgctgctgcaatttctttggctgaaatggctgtcttcttcgaggcatcgcctaattctgtcgctgtattcagaacttcctgagctgagacattcgtctgttgtaccagcaatgtaatctgctccatcatcatatcaaagctttctgacaactgcccaatttcatcctgagccttatagttcgttcggatttgcaagttgcctttggcgccttcgaccattaaatccttcagatgtgtcaatggacgagccacgaggcgcacgatccacaggccaatgaacaatgcaatgagtgcagccactgcagcaaatatccaggttgtggttagaatccccttagcgtctctcaccagctcagatacaggtactacacccacgagaatccacttggaagttcccagcgtattatgaaccgcaagcacactttgctttttgccgtctgcttcctgctccataatttgatttccttcgattccttcaagcttggaaacgtaatccagctttgtcttccctcctgtcaagctctcattgttagagcctacaaactcacccttgtctgtcacaaggctaatcatactgccagagcccaaattaataccttttaactcgtcctccaccgcactggactttaaatccataaccagaacataagtccctcccaacccggacatgctgttcatggagcgtgccaaacgaaaggttttgctaccattgtcattcacctgcgtaggaagccaaaccattcccttgtttttcaaaatatccttaaaccacgcttcctgccgtacatccttttgtgttccggtgcccatagcagctaaattggtttcttccgggtacaagtacattgaatcaatcgctttattcgtaaaagcaagattcgtaagcttcttattcacttcgcccatagcaacaaaagatgcaaagggatttttatcttgctttacagccttttgcaactgatcacttaattcagtatcaaaaaatacctgtgtcgatgtatcttgaaagcgctctagaataatatcaagcttttctgaagtttgctgaacggtctgctgataagccgtagctgcattttgctcaatcgtacttttagccttgtagtatgagagcatccccaagctgaccacaaataacataattgccgcaaaaaagatcagaaacaacttcattccaaccgaacgtatcggattatagtttttgaccaaatgcatgaagtctttactgtacctttccggcttaagtaaacgctttaaattgtgtgtacctttacgagtcgctttagctacccagggggcaaccttcgaagacaccgcacccgtttgttcccctttttccgtgttcactttactgcctttcaaactctgcatttgatccgttttcttgggttgcttttttactgtattcccctcttttttccgtaaacccattcctctcacctgccaccatataattagtttctaattccacgtcatccattatgtatctattatctatataacttctatcggaactattcgacaaggaatgtagctttcctttgagtatcaactaaattttgtgaaacttttttcctagaaaactattcaaaaaaaagcctctccaaccgataggagaggcttttgaatcttttaacctgtgacttaaggcttatttacttctttttacgcatcatatcaaaataggatacgggttgatctaccttcattctaattcgttgaagcgggtgacgagcagcatccaattcgttgccttcttcatcccagatcgttccgaccgtttgtttaaagaatgttccgttcgggccgaaaaattcaatttcatgaccgggtttaaaatggttccgttgttgaatagttgcgatgccactcgcggcatcgtagtccatgaccagtccagcaaaatcataagggactgctttttcttccggctcataaatatgatcctcatgatccggtgtatcgtagaaaaatcctgtattcagcgggcgattggctgccttgttaatttcttcaatccattctggtttgagcacataattttcaggatcagccatataggaatcaatcgcttgacgatagacattcacgaccgtagccacatagtggatagacttcatacgtccctctactttaaaactgtctacacctacatcaatcagatcagggacattttcaatcatacacagatccttggaacccatagaaaaagcattatcgctctcttcaaacagtggaagctggttaacaccgagtcggaactgtttcagtgcattgctgtcctgtgcctcttcctcagatatccaaacttcacctgggcgtgcatcctcaaacaaatcgtatttccagcggcaagactgacaacatcccccacgattggaatcacggtctgtaaagtgattggacaacacgcagcggccggaaaatgaagagcacatcgcaccatggacaaaagcttcgatttcgatgtccacatgctttttaatttcttcgatttcctctagactggtctcacgacccagtaccacacgcggtagtccttcgtttttccaaaactttaccgcttgccagttcaacgtggactgctgcgtactcaaatgcacttccaatccaggaacagcacgcaatgccacggatacaatagccggatcagcgacaataacggcatgaattcctgcctcatacagattgcgcaagtattcctcgattccggcaatatcttcattgtgggcatagatattggtggccacaagcaccttagcaccgtacttgttggcaaattctacaccttcgcgcatttcttcaaaactgaaattatcggcgttcgaacgcagaccatatttttgtccaccaatatatacagcatccgcgccatagtgaacggcaaacttcagcttttccagatttccggcaggagccaacagctccggcttatccagacgattccgtttacctatatatttcctcgttttggttatcgtccccatgacgttcccccctctgtgaattcaattcattttaaaattaataaacctgctctttatagaaaaatccgaaggaaagttcccgttctggatcttgaagacggcgaacttcatccagccagctttcatcataagcataagcatccgggtcagctgtataagtatctattgctttacgataagcacgaacaaccgcctcattgtaagccgtaggtttcaataagccctcgatcttaaagctatgcacgcccgcctccattagaatatgcaggtcctccatgatgcaaaaatcatctgaactcataatatgtgtcccattaatatcctcgtagatggggaacttttcttccttccgctctgcttcaatcagaaacaagccgcgccctctgcccaaatcgccttctacattacgtccctgatgcagcatataactttgaacaagcttacgcttggaatgataaatattggtcataccatgtacctgaacctgtgcttctatgttcaactttggtatcatttcggtaatttcatccatactgagctcacgagccaaaatgacccgggaagcccctttttcaccccaatagttggcggttgcaaagttggtggagatcatctcaccgttccagaacagcttaagatgcggagcatactccttcacggccatgagcactgcgggatcattaaactcaatggcatcaatgccgcatccagctagggtctgcacatattcgggaaggagcggcaatagctcgttcgtcatcaaattcgtcatggatacatatacctgtgccgtatgcttgcgtgtctcttccaccacttcacggatttggtcaggggtaaaatgtcccggcagccgcattccaaagcggtcatctccaataagtaatgcagtagctccagcctccagcatatggcgggcatcctccggagagctggcagttgccagtagttcgggtttgtaagccataggctcacctcctaatttgtcttacggttacttacctgaatgttatgcaaatgttctttatacgttttggcaaacaaatgttcatgtgtcccatcttttttggtcacataaaataaataatctgtagcttttggctgtaaagccgctatcactgagtttagactgggacttgcaatcggccctggcggaagtcccagatgcaaatacgtattataagggcttttcacagccaaatccttgtaatacagccgttctttttgcttgtccaacatatattgaaccgtagcatcaatttccagcttcttcccctgtttgagccggttataaatgacgccagctactacagaccgctcatcttcaacaaccacttcgcgctctacgagagaagcaactgtcagcagttgatgcagcgtttcaccccgctgtttcagcttggcatccaaatcggaaacagtctccagccgcttttgtgtctgttctagcatcacctgtataatatctttggccgtactaccctttttcagctcataggtttccgggaaaagatagccctccagcgcatagcgaagccccgcctgctttggaatgtcccgcactagcgcgacgtcaaaagcggacggatcgttgaccagctgcaaaaattgctgccgatctgccaatccttccttttgcagcttatcagccatctgtctaatcgtaaaaccttccgggattgtaaaacgaatcatttcctctttgacaacatctccggccgataacttagtaatcaactgatcaaaggttgcgccaggctgcgcctcatattttccggcctgaaatgcgcttccttgctgtttgaatttcacataagccttaaacacgaacgcattacgtataagtcccttttgctccagcgtatctgcaattgccgatgttcctgttccctgcaccaccgtaaaagcaacgggttgtgtttggggctgaacaggctgcatggcattccaaatatagagggttgcccctcctgctataatgataagcagtagaaacaacgtaaacatcctcgtccttcgcttcacatccactcaactccttcacagccaaaaagggcggactggtccgccctttcaggtttgatctcatcgctatccagacttacagttcttccggcaacgtacattcatcgtacagttcggaaatatcttcccactcatcatcatcttcaatggtggtgatggagatttcgccgtctgtggatgagcttacatggtatagttcatgttcgccaacagcagccccaggtctacgcaatacagcgtaccgttgttcacctaccttgaactctgcttccaattccatgcgaattgcatggccctgttcatcctgtaactctacatcgccgtcgaacgtttccttcaaatcagaggtccaactcaggtcttcacgtgaatagctcgtcatttcccgtcttcctcttcctcttcttctacaaatgtattaaaggtctcttcgacgatttcccattcggcatcgtcttggatcacaaacaatttaatatcatcgccttcttcctcgtaacggaaggcgtacacatcggactcatcagcttcagggtccactggcgcaaccatcatgtacttcgcttcggaaccatctacctcaaacttcataatgacctcgaactcttcctcgttgccctcgtcatcggcaatataaataatttccggctcttcttccatacccacttgattttcagccattacgaaatccccctcaccttgtactgtgtgcgtccaaatagttttgcaagatcaggcttgcggccagtttatctaccacctgcttgcgtttttttcggctgacgtcggcctccagaagcgcacgctccgccgaacgcgtcgtcagccgttcatcccaaaggtgaacgggtaaacccagtaactccttgagtcggttcgcaaactcgatgcaaatctcaccgcgtggacccacggttccgttcatgtttttcggcaagcctacaacaacctcgccgacctcattgtcacgaaccaaatttgcaattttaccgaactcgctgtcgtcaccgcgtcgttctatgacttccaatccttgggcggtccagccgaaggcatcacttacggcgaccccaattcggcgatccccgtaatccaatcccattactttcatgcctgtctcctaacggtgcttggcgagatagaaacgaaccaactcttcaatcaactcatcgcgctcttttttacgtaccaggcttctggcattattatgccgtggcacataagccggatcaccggatagcaaatagccgacgatttgattgatcggattgtattctttttccaccagcgcatcatatacggtcaacaaaatctcctgagcagaagcttccttctcatctgccttgacattaaatttgaccgttttgtccatggaatccattgttgacacctcgcttccacaaaacatgtgtacatgtttatgccagcttattcttttacatcataccataagcaaagccctacaaggaaatatctaagcccgttttttcccaaaaatccgcaaaaattatcgaactttatccttgtgaggctgccgacaccagttcatgcgcacgttgaagtgcttcgtccagcttgctggcatccttaccaccggcttgcgccatgtcaggtcttccgccaccaccgccaccgcatacggcagcaatttctttcacgagcttgcctgcatgaagtccagccttggtatgctctgccggaactgctacgacaaaattaactttgtcgtccattgcagcgccgagcaccagcacagcagccggaagtttccctttcagttcatcagcaatcgcacgcaacgcatccatgctggaagcctgcacgcgtgcagccaacagctgcaccccgcctgcttgcacgacctgatcggtcagctggcctgcctcaataacgttcagcttgctttgcagcgattcattttcacgactgaggtctttaatttgttgctgcaaagattcgatacgcttaggtacctcagacagcttggattttacaagcccagccgacaccttcaacagctctaattgaccttccatatattcaaagccaaaacgtccggtcaccgcttcaatacgacgtacacctgatccaatgccgctctcgctgacaagcttgaacaagccaatttgcgaagtattgctgacatgacagccaccgcatagttcaatgctgtaatcgcctaccttaacgacccgtacgatatctccatacttttcaccgaacagcgccattgctccgagagccttggcttcatcaatcggtttcagttcaatattaacgtccagttggctccagatggcacggtttacacgcagttcaatatccgccagctcttctggtgtaatgcttccaaaatgggagaagtcaaaacgcagacgcccaggctctaccaaagaccccgcctgattgacatggtcacccagcacttctttaagcgctttgtgaagcaaatgtgtagccgtatggtttttctcaatttctccacgtgaagcttgatctacttctgctttcaccgtatcgccaacgttcagctcaccggcttctacaacaacctgatgcacatgctgaccttgaggcgccttaaacagcccttcgaccttcgcggttaccgtacctccacgcagcaagccttggtcacttacttgtcctccgctttcggcatagaaaggagtcacatccagcacgacctgacaagactgcccttcactaacactgtccaccagtgcatcttcatatacaatcgccacaattttagactcagttatgaggtcattatatccaacaaattcacttttaaccgccagatcggacaaagctccgccctgaatcttcatgctggcgctatcctgatgagcatcacgggcacgtttgcgttgctcctgcatcgcttcatcaaaaccttcacggtctactttcaagccttgctcgtccgcataatcctctgtgagatcgaacgggaacccgtacgtatcatacagtttgaaggcatctgctccgctaatgacattgcgaccttcggccttcgcctgagcactgatatcggacaaaatggccaatccatctgtcagtgtttcatggaagcgttcctcttccgttttgatcactttgatgatgaaatcacgtttgtccactacctcagggtaatacacacccatgacatccccaacggtttccaccagctcaaacataaatggacggttcatgccgagcatttttccatagcgcacagctcgacgcagcaaacggcggatcacgtaaccccgtccttcattagaaggcagcacaccgtcaccaattgcaaaagctacggtgcggacatggtcagcaataaccttaagagccacgtcactgtccacattttcgttatatttgactcctgccatcgccgctgttttttggatgagtggctggaagatatccgtatcaaagttggaatctacattttgcaaaatggatgcaaaacgctctaatccagcccctgtatcaatatttttgtttggaagcggcgtatagctgccgtctttgttatggttgaattgtgagaatacgaggttccacacttccagataacgctcattttctccccctggatacatttcagggtccgtcatgtcgctgccgtaggcttcgccacgatcataaaagatttccgtacaaggtccacaagggccttcgccgatatcccagaagttatcttccagtttgatgatacgttcggctggaagtccaactttttcgttccacagcttgtacgcttcctcatcctcaggatacacagttacagccagacgttccggatcaaaaccaatccatttcgggtccgtcagaaactcccatgcccatgtaatgacttcttccttaaaatagtcaccaatggaaaagttgccgagcatttcgaaaaaagtatgatgacggcgcgttttaccgacattctcaatgtcgttcgtccggatacatttttgcgagttagcaatacgtggattctccggcttcacacgtccgtcaaaataaggcttaagcggcgccatacccgcattaatccacagcagggaaggatctttatgtggaacaagcggtgcgcttggttcaatcacatgtcccttgctttcaaaaaactccagccatttggagcggatttcactagctttcatataagtagcctcctaattatggtgtcactggttcctggcactggccataaaaaaacagaaaaacgcccctgaacggatcagggacgattgtatcgcggtaccaccctggtaaacgccgtcccctctgtacgaaatgcccatgcgcaagctgcacaccaacatttgcttaacggacgatcgatcgccttgttttcactggtaacgggagcatcccggcgggttcagcccgcacttcgaaatgagctttccctactggataaacacatttaaacatactcaattcagtatatccgtgtcatttagccgtgtcaacgcgatttcagacaagatacatacggtatatggacaaaatcagattgttttccgcttcacataataagcaaaaaaatgctgaagtcctacctttaaaaccgccatcacgggaaccgctaaaatcaagccggtaattcccgcaatttccccacccactagcagagcgaaaataatggctatcggatgcagatgcaacgttcgtcccaccacctggggagagatgacattgctctccaacacttgaatacaggtgttaacgaccacgaccaaaagcaccattttaaaggagaccgtagaagccatgactactgccggagcggctcccaaaaaggggcccaaatacggaacgatgttaaaaaccgcaaccactcctgccaacaacagcgcataaggcatgccaatgagcatatagccgagataagccatcactccaataatgacgcataccagtaattgtcccctgacatagttgccaagcgcctgatcaatttccttaagtaccgttacaatcgccttacgacgagaacgcgggaggtaagacacaatcgtccgctcgaacacatcaaaatccttcaaaatatagaaaatgaggaacggtacaatgaacacattgaacagcatgttgatcatcccgccgatgttatccataaaggtagaaatccctgttgccatccgattctctagttggaaaaaccattgattcatacccgttcgcaccccttggggcaaaataccgctatccatagtcgtcattaatccctgtgcatgcatggtcagctcaggcagatgctcattcagctcatccagttgttcaatgaacatcggaatcaggttcatcagaatcacaacgagactggctaaaaacacagcatagatgagcagcacagctacgcttcgaggcaccttgcgaccgcccagcatactaacaacgggattaagtacataggagatgatcatcgctaccgcaaacggagcaatgattgttttcagaaattcatacaaatgcaaaaacaaaggtcgcagcagccagataaaatatagaatgacaagtcccagcagcgtccatattccgtaccggaacagtctacttttcattaattgctccatttcgtgcccccttaccggactagcctcctttaagtatatgcctgtacctccactttaatccttcccgcaagtctggattgccctatagattactattgtaaaaaaatgatgaaaacggatgaaaacaattaacaaagtcataccatctgacgatataagtacaaagcactactttaagctttcacatttctgaaacatcggggggcgttacatgaacttaaaaatcaagcttattctcctttttacttgtattgttatcgttgcagctgggccattgtcgatcattagcatgacaagcgttaaaaatcaggccaaccatgatatccaagagcttatgaacagcaaagcctccgaaaccgtcaatcagctcgacggatggataggtggcaacgccaaaattattgaaacattggctgcaggtctggaatccagcgatatttcatcagatgccaaagccgtatctctgaaagcagcttttcaaaactataaagataaaaatatttccaatatttacgcaggctttgaagatgggtcctactgggatggatctggctggtttgaagcaggttatgatcctcgcgctcgaccgtggtacaaggatgccaaaaccaagggagaaatgtattactcgtccccatacattgatgcaggcagcaaggacttcaccatttccattgctaagcctctcaaggattccaacgattctatcaccggggtagtcagcgaagacattatgctcaacgatatgacaaaaataattcaaagcataaacctgaacggattgggctacgcatttctgattgaccaaaatggagccgtgatcgcgcacccagacaacaagctggctggcaaaaacctcaaagatacccccgagttgggttcatcaaccgcggacctgctgagcgcagcttcgggaagaacagactatagctacaatggaagtgaccgtcagctttattttaaaaagatgcctagcacaggctggattgtagggttgtctatttccaaagaaattgcttttcaggagtattactccactcgtaatacgttgattattacggttgctatcatcttggtcgtcgctatgctgctggcaatctgggcggcaaacaactttattaagccgattcgcagactccaagcgaatgtcaaacgtatagctgatggtgatatgaccgctcgcgtagatgttaagggtaaagatgaaattgccagcctgggaacagattttaatatcatgtctgataatctctctcacctgttgcgcaaggtatcagatacggcgggcgatgtcagctcagcttcccatgatatgcatcaacacgccagagatactggaaccatcgcgtcacaaatctccagtgcggttcaggagcttgcccaaggagcgagcgatcaagctgaggctgtatattccggctctgagaagctgactcacataacaggctccatcgaccagattggcgaaagtgtcaaacggacccaaactgccgtgttcgaaacagattctgccgtgctcgcagggtatgaaacagcagaacgtcaagcgaaactggccgttgagtccagacaaacgacgactgcggcaggagaagccgtagattcgctcgcgctgaaaactcaggatattgagcggctagccggggccatccatgatatcgccgcacaaacaaacctgctggccctcaatgcatctatcgaagcagcacgggccggggaacacggacgaggttttgctgtcgtcgcgggagaagtgagaaagctggctgaacaagcgggcagttccagtgacggtatcatgaggaagctggaagaaattaaaattgcaggagtacaaagcgcagaggaaatgaagaaagcacttgctgtaactgtagaacaggagcatgctgccattgcaacgagacaggcgtttgaatccattcgtggggcttctcagcatatgcttgcccaaattgaggacgttaccgccgctgcagatcatctccgtgtgaatgctggacatatttctgatgtcatttccagcgttgtcgctgtttctgaacaaagtgcagcatctacagaggaagtggcttcttctgtacaagaacaaggtcatgccatgaacaatattgccgacctttctgccaaactcgattctcacgctgatcttctattggaagaggtcaaacgctttaaattgtaaaactaaccatcttcataaatatggtatacaaaagagggtaccccgaacggccatatgactgttcggggcaccctcttcgttgttttttatcaagcgttatccaacctactaagccgtatgtagatcacacctcttagtaagcagcctgtccactttcggtgtcaagcttaggaagaagcatgaatttgcggcaagtcctgttgtgccatctcatctccaaagaataggtcgtccagcgaactgagcgttccatcctcttccacttggtagacagacattttttcaccattcacctgaagttcgataaagcatccccagcaataaaattgatgggagccgattttgccgatatctttggaattacaattcggacatctcaataaactcaccctatccattaacagaatatatggctttttccagacgctgctcgcttaacgggggaaccataacggcattttccccgatggacatatcttcggtgcagggcagccatttccgcccttctataatatccgatacaaaaccatcgctgatttccaagcctattatgttattgcccatttcctggtcaaaataaacatccgagatgtgcccgagcataagcccttcctctgttagcacggatagatccttcagtttaccgggtccaagcaagtacgtatgttgtatatcatgggcctccgttttacggacagcctgctgattgcgaatcatgatcgcatcctcaccgtaagcaacgatatcatcccaagcaaccattttcacgtgagaagaaaaaaaaccttttccttccaactcgatccctgtgattcgccaatcagctgtcaccataaagtcatgtattttgccaatctgcttcccgtcctccacatcgaaaacggcaagtccgatcatatcttgaagcttcatatatagggtacctcctcattctgcaatccgaacgaaggtgcggtcattttcctacatgcctgtcagaccttgcttccgttcatgcaatgaaatggaaaaccgcccctcccttcttattaaaatgcggagaaatccctagtacctagtacgcagccgcttccatatggtttcaattttcttggccgtgtattccatttcttccgtagtattacccaaaccgaagctaaaccgaatcgctgaatgtaaaacatcttcaggaagatccatcgcctgcaatacatgcgatagctctagagatccggaagtgcaggctgatccgcttgctgctgcgattccttccatgtcaaggttcatcagcatggtctctgtaccaatggccggaaagctaacattgaggacattaggtaaagaatggtcagggtcaccgttaattacaaaattttggctaccgagagtgtcttccaaccctttaagcaatgtctgacgaagaaccgtatcgtgcgccccacgctcctcaatggaagcattaacaagagttgcggctttagccagacccgcaataccagcgatgttttctgttccggcacggcgtttcttctcctgaagtcccccatgcattagcggttgaatgcgtgtaccctgacggatatataatgcacccaccccttgtggtccgttaatcttatgacccgacacactcagtaagtcaatcgggagattccgacagtcgatggatatatgaccgaaagcctgaaccgcgtctacatggaatacaatgccatgttctctcgcaatctgccctacttctgagatcggctgaataacgcccacctcattgttggcatacatcatgctgatcaaaaaagtgtccggtcgaatggcagcctcgatatccgcagggttcacgcgtccaaaaccgttgaccgggacataagtcacctcataccccgctttttccagctcatcacaagcatgaagcactgcgtgatgttcaactgcggttgtaatcatatgcccggaagtacggccgtctgccgtagccgtcccaaacagggccagattatcgctttctgtccctccgcttgtaaatataatttcttcaggcttgcagcccaaagaggccgcaacggcatcccgagcagcgctgacggtgcgcttggcatcgcgaccaaaggcatgaacgctcgaagcgttgccaaattggccggtcatgatgtccatcatagtctgcgcaacctcaggatgcataggagtcgatgcggcatgatccagataaattctgttcatgttaatccacctcaaatatagaacatatattaaccattatctacacaagcatacaagaagagagttaaagccgcaagggcaaagggtttttatgatttttgagcgagttatatctacaagaaaaattaacgatctacaagccattttgcgggtaaattgcgggtgattttttgacccatttaaagagaaagagcagtgaggttttatcctctcctgctcatttgcatttagtctcccacacaacaatcggtaatattgtccaatactatatcctgctcttgtaatggtgagataactcttactgtaacaggtgtttttatatcgtatacgctcataatgatttccgcgagagctgttgcagccttctggcttaaattttgttttatctctatctgatatgtctgcattgatgcactccttatgtgtttgtctttactggataatgaatttcttgtatactcacgttgattctttttccgtgggacttactttggctatcctggcagggatgccaacccacattcgagcgcctctctttgggaggcgttttttcacatcccttctcgtaacagggactttcgttcctattattctaaagtcttgaatctcttaacctttttataccaacatcacattatgacgtaaaggggaaaaatgtcgtaagatgtcgaatgtgagttgggccatcctagggtgaattcatcttgacttttccttttatatatgataaaaagcccaaccgaaggcgggcttagttaaatcctaatatttttttaagcatatcaagtttgcttttagatatagggcaagtataatccgtatccttaaatataatttccgttccgtaactctgctcatcatatcctgctactttagataaatttatgaggtgacttggagtagcaggaaaaagataaggaaaagcctccttgcactttttaaaagttaatatgattgcgatgtattcattttggttatggaaacgaggaacatgataattttttttggggtcccacatatcgaaataacaaatatctttagctgggtaaagcccgaccgaagtcttagtttcacctataataaatctccgatcatcaggacgctttttagcagcgacgataaggtcactcaaaaataaagaattagtcttattaacgctagtacaagcttgggaaccaccaaaaaaaactttgccgccatagtcagctgtttcgtgtgcggaaacattttttagattaaccaaattacctgaatccaggctaataaaatcgggaaatccgtttgagaattccccgagtgtggttggaactgtataattaccgctggttgtgaaaaaaaacggtatttcgtagttggattttggcttccaattttcgatactaactaaatcgctctcaaaaaatgaaaacctatctccgtaactaccatccgacataatctcaggtgcgaaaatctctctgttgtccatagatcaaatcatttctttagttctttcggcagcggtaaagctccgataattgttttgcggcttacagcagctttgttagcatcttttaataactgtttggacacaagacgtgcaatagtctttttcatgctctttcacctcccttcagaatcggtggcggtaggagtagaatagcctgagccgcgaaagaaagagcaattataggagattgaataataaaattagcgagtacaatagtaagggaaatccattttagatatggatctattttagaaggattaatttcttcgaagttattcggcgccacgcatagtacgactaatgctgttatggctgtaagtagtagcgtgccaccatgtcctaaatccactaagggaatactagcaaaaagcccagctgaaaacacagcacaaaccgttaaagatttaaaatgcaatcctccagaaaactttctaagtgcaacaaatgaaaaaaaagctacgagtgcacctaccatgtgtcctagcatccatccaaataacgccgtaagcacaagaccagaaaaccaattaagctttatacctattatgtaggttaacacctcaacgcttcctggcccctctggatcagctctttttattcctagcgcgatacgcctcgatagcctttctagcatcttccatgtcctcctttcttgatagaatataggagaaaccgaaggtaaatatagacataagtaaaagaacaaacggactggactggtataaaagagcctctgctataaagatggtgacggaggataaaagagcactaactgataccctcctattttctgcggataaataattttctttccatataaaatcgtgcggcggagtaacgataaacgagaagccggtataataaattctaaggataaacgatatagcaaaacagataagtatatatgttatttgtaagatgtagacctgataagttgtgttttgctgtagtaccccagtctgcaaaatacccagaaaattataaagatagtagacgccgacttgcaaaatcgcatatgcacttattccagctccgaggataaatgccgcaagatgcgtcttaatcgacatcccgtatctgaaaaacaatataaacagtatatattgtaaaggtaaatcccacttaggaatattgaaaaccacgcgcatgaaaaaagaaattatagcgattaataccccaaaaccaataattctttttttatatgatgctactggaagcatatatattttaagactaaacaccataacggctattgcatccaaaataccaagcagtatataaatcgcattacttaacacctcacaccgcccatctaattaatctaccttaattatatagtggcgcatgacgtaagcaagagattttaaaaatttgtcgaaacaatatcctccagcttaacccaactaaaatcatcctcaccacgaaacagttttacttcgcgtctagcggtgttaatcgacgtaaccacaccagtcataacctcatcgtcaaacgggctaaatacggtcactgtgacggcgttgcgtgagttgtaagactctattagagcctgctcaattaactgcacctcttggtcgtccaactccggttttccacggcgctggcgatcctgcatgagctttaaatatgcttccttgtgttccggtatgataatgcgtgaactttcccataaaccattaccctcaagtttctttcccatgtatgtagcctcctgttgtgttatgtatcgattatattacgaacaagtgttctatacaataaaatattatcgccataacaaacacaaaattatcactttggtttttttcttactcctatattcacctatattgtattggcagatatagccaaaggcgtatcaatagggtaaactatatttacggaagatgaacagcaactactccagccgatggagattgatgacggtgagacaatgaaacacgaaatacgaactcaaatatcctacatcctgttttcagaaagtactacaaatttaaaggccaaaggtagatctaactttttaatttttgaaccttatgttagaaaaacagtgagtttcccatataagttttcgttttacttgaccgtaggaattatgaccccaaagacagaaatagaagacctttatattaaagtttttgacccgatgatgaaagagttgactcagatacctttaggcaaaatgatagaggatcaatattctgttccttctgatttagtgtttactggtaatttcagtttatataccgaaaaaggaatagacatcgaaatgcctggtttgataacgatagttgtcttttaccaagacacgcctttagctgaatcaagaatactatttgatgaggttgaagataatgagtgattctttatttgaattaaaaacaccaaaagaaacagatgctgttattgacattgatcaatataaagaaaatagagtatcgcagcccaaaggtacaaagtatcaagggcgccttaatagaactgtacttgaagaatctgcgaatactagcgaaacaccaacaggaagtggaggtggaggcggaatgaacgatatactgcgtcggatagagaatttggaacaaggtcaaaaagacttgaaagacgatttgaaagataaggtttcaaaatcagacttggacaaatccactttagagttaaagctatacatgcgtgaacttttcgaaaaagtgcctaccgaagacagaatcaagaccatctttagtgaacaacttaagtcccacggtgtagccactgaaacatttgtttccaataaggttggtgaagcaaggctttcaacaattctttggattatagcaacaacgattgctattgcaggcttgatttttacgattataagattatattcataagagcattagcatgctaaaaaagcgaaaacccagcgctgtatgtcgcgttaagggctttcgctttttaatattccgtgtagtatctattcgctgcacccgggggcgtgactatcttttgatcacgatcccagccctctatgatttggatgttgcgcgtatcagatttgttttcccaaagaatatagttatccctctccagagccaacagccccgcctttatgtccgatacactcctacccatctttatctccaactctttcatagttggcaaacgccgccgcccagcagaatagttataaagtatccgcagtaatttccgttcccggtcagtgagcatatggtaacaccttaagtgcacgcggcatattttcaccacgtacaatatagcccttcttttgtaggcgctccatgtacccatatgcagttgatgtagatgccagccccagccctatttgtagttctcgaaccgttggtggatatttacttacctcgataaattgttcgatataactcaaggctctcagttctttcgctgttaatttcatcatgatgtccccccttgatgtttggatgaactcattatataacgaacaaacgttcttatcaatgtaaacaaaaaagagcaatgaggactaattattattcctcttgctctttcgctttttccaccatctggttgactagaacacttacagtgcatttttgcttttcggctttcccctgtaaccattcaagtagatcaggctcaaaataaatagcctctctgactttcttatcctttttcggtggtcttcccgccataaaatcacactcctaattacgcacattttacagcatttaaaatattttagcaacactcaaaaaagctatttacaaagcattttaaatgctgtaaaatagaagatgtaaggaggtgatacacattgagagctatagattgggtcttgctctccacagcactcacaaacctgataactgcaattatcgggttggtaaaagtgtttaaagagagcaagaaaaacaaaaaaggaaccaaacgacgcgtgcggcgcaaacgttaaggattccttggtagagggcggcttacacagcgccttctatacccaatcataacataagagtgaaataaaataaatctcgattaaggagcgttgggtatgagaagagtgactacgtataaaggattcaagattttacagaggaaagatcatacaacacaactcccagtattcgcagtttacaccaaagaagaatgggcatacggcgaaggatttcgctcatacgagtgggaagcttgctccatgaaggaagcccatgagtttatagattcgtattaaaaaatggaggggtaccgttatgtatgatgtaatcttatggaccatatcaatatccggcctggtaataagcctcgccgcgctgctgctgactgtccgcaaccatttcaagtaggaggtgattcccgtgggtaataacgaatttgacaacctgctaaagtccatattggacacccaccgcaaacatgggataatgaccatagacctgtcccacgacagcggggtaagcgtgttgagaggatatttagcagacgcgcatagattgggtctacaccaaggatctggcatcgcaaaggatgcaggcaaataaaaaaatccccgccgaccaattaaggttaggggggatttttcctacaaattaataaatcatattaaaattttattattagttactgactttgaatgaaggagtgtaccagtcgcctatccagttatcataattactatcgctaaaaagtttcatcattatttgaaagttaccactctggcctttatttaacaggttatcgatcggaaaacgtgattgtggggaagttgaactaaacgatgagggattactttctgcaacaactcgatcagtatctatgttcacaagataataataatagtaaatagtcccccctgcagccgttttttctcctgttacccctatatatgaatcactaactggcacatctccgttacgatcagtgtacactctggcggtaattccattcttagtctcccaccctgaattcgcttgtggagtaattaattcttgggaaactgctgatgtatctggattttgtacaaccgtttcagctgatgctactacgggagaaagagacgcgattaataaactggcagataaaactggaacaattaacttcttcattagaattcctcctctttgtttaaatgccttctctgtatatattctgcacacaaacccaattaccttctatatatttatttttttatatcaaattaataaaaaacacaaaaaaaataatataattcactttttaacaataaattctattttcgttccatccgcatagtcgtccaatttgtgacctacccacgatccagctccacgattatcctttggacttatgtacttaatgtctgcaccctctccaccttcggagcacatcgccataggccactcgtcgcggtcatatccttttttagttggatagcccttcaaggattcccttcgattttcctcagctccgtcccgatcaatcgtacataccgcagaatgtccagatgcaatggcatcccttatgtgtgctccggtttcaggataccgtgaacttgggaactccaacgtatacccaaatgcttgttggttggttgctgccggttcagcatagacgccttgtacggtaaaaatagcagctagtaaaaatacaattaatcctcttacgattccttttatcatatgacacctccaagtatttgaatcttctctatactatattgggagacatgtcgaagtatcgcataggttgtcgcaaaataaaaaagaagctcctagttataactactagcgctttattactctcgaaaaaattaaatccacaattaaacttatatttgaatatatagacattaatgtttagacatccctttttcgattttgtatgattactgagcaaatataacaaaaaggggatttatacatgaaaagaaagctcaatctaattttatgcttcaccttacttatcactatttttatcccactctcctcagtgagtgcctatactggagggtatgccaacggaaaaaatgtagttgcaatggtacctgatacttattttataggaagaccgcatgtaagcaaagcaaatacaacgcttataacagataacaatgaagaaacaagctacttacttcctaaagataagatgattatgattgatttaggtacagatagaactattgattcatataagcttaaaagtgattataaaagtttaagaattagtttctacgaccgagacacaggctatatagaccaattagaaaccaacgttggtaatggagaactgacgaagcttccaaatgaaaaattgttagaacgtgttagatttgtcactttgtatacgcttagtggcgaagacattaatattagcgaattcgacttcttttatagtaaagatccagggtcaactccagatcctacacctacacccgaccccacacctactccgagcccagaacagccaaccggtgaacgcgcaatcttagttgtcactatggatactggtcttgaaaaagagtttgacctgagtatgaaagaagttaatgattttattgcatggtatgaggctaaacaagcgggttcaggcacagcttcttatgcaattaataaacataaaaataacataggcccttttagcagtcgcaatgattacgtaatattcaataaaatccttacatttgaagtaagcgaatactcaactaaataaacagtacgaaggactccattctggctacataccagtggagtcctttttcacatctactctaaattcaaattgattccgtatgtaatacaccccagcaatcttaaccgaatcaggcgaaaacttttctatagtgccaccatagtctataaccgatataaaatcctcacctaacggctgtacaacatatactctcacctggcttaatgcagctgcaaatagttcgatatccgactttaatactttatatgtatggttcatgctatcacctcagtaattcattcggcgcatggtggtaaattcctgcaagtaaaaaattccccgccaagcaattaaggttagcggggaatttatttgcttacgtttaagcccctccttgttgatcgaaaagtacgatattctgatggtggctatgagtctgagcaggtatagtcacgataaacaaaaaactagctgcgacaatcaatagcgccatttttcttaacatcagctatccacaccctttcaataaattctaaatatgctgccttggtttcggatactgcataagctcgataacgctcaaacaacaccatacattttataaaataagtctcattatttagtgtatgataacttaccattgaatacatcaagtatttgaagccatcgtcgtatgtacctcgatataaatgataataagctacttcataactcaaacgtgcatactgttctggtataacttgtttcgtatatatgtcattagattgcggaaattgcaaaagtgaattaacatccgtttcaaaacgctgaagtatatcacttacgtctatctggtatcggtttgccgtcatcataatgttcaacagttgggcaactttatcttgttcagatgtatctgatggtgcaccaatgtattcaacataatcatataaggcgtttatatctccagataaaagcttatttgcgacagcgttagcttgcgcccaacctttgaataaattaatccaatatagtgtatcctcgtccatctctctaacccactctaaatccgcataggcgtatgtatattgtagagcttgttgataatcgccttgggcttcgcagacactggcacacaataaatcagcataagtgatgtacacaaacatgggacgacttagccttttagtagattcatcacgctctcgactcttctgttcatgcttcatcgaatattggatttccgctttagccctcatttttttagccatttcatcaaccttgtcccatttgcgtaaagacctgtatacgtttgctaaatccttcaatgcgtcaagttgctctatttcgtccagacgttccacaaaagcttcaaataccgaagctgccctgacattttggttttggtcgtctcctatctgaattttaaatatgcgatattggcagactgccaaacgttcagaatgttgatatctctccgtttcagctacaccctcataaagcagcaaagcagcctcatttcgtccctgcgacaataattcttctgcaatttcaaatagcttgggtgaatagagtagattatccatgatggctccaacaactcgacggatcgcatccatcttgtccaactccgcacatcgaaacaaaaatggctcaattcgcctcatatttggagggtggtcgatgatgtagttttctacgaacaagtcgtaaaaatggccttctggcaaacccatagcctcagtaattcgatccagttgtttaatagacaaaggcttatttcctgttacaatagcacttactgctcccctattcatatccgcaatatgaccaaattgtgttaaactcaatccttcttgttgtaggtatctgtctaattctgctctaatcgtaggtgtatgcttcatgtcatatccaccttccacacagaaattccaaaactttttattattgcattctattgttgtccataatttaacagttgtcaataagttttgaaatttttgtcattcggatattcaactaaattatttttttgaatattgtcgactactgtaagacaaatagtgctatagcatcatttttccaatttgttaataaaaacacacaaattattcctactattatggtacactgtcacagtaatacaaattataccataaaggacgtgtgtcaattttgttaaagatgaagaaaacagcaattatccttacaggtgtcttggctcttaccgcagtagctcctttagccgcatcggctgctcccattacgcagagtgcagaacaagcaagcaaagaagttaaacaagtgagcatagacatcgaaacctttaacgctatcacggatattgaaaagttcataaaactggatggggatcgttacacgcttgatccagccgcaaaagaggttgtaagtgagaaaatatttgataactactctaaagcaattgagtctgtaaatgaacaactgaaaaatgggattctgcaaacaaaaaatggggaacttaccgtaaatcctgactacaaagagattggtacgaatatgtatggtaattggtactggtggggatatgcattgacaatgtcggattatgagacaaagacacaaataaatgctattgagaatacaagagacacctctgcatttgtatttgcaattttggcagcgatacccggcttgcaaggaacaattgtaccatcggttataatcagtagtggagctacgttggtgctaaataggctaaaagctaatgatctcggaagaggtgtaaccatcaatttccatcctggatattttgaagtcacaagtaattaaggaatttattatatgaatatatatttacttatcttttttattgcagtcattggtggcaacatagtgtttagcatctttaagaaaaatcaaggagaaggtagtaaaaagcctgatgtcgtaaccattatagcattagtgatcggattaggattaggcattgctcctgtttttctcagtggtatacaagagtggacttggcacactacagtccttgtgcttggttctgcacttgttattgggcgcatcttgtatagctggagaaaaggtcgaaataatataacaaaaaacagctgatacaaccatttcacggtgttgatcactataagccctcatctgtgatgagggcttagtcgtggtacagaggtagggagaatgatgaaaaagaaaatctttatcacaattggagttattgtagttatcctttttgccttatacttactaactgtgtgggcagctaacaaccttcacgtaccctctcaataaattaaaatcaaaaaataccctaccagctaaatgccagtagggtatcaccgatgctttcggattgcacaacggtgcttccgtatgagttgttataagcatataccatttgggggattctgtaaatataataatatgtttattacctcagttgtgagtgttcggtagaatacgtattttagatttagcaacctccacttccttaatcgctaagtggggattttaatctaggacccattaacaacatcacggttgttattattggatcgctttcttggcttcctacttttctgaggggaatttattgccttgacagactgtatccataaaatagctccgcacaaaggagtaaataaccaacagacaataagccaagtccataatgcactatcaaaatcgaaagtggggctgattgaacgtgatatagcaatgaaataaccagttcccccgaaaattataatcgtaaaaaccattatcggtgtaagaactttaagtgcaagttgagatattagcttggttacttctttatctatatccaaggaaagttcctcctaaagataagtttaattccaccaaacattattaaggagcacgcactcatgaaagttccgatcatagagacttccgaagggattactttgaacaaccataacagtggaagaaatatgacaccagcgccaaaaacagtgaatgccgttttatataagcgatcaccgaccacatcaaaaaaatgattgttcatttcggtttcctccataagatttaatatgtttaattgcatgttaacataggcaggctcaaaataaaaattgtattgcctcagagcttgggcaaatctatcttctgttcctttaagattagccgcaatttctactttataactttcatttaaatacattctattatgatttgataaattagatgcttcttttttacctcgacgaggattaatgttaattgaactacttgatgaaaacttcctaaatgaaggttctgctgtgccagtagcacaagcttgcaaaacttgcgaagtaggttttggaagagactgattagcaactggcatagatccaccgattacagaggtagaaatcactccagcgataaaggttgcaacaattacagggttagtccctttagtctccattacgctaatatctggagcaggattccttactacgttaacaaggacgctctctgcttcattcaaggccttcacgcccatgaaccattataggatatgaaccttccaagacctcgtccacgtacacatgtgatacatattcaccaactgctctaaatagcacatttttgaattccataccgattacagttccttgatactcaataggcactgttgcgcttattgtactatcagcctgtactccaaaggagattgctcctgtatcaacaaggcgaggagaatcgtcacttcttccgaacgttactcgaagagtatgattatcactctcctcaaccccagctaatccaatgcaaatattaaaagaaaaattccctggtacaaatgagggcaacaatgaagaaaatgggtttgagatatgcatcttaggacctgtggtagtcatttcttgatgagtgttctcgcaatagacaaaagcactaattttgttcactagattccctccataaagcatcattaagatcattcctattacaatattcctataatctctcatttggggaaatttagcaagccataattcctataacatgtatgtaaccaacagctcttgcatatgtattttaacatttagttcattttcacaaagtagctaaatagtctataaaattactaactagcggatgattttggtgtgccctactgacacgcagcagggcagttgttcacttgtactgttagtcttatcccgcagaaataggagtttgttcagtttctgttggtccaggagtaggctctggttcagatcgaaccagagcacttggcgttacctctgccgtagcctgcgccaagaaatcattaagctttgcagcaagccccgatacagcttccttagctgcggcctgtgctgcctcctcgtttggctgtgcttcagtagccagtactgcttttgttttggccttatactccaggtatgctttctcaatcgcggattttagctctacttgggatactgcgatgccttgactagtaagagtacgtgaagcatactgcaaagcctcctgaagcttacgttctcccccagcttctttaaatgctgtttgagcaagcgcgaatgcctcccctgctactttatggattacctcgcgctgtgctgccgttgtacgcgcttctagccacacgttaaccttagttttgagtttattcagacctcctaaaacaaatgctgtaagcacacccgcagcggctgtgacgatggtatttacgtaaggttgtacattttcaataatggtttgtgtttgcatgattatttatcccctttcaatttcaaagcagcgattttatttttggcatcccatgaaacctcagctccgtaagattctgcaattggccggagttgcacgtaagctgcaccttcaacaagttgcacagactgcaatttacgaccgtccaaatacgccaccttattgaagttatcccaattgcaagataccccaagagccgtagccaaggcccgcaggggcacatgagttttcgagccaaacagcagcgcctttcccagcgtcttaccacccacctggaacacagaatcttttacggactccttcttcggtgcagcagttcccttaccgaaccgcgcccgcagatcgtctaccgtgccgttgtactcattcagatcaaccgggccagcgatgccagccaccttacgtgtgccggacggtaatgtgccaccagccgagccatcgctatactgccagaaatcccagcgtgaccaaccagatgcgccagccgggacctgtgtggcgctgtaccgggcaatccacaatgggtaatctgataaaccgctgaaattaccgatgaacgaaggatatgtgtacacgattggtcgtactccagtaagccgctcaacttccgccagaaatgtcctagctacggctgtaagagccgctttgcttaagcccgacttgttggactcataatccattactggtggcagatcgaaagacgcgatgcctccggctgaattaacggcacttacaaagtttgcagcttcctttcgggcatcttctggcgttttcgcagaatcgtctacatagtgataagccccgaccaggactccgacagctcgtgcagcctgtgcattaccgatgaatgttttgtcgcggtataacttaccctgactggccttaataaaggcaaaggaaatgccacttgccttgaccgccttccaatcaatctttccttgataacgggatacgtctattccttgggcattaccttttttccttgcttgcatcttccctatccccttcctgacttccgcttttactttttagaacctcaaccgcttgtcggatcactggtggtattggcgctccaagcctgcccccgttttccagaatcgaaagcagctcatttgccatataaaaataggcgaccgcatcccggaataggtgcgaatcgcctaaaactccatcaatcagatgggatactgctaccattgcaaagataaatacctttcgagcgataccgataagaccaatcttgcttttcaaaccgggtccggttcccttcttaccttcagcgccagccgcgaataatccagttacgtagtcaataatgaccagagcaagtaacacccccaatactcccgaccacccaccgtaaaaatacgtcacagcgctacttcctaaagcagtgctgaacttaaaaacctcccacttatccaccttgcttcccccgtctctttgttcaggaaacttttcctgagctatcatcgtctactatctgttccttttcttcttgcgcctgtatctctgctaatgcatttcctactgctatatccaaacctataagtatttctttccggcgtgctggctgcgaagcaatgacagcagatataacctctgtcaattcttcaactggtctggtcagatctagttgtatatccaatgtggattttatctttaccacgggtttcatcacctcctcaagacgcaaaataagcctccaaaatctcagaggcgttcatgtttatattttaaagttgttttgttactgtagtcctacagatttaaaggttcgttgttagttcatgtcgaagaaatatagaaaaacataggaggtgactattttgaacagtaatcaactcgcccatgagttaacaattttattcctcaaaaattcgtttgacttgtccggcatcaaaacacctgaagaatacgtaaaggtttatcaagagaacttccagaaaatattaaacgaaattggtgaacaagaaggcttcttcttcggttaagacatactatcaatttcattgatgtattctttttgcattagggtgcaattggttgcagcttctttcgctttgtctaatataagcaaggctgtgcctactgaacaagtttgttttcctaaatagcttaagatatgtttcacgcactcagcagccttttcgtttttaattccaatcgtcttgtccacaagaatcggactttttgtgttgttttctggcatttcattccccgcctttgtaaaagagtaaaagcctctctgtctgttaagagaggctttcctaataaataaatcatattttacttttaatactttgttactacgaaaaaaggactttctacacaaatgtcgaattatggaacttggaaggagggtcacaattgtcagataaaaaaggatttcctcaacgcaagcaccttcacaattcagtggataaaagatccgccagattggtcgagccaaacaaagcggttgacagcagtaaaaccgattcatccaaaacatcagatggaggtaaaaaatgagtaatttcaataagcctacaaactcaccaaaaccatctaactatccagttggagaacagcgatcagtggacaagcctagcgctcggatttcttcaacagaccctaagaaaaagtagcatttattgctgtgctttttttatgccatcagggtcgaaaattttgatgtataccccagtctttgcatcgtacagaatctgacgcacaggaattttatgttccttgaccaaatcagtaaaaaaatcaacatcctctaaatttagatagcgttctggctcaaatgtccgggacgctttcgttatacttccaataatcggatcttcttctttgtttattttaccgatctccacaacctgctcatcatcttttccaaaaacttcatcccatactgaagagttatcagaaaaactagcgactccgcgctgtttacgtactttatttatcagtttcatttgaaacggttgtatccacttcgcccaaacccatcccataaaaaagctaacaaccacactaagaattaagaagatgaccaagaaaataatattgtttgatttgcctttcaatacgtccagtgaccacacaaattctgtttgccctaaaaaacgcgagagaaaaatgacaccattgtaaatcaacaatgtcacaaaagaagtcggtaaccatagaagagcagctacagccgtaaattccccaggagtatgtttcactacaggattaataccgaaagattgaatccaaaagtacaacaagaaccccggtaatataaatactattgaacctataaagttttccatagcacttccctttccttacatgtcatacaaaaaccctccgtttttaagagggcttctacatattagtatataatttggttatcacagtattactacggattttatttaagggaagctatagctttatttatttcttctagttcagtcttatatttagctatatttgtttcagcttcttgtatatttttcttcgtttcttcaacatttttttctctgatttccgcaaacttatctgaagtagattctgtcttcttagaagaaatctcaagagacttcaccatatttcccttgtcactttctgtatctgctacaaatttctcaagttcagttttcctctcttccaacttagaaataggccatccttggtatttacctgagacagttttcacttcagcatttgcttgttgtgaagaagaattattcgatgaatcaatttgaattgtctttccatccacttttaagttcactcctaaagagtcggttacagctcgcaaaggtacgtgcgccttcccgtcaacgactatggcattttcggaaagtgaatttccatttaccttgactacatattctccagcgaccttctctccgactaaagatttgatttgatccgcaaatgcactgccagccgtagcaacaaccgcaccaatcaatacaccactaagcaaataagaccatttcttcattaaccgtacctcctgcatagtatatatgtcctaatattaccatcggcagaagatacagtaaacatcatgttgtcgagctactagaacttccgcctgctggaatattgacggtgactaccgttcttccttgactgtatagttttaaatttctagtacccggatcaaaagttgcattaatgattaaaccgttaaaaagatcgccgcgaatttctccaatttcattttgtaaactggtcaatttgttctgaacgccttcaacggcacttatctttagtccgcttactgtcgcattactgaaatctacttcaccgtcaaaataaaccatgtcatctgtggatttgatataaactccagccatattccctaaatggaacccatctgaatctccgtaagccgatcctcttggacttccgttatccataaacaaaagagcagcaccatcattatactgacctaaagaaatggactccccaccccttgagttataagcagtcaagccattggagtttatctctattcgtctgccttccttggctgtacggaataaagcccctgtaataataccgccctcgatctcattaccgattaacttactaccacgtatcgtacttgcagtaacggtactagccttaatatctgaagcattcatttctgagttatcaatttggcccgtaagcttgattgacctggcaacaacattcccctgcatgtctacccggaatggcgcaatggtatagtcgtcattccctgcactgattccgttcgtattaattttggttacgttattgccactaccaataaccaaagaaacgaagctaccaagttgcccaataatctgttctgccaatactccgcgagcagttatagcagcacggatcgttttccaaccatctgttgatatgcctatcccttttgaggtcagacgcacttgttccaatggatttgtcttttcttgagccaagatcccgccttctggtggataaatcaattccgttttactgttgttgatatcaatgacagcttgtttggcataggcttcaaaaacttctgttcggatcttaccgttactaaatgagttgttaacaatgttcttgcttctctccaagtcactgataatatcagcatagtcacgtaaattgacattggaaatagtgggttcagagtgcttgtcacggctatatgggtactctgtaagctccgtgattcgagctttgagtttgttcatgtccatcgccggatcaatacacattaccgtgtcacctaaatgtggttctggctctgtattgtcaattttatataggtcagccgtagacacagtaacctctagcgttacattctcttgctctctgagagccttgcgagtagctttaagcagctcctcaggttcttcaatatcctgctctatgatttccccatcgtaaaaaggaaccgaatcgttggtccaatattgagcataaggagaaattaaatagttaactgccagttttccgtttacaatcgttcccggcacactggaaagcaaactccgctcctcgtccgtcagtttagatgcatccattccaataaaggttcgtccatccttcatttgcgaaaacatgcgggttacaagagattcacccttgtctttgaaggagctagaaacgatattctttttgagtctatattgtagtccattatcagaccctatcttttttctcagattgattacaaaattatccggctctgcttcacattcatacatttgaacgatcttattgagagcttccaagcacgtcccacgcccaaagtctttgacatcatgcaaatcgaatgtgtcatggattacaaatttgaatctcccgcctgtagcagctgtaatcaggtctgtgagttgattaatatggataccataggcttcagcgatataagatgcgtacggaaacttgtagtcattaagtttgaacatgatgtgattacagtagatatttgcagtcagctttttcccctcgcgtgatcggctacgagactgaatgacataaaattgaccacgctcatcttgaacgtggcccttgattgctatcttctccctatagtcttcgctggtcattgggaccataaaggttaattcgtagtcactgttaatcctgcgccgccgctgaatgtcataagaatccaccagtgtaccaacgcgtctcatgtttttatcaaatacttgcatagttggagtaggcataatccacctcacttaatataagaatttatctcggtgtgtaatacggaacaaaaccgtccggcctgtctccaggtccgtccaggtcaagttattattgccgagattcaaatcgaagaaatcaccagtgtaaagatgcgagacgttctgaccatttctcataattttgaattttcctgcatctatagtaatgacttcaccaggacggaatacgtccgtaaactcaatataatctgtatggaatcggctggcctcggcaggctgcaatcgtccctctcccgacatcggtaaagcttgtagaataatttcacgagtatactgtgcatctgttacgcgtccatcgccggacattggcatagcttctaagtcataagaccgaacaaaatcagattgcgcccggccttctcctgaaagttccacgcctgcggtcatatctaaattaaagtccaatatatattccgtgaccgtttctatgtccgtgacattgaaggacattaggttaaatgcattgtcagcttcggccccactattctctttacgccgggaatacatttgtgcctgaccggataaatgagcggatagatctattacattcccatccgttgaactgcccgaattaagagcaaggccattaaatccacctgtattaaacatagacctccctcctaaattaagtccttctttgcccgatacatgtaagcctcatctgtgtgttataaacattgtgttctgccgaatcactttgaaagactttgaatgatattacgtctcctgctgctagatattgttgatcatccatcgttaaaaatgtgaccagtcccgtacctagcccagctccttggcgggtggttaagttgctcccatttttgtataccgttatatcagcgattttagtatttggaaggctttctatcgtagctagacaattgatgtgataccagccgcttttactaataagtaccgtgtttccaacgcgcatattatagctgtcttccatcactgtagtaacgggtacgtcagcaggcgcggaattagctggcaaggtgtatcccccgctacgaaggtacacaaaaggcgtattcccgaatatttgacctgataatggcgatttttcatctgttacaccctttggaacagtaccagccacgacgattattgatcccaactgagactggatacccgtgacatttccatcccctgtgcaattttcgatgtaaaaccagcttctggcgtcagcagctataccaatattgcgattagaaattttacagtttacgatccgtgcattagcatcatagctactaatgccatgctggcttgtggatgcaccttcaataacgacgttttcgatcaaagttcggttacaatagaccagagatataccaactttttcagtagtcgttatcgtcatattgtaaattcctgcacggtttgtgaagttgtctaatgtgacagatttaaccttatataagctagcatcttctgtttctccctttagttccagcgtctgagcacgcagcttgtgcttcatctcaacatcttcatcatacgttcctggtaacagcacaatggagaaccgggacaggcttataggcttcataatgctcacagctttggcaatggtcttgaatgccttgaccttagtcagaccatcattagagtctgaaccgttaacagcatccacgtaatatataaaggcatccgttagctccatgccttgtaatttatcgtcaatggctccaatgtttttttgtactgctcgcaagtcggacgcggtaaaattacgtgccaccacagccccggatgcccaagcacgcgctacaccttcaaacccgcgcatacagcctttaagtgtgttatcttctatgcttgtatatgtgatcgtttccgctacatccccattgcctataactgctataccttcaccttgaagcaatacagcagcattcgttaccttgatttcggtctgagtggcggcaataagttctgccaactctgtacgcggcgaattcaccaccggagcatacattttttccatgcataacgcctacccttcatcaatgtttatccgaccagccataaaacgcagtgagtcatttgtctgcaccgtccgtgggtttgtaactgccccgtgatacattaaattgcctccggtcgctgccgtacggatgccgatatgtgtaaccaatccccaatcagccgttgcaattgggaaatatacatctgctgcactggctgcggctgccctacgatccgcaataaccggagcgccaaacgtaacagcacgccgcgcatagccgcctccgcttacctcttgtcctgtatctgcgtctgtcgggttgctagtgtacagagcaatgtacacggtctgtggagctgtgaaattcgtcccccttaaagcagcattgatacaggctgttttccaccaattacttttactaagcaatatttcttcttcagtcgattcactaagcaatgtgtctgccaatataaaaacctcctattctacctggtactcatttgctatacgaaaattccgtatgtcgttgtttcctatgttggtaagcactattacagggctcgctcgttcatcccctgtagaaataactgacactgtttgtggagactgtgtgataataacctcttcaatgttctcgtcactctcgggaaacggatgttcacccattttgattggtatggttaactcaccatcccaaagtatcttttcgatatccaacgtgccagcataccgaccgacgtatctccttcccggcaggtcagaaaacgtgaatacgatatccccttttttggcattaaaaagagccgccacttgggcgactctcctatggtaatcaagggttgtatcatctgccataacgacacattcaaggttaattgtcctcgctccgtaagtactgccaaagtctaattccccatccctctctgctatttcaagagaatggtcctttgttggcggcagcacaggtatattgtgagttttaagccctaatccaatggatttaaaggacttgccatcgacagtagcatcaatcatttaggatttacctcccctcgcttgcaacctccgcaccagattatctcgttcagtccaaaatacctttgctgcggattcgtcttcaatataagtatcgcctgattttattacgaactgattgctaatttgctgcggatttgatccacccgaagccattggcatagaaaagtcaggcatagaaaaattaagtttcggcatcttaaaattgataatcttccacaagttgctctgttgctgaccattcaaatacatttccccttctcgggcaatgacgggcacctcagctcccttttctccctggactatccctccagaatggaatttttgaagcttgcctgtatccttcttgataccatacttattccgcagagcagcattttcttcgtgcagcttggccttctcagaagtgcctgccgagtaccatttatcaatattggaattatatcgcgccaaatcactatccttttcggatattgacgaacctgtatccaaggaagcagataatgaagttgcgttgatttcagccattttaatctgatagtctaagatgaattgatccaactggcgcaagatttctgcgttcttctcagattcttttgaaatctgcgtatttttcagatcttcagctttggattcaacgccatctgaatactcatcgaacttactggtgagttcatcatagtgctgttttgctgcttcaatctggtcattgtagtccttttcccgttcagtcttctcgtcttggagcttcttcttctgatcctccaatccacgcttagcaagcgtccgattatgttcccgctgcatatcttcaatatctttttcagtctgtttccgttcagctataccttcgggacccacagcagactgtagcagggcaaggcgcgcttgtttctccgccattgcacgttcataatcctcgtcttcgttagctgtctgcatcttggcgagcaagtcgtctatggccttaattttagcgtcctgagcctcgataaaagcatctcgttccgcctcaatcctctttacttcatcatcccgagtcttttcaagtgcttccttttccttcttggcagcttcagaagcagccttcttctgatcctccaaaagttgcttcttcaaatcatggacctgtacatcaatttccatccgttgttctgatccttctttgtaaagagcctgcatttttgtccatgcattaagctgatcagaaacagatatggcttccatactcttctggtaattgattcttttttggaagtctgacaaaaactcatcttccagagctttacgtttctcgtaaatcttctgctgcaactcaaaactctgttcggcggtacgatcctttgccttactcatacgcatataagcgtcatattccattttgaggatagcaatctggctttggcctgccatttccattttggaagtctctttatcaatccatttctccgagttttggtatcgaagctcgttatacttcacagtcagatcataaatttgcttttggatttcacgcctatttgctggtagcaagtaagatttagattgttccttcttgtaaaaatccaggctggttttaaccatctcaatttcctgtttattggcctgtcgcatgcgttcgcttcttcgctctaggttctcaacatcttcctgatacctggaatcgttcagtttctgaacatctcggctccattgcttcattgcatccttatcttccaataggtactgcttatgtcgctgagccaatcgtttgtaccctgctacctgttggtctatagaccattcatttcgttcagcgatatatttgaaattatccatatcatcgctgtaagaatccttacgagcctcagcagcttccttggctgctttttcagccgatttttccgcatcactctttcctttccccccttttttttctttgcttgatgaatcactaaccccgaatttaggatctttatagagcttcgataaagcgttaatccgagtgtcaaaggattttgcttgattttcatattcagtgtatatttcatccagcttttttttgttatccagttttttcttatcaacatcaagttgattcttgaaaggagcgtttaaaactgatctaatgcccgtcatgctattaagttcagtttgtcttttcgcaacctccaacgaactctgggccattacaccattgagagcagcttttaattgagctaaatttctaatagcttctgcttcaatgctataagcttttaatcgttcatcggtggatacttttgtgttaaacgctgaagccttctcagatttcaaatcgtcgattgctttctgaatttttgcttttcggagaacttccacagcatctttttcaaacttccatccatcgctcgtcttatatatctctgctgcaagttgaggatattttaatattaggtccgtggcagcagcggcgttgagagactgtccttttgaaaggtcgctcaagagattattcatctcagatacagcagtgccattgccttgaatttgctctcttaaatctgctaaagcttccgcctgagctttggcactttcagctgctgtacccgacttccctgcaaattgatcaaccgcatcaactgcaacttggcctagctgcactgcgacttcagcggcagaggcggcaagtttatggttctccttctctaaaccatttacttcgtcctggagcagctgaacggagttagaagcttcgtccaaactctttccagtaaaaacgtttttaaagaactctcccatttgtgaagctaggttgtctttaaccttaaggagtttctcttttgattgttccaattcttcggtgttctttttcaactgattgttaatctcattttgttgatcggtaagcatgttctttcgtgcttcattttgctttgcaatcagtgtgttcaaagcgtcaacctgtatttgtacggccttttcactaaagttggcggattcaagctgtttagccccgtccttacctactgttataattaatgcttttgtgacctcttccaattgtttctttatttgagtttgcctctcgatggatgtaccgctaattttaagcgagtcagaaagcgatttatgagcattaacgagtttgggaagcaagtcaatttgtcgctgatactgacttatcatttgttgagctgccgaatcttcatctttcaagttttgtgctctttcacgcgctgctttttcttcttttccactttcccaaatgacaagagcaattgccccagccagcaaagtcaaacctgctgtagcagcagccatcgttacagtggataacgcttgcgccctagtcatagctgtagttgcaattgttgcctctgttgttgcagcagtggatgcctgagttgctgcgctacgttggacggtagacaatgttgctccttgagaagaaacgatattcacttcattggctgtagtgttggcagcaacagccactgtttctgtaaccttagctgttgtaagtacttttacagcagctattacattcaaaattggcccgctgagggctttataagctagaagtaaacctccaatagctgccgtaccctcaaacacaccagacggtactttggtaaggccaataagcagttggtcaatcgcgtccaagacgttcttgatcattcttcttagcccgtcgtcgcctgcattgttaaatatctcaagcaaagatgccttggtttgtgctgctttacgctgaatagtatccatttgaactttcaggtattccattgtcgatccggttgagcctatagaggccgctgtaccaagcaaaatatccccagcattaagggaagctgccagtttggcatactggtacaggccgcgagagatatctgcatatgactttgtaaggtcatagtttttgtcgattactttagtagaaagatccaacaagatatcttctgcttttctccattgctctgatccattaacaacttccttggttgcaacgcccaagcgttcaatttctcccacagccttgtcggttcgaatggtacccaggactgtcttccacatgttccccaagttttccccgctaagagccgtgttacgaacacctgctgagatcaagccgttcataaagtcgaagcttacgcctgtttctgctgcaatcttacctgtacgctcgaaggctgctcccaaatctttagccggagccatcgtatcatgggcaaccttggaccaagaatccagaacacgcccacccagcaccatagcgtcattactgtccttgatttgcactccatactgagcaaatgtagactccattgattttgtcgcatcttctaaggacacaaggtcaacagtggaaagcattgtagacttacgcaccatttcctgtactacgcctgcatccttatacatccggccccagagacgtgctgattcggtaacatccatgatttccgagccaagatcatgagccgttcgaataaatttggttgtttggtcatgaagcttttcggtattcataaccatttctttagtgccttcgttatattctaaaaagtaatgttcatttgtttggatataacccgccatgttggattctatcccaaccaatccttcttttagtgcttcctgcactttgtgcatggctgcatacattgtgttgaatacaagcgcatgcgtagccatatctcctactcgactcatccaattaggagttgtactgaaggtttgcttcatctgggcttcggtctggctcagtgaacgacggatcttctgttcttcctgaagcaccttctctcgtacttgctcctctttttgctctctggcacgtaatgcgttcagccaaaatttttcataatcttgagcgttcttccttgcctgctgcgcttccttgtcagccatttgctgcaacttcatacggatagcctgttcttgcatgaggacacgttcacgcgtcttatcatccgttcctgctcctgaaattttagcggctttctgtccggttgatgtcgccttgttttgaagggcttccatccgctttagatgttctcgttcctgctgttcaattgcatcctcacgcttttttacaatggcctgctgtgctctaaacttctcatcggttatcttattggcctgttccaattgattcttccgagcagtatttaattctgcctgtgcagtacgctgcttaacaagagcttcggattcagcaaggatcttctttcttctttcctccgctgatagagcaaacttatccgcgctactggcgagagacttatagttcttttcgcttgtacctaattcagcattcagtattttaaacgattctgcattggctcttgctccattgtcgataaccttgaatgccggaagtatcttgctggtatcaagatttattcgtgcgcctactacatctttacttaaatctgccattttgctcacctctcatagggttcaggaaacttttcctgccctgaatacagaaaaagaggcatcctgcatgattgcggatgcctcttaatttacttggcgaagaaaccaagatcagataacgttttgaccttcttcggctttttgttttccacattgccaccgtgaagaatgatttcaaattcccggtttctgttcttggctttcatgagcgctctaatctttggaatggtcatattaggccactctgaatcagaaataccattactcacgcataaagcccaaagctctatccagtccgtttcccgatcatcctcagtaacctcttggtcgtcttcgtcgtcaggctcataatcttcatcaggtggaaacgactccttatagaaatcgttctaagaggccgtccaactccttaatgccctcttcgtctacattctcgtattcttcctccgtcagtccttctaccaacacaagattaaaggcttccttatgcaatgcctcaactttaggccaatcgacctcggctcgatcttctgtggcatcccatttttcacgtccaattgaaaaagagaacttatactcatttccactcataagttgccgcacctgacggatcagagcaatagttccgattttaacgtgttttacaattccctcaccaagagggatttccgtcccgatattaagtgttttatctaactgtttgtctgtactcattaaatttcctcctcaatgtatgtaaccccctacctttagtggtagagggttgggttagtaattaattagataccgaaaatgatttctactgcatatccattaggattctcaggtgtgatatccggctccataatctccagcgccaatgtattggtggttggctttttgcgctcttgggacacgtccaaagtcccgccgccgagagccttccaaatagtgagctggcaagggacttctttgccgttccgatcatcggttaatgaaaagcgatgtaccagtttaaatggtttcggacggcgtttaccgcttaagctacttcttgtagcattctcttttgaccatttgaacgtaacggtgattaatttcccttcgtttacaacatcagatgtgattttcccatcagcagtaattacatactgttctgctgttggggcagatgcaacacgagtcaactcagcaagttcacctgtgtcagtatcttttaaataaacccggtcactcttatctacaaaggttccgttatacttcgttggagcctttaacttgtagccatcagttgtatttaaaaacccttgttctacttcatcgaattgaactgttcctttttcagattcagccccctgagacagttcagccaaaatatcagagtagcgaggaacctccatagaggctttatcccctaaatccttagcagtgtagtggaatgcgtagccactatcgccgcccattactttgtcccaatcaaactgcaattgcaaagttaccttagtgattttatcatcaagaaatttgagccttccgccttcttcatatacctgcgctgaccctacgccatcaaatactaaaggttgcatatagtttcatcctccttatgtgtaacacaaaaaaactggtcagcttatttgaccagttcccataaacgcttatcaatttctgcaattcgactgtactctttggctagcttgtaaccctgttttggattccagacacccataatacccaatcctttagcaagcgtgattttttcagcaatcagcgtatcccactcggtaggttctggtttaggaggattaggttgagtccaattcaattcggattcataagttgtaccagcaatagtaactacattgaatttgtacttcttggttgcatttgcttcactaaaccatagagtttcctgatcatccggttcaattttaacaccatctttttcaatactggatacgttggttctagccaaagaaactcgcttttgtgttgaatccagcagctcatactcaacgtggttaacaccgttatgatcaccggatctcccggttactttccatactgctgcttctgccatttaatttcacctcaattcattcttaagtaatctacatcgaaaattgctttatatcctttcgcaccttgtattcctgtagcaaagtctacgtcataggtcagaacacacagatatgaagcaaagccctgagcagtcagtcgtctgtcatgcagaatcttgaatgaacgttcaaacaacagcttcgcttcataggctgttttaccgtagaaatcaatacagaacttaccctcgaacaccagtggattagtggcgtatcgtcccggcatgacatattggcagatatgtggaactgtgtccttagaaaccgttatctcaggctccatgcctttcgtaaatcgctttactacctcagcagagggtgatgaaggagtaagcttcagcatgctcataagttccgaatctgcttttaaagcattctgaacagcatcaataagttgtaggctcactccttcacctccttgaagtatctgtgatacggaaactcagttattacacggctaatgccttccaaaatacgtttccggttggactggattgcaacacgcaaaaagtaggttggaggtgtagccctaaatgaaggatcaatatcaccgcgctccgcaagctcctccaagtctactccagcatacccaccacctgattccctcatcgttccgtctatcgctcggtacttaccacgagagcgacctacgataattcgatcacccttggctcttagtcggttccacgcttcactgttcatgtaagtaatcaggcccgggttctggctgctgtccgccatcttggaacctttaccaaactgctccagccacgcctgccagaagtcggctgtaatgtcgccggatatcatttggtttgcgagaacaaacatatgcatctccagatgatccttgactgccggatagtaccgtatgccgcttttggctgtcagcatgaccagttttgttagcccagtgatttctatagccaacttattctccaaatccttggttgcccgcgctgcatcatagcccgtaatcatatccgatccacagaaagttgcacatgcaatagattaggatatttagtcctatcgactacatctactcgatatgttttttcgctcatcacaatccggtcaggaatagctgtactcgtctcctcaggccgctttatatcaacattcgtctgtaactgcaaaacaaagacggtacttggcagtaagcctggctcctgttgccgcaattgtgctgtgacatactgtgcaaagcaaacaacatcagcagcgaccgatgtaaattcagcatcgcccaccggattatcgtttgcatcgtaagcttgctggtatctttgcacctctaccacagcattcgttttaaccaaagaacagtagttgtcctgatccactgtttttcttaaggtaagaaccagaaatgtgtcctctgtctgcaccaaagaaccacgattaatgagtgattcaggcgagaatacaccgttatagacgtattctttgcccattacagtcgtcgctttggtttcccttgatagaatcactacatcttcatttccgtccaccacacacggcgtatggcggtgtgagaactcatagaacaacttgcatcacctacctaaatgacctatgttcaaactcagacagaagatcggctatttccggcgtaatcatgctggtgccaaagtattcaatgctgtaatcgaagtcctttttggatttcacatttgaatttggattagcagcaagttgtccgatgattaggccacatgccaccttgactttatcaggtatcgtctcccagccgctggtatacgtcacttctaactctgcatacgctgaaccgaaaggagaataaacgcaccagacggtaccgatatccttgtcaatatcaatggtgctgatatcagtaattgtttcgaatcctggcggaccaaagaaattgcccatcaatccctgcttcgacctgccttttacctctttcacctctacaacaggataataggacaaatgacctcgctgctgatccgtaagcggtatccgttcggtgtaggctttgattccaatctcgcgcctgcaccgtccatcaattactgcggatgctcggattatcagcggcatggtcagcttaattcctacaggaacaaaatcagtatcagttaattcgagatactgactcattctacatagccagcatcagcaagctcgtctgccaattcatccggtaactgtgcttctccatccacgaagttaacgaccccatttttaaaatgaatcgtgtgaggacccttgcgctggctcggtgtaccgcgaagcgtaacttttcggactgccggaatcctagcagccagaaaagaactgcgcgcatcattcagcaccgttgtttgagcatcgaactggcttggttctgttccttcatcgccaaccaatgtctctgccgctgtaacagcctccttgaatgcatctgccgattgttgaggatattgtcctccattttcaccaatctcagcctgcgctaacaatgctgcgctttcagcaatcgcatctttcaacttgtccagattcgatttcgccaactgaaccatctcctctcaaaataaaatagagacggtcatgccaaccgtctcttcgactttaaaacctattatgataccgccgtaatagttgggcgttcaatcgtgccgtatgcatgtgcgtaacctggacctttggctactggagcgccatacttgatgccaacgtactgttcttgcagacttgacgttgtacccaactggaagaggtagatgcccttttctccaacgtagtgatactcaatcatcggctctgtcacaatggcaattccgtagtcagtgtttgttgccgtttttgcattaactgctgaagggataaacggctcgggaatgatcggcagcagacctgcggctgtcataatagctaacacttctaagccagcaaccgttgttttcttgaggttgctgatttgcgtttcattgttggcagcattgcgttcttcttcttcgagatagtgatgagcaattggatgaatgtaaatagctgttggcataagctcgtacaattcactcgctaccatcgcagctaccttcgcccggatagcagacacgattgatgcagttgccccaactgtgaaagtgttcgtaatctgacttgcaagtcctacatattgtagagttgttggtacagccaagccagtgtcactgcctctccaaagcgctttaccatgcgtaagtccaatagcattcagcatgtcattcaaatccttggcttttaattcaggaaagttgttttgttgctggcccaacgttacgtcataatgtccaaagttgacttggttcgtcagtgctttgatcttcacaccatgtggtgtacgttgattgctagatgatgtcgctgaggggttacgcggatcaatgaactcaccaccatttacagtgttttgttcgtagtacgtagaaatgtcacctgtagctggtacataattcaaacgcccgtccaggatagatgtacgacgcaatacgtccgtaatctctttttgaaaatcgtcagtaataattgcgcctggcccctgaaactgagctgccgcagcaaccgaaacaaattgagctattccaacacggttattcatgtattacacactctccttttcggcaaattgtgcttttgcctgcattttaagtttgaaagattcagaggacggaagatccagagcatcgacggaagcgcagaaggttttgtaatcattcacttctgctccagctgcaagattggtattactgccatacttggacaataatgcagacgcgctgaatgttttgcgttccggctctactggaggcgcacccgctgcttttaactctttcaattctttttctaaagcatctgctttatcttgagcagctttcagatcagcagcggcttgttcttcagcagtcttttgttcggcttcttcgcttgcagccttaatagtggtgatatctgttttaattgcccccacctctgtgaccacgctttgcacactcgcagtgatagcggtcataccgtcttgcaatgccttcatggagtcttccatcgctttaatttgttccggtgtcatatcgacatcctccttgtcctttttcatgttacgagcagcaaagctcgttgttttataggcagcggcatcagcaaacaggatggctgctcccgtaccgcaaaactcaattacatccaatacattttctatatccgttgcatcctgcacagcagcttccatttcgagtgatgcgccaaattgatattcgctccagttatactcagccgccagaccgttgtagtaacgaatagtcgcaaccacatcaggaaaatcctttgcgtaaatgtatccgtcaatccatgcatacccatcgagtgaacggtaagccttatcaatcacagcaactttaaatctcggatcatggtccgccataccgttggcgtagtcaatattcaaggccatgccaacgaaagtttgaagatacttgtcgcaaacacttgatgaaatacgaatacgtttcccaccagcaccatgaggtgagccatcacttggttggtcaactgcgaaaagagcacatttgaaaggaaccttgtttggatggcctccttcttcggataacttgaagtcctgaacgcgcatccgctggttgctcattttcaacgttttaagcatttagattctcacctccctccgtgacatttctgttgtctgcgctctgctcggtttctcggtgttggcaatgacctgggatatgtcagtctcacaacactgcaaacaaaccttgtaaacacgccctcaccgcctctcagggcaaaataaaaacacctactcttcagcggtgtcagattcatccttttctgttttgactttattgtttggcggatcatcttcaggaagattgcttaacagcttgtctttctccccttgtatttcttcctgggttttattcaaatcaatagctgcggtattacctggttgtaataatacttcgccatgtttattaggcaatgctttacgcgccagaccatcacgtacttcatctggtgtcacagttcttcggtcaaggtaaattgcatcaatatcggcttttaacttctggtccttcaatgaagtagcataatggaacttaaactcaattaccccacccatcttgaagatcccgtcaataatgtgattgttgatatgctccacaatgttttcagcaatagactggatagtttcattcgtatcatcatcttcactgtctgcggtgcttcgattcacatcttttgtctgccccagtttcttaggagatatgtcaaaagcaatagcaactatctcaattaagaaccgttgccactcaagaaataacgccttatcatccgtagcccccaaatccagtacacttggattctcgccacctatgatagggttaagaccacggcctattacttcattttcccaatacgcacggaaagcagctacagccttactatcagtatttttaccaagattaatcagcttcctgatcacagtattcgatgcttgtttcccggcagatcggtgcgccgatataaagctttcaactgattcccaaaccgtttcgagcggtgaaagtccgaatggtgtattggttcttggatttattcgaatatacattaggtcagaagattttaaatgaacatattgcccgtggactcgttgtgcatagcgataagaattctcttttccatcccaatcgggatacaagtcaacagagaaagaatctacagggtacatcctaaatggcctgagagggtcaccagcttttaatatttccgatgaacccgcactgcatacaagcatatcttcaactatctgctcaatccacgaacggaacgaatctcctggattaggctttaataatgatctttcgataatcttacatatctcccggtacttctcagtatcattctcgtcaatagcagctacggaccagttcagttttgtgattccgttcttaataacgttaattgctctgcgcggtatcggggattccgataatgttcgtaagttggtcggtgttctcttcggcgctggctggttacttcccttactcatcatgataccaaacgggaatggatagctttccgtctgtcgttcaggttcgttcttcggtcttcccgccgctagccagttaattagccactgccttacacccaaatctgtacctcccttctgacgtaacaaaaaaggaggtcaggaaatttttcctgcctccagtattcgttcatatttctatgtctaaataatatcattgagttattacggtgttactacggattaaacaacactacttttagctaatgcgatttctcaatttggaccgcgactatcaccaatgaaggtttccaattaatgaaacgtacgcatcactaatacttttaaatctttcataagaaccgttaaataggcctgcttttaaaggcagccattcatctttaaggcgatccgcctcaattattaattcatttatagcgctgtcatcgtaggctgagtacttccaagcaaatcttccaggaggtccccatacccgatcgcctccttcgtaatcgatatctgcatagactaatgcatagaaaacttcaaatttatcaaatgtttcttcataactttttcccataaaaaacaagtcatcaattactggctgtatttccttgaacaaatattcgcttttaggcacatattttcggtcataatcaggaattgctttaaataaattttcgagttctcggttcggcgggaatgccttaataatttcttgagttttactacgccgttcgtttttaacttttgttgtgagtacagtagcaagcatttcataattctcggtcgcaattgcactaattccagcagtatacaccattaatattaagggataccatctcaaattaagccaagccacttttccagatcctatttcgttgaattcggccaaacgtgtgataattttttttacaattacttctttctttccttctccccaataagcaatagacgctattactgattgaagattcccactgacatcctcatatttttttaatctttcaaggagttcatcctgactgaagttgctttgagtaggaaaattctcgctgagaaaggatagcatttgtcttagctgttgattgactatgtcatctaatttaatgtggtatctgtcttcagagagatattctttaactttatctatgatctcttccttttcggatgtagtcctctctacggtagaatgaattataatcatttgatcaatatctttttgctcatctcttaaagaagagagtacaggggctttaaatataaagtcaccatctccatcaaaatatccataatgcggggtttggtttgaatagatatcgttggaaactttctgataaacatatgacattagtccattcgcagttattgtgccatcactttgagcagcctctccttttagcccttgtaggaagtgtcctgtaaatattgagtggttcgggagcggacctcctgcatcagatacaacttcatctgccttaccagcagttaagacttgtcttgtatatcttttaagcatgtctttcaaaaaacgagcgcttcccggctggagggatctggttattgcaaggcctccataacaagcatccattacaaatagaacatgttttgcattgaataattctgaattgcgggtaagttcgtcccaccttataaaggtggaaatatcatcaagcgttccatccacaggtattaagaaacctatttctcctctattacctgaaatagtatgaccgtgaccagcgtaaaaaacaaaaattttatcatccggatctgtgaattcgtttgagaatttcataaaattcttcataatattagcttttgtagcatcttgatcaagcaagactgttacattttctggcgggaagtcaaattcttctactaaggttgaagctacctctcgcgcatcattgcaagcgtaaagcaacggactcacgtgttgataatcatttattccaatcactagagcaaagttattcttatattctgaactaaaaattgtggacatgacattccctctctctatatataatccagtaataatttctgcgaaaaggtgttgatgtcctttttaagaggtgtgatatttacgcattaaccaaacgcaaatcctgaattttcattgcgatcattatatatagcataccgctttgaatcctgtgtatgattattcttgtcttccgcttcttctgaatgctgcccatcacgattttctttccatttgtaattttcggtttctttaatttcatttttacattctctgttcacataaagattagggcgaccagttccatccttaaccttgtagagagtagatacctcgcggattcctggtccaattgcattatccgcttcctttatcggtaggtcatactttctatacgtactgatatattccggttcagatggatcggcccatatttcatcaaaatgatatctgctatgcatttccaagtaacgctttacaaggcagtcctccatttgtccgctgtcatttaccaccagaacattgacatgttgcacataggattcctccacgatgtaataatcttctccggcgcatcctatcgccagcagaacagccggatcattccacccgtgatccatacctcctataaaacgattaaatgttatatctcttacaatgccatctggataagtaacctcgtacaattgaatactctggtctaagcagcgcatatccacaacatgagttgccctcttgaattcgtcatacacttgtccgtgaaagacgttaaatttggctctgatctcccgatctacatagcgctcggggtaagtttcaatcatgcgctgaatattcctctgaagctctggaattgggttatcaagtgaagtccagtaaaaattcctccactctggatctttcatgtattgctcttcctccagcccagcatcaacatattgccctctaagtacaatgtcctcagcaaaccagttaattccctctggcgtggttgtccacacactccagccgcccttatctgccaaagcataagaaaggtagcctgtccacgtttcggccttcattttacttgcttcatccagccacacaccgtccaatcctttaccaaccaaagatttcggattatcagccgacttaaattgaataaggacccaaccctttaaccatacacggtttttggataggtcccagctctcaatcatttcttccggcagcacatccgatagttcttcctgttggatttcagacatagcgtaagtaggtgaaacacaccagtattctaatcgtggcttcggtttcttcatctttctgatattcttaggaggcttgtaaggtaaacccttgccacgttccatatccgccaggatattatcaaaaaatttacgagcgcctacatttgttttaccgccacgacgaccacaatttagaacattattacggatctcgctctccataacctcaatctgctttgcgtgcggtgtccaaccctcaaaaggatcaacttccagcgtcagggacatgggaccacctcttcacgttaatttctgttggtctatccttctctccgtttttcaattcctcaatctccatcctcgtcttctcgacttgggcctgcatctgatccaatttcaaacgtcgttcatcgctctcaggtgcaattgaaaggaattgctttatagcccctcttatctcgcgcattacagtcgcttcggccttgataaaactagcgtacttatcccaagcaaactggatttcccactctagttcgtctccaaactcacccggcttctcctttttcaactctttcgtcatatcttctttgtctttgataaagaaaatgcgctgcgcccatattattttttggaatcctttagttatgttgtgccagatcatatctacagggtccatctgttgcgctatttctagtatttccagatattcagcatcctgcggctcgaatttacggaatagcccatgtgtaactgccttgtcatttccgggaggtccaccagcaccacccttgttccccttagcgtttctatttccagtttgaccgccgcgcttacgcttttcaggaacctcatcccatttatcaagtgacttccattttctaatactggaatcacttactcccaacttgagcgcgatatctttcaacttgattgagcgcccactgtcaagccatattttaagcgctttcttcctatttgtacttctctctttgctcatataaatttcaccgccgaaaaaatattcgagttggtttgaacgctggctgatgatttgccctttaccgctccactaacttctattcacttgctctcagataatcatagaaactagacacttatccaaccagttaatgtaaaactaattcactataatatatattctcggtaactcgtaaaacactgagattgcttgatgctatttgttttgttgttctttccccgttttgaattcacggttacccgattgtagagaattgctacaactcaaaatcctttaaaacatcgtctaaagtgtcctgaaggataccaacatagcgtaaagtcaccttctgttcagtgtgattgaacagatccattagtaacgctatgtccttggtttcgttgtaaaaatagtacccgaacgtctttctcatggagtgggttcctatttccttcaatccgaactttcgggctactccattcaacattttataggccatgctgctgctgatcggcacgacttccgatctcctctttttgttcctactcggaaataaataatcgctatccaatttcccggatatatatgcatcaagttctttgcgaaggttttttcgaatggggatgttctttcttttcttcgttttcttttcagtaattgcaatatgacttcctttgactgagctgactttcaagggcaaaatgtccgatatccgcaatcctgtgttgattccaaccaaaaacaaaatgtagtcccgttcatttttctctttcaaatattgcttaatggcctccagctttttagaatcgcggatcggctgaacgaagttcactgcatttcgctcctttcatgtttgtttgaacagaggatggaaacatacataattgtttagtaccagtccaattgccccaaacacatccattgcataaagcaggttgacgtggtgacctagccagaacaggcgggggtctccgtgaagatttaattggcatatcactttcctccaatgcaaaaaggccgcttttcagcgacctcgaatttacgttattttatggatacaatatatcattcttttgattcgttattactgcggttttatgtatgttattgcatgtaaatttagctaaggaaaagtttcctgaacaattaaaaaagcaccccgaaggatgctagcttataagtgctacaatttcataaatatctttagaataggatcgccacagtggatcataaatatctttttcactatctaaatagatgaatgttccattatcaaaagtaatagttacgttgataagggtcccacccataatagaagaatttatctgcatgctctttatttggtcgtacctatatactgcggtattcatcatgtttccatcaggttcaaaattccatacttttttatcagtaaaaacaaaaactgataagactttaagagtctctgcctcaaaaactggatatatcactttgatattttcctgctcaataaatttaggaatagtattaaaaacataatataagaagtgttcccctcttgctagaaaatcagtcgatagatcttgcaaagtttctaaattcattcgaatccccctatctagatagatactaagattatacgatatcagggagcatatttcctctttggcataattgctaagctttgagttactacatcccatttagtttgtatatttctttcctctaatacaaaaaggccgccctctgacaacctgatgaaaacagtaagcatctattattttgtcaagtgatatcataattacttacattgaggtggaataggttttaaccattccccattctcattaatgaatgcatctttgtaacggcctgattctaactgtcttattatatcctcttctttagctaccaagatattagcaagttgactgacagtatagtactcactgcttttgtagtctaactgtataggaaccgccatttcgtacagcacatccagaaattcattaaacgtcaacttgcccatgttacttatccctgaataataagacggtttatagttagcaaattctcgaaatgattttccttgaaactcttttgccaaggcgttactaagacgtacgctcatgagattatcaaaccgtgtcttgaagttcatttcttccattttagcgtattttgctttgaatgcgattatttttataagaggcaagtctttgcgattaccctctttcaaacgcattctaaattgttcacgatccattatcatcggctgtaccatcctctaagatgtgtttaaccgacattttacatcacgtttcttataatcgtaaacagctattaagacacacaacggaatcgaaccgctataatcctgtatgtgtcataaaattgtatacgctctctgctacgctaagtatttcagtcgattcgatggccctcagcaaaagaaaaagcaccggtcagggtgctaataagcgtggttaatttggagactctcttttctgatttctttatcaaattcagtaatcactccacaagttggacattcgacttgcacagataatttagcttgtgtctttctcactgacactttctctgttcctttaacacgagcctttgcagcaacgcgatttagatcagctttgaaccctttcccaagttgaagttcccataaaaccttacgatcacaaactgagcatatcagttcacctagaattgctatttgatttgtacttgacatataatccctcctttattctctttacaattcgacagcaaggaaggatattcctttttctgcgccgaaagtattagttcgaaaggaggtatgtattttgttgcaatggattgagaacaatgtgaaaactgcgatcatagccgctatcgcccttgctttcgtcgtttctgcaggaaactatgttctgcaaaatggccctacattcacgaacaaactaggaccatcttttgaaaagatggattccaaatagccgccctgcggactcgaaccgcacattttcctttaggcgctgtaaattccccggatcatctccggggataaacactattgcagctctttgactaccttggcaatatgagcaggaatcgtaagaccttcactctcagtcagcgtaccatccgcatgcagcttgatagccaactggtcgtattcacccgtgcctgtagggacaacagggttgccatatgcgtgtggaccagcaaagtttactactctaccagtggggctatatttaagagcctcagtcgctgtgttaaccaccttaaagatattatccgaaccaagatacccatagccgccattacgtactgcgcttgcttctgtactcattacaaaacacttccttttctattatttttgcgcacaaaaaagagcagcgtatgtacgccactctcattaggttttttaattaggtgcacgttgtgggaattgaacccacgcctttaggtctgttttactcgggcccgcctgtgctctaccactgagctaaccgtgcatgaaaggacggtaattatttcacggcgtttaccgtcaatcgctatagtccgcattacgtgcggaacaatctgccgcccttattgatggggtattatgaccctctttacggctgtctcgagttagttgtagttagtttcgatgtgggcgaggcctgtttcacggccttgcgtctattccgccaccacatttaaatcttaatgattacagaagttgatcagctagtgctttaaggccacttggtacagcaatttgtttgccattatcttcatttccgtttacataagctgtgtctttgtctgcataatagattacaccttcgccgccgataaccggaaagccgctttcgtcgtaatccagatttgtacctacatacttgccatgcttaactgcttcatcttccaatggatggagatggagaattttttccttgtccaagtaagcgtaactatgtgccatgtttattgcctcctagaatagatttaatttgttcctgaataaagtgtaaatcctttctactacgcgcctactacggatttgtcttaccccacataacaaataaagaccgcaaaggcttaagcccttacggtctaatttacttctggcatcctaagtccaatttcaccttccttgtttcgtccccgtccatagtcgatggtgacaaaatccaatgtacggtttgtttttaggctatttgctatattaacaatagccctgcgccgtttatctgcaaatgtagttgctgagataggtggaatgtccttgcgataacctttttccagatattgttgagctttgaggtatttcattccatccaaaaacaacagcgttgctatcaaaccctcgtgcttatcacgcatattatttattgcgaacttaatgttattcgtaatgaattgatagaatttataatttagatgacgctggtctttcaatagaacggcattagctgtcacatctgctgtcaattcttgtcccgaaactcgtttagcaaccgatccctctgccgaaagcaaatcatatgcagtcataccgttttccaactgttgaagtgagtattcatagtttttgattacatcaattaagtcagtatatttgtttagcagccactttgtttttcttatatctactgcatctacatcgtcaaagaagtttacttgaattatcttctgagtatcagtagcatcctcttctttgttacgtataattacagactgttcgtttaccataaatgttcactccttgtatagctgagtgtatcaggcgtaatatgtccaataagcatgaatctatctacttgcactacacctataaacaacagtacagcagctaatatagaggtataagcgtaggtcattagcgtttcccccaataggtagatgcgatacaaaggaatatccacatccagaatgccatccaagggtgagccatcatccaatcagctatggtcattcctttttaccttctaccttcagcagattttcttcaaaacaagatgcgtatacatcagggaattgaacattaattaaacattctgaaaaccccattactgtccccacaccatgatctatccatttgtgttgtactctatcccctacctgtatatctggctgctgtggtgggtctggattaaataatcctgatgatattgcatcagttaaactattgaatgagttcacgcacgatgatccttccaaaaaaccgtcagagtctggagaatgcacaaaccacttgattagcttatctgcatctattaagcgtggtttatctttcattgttgttcctcccaaagcttttgagctgctttagcgccacattctggactgcaatattgccctttgataatagttggcttgggacacattgggcatttatgtggagacatattctcaacgtaccatgttcttttttcggctttatccattttcattaatccctcccatacgtaatccagacaacatgcctagtaagtaagccatagtcactcgttcattcccactagcgcactcaatctcctggtattctccataacccatatcagcgtacagattgtagatggtctctggtttatggaagatacctctctttatcgtttcacattcgattatcaacttattttcacgttgttcattgacttcatttaggtatccattcaattcgctttttggatctatattcgtctcaaaatgtccataagtgaaaactgccatctatatatcctccctta

SEQ ID NO: 36 - DNA, 59257 bp, Unknown
  Kingdom: Bacteria, Phylum: Firmicutes, Class: Bacilli, Order: Bacillales, Family: Paenibacillaceae, Genus: Paenibacillus
aaacaaaaaggtagtataaatggcaagacgcccggtgtccgaacaatacagcggtcttaccttctcatgaataaaggagaagtctatatatgtatccactttacgaagcagatgatcttgcggtaccagttcttccagagaaaccaattcaaaagattgttgtttgtctcgatgaggtcgcagcatatcaacaccgtccgttctacaatagttacctatattatacaacattaacgcggtgtcgtcttaaataaaatgaacataaaaaaagctgtcgagactttctcgacagcctgaggctggtttaataaaccagccttttttctttattcagattccgtgtgcaagatcgtaatctgagcagcaatatcattgtaaatggtccccgtggcagactcagatttatatacagatggagaaaagtcggcctctgacggatggttatctggaatacccagcggaatttgagcaagaagttttgtatgaagagtgtctgccagcatagcaccccctcctcgcccaaaaacatagtccttttctccagtggaggacacataataagacatgttctccacaacgccgatgatcttatgatccgtttgaagcgccattgcgcctgcacgtgcagctacaaaagccgccgtcgcatgtggagtagtgacaatgatttcttcactctgcggaatcatttgatgtacgtcaagcgctacatcgccagtgcctggtggtaaatcgagaatcatatagtccagttttccccattcgacatcactaaaaaactgtctgagcattctccccagcatgggacctctccagatcaccgggttgttttctctaacaaagaagcccatagacatgattttgataccaaatcgctccactggctgaatgataccatcttcgacagaaggcacatcctctactccaatcatatccggcacactgaatccatagatatccgcatcaattaaacccacacgcttcccctgtctagctaaagcagccgccaaatttacagctactgtcgattttccgacaccaccctttccgcttgcaatggcaataaatcgtacgccagatgctgggctaagcagctcatgttcttccatgccaacagcatgtcctttggtcaaaaccgggtcagccgcttcctcggcctcctctccattttgaagggcagacttttcatgctcagatgcctcacgaatacgaatatgaacgtgacttaatcccgcctcttctaatgtttgccgtatttctcgttccaactctgtcagcgtctcttcctggctattcagggtaatggcggtcaaggatacccgatcctctttaaccaccacatcccgaataaaatggagatcgactagacggcgtcctgtatgaggctcccgcacttgttgaagtagctctataacttgctctcttgattgcatgaattatcagcacctctgctttaatgaattacggagtggtaaacacttacagtataccactatctggcttcaggtgctggtgagatccccttttccccggcactgtaacgcaaaatccccttatatatggacgccgccacctgcctttgatagttcacgtcgctaagtcgtctagcttcctcaggatgggacaaaaatcctacttctacaagggctgatggcattttgagagctttcaataaataaactgtgttcacggtcttagccactctgtccgtattttccaagttgcgtttgatctcttcctgaattaaagacgccaaattcccgttatctgcatggttaggtacgtaaaaggtttgggctccactccaacggctcgacggaatactgttcatatggatacttagaaaaaggtctgctttctgctcctcaattatacgcacacgctgtttcaaatcctccgttttccttctggaataacctttcgtttcttgctgcgccaggtcgcgatcatcctcacgtgtcatgacaacaacagcacctgcttgctgtaaataatcccgcaaataaaaagcgattgccagattaatatccttttcaataatcccttctttgctaaccgcccctccatcaggccctccgtgtccagcatctagggcaattactttaccagtaaggggtaaactccaatgggtccaagctctcgaagcaggtatctcatataatgccagtgtaataaatagaacggcgagacaacagcccaacagcattttttgcaacgtccgatagcgaatccacagtgtaacctcgtttttacgattatttttttgcataacaaaacgcctccgtcctatacagatactaataatctatatgggacgaggcgtgtagatagtacaactcaggcatgaacaaattctttcataccttcaatcagcacttgagcgacttccggtcgtgtaaattcaggtggcgggcaaaccccagagcgcaacaattcccgtaccttggtgcccgagagtgttaaatgatgctccttgggatgtgggcatgttttacttgaggccatatttccacatcgggtgcaataaaaactgtgttcaaagaacaaaggagtaatccccagctcttcaggtgtaaagtgcctgaaaatttcctgtgcttcgtaggtaccataatagtctcctacaccagcatgatcccttccaacaataaaatgggtgcagccatagttctttcgcacaatagcatggaaaatggcctctctaggacccgcgtatcgcatggcagcaggaaatacccccagaaaagtccgatcagccggataataattgtccaacagcaccagatagctcttcatacgcacatctgccggaacgtcatctgacttggtttcaccaacgagtgggtttagaaacaaagcatccacaatctccatcgcgcttttttggatgtactcatgtgcccggtgtaccggatttcgtgtttgaaatccgactactgttttccagcctttttctgcaaaatagtcgcgtgtctgtgatggtgtatagtaaaactcactaaattgtgtgggctccggccgattcagcacttgcacagatccaccaacatacgtagcaggtcgatctaacagtttttttacgccaggatgagccgggtcatccgtcttgaatactcgtctggcttcctcagcctgatccacctgataaatactttcaatatcaagtacagcataaatagtaccgtctgtttcacccaccaaagccacctgctgacctaatttcaattcactggctacactttctgcaactgcaagagtaatgggaatactccagactgtaccatcggcaagacgcatatctgttaccactgaccgataatcagattcattcataaaccccgtcaaaggagagaatgcccccactccaatcaaatccagatcagaaatggtccatgagtttacacggattgggaacaattcctctgcagcctgcaaaagtgctttttgcttcggtcctgtaatgattttatcaacaagtgttccgccatgcggaagaattgcagtcataatgcacttcccttctcttcataaatatgattcatagctacctgaataccattttattgatggagcccacactccgttttctcattgcctgaccagcgacctgcacgaggatcttcacctggtaggacctcacgggtacattgctcacaaccaatactgggataattgcggtcatgcaatggattatacagcacttcatgagtacggatataattccatacatcctcggatgtccagcttgccaaggggttaaatttaacgagtccaaacttttcgtcatactctaccttttttgaatgcgcacgggtaggggcctgatcccggcgaataccggtaatccatgcatcgtattgtgacaaaatacgtgtcagcggctcaactttgcgtataccacaacatgtgtttggatctgttttccacagttcctctccatgctcagccgcttgctcttcaggagtaattaagggagagaccctaacaaaatccaagttatatctggctttcatctgatctcgcgtatcataagtttcttgaaaatgaaagtcggtgtccaagtaaaaaatgtcggtggaagggctaattttttgaagcatatctactagtactacatcttctgctccgaagctacaagcaaaggtaagattgggaaatgtaagaacagcatactggataatttcctctggcgtagcctcttccagttcaattgccttgactctaatcaacgcttctttctccaataaattcattatcaatgcgcctccatatgaagattcataaataagtgtcactccaataccgactaaactaataagattaaatacagtataaaactttcacaatcattgtcaatccacggcaaaatgtcctgatgcaagcatttatccacctaaatttgcaggaatgttgctctgtcagcattctttaatgctttcttgcgtatctaatcaagttcattgactttatataaaatattcttataccaaacatttgaaaatggcccataggcccagtgcgcggcagccatcggtaatgctgaacagcttggggttgctttgatcaagcaagaaccatctgtagaagaaagcaagcatcgtttctaaatctaagattatcgaaggatgctaaccgagggaattgagaacaactttaggtttcactctactattctggagctctggcgtcagcgatgacttcattctgaaaattataaaaggaatgactgcgcgctgaactcttattatacctctattcaatcctaaagcgctcgtagcggcaatttccgaggaattgatcactggacacaagcaagactcttatcgctactggaagcctatttaaagcctgtcatcaatgaggggcgatattatgagggtagacagtcggacaatacatggtgctcccggttatagtttggagcgattgctgtgtagacaatttctattaccagtaacatgtacatcggcgttgcaattgcagtagcctaggaagcgaacactgctaggctaaggaccgtccttctgctccgtgcacacaaataaaaagaggtattccttgccgtatccctagctacgcccaaaacagctgtacaagaggcatagacagtgccagccagaacatatcaaggaggactttacataaacaagtgaaagcaaagtatcctcgtgaaacagcacttagcaaagaatattaagataaggctatattgaataaccgaacattatatttttagtcacaggttataaacattacagaataaactgcgttgaaatagcaaactgtatttgtgtataacaatatcatcttcaattccatcgtggataacttttcgtattccgtgcatttgcatgcagttatttatgtattcgctgaaacatgctgaagctcgtaacttttagagtaggtctacttatccacatgtggataatgatcaggaaatgactaaataaaaaagaaccctttccataaggaaaaggttcttctgtattcgaaatattaacgtttcgagaactgtggtgcacgacgagcggctttgaggccgtattttttacgttctttcatacgtgggtcacgagtcaagaagcctgcttttttcaaagctggacggaattccggatctgctttcaacagagcacgggaaataccgtggcgaattgcgccggcttgaccagagataccaccaccatgagcgataacgagtacgtcatagctgccaactgtttctgtcaggttcagtggttgttttacgatcagtttgagagtttccaaaccaaaatattcattaatatcacgcttattgatgacaatgcgtccttcacccggtacgagacgaacacgagctaccgaatgtttacgacgacctgtcccatagtattgtacttgtgccatgaaactgtcctcccttttaattatccgcgaagttcgtaaacttcaggtttttgtgctgcatgtggatgctcagtgcctctgtaagctttaagtctcagcttcattttctcgccttgacgagttttaggaagcataccgtgaacagccaattccaacatacgctcaggcttgttcttaaccatttcttgtgcaaccgttactttcagaccacccggatgcagggagtgacggtagtatttcttgttctccatttttttaccggtcaatacgattttttccgcattgattacaacaacaaaatcacctgtgtccacatgtggtgtaaattgtggcttgtgtttgccgcgaatcaacgcagccgcttcgcttgccagacggccgagcgttttgccttcggcatcaatgatgtgccagttgcgctcaacttcatttggcttcgccatatacgtagtacgcatgaaaagtatcctccttaagttcgttaacagaaatcatcatttatcttcgttcgttaagttgctgcattattgatggattagatgttaatttaaagtgattatcttaattggggctgtgggaaagccattaagaaaacacaacttttatattacaggataaccatcaattccgcaagggtaaaatcaatgttttttgatgttttcgtcgtactctacattccagagcgttaaagcgtgtccaacggccgtaggtccagcctttgaacgatttttcgcctccaaaatggaaggaatatcatccgacgcttttttgccttctcccacttccagcaaagtacccataataatccgaaccatgtgctgtaaaaatccgctacctgtaatataagtatggataattccctgatcatccgagcccggacgtgaaaaggaatggtctactgtcatataggcttcgtaaatagtgcgaacatgattcgtcttttgggaacgtcgagatgcgaacgaagtatagtcaaaggtgcccactaaatgagccaacccttcctccatcgctcttacatccagtctcgttggatgatgggcctgtgtacgacggtgaaagatgtccggaaaccggttcgcattaatgctgtaccgatatgtcttccgcttcgccatgcggcgtgcatgaaaggacagtggcacctctctcgcatccgtaacgatgatatcacgaggcaaccaggcattaagtgccagacaccagcgctgtaacggaatcggcgattcagtgtaaaaattgaatacctgcccgtatgcatgtacacctgcatctgtacggcctgagcctgtaattttaagacgctcgcccgtcaatgagtaaatagcatgttcaaggcagtcctgaatggtgttaccgtcaggctgcgtctgaaagccatcatagtgggttccgtcatagttcaccttcatgcacaagttccgcatgtttctcacacctttataggggtagtctctggccttacaaggaataaccgaacataacaaaggagaagcccctcaaggactcctccaagagaaaaaaagggttgttcagaatcaagccgattctgtccacccttccctcatcttcgcctgtctacgcgcggtcaaccaattccagatataccattggagcggcgtcgccacgacgaggtcccaatttcaagatacgagtgtatccacctggacgctcagtgtaacgtgtagccaattcgctaaacagcttttggattgcatcctgctcaccatccaaagtttcacggcgaacgaacgcagccacttgacgacgtgcgtgcagatctccttttttcgctttggtgatcagtttttcagcaatagaacgaacttctttcgctttagcctcagtagtttggatacgctcatacaagaacagatcggttaccaaatcacgaaacaaagctttacgggcactggagttacggcccaatttttggtatgccatgtattttcccctccttcacaaaaacgttgctgtactattcttccgtacgaagtcctaaaccaagttcctcaagcttctcttgtacttcttccaaagatttgcgacccaagttacggaccttcatcatatcttcttcagatttagtcgtgagttcttgtaccgtattgataccagcgcgcttaaggcagttataggaacggacggagagatccagctcttcgatcgtcatttcaagaactttttctttcttgtcttcttctttttcaaccataatttcagcatcttttgcctcgtccgtgagacccacgaacaacatcacatgctcggtcaaaattttggctccaaggctcactgcttcctcgggacgaatacttccgtcagtccaaacctcaagtgtcagcttgtcgtaattcgtaacctggccgacacgcgtattttctacgccgtagttcacgcgtgcaatcggagtgtagatggagtcgacgggaatgacgccgatcggctggtcatcacgtttgttccgatcctgcttaacgtaaccgcgaccgcgattggcaaaaatacgcatgtgaagtctcgaacccggtccgagcgtagcaatgtgaagatccggattaagaatttccacatcactatccgcacggatatctcctgccgttacaactccttcgccttccgcatcgatttcgagtactttctcttcatccgagtggattttaagcgataaagctttcaagttcagaatgatctccgttacgtcttccttcacaccgggaaccgttgcaaactcgtgcagaaccccatcgatctgaaccgatgtgactgctgcccccggtaacgaggataacagaatacggcgaagcgagttacccaacgtcgtaccgtatccgcgttccagcggttctactacgaattttccataggtgccatcatcattgacgtcaaccgtctcaattttcggcttttcgatttctatcactgcaatatccctccttcaaaacgtcgctcctatatgaaacattcaccttatccatagtctatcatgcagtatacctaaacatccattcttggcagtttgtgccggatctatactacacgcagaggagaaatctcattagacgcgacgacgttttggaggacggcatccgttatgaggtaccggagttacgtctttaatcaggttaacttccaaaccggcagcttgcaaagagcgaattgctgcttcgcgacctgcaccaggtcctttaaccatgacttcgacagttttcatgccgtgttccatagcagctttagcagcagtttctgcggccatttgtgctgcgaatggagtagatttacgggaaccacggaatcccatgccgcctgagctggcccaagagattgcgttaccgtgtggatctgtgatcgtaacgatcgtgttgttgaacgtggaacggatgtgtgccacgccagtctcgatatttttacggtcacggcgttttgtacgtacaacttttttcggtttagccattgaatgttatcctcccttcttatttctttttgttcgctacagtccgacgcggacctttacgggtacgagcattagttttagtacgttgtccgcgaacaggcaatccacgacggtgacgaacaccacggtagcagccaatctcagtcagacgtttaatattcaaggaaatttcacgacgcagatcgccttctactttaacttctttgtcgatcgtttcacgtaatttgctcacttcatcttcagtcaaatcacgaacacgcgtgtttgcactgatgcctgtttccttcaagattttctgagaagtcgttttaccgattccgaaaatgtaagtcaaggcgatctcaacgcgtttgtcacgtggcaaatccacaccagctatacgagccattttacgctacacccccttctattaaccttgtttttgtttgtgtttcggattttcgcaaataaccattacattccctttgcggcgaatgactttgcatttttcgcaaataggttttacagaaggtcttaccttcatgttgattacctcctccaagctttaccctggtaaaactcgcttcgtgaacattcacatcgttttgcagagcaaaacaagtttttttaaatgacatacgtttaataaaaacctgcatgaattacttgcggtacgttatacggcctttggttaaatcgtaaggcgataactgtacaaccaccttgtcgcctgtcaaaatacggataaagtgcatccgcagctttccggaaacatgagcaagaatttgatgaccgttctccagctctaccttgaacgtagcgttcggtagtggctcgattaccgtaccttcaacctcaatgacatcttctttggccaaagtcagtctcctttctcttcagcttggtattcggacgagtccaggaaagttttcactgcatggcgcagctttccgttcgtcacccgaccgctttcgtttaaactgtttacaatctcgctactaatctttggctgaggcaccaaatgaagaacatttttcttcttcgcttgatcaaactttcgtttatccccatccgcaatatatacaaacctgctatctgctactgaaacgacaaccgcaatctgtccggcacctctgcccttcagaatcttcaccagctgaccgatttgcaggtttccttgctgaatcattccaatcacctacgcactcagtttcgtgaaaatgtccatgccgcccgtttcgcacgtcaccgcttgctcgttatgagcacatgaggttacgttcatcgtaacgaccgtccagttgtcttccagcgtccctacatggtgagaacctatctgaatcatagattcaatagccagcccaatgccggttttcagcctcggcccctgctcaggaataccacggtttggattctcaatatattgccgaatggcatgcgacattgtaaactggcgagttttcgcgatgatatcgcctttgtttaaattgcgtttgccgggaaatccgtgcaccagttgttcgttgactgaagcgcaaatgctagcaggaaaaccgttataacctttaaaagacggcacagctccctgactgcgaatataccgatcagctaaatgatcaagttcaccggtcgtaataccgggctcgatgtgtcctgccaagagatgatccgtctccgtatctattctcttagctttcctcattaagcttgattccgtccccgacttgcaaatgatcattacagctaaccccgcaacaaggacacgatattttgggaaaccacatcaatatcctgttctccgtcaatatgacgcagaagattctggttctcataaaacgtgaggagtggtgctgttttattactatattcttcaagtcgtgttcttacgctatcttcattatcgtcaggacgctgatagagttccccaccgtctttatcgcaaatgccttcaaccttaggaggattaaagacaatatgatagctagttccgcagcttttacaaacccgccgtcctgtgattcgtgccaacaagttgtcactatccactttcaagttgatgacgtcatctagcttcgtattcaaacgacccaaaatttgatccaaggcttcagcttgagccaaagttcttggaaaaccgtccagcaagaaccctttcttgcaatctggctgttgtagccgttcttcaacgataccgattgttacgtcatccggaacaagttcacccttgtcgatatattctttagctttaatgccaataggtgttccctgtttcatcgctaggcgaaaagcatcacctgtcgagatatgaggaatgccgaattccttcacaatgacatctgcttgtgtacctttaccagcccccggagggcccatgatcaaaatattcacaatctgtcactcctcaagacgacccctacacaagaaacagcacaaaaggtgccggtaagcatgcgaacatcctaagccggtacctattgcctatttgttgatgaagcctttgtaatggcgtttgatcagttggctttcgatttgcttcattgtatccaatgctacaccaatgatgatgagcaatgaagtaccgccaatttgcacggaacgaggcaagcccgaaagcgaaccgaagaataccggcaaaacggatatgactgccagaaacaaagctcctgtcattgtcaaacgtgacattactcgtgtcaagtatttctccgtggccttacccgggcgaattcccggaatataaccgccgttcttcttcatattgtcggccatttgctgcggattcatctgtacaaaggtatagaagaatgtgaaaccgataatcattacgacatacaaaaccatgcccagcggcttgtcatagtacaagtaagtggtaatccacttagcccaagcatgatctgcccagaaactcgcaataattgtcgggaattgcagcaatgataccgcaaagattaccggaataacgcctgccgcattaattttcatcggaatatgcgtattctggccaccgtacattttgttgccaactacacgtttcgcgtattgtaccgggattttccgaataccttgctggatgtagataacaccaacaataatcagaacaatcaccagggcaattataattgccttcagaatattcataaacagctgatctgcctgaataaactgagattctacaaccgtccgaatatgtcttggaatacccgccgcaatccctgcgaagataacaatagagataccgttgccgattcccttttcagtaatttgctcaccgagccacataagaaacgtagttcctgctgtaagcacaatggcaataaccagataatctgcaaaagtggctcctggaatcatcgctgcaccgtacagtcgattaaagccaatcgacgttccgaatgcttgaatcaggccaagtattaccgtaccataacgcgtaatttgagccaacttctttttaccatgctctccttgtttagcccattccgcaagtttcggaatcacgtccattgacagcaactgtacaatgatggacgctgtaatatatggcataatcccgagggcgaagatcgaaaactgatacaatgcgccccctgagaaggtgttaaggagtccaaacaactcgcttcctgcctgatcctgagaagtaaagacttgcttgttcacgccgggaaccggcacgaaggagccaatacgatatacaaagagtataaacagggtaaacaggattcgggttctaagatcctcaacccgccatatatttttcagggtcttgaacattagatcacctcggttttaccgccggcagcttcaattttctctaccgcagattgagagaacttgttcgctttaactgtcaacttcacagtgatttcaccgttacccagaattttaattccggatttggcgtttttcacaatgccattgttcagcaaaaactcagggcttacttctgtacccgctgcaaaactgttcaaatcttcgatattcaaaaccgcatactctttacgagtaggatttacgaaaccgcgtttaggcaagcgacgatacagtgggttttgaccaccctcgaagcccggacgtacaccaccgccggaacgagcgttttgacctttatgaccacgaccagaagttttacccgtaccgctactaggaccacgacccaaacgtttacgttctttgcgggagcctggagctggggaaagctcatgtaacttcatcgttcgttgcacctccttgattattgttaaaatactttatttcttaagcctcaatttctttaacagaaaccaaatggctaacttgattaatcatcccgcgaatagctgcattgtcgggttgaactactttatggttgattttacgcaagccgagcgttttaacagtcgttctctgattaccaggacggccgatcaacgaacgaacgagggtaatttctaatttcgccatgatattccctccttagcccagcagctcttcgatggatttgccgcgcaattttgcaacttcttcagcgcgtttcaagcgggacaaaccttccaaagtcgcattgaccatattcatggaattcgaagaacccaaagattttgtcaagatatcacctacaccagcaagttccagtacagcacgaaccggaccaccagcgataactccagtaccttccgatgccggtttcaacagaacccggccagcaccgaacttacctgtaacaaggtgaggaattgttgttcctacgagtggaacgtgaaccaggtttttcttagcatcttcaatacctttgcgaattgcatcaggtacttcgccagctttaccgattccagcgcctacccagccgttgccgtctcccactactaccagagcactgaagctgaaacggcgtccgcctttgacaactttagctacacgattaatatttactactctttcagtcagttccaaagtattcggatctacacgcaagtcgttaacctccttttgagaaatgtcttagaattcaaggcctgcttcgcgagctgcatcagccaaagcttgaatccgtccatgatacaagtatccaccacggtcaaatacgatgttagcatgacctttttctttcgcacgtttagcaacgagttcgccaactttacgagctgcttctacactaccgccgtttttgatttcgctgctcagttctttatccatagtggatgcagataccaatgttacaccagctacatcatcaatcagttgtgcgtagatatgcttggaagaacggaacacgttcaaacgaggacgtacagccgtaccttcgattttcttacgtacacgcagatgtcttctgacacgtgctttatttttatcttgttttgtaatcatctcaagttttcactcccttcagtttgccttttaaaactttatactaagacgcactgggtaaaaaagaagtacgaagtctttccagcagaaagaccgcacaaagtcggtaagaaacttatttcttcttaccggctttaccttctttacgaatgatgcgctcgccttcgtatttaatccctttacctttgtacggttcaggttcacgaacggaacgaattttagcagcgtaggcacctacacgctctttatcaattccgcgaacgatgattttagtgttcgaaggaacttcgaattcgatgcccgcttccggtgtgatttcaaccgggtgagagtatccaacgttcagaacgattttatctccggatttgcttgcacgatatccgaccccaaccagctccagagattttgaaaacccttcagttacaccacttaccatgttgttgacaacgctgcgggttgttccatgcaaagagcggtgaagtttgttgtccgaaggacgaactacattaatttcattgttttccacagtaacggacatgtctttatgaagctcacgagtcaatgttcctttaggacctttaactgtgattgctgtgttgttcaaagtcacgtcaacaccacttggtactgtgattggtttacgaccaatacgggacatatctgttgcacctcctatcttttaaacgttatcttaccaaacgtagcaaacaacttctccgccggctttggactgacgcgcttctttgtcagtcatgatacctttggatgttgaaatgattgcgatcccgagtccacccagtacgcgtggaatctcattgctcttcgtgtaaacgcgaagacctggtttactgattcttttcaaacctgtaataacacgctcgttgttcgcaccgtatttcaagaaaatacggatgatcccttgtttgctatcttcaacaaattccgcatcacgaatgaatccttcacgtttcaggatgtcggcgatttgttttttcattgtagatgcaggcatttctactgtttcgtgacgaactgtgttcgcgttacgaatacgagtaagcatatctgcaattggatcagacatagtcattgtgtataaacctccttcccaaacaggactttttaccagcttgcttttttcacgccaggaatctggcctttataagctaattcacggaagcaaattctgcagatcttaaacttttgcagtaccgaatgtggacgaccacaacgctcgcaacgagtgtaagcacgaactttaaactttggtgcgcgttgttgtttgactttcattgaagtttttgccacttagcctgacacctcctaaatagtttcggagaacagggtgtctttaaaatcagacgcccgaaacgttatgccaacattattttgcgaaaggcatgcccagctgagtcagaagctcacgggactcttcgtcagttttggcagtcgttacgataacgatgtccataccacgaactttatcaacttgatcatactcgatttccgggaagatcaactgttctttcagaccaagcgtgtagttaccacgtccgtcaaaagcttttgtcgatacaccatggaagtcacgtacgcgaggaagagtaatgttgaacaatttgtccaagaaataatacatacgctcgccacgaagtgttacctttacaccgatcggcatgttttcacgcaatttaaaacctgcaatagatttttttgcgcgagtgattactggtttttgaccagcgatcagctgcatgtcgttgagagctgaatcaagtactttggagttttggactgcgtcgccaacacccatgttgattacaactttctcgattttaggcacttgcatcactgttgtatagttgaacttctgcatcaaagcaggagtgatttctttcaagaaacgttctttcattcttgttgtagccatgaatcatatacctcctttcttcaaaaaataattagtcgatcacttcgccagaacgttttgcaatgcgcactttttttccgttgtccaaaactttgtaaccaacacgggttacttttccgctcttcggatcaatgtgcataacgttggaaacgtgaatcggagcttctttctcgatgatgccgccttgtggattcagctgattaggcttttggtgttttttaatcatgttaacaccttccacaagcacacggttttgacgagggtaagcagcgataacgcgaccttttttacctttatctttacctgtaatcaccagaacagtgtcgtcttttttgacgtgcagcttgttgttatgggattccagaacttttttcacttttggcatttcgtacacctcctacgggcacattttaaggtgagtttagatcacttccggagccaaggaaacgattttcatgaagtccttgtcacgaagttcgcgagcaactggtccgaaaatacgagtaccacgtgggctcttgtcttctttaacgaccactgctgcgttttcgtcaaatccgatgtaggaaccgtctttacggcggatagaacgtttagtacgaacaacaaccgctcttactacatcaccctttttgacaacgccgcctggtgttgcttgttttacggaacaaacgatcaggtcaccaatttgagctgtacgacgtcccgtaccaccgagcacacggatacacatcagttccttcgcgccggaattgtcagctacagtcaaacgtgtaaatggttgaatcatttatttatcctcctttcggaaaaactacactacattagattataacagctttttcaacgatttcgaccagtctccagtttttgtctttggacaaagggcgagtttccatgattttaacagtatcaccaatttgtgcggtgttgttttcatcatgagctttgaatttcttagttactttaatgcgtttatggtagagatcatgttttttgtaagtttctacagcaatcacaatcgttttatccattttgtcgctgactactttaccgactaatactttacgggcattacgttcgctcattgttggcctccttcctaattacaggcggattttccacccggtctgatatcttagctaatcccaagttctctttcacggatcacagttttagcacgagcaatttccttacgcacagcgccgatccgagtcgggttatcaagctgaccggtagcgagttgaaaacgaaggttgaaaagttcttctttaaaaccggagatcttttgttcgatttcagcagtggttaggttgcggaattcactagccttcatttgcttcaccacccaattcttcacgtttcacaaacttagttttgattggcagtttgtgagcggcaagacgcattgcttcacgagcaatctcttccggaacaccagcaagttcgaacataatcttgcctggtttcactactgcaacccatttttctacgttacctttaccactacccatacgaacctcaagaggcttctgagtaataggtttgtcagggaaaattttaatccaaaccttaccaccacgtttgatgtaacgagtcatcgcaatacgagcagcttcgatttgacggttagtaatccatgcaggttcagtagcttgcaaaccgtactcaccaaagttcagtgtagtaccgccttttgcacgacccttcatatgaccacgttgttgtttacgatgttttacgcgttttggtaccaacatgattagttgcctccttcctgaggagcttgtttcttagctggaggaagaacctctccacgatagatccatacttttacgccaagacgaccgtaagtagtatgagcttccgctgtaccatagtcaatgtcggcacgaagcgtatgcagtggaacagttccttcgctgtacccttcggaacgagcgatttcggcaccgccaagacgtccgcctacttgagttttaattccttttgctccggaacgcatagttctttgaattgcttgtttcaaagcacgacggaaagaaacacgacgttccaattgttgtgcaatgctttcagcaaccagaattgcatccagttcaggatttttaatttcagaaatattgatgtgtacctttttaccgcctgcgattttagtaatttcattacgcagattttcaacttcggaaccacccttaccgataaccatacctggtttcgcagtgtgaatcgttacgttgacacggttagctgctctctcgatttcaacacgggatacagcggagtctttcaatctttttttcagatgttcacgaattctaacgtcttccagcaaaagatcaccgaaatctttgcctgcataccatttggattcccaatcacggataataccgattcggagtccgacgggatttaccttttggcccacacgttttccctccttatttttcagataccaccagagtaatatgactggtgcgtttgttgatgcgacttgcacgacccattgcacgcgggcggaatcgtttcattgtaggaccttggtttacaaaaacctgagatactaccaatttatttacgtccaaagagtagttgtgatctgcatttgcaatcgcagaattcaacaatttctcaacgactggagaagcggactttggagtgtgacgaagaattgcgatcgcctcaccaacctgcttaccgcgaatcaaatcgataacaagtttcactttgcgagcagaaatccgtacggacttagcatgtgcttttgcttccattgagtttacctcctctcaaacactacgctgtgttgattatcttcttgttttcttatcgtcatccgtatggcctttgtaggtacgtgttggagcaaattcgcccaatttgtgtccgaccatatcttccgttacgtatactggcacgtgtttacgaccatcatatacaccaaacgtatgtccgataaattgtgggaaaatcgtagagcgacgggaccaagttttgattaccacttttttgtccgactcattcaaaacctctacttttttcaacaggtaaccatcaatgaatggtccttttttgagactgcgacccatttatgaatcctcccttcgttaaaacgtagtcgttctttaatatgttaacgtgcgactcaagcgcacgttttattacttagtacgacgacgaacgatgtacttatcagatgctttaccttttttacgtgtcttgtaaccaagggttggtttaccccatggagacattggagatttacgtccgattggagcgcgaccttcaccaccaccgtgtgggtgatcgttagggttcattacaacaccgcgaacttcaggacgttgtcccaaccagcgactacgaccagctttaccgattttcaccagttcgtggtcttcgttacctacagaaccgattgtagcgcggcaaactttcagaatgcgacgaacttcaccagaagtcaaacgaattgtaacatacttttcttctttaccaagaagttgggcttccgtaccagcggcgcgaacgagttggccacctttacccggtttcaattcgatgttgtggataaccgtacctactggaatgttttccaacggcaaggagttaccgattttgatatcggaacctgcaccggataccacttcgtctcctactttcagacctttaggagcgatgatgtaacgtttttcaccatccacatagtggataagtgcgatgttggacgtacggtttggatcatattcgatcgtagcaacgcggcccggtattccatctttgttacgtttgaagtcaataatacggtatttacgtttgtgtccgccgccttgatgacgaactgtaattttaccttggttattgcgtccagcttgcttgctcagaggtgccagcaacgatttctcgggctgattagttgtaatctcctcgaaagtagatacagacatagcacgtctggccggggacgttggtttatactttttaattggcactgagtttccctccttactttacagtttcaattataccgtttcaaaaaactcaagcggcttactgtctttgctcagcgttacgaacgctttcttccactcgctcgtatagccggaatgacgtccgtagcgttttggttttgcaggaacacgaagcgtatttacgttacttactttcacgttaaaaatggcttcgattgctttttttacttcgactttgttagaacgaatgtcaacctcgaaaacgtatttcaagtcattcatcataccagccgtacgttcggtgataaccggacgtttgataatatcacgaggatccttcattacgcgagcacctcctctaccttctgaactgcttccttcgtaatgatcagtttgtcgtgtccgagcacatcaagaacattaatgccgtctgcggctacaaacttcacaccaggaatattacgagcggacagtgctacattatcatcatagctaggagctacgatcaatgctttacgatcagctttaaggttattcaaaatggctgcgaattctttcgttttaggtccgttcagtgtaagagcgtccaatacgataatttcattctcaatcactttggatgacaacgccgatttgatcgccagacgacgaacttttttaggcaatttgtaagcatagctgcgtggagtcggaccgaatacagtaccgccaccaacccattgcggtgcacggatcgaaccttgacgagcgcgaccagtacctttttgtttccaaggtttacgtccgccaccacgtacttcagaacgtccttttactttgtgagtaccttgacgcagggaagccaattgcataacaacagcgtcatgaagaacgtgcttattcggctcgataccgaacactgcgtcgttcaattcaatttcaccaacttggctgccgctaatattaaatagtgctacttttggcatttcgtgttcctcctttcttcagttgtttattttttcaccgtttctaatactttaacgaagctatttttaggtcctggaatggaacctttcacgagcaatacattacgttctgtatcgatcttaacaacttcaagacgttggatcgttaccgtttcatgccccatgtgtcctggaaggtgtttacctttaggaacgcggttagcttgaatggaacccatagaacctggacctctgtggtaacgcgaaccgtgtgccattggtccgcggctttgtccccaacgtttgataacgccggcaaaacctttacctttagaaatacctgttacgtcaacgaactcgccttctgtgaagacatcagccttcagttcttggccaacctcgtacgcagcaaggtcgatgccacgaagttcacgaacgtagcgcttaggtgcagtatttgcttttttcgcatgtcctgcttcaggtttgttggatcttttttctttcttatcagagaatccgagttggatagcttcgtatccatcgttttccagatctttcttttgcagaacaacacaaggacctgcttcgataaccgtaacagcaagtacgttaccttcaggggtaaacacttgagtcattccgagtttttttcctaagatacctttcatgttgacacctcatttcttttcctaattacatattacaatttaatttcgatatctacaccggacggcaggtccaagcgcatcaaggcatccacagtttgtggagtcgggttaacaatgtcgatcaaacgcttgtgtgtgcgcatttcgaactgctcccgggaatccttgtacttgtgtaccgcacggagaatagtaatgatttgtttttcagttggcagcggaattggcccggatacacctgcgcccgaacgtttagctgtttcaacaattttctcagcggattgatcaagaattctatgatcgtaagctttcaaacgaatacgaattttttgctttgccattttagtccctccttctatcgcccaatttggtatcggacatactccgtgaaaattttccgacagccctcccatggcaaaggggccgggtgtgtcagtaacctctcacatcatcgcacagtcacaaacaacattagttattatatcgaatagttctgcctattgcaagcaaaaacgaaaaaacaatgcatcttattttcaagagatgcagttgtgctcgcagctcgcgattttccccaagagaaaagcccccgcaccagggcaggggctcgtttagcttcgttccaatacaacgttactcgttccagtacactgttgctctatttaaaggctaaagccttcttatttggagattgttgctacagcaccagcgccaactgtacgtccaccttcacgaatagagaacttagttccttcttcgatagcgatcgggttgatcagttgaacagtaactgtgatgttatcaccaggcattaccatttcggaaccttctggcaaagtaatgataccagttacgtcagttgtacggaagtagaactgtggacggtaaccagtgaagaaaggtttgtgacgtccgccttcttctttagtcaaaacgtagatttgagcagaaaattctgtatgtgggttaacagaacctggtttagccaatacttggccacgctcgatttgtgcacgatctacaccgcgaagcagtgcgccgatgttgtcaccagcttgagcggaatcaagcaatttacggaacatttctacgcctgttactacggatttacgggattcttcttgaataccgatgatttcgatttcgtcgcccactttaactgtaccacgctctacacggcctgtagcaactgtaccacgaccagtgatggagaatacgtcctcgacaggcataaggaaaggcttgtcagtgtcgcgttctggagttgggatgtaagtgtcgattgtttcgaacatttcaacgatttttttagcccagtcgccatctgggttttgcagtgcttcacgagcggaaccgcgagtgattggagtgtcgtcgcctgggaagtcatactcgctcagcaagtcgcgaacttccatttcaaccaattccagcaactcttcgtcttcaaccatgtcgcatttgttcaggaatacaacgatgtaaggaacaccaacttggcgggacaacaggatgtgctcacgagtttgcggcattgggccgtcagctgcggatacaaccaggatcgctccgtccatttgtgcagcgccagtgatcatgtttttaacatagtcggcgtgacctgggcagtcaacgtgtgcatagtgacggttaggtgtttcatattccacgtgtgcagtggagattgtgataccgcgttcgcgctcttctggagctttatcgatttgatcgaatgctacagcagcaccaccgtaagttttggacaatacagttgtgattgcagcagtcaaagtagttttaccatgatcgacgtgaccaatagtaccgatattaacgtgcggtttgttacgttcaaacttagcctttgccatttgaacaattcctcctcaataacttgttttattttaggctgccggatgcctttttggtaaaaccttaagcataccggtcagctgatacattgtattactcgccgcctttggttttggcaacgatctcttcagcaatgctcttcggtacttcttcataatgagagagttccatggagaacacgccgcgtccttgtgtaccggagcgaagtgtagtcgagtatccgaacatttcggacaaaggcaccttcgcacgaatgatttgagctccactgcgggaatccataccttcaatccgaccacgacgggagttcaacatacccattacgtcacccatatattcctcaggaaccgttacttcaactttcataatcggctcgagcaatactggtttacatttgtctttcgctgctttcagcgccattgatccggcaattttaaatgccatttcattggaatcgacatcatggtatgatccgtccacgattgtagctttaacgtccacaagcgggaagcctgcgataacgccgtttttcatttgttcctcaataccagcaagagcaggagcgatgtactctctaggaacagagccgccgactaccttactttcgaattgactaccagtacctggctcgagcggttcgaactcaacccatacgtgaccatattgaccacgaccaccggactgacgaacgaatttaccttcgacacgtgctggagcacggaacgtttcacggtaagcaacctgtggtttacccacatttgtttctaccttgaactcacgacgcatacggtcaatgatgatgtccaagtgaagctcacccatacccgccaagatggtttgacctgtttcttcgttagtatgagcgcgaagagttggatcctcttcagtcaacttaccgagagctacagacattttatcttggtcagctttggttttaggctcaaccgcgatttcaataaccggatcagggaagttcatggactcgagaataacaggactcttctcatcacacagtgtatcacctgtacctgtatctttcaaacctacggcagccgcaatatcaccagagtaaactacagtgatttcttgacgactgttcgcatgcatttgaagaatacgtccgatacgttcgcgtttaccttttgttgcattcaatacgtaagaaccggattgaagaacaccggagtatacgcggaagaatgtcaacttaccaacgtaaggatccgtcatgattttgaatgccaatgcggagaatggctcttcatcggaagagtgacgttcaacttccgtaccgtcttccaaatgcccttgaatacttggcacatcaataggagccggcaaatagtcgagaacagcatccaacatcagctgaacacctttattgcggtaagaagatccacagataactgggaagattttaacttctacaacacctttacggagagcggctttaatttcggcaaccgaaatttcttcgccttccaggtatttcattgtcaattcttcgtccagttcagcaaccttctcgatcaattcattacgaagttcttcaacttgatctttgaattccgcaggaacttctacttcttcgatatcttgaccaagatcatctttgtacatatgagctttttgttcaacgatatcgataataccagtaaaatcattttctgcgccgattggcaattgaatcgcaactgcgttcgcttgaaggcgatcacgcatgtcagagacaacattcaggaagtcggcaccaatgatatccattttgtttacatatgcgatccgtggaacgccgtagcgatcagcctgtctccatacggtttcggactgaggctcaacgccttctttcgcactgaaaacaccaactgctccgtccaatacacgaagggaacgttcaacttcaacagtgaagtcaacgtgccccggggtgtcgatgatattgacgcggtgacctttccaggcagcggtcgtcgcagcggaagtaatcgtgattccgcgctcttgttcttgttccatccagtccattgtcgcagcgccttcgtgaacttcaccgattttgtgcgtacggcctgtgtagaacaagatccgctctgttgttgtggttttacccgcgtcaatatgagccatgatcccgatattacgtgtatttttcaaggagaactctcttgccatgaaatgggtctcccttcaaaattgaagttatttttttgagctgaatcctaccaacgatagtgagcaaacgctttgttcgcttcagccattttgtgcgtgtcttcacgttttttcacggaagcgcctgtgttgttggaagcatcaataatttcagccgccaaacgctcttccatggttttctcaccgcggttgcgggagtagtttacgagccaacgtaatcccagggacgtacgtctttctggttttacctcgattggtacttggtagttggcaccgccgacacggcgtgctttaacttccaggactggcatgatattcttgatagctgcttcaaaaacttccatcgggtcattccccgtacgttcttggataagcttgaacgcattgtacagaatgctttgagcaacgcctcgttttccgtcgagcatgatgcggttgatcaagcgggtaaccaacttgctgttgtataccggatctggcaacacgtctcttttggtaactggacctttgcgtggcatggatatccccctttcttacatgttaaaccgacatacgcggtttatattcattaggattttttagctttagggcgttttgcgccgtatttggaacgagcttgcatgcggttgtttacgcctgcagtatccaaagcaccgcgaacgatgtggtaacgcacacccggaaggtcttttacacgaccgccgcgaatcagcactacgctgtgttcttgaaggttatgtccaatacctggaatgtaagcagtcacctctacacggttcgtcaagcgaacacgagcatatttacgaagtgcggagtttggttttttcggagtcatagtacctacacgagtgcacactccgcgtttttgcggggcactgatgtcggtagcttcacgtttcaaggcattaaaacctttttgcaaagccggtgatttcgatttctcgattttggcttgacgtcctttacgaaccagttggttaatagttggcatgttggttgccacccccttcctcaatttttgctgttactttacaaaccttatctaagcccacagacccaggcggttcataaaagaacaaatgaaaagtctttgccgccaagaataacaattccttagacaaaaacgttccttaccctattgttttacgatagcagccattgcggctcccacttcaatcccacatgcagctccgagatttttcattgtgtctacgagagtcactttgactccttgcttgttgcacaaagcaatgatgttggaagtgagacgctgatctgcgtcttctgccacatatacttctgaggcaaagcccaattctaccatacgaatggtttgtttggtaccgattttgacatgagcatcttgcagtccttgttctttagacatatctcattcctccgaaaagacccaatagcatataggctgctcacgcacctttgctatattagcattgactataagtaatgtcaagacaattataaactataattcatttaaacagaatagtacgattcatttttgaaaagcaccggagcaccgtctgctgtagcttttatgcaaagcttatgtctacggtgttccggcaatcatactatttttatattactcggccgaaattggttcgagctcctcagatggagactgcccctcttccggttgggcaaatttcacgctacggtaacggttcatacctgttcccgcaggaatcaatttaccaataattacgttctctttcagtccaagcaactgatcgaccttgcctttaatagctgcatcagtcaggacacgagtagtttcctggaaggatgctgctgacaagaaggagtcagtttccagagatgccttggtaataccgagcagtaccggcttggctaccgctggttcttggccgctgagaatcgctatcttgtttgcattttcatactcatggacatcaacaaaggagcctggaagtaagatcgtgtcgcccgcatcaatgatacggattttacgcaacatttgacgaatcataacttctacgtgcttgtcgttgatttctacgccctggttccggtatacgcgttgaacttcctgaaggatatagttctgtaccccgcgaatacctttaatacgcagcatttctttaggatcaatcgaaccatccgtcagttcgtccccagcttcaacagtcataccttcgcttacgcgcaggcgggaaccatacgttactgagtatgttttcgtttcggcttcaccctgaatgtcgatctcacggcggtctttaccttcacgaacttctttaactgtaccgtcaatttcactaatagttgcctgacccttaggattacgtgcttcaaaaagctcctggatacgaggcaaaccttgtgtaatatcgtcacccgctacgccgcctgtgtggaacgtacgcatagtaagctgtgttcctggctcaccgatggattgtgcagcgatgataccaactgcttcaccaatctcaacgtgtttaccagtagccagattgcgaccgtaacatttcttgcagacgccatgtttagcacggcaacttagtacagaacgaatctgaactttgtgtacaccagctttaacaatcgcttcagctttatcggagtcaatcaattcgttacgtctagccaaaatctcgccagtctcaggatgacgtactgtttcaaagcaatagcgaccttccagacggtcatagagatcctcaattacttctttaccgtcctggatacgacttactgtgaagcctttatccgttccgcagtcttcttcgcgcacgataacatcctgcgccacatctacgagacgacgagtcaggtaaccggagtcagccgtacgaagggctgtatccgccaaacctttacgcgctccgtgagtagagatgaagtactcgagtactgtcagaccttcacggaagtttgatttgattgggagttcgataatacgtccggatggattggccatcagaccacgcataccgccgagctgagtaatctgtgatttgttaccccgcgctttggagtccaccatcatcatgatggagttgtagcgatccatggacttcatcaatacttcagtaatatcatctttcgctttagaccaaatatcgataatccggtcatagcgttcttcattcgtaatcagaccacgacggtactgattcgttacaacttgcgctttgtcttcggatcccttaagaatctcttgtttttccaccggcacgattacgtccgacacagcaacggttacccctgcacgagtggaatacgtaaagccaagctgcttgattttatccagaattacagctgtttctgttgtatggtaagtctcaaaacaacgtgcaatgatattaccaaggtaatccttgcctaccccgctagcttgcggagcgttttgaatggcttctgtaagatttacacccttctcgtaaacaaagaactcctccgcagtaccataaagcaggttcgcacgggtagcatcattgatgtacgggaagcttgccgggaaaatttcattaaagataattttaccaaccgttgtgatcaacatcgcttcctgttgtttttccgtaaagctcgttttattcaaagctttaaccggaatagctacacgagcatgaagtccagctgtaccacgttggtaagccgatatagcttcattcatgttgcgaaggatcatattgcttccttcttcttctttgttatccatagtcagatagaaagaaccaagaaccatatcctgggaaggtgtaacaactggcttgccgtctttcggattcaaaatgttgccggatgctagcataagcaaacgagcttcagcttgggcttccgcagacaacggaacgtgaacagccatttggtcaccgtcaaagtcggcattatatgcagtacatacgagcggatgcagacgaatcgcacggccttcaaccaaaatcggttcgaacgcctggataccgagtctatgcagcgtaggggcacggttcagaagaactggatgctccttgattacttcttccagcacatcccatacttctgcactcacacgctcaactttacgcttcgcgctcttgatattgtgcgccaaacctttgttcaccagttccttcataacaaaaggtttgaacagttccagtgccatttcttttggcaaaccgcattgatacattttcaagtacgggcctacaacgataacggaacgaccagagtagtcaacacgttttccgagcaagttctgacggaaacgtccttgtttacctttcagcatgtggctgagggattttaaaggacggttacctggacctgtaacaggacgaccacgacgaccattatcaatcaaggcgtcaacagcttcctgcaacatccgtttttcattttgcacgataatatctggcgcacctagatctaacaaccgtttcagacggttattacggttaataacacgacgatacaagtcgttaaggtcagaggtagcgaaacgaccaccatccaactgtaccatcggacgaagctcaggaggaataacaggaagtacgtccatgatcatccaatccggttggttgcccgagttacggaatgcctcaataacttcaaggcgtttgatcgcacggttacgacgttgtccttgagctgtacgcagctcttctttcaagaattctaattctttgtctatatccaaatcttgaagaagctttttaaccgcttcagcacccatacctgcctggaagccatagccgtatttctcacggtagctacggtattctttctcggacaggagttgctttttctccaaaggcgtatctcctggatcggttacaacataagatgcgaagtaaatgatctcttccagagatcttggagacatatcaagagcaagacccatacgacttggaatgcctttaaagtaccaaatgtgcgatacaggagcagccaactcaatatggcccatacgctcacggcgaaccttagcgcgagtaacttctactccacaacggtcacagacaacacctttataacgtacacgtttgtacttaccgcaatgacattcccagtctttcgtaggtccgaaaattttctcgcaaaatagtccttctttttccggtttaagcgtacgatagttaatcgtctccggttttttgacttctccgcgggaccaagaacgaatcttttcgggggaagcaagcccgattttcatatattcgaaattgttaacgtccaacaaggagcaaccctccttaaccaaatcctgagtttttaggtttgataccgcccagcagcaccgggcggtatcaagaaacctgatccatcctagaatggatcaaggtatataacaaagctgatatgagtcagtcagcagtcaaactactctacgccaacctcagagccttccagattcaaactcaacttatcgccggttgtgtcatcctcatcatcaagctctctcatttcgatctcttgttcgtcttcagacagaatcttcacgtccatacccaagctttgcagctctttgatcaagaccttaaatgattctggaacacccggttcaggtacattttcacctttgacaatggattcgtaagttttaacacgtccaaccacatcatcagatttcacagtcaaaatttcctgaagcgtgtacgctgcaccgtaggcttccaatgcccatacttccatctccccgaagcgctgtccaccgaattgagctttaccacccaatggttgttgcgtaacgagagagtaaggacctgtagaacgagcatggattttatcatcgaccatgtgcgccagtttgatcatgtgcatgacaccgacagtaacttcacgttcaaaacgatcacccgtacgtccgtcatacaacacagtcttaccattacgctgcatgcctgcctcttccattgtatcgaatacgtcatattccttggcaccatcgaatactggagttgccacatgaataccaagacgcattgcagccatacccagatggacttcaagcacctgtccgatgttcatccgtgaaggtacgcccagcgggttcagaacgacctgtactggtgtgccatccggcaggaacggcatatcttcttcaggcagaatacgggcaactacacccttgttaccgtgacgtccagccattttatcgccttcggagattttacgtttttgagcaatatatacacgaaccaactgatttacacctggtggcagttcatcgccattttcacgtgtaaatacctttacatctacaacaatcccgtctgttccgtgaggaactctcaaagaagtatcgcgaacctcgcgtgccttctcaccaaagattgcgtgtaagagacgttcttcagctgtcaattcagtcacacctttaggtgttactttaccaacgagaatgtcacctgcgccaatttcagcaccaatacgtatgattccacgctcatccaagttgcgaagcgcttcttcaccgacatttggaatgtcgcgagtgatttcttccggtccaagcttcgtgtcacgagcctcggattcgtattcctcaatatggatcgaggtgtatacatcttccttaaccagtttctcactcagcaagatcgcatcctcgtagttgtaaccttcccaagtcatgaaggcaacgacaacgttacgtcccaacgccaactcacccatctctgtagaaggaccatccgcaagaatatcgccaactttgacaatatctcctctgttcacaatcggacgttggttgatgcaagttccttggttagatcgcataaatttgtgtaatttatacttaacaatgtcgcccttcacctcagcgccatctacagtttcgatacgacgcaaccaaatttcgttagccgaagaacgttcgataactccgttgtatttggatacaacgcaaacaccggaatcttttgcagacttgtgctccattcctgttccgaccaatggagacttcggaatcagaagcgggacagcctgacgctgcatgttggaacccatcaatgcgcggttagagtcatcattctccaagaacggaatcagtgcagtcgcgaccgatacgacctgtttaggcgatacgtccatgtaatcgacacggctactagccatcggaataatgttatcagactgtttgttataacggacaatgacaacctcatccttaaaggtgttttcctccgtcaattccgcattcgcctgagctacgatgtagttatcttcctcatcagcagtcaggtaatcaatctgatctgtaacttttccggttttcggatctacccaacgataaggagcttcgataaatccgtactcgttaatgcgtgcaaaagtggacaaagagttgatcaaaccaatgtttggtccctctggtgtctcgataggacacatgcggccgtagtgactcggatggacgtcacgcacttccatgcccgcacgttcgcgcgtcaaaccgccgggtccgagtgcggacagacgacgtttgtgcgttaattcagcaagcggattcgtctgatccataaactgagacagctgcgagctaccaaagaactctttaatcgaagcaattactggacgtatgttaatcaatgcctgtggcgtaattacattagcatcctgaatcgacattctttcgcgcactacgcgttccatacgggataaaccgatacggaactggttttggagcaactcacctacagaacgcaaacgacggttacccaaatggtcaatatcgtccgtacttccgattccgtgaagcaagttaataaaataactaatggaggaaataatatcggcaggcgtaatattcttaaccgatttatcaatatttccgttagcaatcagttttactactttaccatcctcaattggtgagaacacatcgattgtttgaagtggaatatcattgctttctagcacaccactcgcaacatgatacgtacgatgtcctactgattcctccagttgggccaaaatctcgtccaacaggcggcgatctaccatttgaccggcttcagcgatgatttcaccagttgttgtatcaatcaaagtctcagcaagtcgttgattgaacaaacggtttttaatgtgaagctttttattgattttgtaacggcctacgttggccagatcataacgtttaggatcaaagaagcgagcaactagcaagctctttgcgttatccagtgtaggcggctcacctggacgaagacgctcataaatttcaatcagcgctttctcggtggaatccgtgttgtctttatcgagtgtgttgcggatatattcgtcattgccgagcaaatccagaatctcagcatcagtgccaaagcccagcgcacgcagcaacaccgtaaccggaattttacgggtacggtcaatccggacatagataatatccttcgcatccatctccagttcgagccaagccccccggttaggaattaccgttgcggtgtatgttgttttcgcattcttgtcgacttttgtgctgaaatagacgctgggagagcgaaccaactggctgacaataacccgttccgcaccgttaataataaacgtacccgtttcagtcatcagcgggaagtctcccatgaatacttcctgctctttcacttccccggtttctttattaataagccggacttttacccgaagcggtgctgcatacgtaacgtcgcgttcctttgcgtcgtcaacggtatatttgggttctccgagagaatagtcgataaactccagaatcagatttccagtgaaatcctgaattggagaaatatcccgaaacatttcccttaatccttcctccaaaaaccaatcataggatttttgttggatctcaatcaggttcggaacctcgagtacctcattaatacgtgcataactgcgccgagtgcgtcgaccatattgaacaagatgtcctgccaacttaaactcacccctcatgtctactcactttaaaaatacattgcgaacctctgtttgtgaccttataataagacacatacagaagattcaatcttacaaatacagaaaagcccttactcgaatgcattcgaaaaaagagcaccgtatctgcagaatcctcttaccggaagatcttcatcacttgtagatttgcccaaaatggttgtattatacgtaatagagataaatagtatacctactacgcataaatctattgacatttcaacaaactaaagccatggagggcatcctaatactgacattttataataatatcacagaccaggattcaagtcaatggtcctattgcattttcttaaaaacttttttcagccttcaaaattcgataacctttatcctttgtaacttcctctacatgaccgaaaaggctctctatcttagcactcgccgaaggggccccctgctttttctgaatgactacccacaaagctccaccttcgtttaaatgctcataagcaagctcaaaaatggtatgcactgtttcttttcctgcacgtataggaggattcgtcaagatcacgtcaaagcgttcatccttcacttccgcaagcaaatcgctttgcttaatggtgacattcttaaccccattacgttccgcattctctatcgcaagttgaacggctcgttcattaatatcaaccattgtaacgtgtccctctgggacaagcgcggctgccgccagaccaatcgggccgtaaccgcatcctacatccaataccgaggcttgtacaggaagctgcatcgcttcaatcagcacacgactcccgtaatcaattccctgcttcgaaaaaacgcctgaatcgctggcaaaacggtatgaccgaccccgcagcactgtttccaggctccgtcgttcatgtgccgtctctggccgcttggagtaataatgatcagccattcatgcccacctctttcggttgtactaccatcatagcctttacaataacctttcagacatgctggtactaccgttttacagcaacaaaccccttgaagatcacctcaaggggtttgttttagtccattgtctgctagaaagcagtcaattattttacttctacagaagcgcctgcttcttccaattttgctttaatggattcagcttcttctttagcgattttttctttcagtggttttggagcgttgtcaaccagttcttttgcttctttcaggccaagacctgtgatttcgcgaactgctttgataacgttgattttggaagcgccagcgcttgtcaagattacgtcgaactcggattgctcagcttcagctgcgccacctgctgcgccacctgctacagctactggagctgctgcagttacgccgaattcttcttcgattgctttcacgagatcgttcagttccaatacggacatacctttaattgcttccaagatttgctctttactcatggttgaacctccatttaaattcgtatttttttgttctcaactgctatacagcaggtttaatccctaacttatgcgctttgctcttctttttctgcaacagctttaactgcaagcgcgaagttgcgcacaggagcttgaagcacgctgaggagcatggaaaggagaccttcgcgggatggcagttctgccagtgctttgatttcctcaacaccgataacgcgaccttctacaactgcacctttcagttccagtgcattgttcttcttagcgaaatcgttcaagattttagctgcagacactgcatcatctttgccgaacgcgattgcagtaggacctgtcaatactgcgtccagttcagtcaattctgctgccgcagttgcacggcggagcagtgtgtttttcagcacttgaaattcgattccggcttcgcgaagctgcttacgcagctcagttacttgggcaacattcagaccgcgatagtctgcaaccacagtcgttacgctctcgcgcaattttgcagctacaacttcaacagcttcttgttttgcttgaatcacctttgcatttgccaaactgtacacctcctgatcaatttatccgctttgttcaaagcacccaatctggtgatcttacaaagcttgctttcataagcatgaaaaaagcctccgtagagtacgaaggcttgataaatctacatggacgggacaagcccgtcacatgaaacgttctatcataacacctcggtaggaaattaagcccaaaagcacctactgtctacggtaagcatattcaactttaatggtcagtcacaaggactcacaacttttatagaataacaaatttgattgaacatgtcaatcaaaatattatctgtaaacagatgcgttcacacgtgcacttggtcccatagtcgaagaaatagcgatgtttttcaggtatacacctttagcagccgctggcttcgcacggttcaaggcttcaaccaaggctttaagattctcgttcagctgttcagcactgaaggaagctttgccgattggcgcgtgaatttgaccggctttgtcgagacggtattcgattttaccggctttaatttcttgaacagccttggcaacgtcgaaagtaactgtgcctgctttagggttaggcatcaaacctttaccaccgagcaaacgacccagtttaccaacctcgctcatcatatcaggtgtcgcaacgcagacgtcgaattcgaaccagccttgttggattttgttgatcatatcttgatcgccaacaaaatcagcgccagccgcttccgcttctttcactttgtcaccttttgcaaataccagaacgcgttgtgttttacccgtaccatgcggcaggacaacaacaccacgaacagcctggtcttgtttacgggaatctacgcccaaacgaactgctgcttcaacggtttcgtcgaatttagcagtcgcagcctttttcaccagttcaacggcttctaaaggctcgtaagttacttcgctgtcaatcagcttagcagcttccaggtacttcttaccatgtttagccataatgttttcctccttatgtggtattagcggatattcctcccacacttgccggacagtcaaactgccggcacacgtagattaataaaattaatctacgatggtgatacccatgctgcgagcagtaccttcaaccatacgcattgccgattctacggaagctgcgttaaggtcaggcattttttgctctgcaatttgacgaacagcagcgcgatttacagttgcaactttcgttttattcggttcaccggaacctttttcgattttagcagcaactttcaacagaacagcagccggtggagttttggtgatgaacgtaaaagaacgatcctcaaacaccgaaatttcaaccggaataatcaggcctgcttgatcagcagtacgagcattgaactctttacagaatgccatgatgttgacacctgcttgacccaaagctggacctactggaggcgctggattagctttccctgcaggaatctgcagttttaccattttaattaccttttttgccatggatgacacctccttgactcaatagtggtagacggacctatcgatcctcccacaagaaacctgtaagaaaaatctatattttctccacttgagtataatccaactcaagcggggtttcccgtccaaacatgttgacgtgaactttaagcttgctcttctcaaccaaaatttcttccacggagcccacaaaattcgcaaaaggaccaactttaattcgcacggattccttaacatcgaattcaatcttcggtttcggctctaccatgcccatatgcttcagaatctgttcaacttcttctggaagcaatggcgtcggtttggaacccgagcctgtcgaccctacaaatcccgtaacacctggtgtattgcgcacaacataccaagagtcgtcggtttggaccatttcgactaagacataaccagggtagactttacgcataacggtttttttcttaccgtccttggttaccagttcttcttccataggaacaagaacacggaatatcttgtcttccatgcccatggactcaacgcgtttttccaaattggctttgactttgttctcataccctgaataggtatgaacgacgtaccatcttttttccatatcaagccacctggaacccttcctagataatcgcttcgatcacagcggaaatgccgatatcgagaacccaaaaataaatcgtgacgaacgcaattgtccctatgacaatcaacgtatagttggtcagttctttacgattgggccagcgaaccttcttgagttcagcccagctttcagagaaaaaggaaaacagagacttgaaactgcgtttcacgccgactacacctccaaaaactatctggtttcccgatgagaagtctgttcgttacaggacttacagaatttcttcatctccatgcggtcggggtgattacgcttgtttttcgtcgttgtgtaatttctttgtttgcatgttgtacaagccaaagtaataattacccgcatgatgtgcacctcccgaagacatccaacaccggaagtctcataattgatcctaaaaaaaaccgcgaatttaggcctacctaaaacactttatcacacggggttttccatgtcaacgaatgtttgcatacaattcgcagtcccggctgtggtgcattttaacatctgtgcatcctttaaaactgttctctgaaaagctgcttcaaaaatcaaggcgatatctattattcatcttttttagtataaatcatttgtaacacttataaacctgcatagcctacctataacgaataaaaaaagactcggactcgagccttttccctgtcagcctctactttcaactatctcttacttccagatacttttcaagtttacgcttgacccgttgcagcgcgttatcaatggatttcacatggcggtcaagatcctctgcaatctcctgatacgaacgtccgtccagatacaacataagtaccttgcgttccagctcgctcagaatctcggacatcttgtcctcaaggcccacaaactcttcctgattgattatcagctcttcagggtcacttacttgtgttccgcaaatcacatcgagcaacgtgcggtctgactcttcatcatatatgggtttgtccagagatacgtaagagttcagaggaatgtgcttttgtcgtgtagccgtcttaattgccgtaataatctgtcgtgtaatgcacaactcggcgaaagccttgaacgaagcaagcttgtctcccttaaaatcacgaatggatttgtagagaccaatcatgccctcctgaataatatcctcgcgatcagcgccaatcaggaagtaggatctggccttggcccgcacaaagttccggtatttattaatcagaaactccagcgcttccccatcaccttcatggactgctccgacaatgtcttcatcatttttgtaatcaaactttgacaacatgatatccttgaggtccacactcactaacaatccctccggctgcaacgcaaggtacccgttactctctcaaatatacgacaagtatacgcgatgtaacctgataccgtcaaccacaacaacctaaaaaagaagagcgctaacaaaattgtcaatggtttcaaaatggagtagtccccaattattggtttattctcttctccatcgttcaaacaactttcgaagctccggactcagtttggcatctagcgggttacgggacaatttggcactatcctgctggattcgcttctgtacttccctttcggattcctcaatctcgatcagtaattcccgcgccgacaccctgagtgcaccttgtccaaatgcgacatgttgctctacctgatcgcttgtcgctacgtaaatacttcttcttttactgctcagctcccgaaccaatcgctcgatacactcatcagcagtttctttttctctggtaaaataaatctggactttgctctgagcaaaagttttacctaatcctggcaccctgtaagcatcaaatacgacgatgactcttctgccggaatacgcctgatgatccgccagtcgttcaagaagtctgtccctcgcttcctgcataccagattgtaccagtgcggaaagttcgggccaggctccaatcatgttgtaaccgtccacaagcagaacatcccgcgtgtcagccatatcgttagccccgtgcctgtcgtccgcgcaatacttcgtacatgacaacacccgcagctacagaagcattaagggaattaatttgccccgccattggcagcttgacgagtacatcgcatttttcacggatcaaacggcccattcctttattttcgttaccaatgacaatagctactggccccgtgaatactccattcccaaagacaggatctgtcgctgtaacatccgtgccaactacccatacaccttcttctttaagacgatcaatggtttgtcccagattgtttacacgcgccaccgggacgtactccacagcacctgccgatgttttggacactgttacagttacagctgcagagcgccttttcggcacaataacaccatgtgctccagtacagtccgctgtacgaaggatggagcccaaattatgaggatcttcaatctcatccagcaaaattaaaaacggctcttctcccttatcacgagcagtggcgagcaattcttccacttcaacataggcaaaaggcgcagcttgcgcgaccactccctgatgctgaatgcccggaaccatttgatccagcttacgcttgtccacctgcaagacaataattcctgcttttttggcctcagctgtaatcggcagcgtcaaatgtttttgtgcattatccgcaatccatattttatttatcgttctgcctgaacgcaatgcctccgttaccgaatgcttaccggcaatccattcttcttccatctctagcttcctcccgggacacggccgatgcttgttccatccagtccgttcccatttatgatttttctgtattttccatctgtgcaattccgtacgtaatcaactctcttaatctgtccaaatgtccatcacaataaagagatccaattaacccttccagtgcagtggcatgacgatactcaagcacatcagcatttttaggcaaacttcctgatttagcatttcttccttgtcggacaatatcgcgttcttcttccgtcagtaccttttccaatagccccaacatacgactctgcgccttggcggagactagccctgtggctcggcggtgcagatgatttggacgcaggttgggctgtgccaacaaatattgccggacagctacctcatacactgcatcaccaatataagctagtgcaatgggaggcatcaaacgagctggcttggacgcagggtacgggaaccagttccccgtacctgccgatgctcctgagttcagtggcttatcactcattttcgccgccaccgcataccctgcgccgtatcttcaagcacaataccttttgcagccaacagatcgcgaatttcgtcagctctaccccagtttttggtcttacgagcttcgacacgttctgcaattaactgctcaatttcgtcatccagcaactcttcactcggttccgaataaatgcgaagaacgttattcatcgattgaaaggtatgcaatacagcctgtagttccgcctgatgtacgacatctcgctgcaacaaatggtttgcttcgctaacccaatcaaatacagcagtaatcgcatcaggtgtattgaaatcatcattcattttttcgccaaactgctgcaaaattccgtcgagcttcgtttgcagttccgtcgatactcccccattaccttccagcgcattagctaaacgatgcttcacattggcaactgcattggcgatccgctcgacactgttctccgcctgactcatagtctcttggttgtagttcaacggattccgataatgcgtcgacaacataaaataacgtaaagcctccggcttgtgatgagcgcgcaaatctttaaccaaaataccattaccgagtgatttcgacattttttcattatctatgcgaatatagccgttatgcatccagtagcgggataatggcttacccgtgatcacttcggattgtgcgcattcacattcatgatgcggaaattgcagatcctgtccgcccccatgaatatccagtgtatcccccaaataatggcgagccatagcagagcattcgatatgccagcccggtcgtccatctccccaagggctcgaccaataaatttcgcccggtttcgctgccttccagagtacaaagtcctcagcattttccttgcgctcatccacattgatgcgaataccgaactgaagctcttccagattttgacctgacagttgtccgtaatctttgaactttttggttcgatagaacacatcgccatcattctcataggcatagtccttgtctaccaattccttaataaaatcaataatcaggtccatgctctctgttacacgagggttcatactggcagcaggaacattcaatcctgccagatcctcatgataggcagcaataaatttctcagcaactgccgagacatccatatcaagttcccgagctttgcggattaatttatcatcgacatccgtaaaattcaccacatagtttacatcatagcccaagtactccaggtagctgcgcaccacgtcaaatacaattacaggtcgtgcattgccaatatgaatgtaatcatacacggtaggtccgcatacatacattttaacctttccaggctccagtggcacaaaaggctcccgactcctcgtcattgtattataaatttgaagcggcattgttatgttcctccctcatgaaaatcatttttctaatttattctcttgggtcacctgatgtttctgagcagatgcctcatccttcaaatcagacatttctgcacgcaaacgttctatttcccgttgaagttctcgcatagagtccacaaccggatcaggcaattgatgactaagtcggtctggacgcctaccatcctgtctgacaactcgccccgggatgcccaccaccgtactgtttggtggaacttctttgagcacaaccgagttagagccaatgttggattgtgccccaatcgtgaaagagcctaatatctttgcaccggagccgataacaacattattcccaatggtcggatggcgcttccctttctctttcccagtcccgccgagtgtgaccccctgatacaatatgacatcgtcgccaatctcacaggtttcaccgatgacaactcccatgccatgatcaatgaacagccgatttccgatacgagcgccaggatgaatttcaatgcctgtcataaaccttgatacctgggatataacacgggctagagtacaccagtttcgcaaataaaaccaatgtgcgattcgatgtgcccaaagggcatgaacgccggaatacgtaaaaatgacctccagcttactccgggcggccggatcattatccaaaacagtctgaatgtcggatttgaaatgtctgaacatgtcgccctcctattcccttcatatccttgccgcatcatcactacacttcacgttccgccaattttcgcatccaccagcactcttcgacatttttcaatctataacgagtctgagtctgataaaaaagaaaaagcgtctccgcagcctaagctgcagagacgcatgaacgtggtcccactctgcttcgaacatatctgctgcataaaaagcagacagtccgtctttggcgtcctgtaacgggaacgactcggcacgcccttgtcacatcagcatttgacgctaatgaaagttcgggcgcacggctcccaggcgcatttcctccgcaggtcatctggacggctctcagcctggagtttcccctcgaccgtcctctctggcagatgcccctatgcagtgtacttctcctgttcgcagcctttacacgtaaatatcaatccgtatcaatggagtcattatagcgaaaagacaacaaattgacaagaaatatcagcctttaatttgtgccttgagacgatccagtaccttgtcacgtccgagcaaaaagatggtttcattcagatctcgtccatgcgtttggcctgtaagagccatacgaatcggcatgaatagttgttttcccttaaaacccgtttccttttgaacttccttgatcagcttagccatttgtggagctgtaaattcctcgctcgtttcaactttaaccgtaaaagctctaagtacctcaggaacctgctcttcggccaatacagctgctgcttcagcatccagttccagatgtgaacggaaaaacaactcagacaacgctacaatatcggatgcagaagtcatctgttcctggtataaacgaacaagggccttagcccaatccagttgttccgaagacagttcagttggcaacagccccgctgcctggagatgtggaatcgccatactggcaattcgctcaggatcagcctttttaatatagtgattgtttaggtaagcaagcttatttgtatcaaacacagctggacttttggacaaacgattaggatcgaaaatcgaaatcagttgttcccgatcatagatctcttcttcgccttccggggaccagcccagtagtgcaatgaagttgaatatagcttctggtaaatagcccaacttgtcatactgctccatgaactgaataatggattcgttacgcttactgagctttttgtgatcctcgcctacaatcagcgtcatatgaccgaagcgtggcggttcccagccgagagcttcaaaaatcatcaactgccgcggtgtattggaaacatggtcttcgccccgtagtacatgcgatattttcatcaaataatcatcaaccgctacagcgaagttatatgtcggaataccatcctttttgacgataacaaaatcgccgctttccttggaattaaacgtaatttgacctttaacgatatcgtcaaacgtatattcacgatcttccggtacgcgaaaacgaatacttggtacacggccctctgcttcgaatgcctggcactgttcttctgttagatcacgatgttttccagaatagcgtggtgtctccccacgttccgtctgttcttcacgctcgcgctccagctcttcttcagtgcagtaacagcgataagccaaaccacgatccagcaaatcctgccagtacgttttatatatgtccaagcgttccgtctgacgataaggtccaaactcgcctcccacgtctacgctctcatcccagtccatacccaaccatttcaaatatttaagttggctttcttctccgccctcaatattgcgcttcacatctgtgtcttcaatacgaataataaattgtccaccttgattgcgagcaaacaaataattaaataatgccgttctggcatttccaatgtgcagatgccctgtagggcttggtgcatagcgtacacgaacttccgtgctcatataatctcctccaaattgaattactcaagatgatagcatttacttgataagacagacaaccgattgagccgcgattccttccccccgtccgggaaacccgagttgctctgtcgtggtcgccttgacgttcacctgggatagctcctctgcttccaaagcccgtgcaatgacttcattcatctgcgggatatacgatgccattttgggcttttgtgcgataatcgtagaatcaatattccccaagcgatatcctcgctctttagctagcccccacacatgctccagtagcttaagactgtcggcatccttaaattctgggtcgttatccggaaaatgcttcccgatgtctcccaagccaagcgcgcctaggatagcatcactaatggcatgcagcagcacgtctgcatcggaatggcccaacaaacctttttcatacggaatattcacacctccgatgatgcatggccttccttccaccagctggtggacgtcaaatccttgtcccactctgatcaattgatatcctctccctctgtttttacccataacgccgccatatccaaatcctcaggcgtagtaattttgatgttcttgtagctgccttgaacgacagtaaccggaattcctagccgctctatcagcatagaatcatctgttcccaagaatcccgactgctccgcttcctcataggctcgcagcagatcggaaagacgaaaagtctgtggcgtttgaatactccacagacttcggcgatccggcgttgctgtaatgataccatccccgttcacttgcttgaccgtatcctttacaggtactgccgctacagaagcaccagtacgctgagctgcctcaaggcatgaacgtacaagctcaggttgaatgagtggacgcacaccatcatgcaccatcacccaatccgcttgtaagtggcgcagaccgcgataaaccgaatgctggcgttcattgccaccagccaccacccgtacatttttaccgattttgtattgatgaatccaatctcggcagcgttccacatctcctgtcccagtcaccatcaccatttcatccacttcgggcatagctgcgaatatttcaagtgtatgtatgaagatgggcttgtcccgcaaaagcagaaattgcttactctcctgcgtccccatacgggagccgcgccctgctgccacaatgacaactcctacccgattgttcattcaaataactcctgccctgatcgctttggacgatccgtatgataacacatctacttcatcataccgcgtttattgagctttttccaataattttggtttagcaaagatcatacggccggcagaggtctgaagtacactcgtaaccagtacctccatcagagagccaatatagtcacgtccgccttctacaacaatcatcgtgccatcatccagataggctacaccctgcccatgctccttgccgtctttaataatctgcaccataatttcctcgccgggcaatacgacaggcttcactgcattcgccaaatcgttaatatttagcaccgatacaccttgcagttcgcatactttattcaggttaaaatcattagttacaactttaccctgcaacacctttgccagcttgaccagcttactgtcgacctctgaaatttcctcaaaatcaccttcgtaaatgagcacattcacatccagctctttttggattttattcaaaatatccagaccccggcgtccacgattacgcttaagtaaatctgatgaatctgcaatatgctgaagctcctccagcacaaattcaggaatcacaatcgttccttcaataaaacctgtcttgcaaatatctgcaatacgtccatctataatgacgctggtgtccaatattttatgttcctccagcttgcgttcttctacacccgttccccgaccaaaaaaaccagaactccaaaaggaagacagctcgtcccgcttttctagtccaaccatcaatcctacatatccgcatatcacggtaacagcggtctggataagttgacccggggcccccaaccatgaaaaaagcggataaactgctaaggaaagcgtcaatcccactgctaaaccaatcacacctgccatcatctcgttcatcggaattcgtaccaagccttcaatgccctgctgcaatcgatttgccacggatgcccctgcgaatgaacacccagccataaatagcactgctcccgccatcatccaaacaatcattcccggtaaagacccatcactcaaccattgtggcatccacgatacaatgcctcctacccgctggtataacgtatagccaaaccatgctccgcacaatcctgtaaaagttaaaatagcctttctccacattgagtctctatacctcctttattttctttgcatatagtctgctgcttgttggatacatagcatttctcttaccagtatgatccatttcctacataactaaccctgtgttttcactttttatgcataaaaaaaagcatttatctccctaaaatgattcaaggaaataaatgcttattcttgttcttgcttgatactagcgctgtgaatgacgatattgatcgtcctgttctttctgactggaacgctcccgatcacgtccacgtctgcgtgacagcttacgaatgttcagcttcataccatacaatgcatacagcaccagcggcacaaaaatcagcttcgacagctggtcagggaatttaacagccaacaccaccgctgcaattacgacccatggagcaacccagatcgcttttttcggaaggccgacctttttaaaattcggatatctcatggagctgaccatcaaataagaaaccagcaacatggcaatcgacatgtataacaatgaaatatcgttatggaataaggacaaagtggctaatacgccacctgctgccggaattggcaaccccgtaaaataacctggtacaccaggacgtacgttaaatcgagccaaacgcaacgctccgcacatcgggaaaatggcagtaaccgtccaagcgagagccgaattcgcatcatgaaaagcaaccatgtacataataactgcgggagcaacaccaaaagatatcatatctgataaggagtccagttctttaccgaattcgctttgggcattcaggacccgggccatcctaccatccagtccgtccaacaacatggcgacaataaccataatagcggcaagactgtattttccgtctacagccaataaaatggcgatcattccgagaaacaagttacctaaggtacacatgttcggaattgatttggtaatcatctcttcacctcaatgtatgaattgttccattataatcctttcactgtattacatttacatttgcctgtcaatgaaaacttgttcctgcaaacgtttaagaccttctttaatcgtacgcgcacgaacctctccaataccatccacttcatccaattcttctatcgttgctgtgatgacatgtggaaaacgtccaaaccgctccaccagattatgaataatcacattcggcaaacgcggtatcttgttcagtacccggtagccacgtgcagcaatatactcctctgatgtcgcagctgaagaagggtagcctagtaaacgtacaatatgattcacatccaacaattcatcgtccgtagaacgtttgagtcccaatataatttcacgaatcttctcgtcgctatcgtctttggcataatccttatacagcaaccaagcttcttcctcaatgttgctgacaagctcttccatctgcatactaatcagacggccctcatttccgagctcgttaataaatcgtttgatttccattttgatgcgcagcaccatttcgatccgctggatgacattaacgacttccggcatggtaaccagctcttcaaattcagatgctgtcaaattcgtagaggcttgccccaacacggatctatatttttctaatgtctgaatagcctgattggctttcgttaaaataactccgatttccttgagcgcataccgtaatgtcccctgatacaaggtaataatattacgccgttgggaaatagacacaactaatttgccagtctgctttgcaactcgttctgctgtccggtgccgaattcccgtctcaattgaagaaatggaggagtccggaatcagttgcgtattggcatataaaattcgttttaaatcctcgctcaatatgattgcgccgtccattttagccaattcatacaaatagttcggtgaaaaatcacaattgatggagaaaccgccatccacgacttccataacttctgggctatagccaacgaccagaagagcacccgttttggcacgcaaaacgttttccaacccgtcgcgaaagggagttcccggtgccacaagccgcagcaaatcgttcattttatccagttggctcgcttctttcattctcaatgccccctaatctaatgcggctgccagtgcatctgccaccgttcctactcctataatttgtatccctttcggatgtgtccagcccttcaagcttttctccggcatgatcacccgtttgaaacctagcttctccgcttctcgtactcgctgttctgctcgggataccgcgcgcacctcacctgtcagtcccacctcgccaaaaatcacatcatacggctttgtaggagcatctctaaagctggaagcaatactcacagctatagccaaatccaccgccggttcatccaacttcacgcctccggctacgttgagataagcgtcctggttttgcaaaaacatgcccatccgcttttctagcacggctatgattaatcccattcgatgatggtcgactcctgtgcccattcggcgtggagagggaaaatgtgtagctgcaatcaatgcttgcagttcaaccaatacaggtcgagttccttccatactggctacaacagtagaacctgccacacccagtggtcgttcagacaggaaaagttcagaaggattcgacacctcacgcaaaccgctttcagccatttcaaaaataccaatttcatttgtagaaccgaaacgatttttaactgcacgcaaaagccgatacgtatggtgacgctctccttcaaaataaagtacacaatcaaccatatgctccaacaaacgcggacctgcaatggccccttccttggtcacatgtcctaccaataccgtagcaatacctagccccttggcaattcgcataaagcgtgaagtacactcccgcacctgagccacactacctggtgcactcgtcacctcaggcaaatatacagtctgtatcgagtcgatgaccaaaaactccggcttcaagctgtccaccgcttcttcaatcgtctccaaattcgtctcacataatacgtataggctgggggacaaggcaccaagccgatctgcacggagtttcgtttgacggacagattcctcaccagacacgtacagcacctttaaaccagttaaagccagttcattagatgtttgcagcatgagcgtagatttaccgattcccggatcaccgcccaccaaaacgagtgaacccggcaccacacctccaccgagtactcgattcaattcgccaattcccgtcaaaattcgtgtttctttgccactctccacctctataatagggagtggcttgtcttttgtgctatgagtaagaagggaagaccccattccttgagtttttacaacgctttccgtttcttcgaccatggaattccatgcctggcatccaggacattttccgtaccatttgggcgattcataaccacattccgtacaggaaaatttagttttcactttagccatactttgttccctggctccttattgacgacgatgatgtcaaatttatgttcatacaacccagaaagagctgtaacaataaaagtttaccattgaagcttggcggacgtaaagcaatatcacaaactttcccaaagcatttacccaaccttttcaccgtgttttatacacaaaaagggtgtcttcgcaatagctttccagcttgcgagacacccttttctgctatcttatttagtaaactgctttaggacttggcagatacattatcctttttggttacagtcaatgcaccgttctcctcatcaatgaagagtgagtcacctttagtaatgttgccagtcaacagttcctcggacaggcgatcttcaatatgcttctggattgcacgacgcaatggacgcgcaccatacgctggatcaaagccttccttggcaaggaattttttagcgttgtctgtcaactcgaagtccacctcatactcattcaggcgcttacgcagctcttcagacatgagtgacacaatttcggcaatatgtttttcttcgagagaatggaaaacgataatttcatcaatccggttcaagaactcaggacggaagcttttcttcagctcatccatcactttgcccttcatattatcgtaatccgctccagcgtccactacagctgtaaaaccaagcgtggagttacgtttaatcgcctgtgcaccaacattagatgttaagatgatgagtgtattacggaaatcaacgacacgacctttggaatctgtcagacgaccatcttccagcacttgcagaagaatattgaatacttctgggtgtgctttttcaatttcatccagcaacacaacagagtatggcttacgacgtaccttctcagtcagttgaccgccttcttcatatccaacgtaccctggaggcgctcctaccagacgggacgtggagtgtttctccatatattcggacatatcgatacggataaccgcattttcatctccaaacatggattcagccaaagcacgtgccaactctgttttaccaaccccagttggaccgaggaaaataaaggaaccaattggacgcttcggatctttcagtccggcacgtgcccggcgaatcgcccggcttactgccttaactgcttcatcctgtccaattacccgctcatgcagcaactcttccatattcaacaagcggtgtgtttcttcctctttcagcttgctgactggaacacctgtccagattgcaacgacttgagcgatatcctctggggtaacttcggaatctgtacgaccctgttgttctttccattggtttttcgtcacgtctaactcttcacggattttttgctctgtatcacgcagcgctgccgctttttcaaactcctgactttgtaccgctgaatccttttccttacggatatcttccagacggttttccagctgtttcaggtttggcggtacagtgtaagaattcagccttactttggagcccgcctcatcaataaggtcaatagccttatctggcaggaagcggtcggtgatataacgatctgacaattttacggccgcttcaatagcctcatctgtgatctttacacggtgatgcgcttcgtaacggtcacgcagaccatacaagatttgaatcgcctcttctggagaaggttgatccactgtaattggttgaaaacgacgctccaaagcagcatctttctcaatatatttgcggtattcatccagcgtggtcgcaccgatgcattgcagctcgccacgtgccagagcaggtttcaggatgttggacgcatcaattgcgccttctgctccaccagcaccaatcagcgtatgcagctcatcaatgaacaacacgatattacccgcttgacgaatctcgtccataatttttttcaaacgatcctcgaattcaccacgatacttggtgcctgctaccacagaacccatatccagtgtcattacgcgcttgtcgcgcaacgtttcgggaatctcattcgctatgattttttgggccaatccttcggcaatcgccgttttacctaccccaggctcaccaatcagaaccggattgttctttgtacggcggctgagcacctgaattacgcgttcgatttccttgctacgcccaataacagggtccaggttgttttccttcgcagatgccgtcagatcgcgtgccagactgtccagagttggcgtgctgacattagctggagcaccgtgatggctggaaacagcctcgctgctaccgagtaattgaagcacttgctgacgcgctttgttcaggctaatgcccaggttattcagtacacgtgctgctacgccttcgccttcacgaataagaccaagcaaaatatgttctgtacctacataggtatggcccagtttgcgggcttcatccatagacagttcgatgacttttttggcgcgtggagtataggcaatgttcgtcggttgctcttgaccgcgtccaatcagcgtttccacttcatcctggattttttccagtcccagtcctaaaccgattaaggctttcgctgctattccttcaccttcacgaatgaggcctagcaaaatgtgctctgtgccaatgttgttgtgtcccaatcgaacagcttcttcctgagccaaagcaagcactttctgtgcacgttccgtaaatcttccaaacatcatatatcctgcacctccacagtgtgtatttcagatcattctatatattaaagggttgtgcctaatttttgccggatcagcttcgcccggtacatatcgcgctcttcggtattcattttatccccaaagcttttttgcaggaacccgggttgtgtcatcacattcagctcattcatcgctgcggtggaaggacgctccaaaattcctaaatctacgccaagacgcacatcggacagccgctgtgcagcctccttggaatccaatactgctgcatatgacaaaataccgaatgaacgcatcacccgatctgtaattcgcagcatagattcattcattagccgttctctggcagaacgctcgtgctcaataatttgtagcaccacgccatgtagattctctataatttccgcttcggtttgtcctagtgtaatctgattagacacttgaaacaagtttccaacagcttcgctgccttcaccgtaaatgccgcgaaccgttagacctacctgtgaaacagcagacaatatacgattgatttgatgagtcatgactaatgcgggcaaatgcatcatcaccgaagctctcatacctgtgccgacattcgtcggacaactggtcagaaaacctctccgatcatcaaatgcataatcaacatgcgcttcaaatgcatcatcaataatcatagcgcgttcccaagcttccctaacctgacatcccggatataagcactggatacgcagatgatcctcttcgtttatcataacactaaccgattcatcatcgctaattaaaacagcaccgttacgagattcgttcgccaaattaggactaatcaaatgcttctcaaccagcacccgcttgtcgatctcatccaactcggatattttcaatgtatgaaaagtaccaaaaccacctaaatcatcatactgaaggatatccgttaagcgttgaagtgcttcttccgactgctgattggtagcaagcatgggaaaaggcagatgctgcaagttacgcgcaattctcacccggctgctaatgacaatctccgaatccgcagcatcaccacgcatccagtcacttagcggcttctccgtaaaccgaatattgggcattacgcatccctcctactcttcacaaactttactcttcagtcatttctttttcaagctctctgatttgatccctaagctcagcagctgattcaaattcttcctgtacaatatgctgttgcatctcttttttcaaatcgtcaatttgccgtttaaccttcaggcgacctccagtgcgaactggaactttaccaacatgattcgtactgccatgcacacgcttgaacagagggtccagacgactatcaaagtattgatagcacgacgggcatccgaaacgtcccagcttactaaactgtgcataggtcatgccacaatccttgcattgcaggttttgcggaccactgtggcctggagactggctctttgtactggagtcaaaatccagcatccccgacaacaagctatgaatcgaaaagccgttaggtgttccagggatcatctcccctttttccttggcacacgtctcacaaatatgaaactctgtcttttcgccattcacaattttggtgaaatgcaaagttgccggccgcatattacattcttggcacagcataaaagcacctcctttaatgtcaggatttataccaatccctacatccaaacgttagtctcttttcacacactatttggtcgccagcaacgagatcagcatagccttaagcaatcttgctcgcagttgatcacgatagggaagcttcagtaataatgtatccctcgataaggcagccttcattagattagcttcccttttgcttaaaaaatgggcctcctctaactgataaatcagtccttctgctgccgattggcttatttcctccccgatgctctgatgaagatgtgtatggatggcatgctgtgcaggcagctgaattcgctgaatacgaatgtagcccccgccaccgcgtttactttccaccacatagcctttttccagcgtaaaccgggtgctaattacataattaatttgcgacggcacgcaggaaaagcggtcagccagatcattgcgctgaatctccactaaaccttggggactttccagcaatatactctttaaatattgttcaataatatcggaaacattgcgcatttcatcatcctccactaacggaaacgcaagtattcaagtacatttcacgctccacagagtccgccgtatattgaacttaaccaaacggtaaagtcacgaatctaagctgtattcaggctgttgcctgttctacattcatttgaattgtaccgttttgtctctagtgtggcctttatttgcgattagtcatacacttctcttattttcataaaaggcagttcctaactatacgcaaatcatttcgatcctcgtttgcttctttgctatcaaaattactttatacggcccaccaaaatacttctacagaatctcaggaggtttgattgactttgactttctttgactatattcatattatagcacattattcatttttgccaaggggtcaataccatttttcgcaatctaattatgttttatacaataccataaaaaactcttcccaattacagaaagagttttgaaaattataataatcacacatattccctgaaaaacggaacataagaagatctaaatgggcctttatcagaaaaaatctaataaaaacgtttgttttactggtattacacgtttaagcgcagacacagattcactgcccccttcaatacgcccccacttatacagatcatcagcctgctggtagccaagcatcagagtcgtcagtgactgaatcccaagtttcaagtcagataccatagcgttttcagatgaattgcttgtatccactctcaccagatgacctttcccttccgtagtaattgttaatctccatactccttcattccatggtgcataccgatcagtcagatttaaggttaaacgtgttacctctccaacctgctcaaaagggtatctttctacaaaagcagctgcatccacaatacggcccataaaataaggcacggtctcctgttgaattcgcggatcatcaagtaaaaatggcagattgtcatctgctggaacgtaaataaatttaccatgggttatcatggagtcatgatttgcaaaataagtccataaagcctgacgggccgtctcattttcataaaccaactcatcacaattgaattgtttatcttcaattttgtacagtgcatatccctgaggatcgcctgtttctgagtaatataccgcagttcgatagttctcatttaaaatccgctcttgccaccattccttatctcgtaccagcgtgccattataacgagatgcaaacgcttgatacacttggtccagtgctaaaatatctttgacatcgcgtttgactgtaccttctgttttaagttttgcagggaatttatcaatgggaatgacgtactttttgtattcaatatacgtttcccatccaaatttacgatagaaggcaaaggagaagggatgcagaaaagaaaggctttgtcccgcagacttcatctcttcaagcgcatgcgtcaacaaacgtgaaaccatgcctccgcgacgcttttctggccatgttgccacaccagcaatgcctcccatatcaaaaacctgaccgtttatgtatacctgtagcggtaacaaagtcagtttagcattcaagtcatgtccgtcgaatattccccatgtttgctcaggtttgaatttcttcttggatttttccaagtcttcctgggacattgtaaactgaaaagcatattgggataattcaatagccgcttcaaattccttacgttgtaattgtctgatctccataacttcgtcacctcgcttgtatacttgggcatccataaaaagattacacacttagagtgtggcaaaccccattctctctgtcaaccttagaaacaggtggtcatctaaaagcgcacaaaaaaaggatgataatctcattgagattatcatccttttcacttttgcttggcgacgtcctac

SEQ ID NO: 37 - DNA, 40451 bp, Unknown
  Kingdom: Bacteria, Phylum: Firmicutes, Class: Bacilli, Order: Bacillales, Family: Paenibacillaceae, Genus: Paenibacillus
aacaaatggggtgcagttcatccatggctgcttttttcctatgagaagcaaccaaattagaacctctatttaagctttgtgttacctggatatagaccgtattccttagtcagagcggtctatttctttttcacgtaggtaagcaatgccagaatgaacatgccaaacatgatcatcaaggaaatcgcgtctttaacctccatgggcatcacctcccttcggggagactagccgaccgctcttttagccgtatgttatattagcaaagtataccataaaacaatcgcttttaagagtgaaaatacttaaatacgtaattatgaaaacaaatgacccgactaagatagacattatcttattcaggttattttacgacggtagctccttgacatcctggaaaggcattcactataattcagatagaaatcgcttccactcttctttctattcattttgtggaaccggttccttgaaatgtgtagctaagtcccattcactatttatgaatgtaatctctaaataaggtggcatcgttatgtttaaatggttgaaaaagaaggcggctcctcgtattgaagaattcgacatggtagcaccaatcaaaggaaaagtggtttcccttgaagaggttccagatcctgcgttctccacgaaggctatgggggaaggtatcgctattcatccgactgaaggtaaagtgactgctcctttcgcgggtaaagtggttcacgtgatggagaaaagtaagcatgctctgatcattgagcatgaatccggtgtacaaattttgatacatgtcgggattaatacagtttccctcaaaggacaagggtttaaccctcacgttcaaacaggagataacattaaagcagggcaattactgatggagtttgatctagacgcgattcaacagggtggcttgcctgtaattactccggtaatcgttccagacgggcaagagatgatcagtcatgtggaaatcttggaaggtacatctgcctctccagaagtccccgtattaagagttcacttaaaagcctagttctccttcagaaaagactaaccagtaattcctggttagtcttttctttagatgattcactgactggtcaaggatcgggtatgaccatgtgatcaaaagctaggattcacatatttcagatatccgctgattacaattgccttcgtacagccctccatgaaagcagatcacttttttaatatcatatggcagcaggtttttaagagattctttggccatattgaaatcacagcagtattgcggatctggagccaataatttgccgcttaccacgcgtagagcatctcctgcaatcagggtttgactggatttatgatagaaacttaggtgtcctggtgtatgtccagcagtatctataactacgatccccccacagaagggtaattcctctccggcaacgatggtggagtttacaatagcctttgggggattttcaagtgtacgccggaatgcgtgtctccactctaccggaacggattcgggcatggcgcttacagcttgatctattgcttctggagtcagctttataagctgttgttctccctgtatataaggcttttcgatagaactggctaatacttgaactggggatgaagaagcccggattatatctgctaaactgccgatatgatcaagatcctggtgtgttattaatatgaaggtaagtttatggattgttaatccggtgcctagaatagcctcatgcaaaagtgagagttgcccggggtaagccgtatcaactaaaatcatgttatcttcgtcccacattaaagtgggatgaatactctctatactttccataatgttagcagaaacctggagcatgtgtattcccttgtctaattgcatcgtatccctcccataagagttgatgtaatacaaaggaatcgtatcatgaaatataaatatgtaaacctatattatatcacaaaaataattatttgtaaatatgtagaattttaaatttgtgtgacagttaggagtgatgacgtgaagaagatttattttgtcagacatgcccaagcaacaggacaggaaccagatgcccgacttaccgatgagggtacccgacaagctgagcagttagttgattttatggagaacgtaggtgtggaatatattgtgtccagcccgtggaaacgggccgtgcgaaccattcagcccttggctgaacggaaacagttgcaggtgtatactgatgtacgtcttcaagaacgggtacttagccatgagcatttggaccattggctggacgtgctggaacagacctatttggacgaggacttgaagctggagggaggggaatcatcccgtgaagcagtagatcgaggaatccagcttgttcaggagcttatagagcgggcggaaaaaacggttatcattgtaactcatggagctttactatctcttctcattcgacattacgatccgcagtttgggtttgaggactggaaaaagctttcgaatcccgacgtgtatttgctagagctgaaagaagcagaagccaagattcacagagtgtggaatacgggttgaaataaataaagcacgttcaccataagtgcagaatgaaatcgaaaggggaggcgcatgttgaatgcaaaccgttttttagaattagaaaaggcgttgtttcaagcttggtctttggagtctagttctaaatggacagcaaataatcctgcggctggacaatgtggtgtcacagcgcttgtcgttcaggacaggcttggcggcgatattttgaggacatggctggatagtggctggcactattacaaccgcattggtgaggacattatagattttacgaggtcgcaattttcaagccttcctcagtatcaggatgtatactccaaccgggaggaggctttttcggacaccaatccagagcagtatgcagccttaaatcgaagattaaaggaatttatgaacgaagaagaataaggggatttaaatctggatgcagtcataaagacgtgatttttgaacctgatccaatggaaggtactttttgttgcccaatatacattaaagagctgagtaatcagtaaaattcttgaagataaaagctgtatttacgttataaaatgggctatactgaggtaagaatagtaaaggagtcgtgcgctaacacgactccagtatacaaccactgcttaaagagcagtcggcagtagggtccaacaatagaccgttaccttggatcggggcggtctatttctttttcatgtaggtaagcaatgccagaatgaacatgccgaacatgatcatcaaggaaattgcgtcttgagatattaattacttaattacgtattttcttggagagtactataaaataaactctaatgcagccaatgaccgggaatgcttagagaagggggcagtttggttttacaattgcccttagccgaatttaattgcgcctgtgtaagaaagatacttccttccagattagccccacttaaatcagcatctctaaaatccgtaccgatcaagtctgtcattctcagatcagcctctcgcagatcagcagcaataagtaaaactcctctcaggttggtacctctaagattagcgcctctcaaattggccccgataaggtctctactcctgatttttttactatatttattgtgctccacgtttttcttacctttttctcgtactaactcacttgtttgtaaaagtaaatcattgactaacgccctatgggttggtacatgaagatttatgagggattttggatcttgatccgtaagctgctcggttttcgccatagctttttgtaagtctgtatagatgggttgagtttcttttaagttaagggcttcattgaggtaataaagcatttcatgaagctgttgcatgatgggaaatatattgaacatttcctcagctattgccggatcgtctcgccagctttttcccttgtatgtaacttgggaaactttttgacctgctccaaagcaatcatataccgtacagcctcgcaagccgttgtttcttagattcttatgaatatcacaacgataatccgcattgaggttttgacaaggggttcctccatccttattaaaagcaaaatcagctgattttgcataaggcaaggctacacagcataaaccaaaacattgttcacaatttgcactatacaataaacacacatccttttactggcacctattaaatgtaatattaccaaaaaaagatggggtatagtatattgttttttcatagacttctagagtctgctggatcgtttagagaagaaatctagtcttttgccaggttcaattgccatgagactccgtatttatcttcaacccacccaaattgttggcttacgggagaggcttcaaggggcattagaactcggccttcctgagatagctggtcaaacacgctatggatttcttcttccgaatcacaagtgacgaatagcgatagagctggggtaaaagggtgtttgtcctgatggttatagtctatagccataaaagtctgccctttgaggttgaatacggcatgtaacacggtcccatcttcctgatgaaaaatgctcatgataccagacggtttaaatacagaggtataatattgcatggcttcttctgcttgaccggagaacatgaaaaatgttgtgatttttggactggaatcatgcatgagatcaactccctagattgtatcgtagatgataacatctttcctcttttttaatagaaatattcagcattagagaagtgcttcatgaagatgtacacacgtgaaaggagaaagacaggataatggacgcgacagcaagacttatggatatgtacggctcagctaagaagctggatgccagcatcatttatgcctatacggatgtggttgcccaatatgggacagtggaggatgcgtgggagttatataggctttttgtagaagatccctatcattatatccgggggttgctcctccagccgatcatgagatgcggggatgttactttggcgcaggatatgtacgagcgttacgtccgaaatcaggcatccccagaacatatacctgacggtgtgctgtatgcgctaggttatttgggttatgtggaggctgctgctgatctcgtcgctttggtgaacggaccgtatggagctgtgtctgtggatgcctgtttgggactggtacatctcccatgcgaaccgtatcgtgagaaactggcggctgaattggaaaaagcgctggatcagaatttgtttaatgaattcttacctctgttaagcttcaaatgcacgactgaagatatgattccgcgattggtacattggggagagcaacatgcttccgtagactgtaatgcaggaattattgctggaatcgcattgtttggagaagggcagaaggatacaattcgatctatcctgtggaatccgttttgggaggctcatggaacggctacaggcagttgtgtgtggtcttattttgctatgcagcatgtaggactaacctttagggagcttgttcaggatataaaaagctacgatacatccaaagaagatgtacagacattggaataccgtttggacgtgctatatgagatgttggaactaaagctaagctatacagcccgaccgatccggttcgctcgcagcaatgaggaatcatttggtcagctatatagcgatttgtttagctggtctaatgaacatcacgatgactctattataggctggatgaatgaacagttgggggttgagcaccgactactggaacggtattatgagctaaggaaacgaatcgagattaaaatggtgcatgaaattgagctggagcatgttcagaaagggagttaatcgtatcaggaaataagaatttttgatgtaaaaggacgaaatggcggagtttggcggcgatatggggattcgcccagtccgcgggctgatgtcccgcataggatacatcagcctagaacacaaggagtgaaacacatgtctttactgccacaagttcctttcggaacgcaaccgggtactccgggtcctttcacgccgtcaagtccttcgattccacaatttcctgatatgcaggattccttcccatctccgataggtccgccaccaggcccaggaccattttcgccacagccgttctcaccaccgccgcaggggccattcggtccgcaaggtgggcagcaaactcaagcaccaacttccccaccaccgcaatttacgccaccgaagccgctggtttcggcgtatgcggttgaccctggagccatctttggttgtttgttccgcaacacgtttgtatggctgacgaacggagagcgtttctggatgtaccctgtctttgtaggcaggacatccgtagcgggttttcggtggagtggacgtttttggttttattatggtgtagacactaaccgtattgagtcgtttagctgttattggtaatagcgcagctttagggaagagcggggcttaacgggatgatggctgatggcactgtcaagagaggtaaatgggcacatgaggtaagtgaagcgaaaataaaaagactgagagagcgctcatcgcgttcccccagtctttttttgctattaatccatccaccaacgtttgaaattgccccaccatgatttcttttcggcttgtcgctccgcttggtcagttggtgttgatgccggtgggttatcttgccccgacagcgtctctttcggctccgtgccgctgacaaatacctccagccgcttatccgggctatccggtgcagccagtttgccgctggccggatcaatataagcgctgactacgccgtcggggataggaaagattttgggcggcacattctccagagctttctccgtatattgcgcaaaaatcggagccgcccgtcgggcatcctgtgtgctgatgtccttgcccttgtcatagccaacccagacagcggtggatagttcgggggtaaagccgaccatccacgcatcggtgttggtcgtgccgctcttgccggcaaccgggcgcttgatcagcttcgcgacccggttgccggtgccgccttcttcgaacacgccttccatgaggcgtgtaaggacataggcggaggcgggtttcaccacctgcacgggcgcggcttggggcgcttcgtacagcgaccgcccggccgcatcggtgatgcgcagcactgctaccggaaccaccttttgcccgccgctgccgatgaccgagaaggccgaggccatctcgaacgggctgacgggtgacacacccagcgccagcgaaggtacgggcttgagctcgcttgtaatgcccattttgctggcgaggtccatgaccttgttcgttcccaccttcaaaatggtgctaacggcataaatattatcggacgccgcaattgcgcgccgaagatctatttcgcccaagtatttgtctccaaaatttttgggcttataggtcttgcggttgttatcgtagtggaacaacgtcggtcggctttcgaacttggacgtactcgtcaattcgccggaatccagcgcgctcagatacataatcggcttgaaagcggagcccggctgccgggttgtggccagcgcatgattatattgattcccgacatagttcgttccgccgaccatggccttgacatgtccgttgcgcggatccatggagattaacgcggtttccagtccgttgctgttcttcatgccttcgtttacagccgcctcggctgcctgctgcatgtgcatgtccagcgtggtataaatgctcaggccgccatgctcaagcaccccttcgctaatcccaagttgatgagtcgccagctggcgaacgtaatcgcggaaccagggagcggtttccactgtccggcgctggctctcgggccgcagggcaagcatttcctcataggccttggtggcttcagccggagtaatcttgccagtgagcgccatcgagtccagtacaattttctgtcgatcctttgcatttttcatatgattatacggtgaatagtaggtcggtcctttcggaatacctgctaacagggcgctttcggccaaatccagatcttttgcggatttaccgaaatacatttgcgaagctgcttcaatgccataggcgccgtgaccatagtaaatttcgttcaaatacatttgcagcagctcattcttggtgtacttcatttcaagctgtgcggtataaatggcctccttggctttgcgcgtccacgttttctcatgagataagtacagattccgtgcaagctgctgagtcagcgtgctggccccttgtgacatatcccagcgggtcagattaacgattaccgcccggcccagacctttgaaatcaaagccaaaatgatcgtaaaacttccgatcttccacagccagggtagctgcaatcaaatcgggtgaaatgtgatcaagctggaccggaatggattccttgcctccagcagagaaagtggcgatgacttgcccctgactatcaagcagtcgtgaattccgatccgtatccgcgagcggaaggctagtcgtgtacaaataggcgagcaggatgcaggcggcgatgaccgtcagaatagtgagagacatcattccttgaaagcatcgaagccaaagcggtttacgcttgggggatcgcccggtcgtatcggtcatcatgccacctccttccatagttgatgttctcagtatagtcaatccgaaagcgtctattcatcagatgcacgtacgtagctattttaaacaagattaaatcttcatattgcttttgcagcccattcaggtatcacttataatgcaaaaagtgtgaaaatccaatgtgtttggtacaataaatatagcaaactcggcgtttgcgtgttgctgatataaggaaagtcaacgtttatgctaccggattgccggacacatactttgatcagaaagaaggttggaatgatggacttgtggtttacggagaagcagactccctctttcggcattacagcaaaaatcaaacaaacctatgtctctgagaaaacggattttcaggatctggctatgatcgagacagaggaattcggcaatatgcttgttctggatggcatggtgatgacaacggttaaggatgaatttgtgtatcacgaaatggtagcacatccggccttgaatacacatccgaatccgaaaaaagttttggttgtgggcggtggcgatggcggcgttattcgtgaggtcatcaagcaccctgaagtagaaaaagcggtattggttgagattgacggtaaggtgattgaatattccaaaaaatatttgcctgaaatcgcagggaagctggacgagcctaatgtagaagtgctggtcaatgacggatacatgcatattattgaacacaaaaatgaatacgacgtcattatggtcgattcgacggagccggtaggtccggcagccccgctgttcgagcgcgggttttaccaaggtatttttgaggcgttgaaggaagacggcattttcgttgcgcaaacggataacccttggttcaaggcagacctgattcagaaggtcaacaaagatgtgaaggaaattttcccgattgtgcgcgtgtatggtgcgaacattccgacctatccgagtggtctttggacattcacgttggggagtaagaagtatgatccgctcgaagtagacgagactcagattccagagatggacacccgatattacagtccgcgtctacacaaagcggcgtttgtactacctaagtttgtagaagatttaacgaagtaaacattttaaaaagcgccttagtggtctttattgcctgtttttgggtggaaaagagcgctataggtgcttttttgtgttggataagttttgaaaaaggctataaaagcatactggacagcggatttccttttaagataaaagaaggaaatttaagggtgtgcgtagaatatacaaaaaaccagacatttaacagatttgtaatgtcaacagggacggtttggttatggaaatacataaatcggcgatgtaccaaagagggggaaacttttttgatcagacgctctttttattacctgtgggggtctcagacaatctccaacgtagcagatatcatctacatgttgagtgtagtggtattggtgttcagttcaagtaattccttaatgacgactattttaattccgttgttccgattgtctgcccaagtacttagtgggctcgttgcaccgatcgtccttggccgatttcagctaacgcgcgtgttgctattttcccagtttgggcagtttgtcatttttacggtgctgctgctttatttgtggatcgtacctgagcagaggtcgtttctatttatttttgtgatggtgtttggtatgtcttttctggatggctggacaaatcccgcgcgtaatgcgcttgtaccccgtttggctacgggtgaaggactaatgcgggccaacggcatggtagcggtcagtgatcaggtggtcaagtgtgcaggctgggcgttgagtggaattattgtggcttggctgggttccctgaatacgcttgtgatcgcatcctgttgttatcttgtggctgtaactgtcacgtccttcatccgtgatccgctggaccagaaggaattaagtcttgaagcttcagattcctcaacaaatctagtagaacctgaaaagggaaaggaaaaaggctcccattggaaagagcttggggaaggctggaaaatcatttggcataaccgtcgtattcgctctctgatgatcgtcgatagtgtggatagtattgggggagtctcctggctcggcgtatttattttggcgtacgtcagccaagtgctgcatcgggatgcgagctggtggggctttatgaatgcgtcctttttctcgggcacaattttgggtggattgattgtcgttggtttggtcaagcgcttgcaaaagaacagctttttatacatgctcggagcgttgctggtgtatgtactgattacaattgtatttgcgctgaatacaatccccgttgctgcacttattctttttgctgtatcaggcttacctgttcaaatggcagggattattcgccgcaccttgctgcaaaccagtgcaccggcagcccagttgcccaaagtgatggcaggaattgatgtgattacaaatctcgctttcggtctgtccttgttattcatgggctggtatgcagatcgtttcggtatggtgcaggtgtatttgttggctgcgattatgacgaccattgctatcttgatcggctggttgtaccgcagggattttcaggaaagtgagcaaatggatcatccaaccgctacgggggcaggcatttgagctttgtttcttcctgtgtcacaacaaaaaaagccgattgcataagagcaaccgacttttccccttaacccgcagtgttaggctgtagtgaactggctgttatagagcgaggcataatggccgccgctggcaagcagtccctcatgggtaccgctttccacgacatcgccgtttttcatgtataaaatcaaatccgcttcgcggatggtcgatagtctgtgggcgatcacaaagctggtgcgtccggtaatcattttcataaatgctttttggatacgcgcttctgtcagggtatctatgctgctggtggcttcatccaggatcagcataggtggatcgacgaggatcaccctcgcgatggtgagcagctgtttttggccttgcgacaggctgtcgcctgacccgctaatgaccgtatcgtagccatgaggcagtcgcttgatgaagctatgcgcattggcagctgttgcagctgcgatgacttcttcatccgtggcctctggcttcccgtaagcgatattgtcccgaatggtcccgctgaacagccatgtatcttgaagcaccataccaaagttagtccgtaggctgtcccggctcatgtcgttgatattcaccccgtcgatggatatcgagccgctgtctacatcgtaaaatcgcatgagcagattgacgagtgtggttttgccagctccagtctgcccgacaatggccacacgagtgcctggctttacctccaaactaaagttcgtaatgagcgtacgttccgggttataggagaatttgacatgatcaaaaagaatcgtgcctttgctgtgctccagctgtacggcgttcgatttttcgggctgctctggcggtgagtccaaaatagcaaatatgcgctgagcagaagccgtagctgcctggaactgggtcagcacacccgtaatttcattaaaaggcttggcgaacaaattggtataaatcagaaagctcgacaatccgcctaccgagatcccacccaaaataatggagatacagccaatcatggcggtgactgaaaaagtcatgttgttcaccaatcgggtagaggggttggacagtgatccgtaaaactgcgatttcactccggcttgatacaattgttcgtttctggccgaaaattcctcaagcgagcggttttcataatgaaaagcggtaactacccgttgcccgccgatcatttcttccacataaccgttcaggcttcctaaaattttggcctgttcgcggaacatacgctgcgatcttgtggtaatgaaccgtgctacgccatatgtgatcggggcagacaccaatacgaccaacgtcatgatcggactgatatacagcatgagtacaatggagcctataatcgtaataatcccggtaatcaatgtggaaaagccctgtagtaatccatccgacacagcatccatatcgttcacaaaacggctaatgctgtctccttgtggatgagtgtcatgaaagcttaatggaaggatattaaaatgatcaaataactcccgccgcatatcatttacggtctgataagcaatacggttcgtcaaatacgtgagcagccagctaaatagactgcctacaacatatacaatgcctaatccagctagaatctgcgcaatacctttaaaatctactactcccttatccaccatatggtcgatagcctgaccaatcatgtagggtccgatcagactggcaagcacgctgagaactgcactgacgatgacccaacatgttgttgttttatattgacccacataggttaacaatcttctccaggtttccttgccactcattggtctacctcctgcgttgagagctgggaatgattaatttcctgatatacatctgagctgctcatcaactgttcatgtgtgccgataccaacaatccgtccctcatcaaacacaattattttatcagcatgctgtacgctgcttactcgttgcgagaccaacaggacggtcatgctggtgctattttcccgtagcgatttacggagggcggcgtcggttgcaaaatcgagtgcgcttgaagagtcatccaaaatgaggatttgcggattgccgacaatagctcgggcaatggtaagtcgctgcttttgtcctcctgacaaattaagcccccctcgggtgatcggagcatcgaatttctccggcaggttggaaatgaactcatccgcttgcgcgattgctgctgcttgagcgacttcctcatcggtggcgtgttcatgcccccaacggatattatccgctatagtaccagtgaacagcagtgccttctgagggacaattccgattttctgccgcaattgctcgagcttatattgccgaacgtcgatgccatcaacctgcacacgaccctctaccgcatcatagaagcggggaataagattcacaaaggtggatttcccagaacctgttcctccgatgatgccgaccgtttcaccgggatagatgtttaccactatatcgctcagtgccagttgtcctgtcttattgtatctaaaggagacatgatcaaaagagatggctggtacagcgccatgctcacttgctccctccctgtctatagatgtagaagtagcagcagtgtcggaaatcgaagcttgcgtgtctaggacctcctgaatacgcgctgctgaagtggcagctttggtgaacaaaataattaaattggttaccacaatcagagccagtaaaatttgcgtaatgtaattaataaaggcaataatctccccttgtgtaagagatccatattggatatggataccgccgatccacaggatagcaataatagctccgttcaccaccaacaaggtggcggggcttagcaaagcagaaatacgtccgacacgaatagcagtctgggtcaggtcatctgaggtggcattgaactttcctcgttcagctcctcttttagcaaatgcacgtatgacccgtacgcctgtaagattttcgctaagtaccagagcgattttatcgagttttttctggtatagccggtacaggggagaagccttcgtaatgacaacatacagaatcaaagccagaatcggtgtagccgccaacagcaccaaagcaaggcggaagtccagaatcatggacatgataatcgccccgatacaaataaaaggagcacgaatgaccaaacgaatcaacatcgctacagctgtttgcagctgattgacatcattcgtaatccggttgatgagcgagggtgtaccgaatttatcgagatcagcataagaaaacgaagaaatatgcttaaacatcgtattgcgcagcgtagttccgaatccttgagaggcacgagctgcgtaaaactgacacactaatgaactgccaaagcccagtatagtcatgagtaacatcaaaagacccatctgccaaacataatgggtgtctcctttacctacgccatgattgatcattaaagcaaccatcgtaggcagcaatagttccaggatggcctcaatcagtttaaacagaggcccaagaatcgtttcctttttatagggtttcaaaaaaacagcaaatttcagcaaataaaccatcacctaacctgaataatgtatatagcctcatgccgcaatagcataactgaatttgattatggcatatcccaaaccatatgaataatatttaatatatattagaggtataggttttacatatatcagtaccggaggtccaaaatgatggaattgagacatctcaagtattttttggcgatcgcagaggccggacagattacagcggcagccaaaaagctgcaaatcgcgcagcctcccttaagtcagcagctcatgcagctagaggaagagcttggtgtaaagctcgtgcatagaggctcacgaagcatccaattgacggaggccggcatcattttacagaacagggccaagcagattttggagctgacagatgccacgacaagagagataaacgattttgccatggggatgaaaggtacgctcaccattggaacggtctcctcctctggggcaacgctgatgaaagacaggctttccgaatttcataaaacctatgcgggtgtaaaatttgaaattcatgagggaaatacgttcatgattctcgatcttttgaacaaaggaattgtcgaggtcggtatcgtcagaaccccttttaatactaccgatttagggtgtagatatgcgtccactgagccgatgatagctgtgatgacagaagaatatgactggaaccccgaacagaagaccatttcattgtctgagttgaagaacaggccgctcatcgtatatcgccgctttgaacaattgatccacgatacctgtatgaagcatggctttgagccaaatttcttttgcaaaaacgatgatgctcgcaccacgcttcactgggctaatgaagggctggggatcggtatgatttcgcggtctgcgttgtcactcggaagcaataaccagttaatcgttaaggaaattatgtgtgaggaattgcatacgcgtgtggcggctgtctggctgaaggataaatacatgtcttctctagcctctcgattcatcgaaagttttagccaagcatccgatggagctgacttaaggtagctgaattttttggatgaaagcatctttttgtaaaaactcatttgaattgcaatcgggaactggatatagtagtacagtaggatagcaatagaatggagtttgaatacatgccacataatgcaaaggtccgaatccgtcttcatagtcatcatgacggagaagatgtggtacaggaacttcccggagaagcgatcgtgcgtgggaagcatctatatataaggtacgatgagccgcaagaaagtcctgagggcggtacgacacggaacacagtcaaaatcggatcggatgagctaaagctgattcgtcacggtgaggtacaatcagagcagtcgtttgcgctgggacgcaggttgcctggattttaccgctcgccttatttaaacctgaacatgtctgcgcatacgcagaagctcgatattcggatggatggtttcaccggacatgtgagctggacctatgatctgtacgtatttgaggatttctcggggcattttgccatcagtttgcatatacaggaggagcaataatcatgacaagcaatccactggaacttattaatcaaaaggtgacttcagcaatcgaagcggcagtgctggctaccggaatcgtgagccgcgaagagctgccgaccattacgctggaggtgccaaaggacaagtcacacggtgatttggctaccaacgctgcgatgcagctcacccgcattgcgaagaagaacccacggcaaatcgctgaagatttgatcgcgaatatggatttagcttccgcttctattgaaagtgcggaaatcgctggaccgggctttattaactttcgcctgaacaagagctacctgtatgcagtcattggacaagtgcaggagcagggggcagattacgggcgtatacaggaaggtgcaggcaaaaaggtacaaatcgagtttgtcagcgccaatccgacaggtagccttcacttaggtcatgcacgtggtgcagccgtaggggatgctctctgcaacgtgcttgattttgccggatacaaagtaactcgtgaatactacattaatgatgcgggcaaccagatttacaacatgagccgctctattgaagcgcgttatttgcaggagctgggacagcctgcggagatgccggaggatggttaccatggtgaggatatcatcggatttgccaaggaactggtggccgaaaagggcgattctctgttgtccatggaaccgggagatcgcgcagcttatttccgtgactacggtctggaaaaggaactgaacaagatcaagcgcgatctggaactgttccgtgtaccttttgactcctggttcagcgaaacgtcgctgtatgaaaacggtgaagtgcttaaagcgctgaatgagttgcgtgaccgtgaggagatttacgagaaggacggagctacatggctgaatacgaccaagtacggtgacgataaagaccgtgtcttgatcaaaaatgacggtacatatacgtacctaaccccagatatcgcttaccatcgcgataaatatgctcgtgggtatgacacgatcatcaacatttggggagcggatcaccacggctacattccacggatgaaggcagcaatggaagcactgggcaatgatccagataagcttaaagtgctgattgcccaaatggtcagcttgttccaaaatggggaaaaagtaaaaatgtccaaacgtaccggcaaggccgtgacgatggaagatctgatggaagaagtaggtgtagacgcgatccgttacttcttcactatgcgtagcatggattcgcacctggattttgacatggatttggcgatttccacttccaatgagaatccagtattctacgtacaatatgcgcacgcacgtgcatgcagtgtatatcgtcaagccgaagagcaaggtattgctgtgctgccgttggcagaagtcgacttgtccaagctgacggctgaacatgaatacgatctgctccgcaaaatcggcgagctgccggaagaagtatcggtagcggctgcaaactttgcaccacaccgtatgattcgctatgtctacgagctggcttcattgttccacagctactataaggcagagcgcgtcatcacagaggatgccgctcaaacgcaggcacgcttggcgttgtttggtgcggtgcgcacgaccattgccaacgtactgaagctggtgggcgtgtctgcaccagaacgtatgtaagcaaacaacttaacgtaatgaccttgtagtcatataattaataataaaaggaaccgttcgtatcaccctcaacagggtggcgcttcggttcctttttatgttggattagcttagtagcgttccagtaccaagttcgttttcagggaatcggcgggaaccagccatcctttggattgcagcaggttcatcaacttggtgcggttgctggcggcaacactgtaatccgaggttttgaaggagatttcgataatatgctctgtacctgatccgtttgcgctgcgaataggccatatttcaacgtcggtatccaatccctgaaagctaccctcgtatttactgacctgtacaggaccgcgtactctggagtctgccaaggtttgtttgccccaattgctgtttttccagttttgcagcttgcccggaagattatcctgcagttgctttaatgcttgatctggggaaggcagagccaatcctttggaggcgtttgtttttttatcattggagaagcttagtgtttgcttgctgtatccccaatccacctcagcctcataattatcatcagatgcgctgaacccttctttattcgcttgggtgagcgccgcgtcgatatttccatttgtgaccgtatatcgctttttgtaggttaattcataattttttttgtcctcttttttgcgaaatctcacgttccagccctcgtcatttaattgcaatgagtttgtatcaaaatactcgacgctcaatcgttgtgcatcgttgctaatttgaaactcgttcacgatgccactttttaatgagccatccgcattgaggacctgagccgtatccagtagtagcttcacctcatagcttggtgtggcattggcggcggcttgtaccggttctgctcctttccatcctgttacgagcagtactgcactcagagttactaccgacatcaatttggtgatacgaaggcctgttttcatttcatcctctcctgttcgtccgaataggttacacgctacactttacgggtgtattgtcagtcgtatgtcaaagcaagaggggactccggttaaaaaattatataatttctatatgacaggtaagatttaatcttggttccatgataaatattcagtgaatctgtgaatgagcgccgagcgatgacggtctttgttgctgaccatatagatgtaccgctcaacagactgccccgggataggtcttacaaccagtaagccccgctcaacctctgactgaacggcaatgcgagagacaaaagagatgtgttctcccagcataaccgcctgtttgatggcttccagtgaatccagctccagataggaaggaagtcgccgactcccacgttccagccatttgtcggtcacatggcgtgtgctggactccttgccatgtaatacgaaggaggaagaagcgataagctcaggcgtcaaatcggtttcgttggcgagcggatgagtgggtgagcagatgagtatcagttcatcttcgcccaaggattctgagagtagcgttggggattgaaacggctctgccgaaatgatgccgaggtcaatttcgtggcgagcgagcatgtccttgatcacgggcgctgttttcacagacaaggcgatgtgaatgcccggatgctcacgggcaaagcggtgcagcacagcaggaagcaagtaggtagcgggtacatagcttgcgccaatacgtatacttccccgctggagcgtatcgaactcgcggacgactcgctcagcttcagcagccagtgcattaattttgctggcatagtgcagcagtgcatttccggcatccgtcaggatgattttgcccatacgtgtgtcaaacagttttactccgaattcacgctccagatttttcatatgaaaagtaacggtgggttgctttaggccaagaaactcggcgaccgtggtaattttatggtgcttattcagcagctctacaatatgtaactttagaagacttaagttcacttagaatgcctcgctttcaggttaatcgaacaatcatgcctatttctatgggtagcagcatcaatcccctctatatagattaaatctatgagtgttaacacaattcattgaaataattaattttgttttaactttccaataacacaggttgcgaattcaagttttacactgggatcagtcagaagaacaggcaggtaatgcgatgaatcaggatctatatattcacggattaagtaaaaccttcagccaaataaccgcgctgcatgagacgaatctggtagtacgacggggcaaattcacaacactgctcggaccgtccggctgtgggaaaacaacgctcttgcgcttgattgctggtctggagacaccggataccggcacaatcacgatgggagaggaaattcttttttcggcagaacgcaaaaaggatattcccgcccatctccgccactttggcatggtctttcaggatttcgcgttatggccgcatatgacggtgtttgaaaatgtggccttcggcctgcgtgcgggcaagcgagggaaagggttcgccagcgtacgagacaaggaactgcggaccgtggtgctggaggcgctcgacatggtcagattgtcagggatggaggatcggtatcctcatcagctgtccggtggccagcagcagcgggttgcctttgcaagagcggttgctatccggcctcgacttgtgttgttcgacgagccactcagtgcgctggatgcggtgctacgggaggagatgcgcattgagatgatatcgcttgtgcgcgatttggggctgaccgccctatatgtcacccatgatcagatcgaggccatgtccatgtctgatgaagtggttgttatgaaaagtggacatattttgcagaccggaacaccagaggtgatctacggttgcccagctcatccagaggtggcgaggtttattggcaaatccaactggctggagccggaacggacactatttcgtcctgaacatgtccgttgggaacaggagcaagcggatcagcatgcttttacagtagagatcctgcatgtcagctatgtcggtgatcgttatgaaattcgtatactagccgagaacggcgagcaatggactgcatatcattccagccgcctgcccataggtcaacaaatgcacgtttgggtatcaccgcaacacatccaccaacttgaagcatagggaaaaggggtatatacaagatgatgaataggcatgtttttcgtacaggatggaaaaaaggaacgatgctcgcattaacattgacttttggactcgctgtggcgggttgcggaacagctacaacatccaaggatggggcacaagctactggatcagcaggaaaagcggaggcggcatccaccgatcagaagctggtggtctacagcgcaggcccggatggactggcgaaaaagttggtagcagggtatgaggcgcagagcggagttaaggtagagttgttccagggaacgacagggaaaattttggcccgcatggaagccgagaagacgaatccggtagcggacgtggttgtgttggcatcgcttccgtctgtacaaggcctgaaaaaggaaggactcacgctgccttacccggatgccaagaatgcagacaagctaaatccagactggtccgataaggaaggcaactacttcagtaccagtgcttctgctctgggcattgcgtataacacgaagctggtgaaaacaccaccaacttcatgggctgatttggcgaagcctgagtacaaggatcaggttaatattcccgatccctccctgtccggctcagcgttggattttatgacaggctatctgagcgccaagggcgatggaggctggacgttgttcgagcagtacaaggctaacggtgttgctatggctggtgccaatcaggaagcgctggaccccgtgattaccggagctaaaggtgtagtcgtcgctgcggtcgattacatgacctacaaggctaaagccaaaggtgagccgattgatatcgtctatccgacagagggaacagtcatcagcccacgtcctgccgcaattctcaagtcaacgcagcatgagcagaatgccaaggcatttattgactatctgttgtcggaagaggcgcagaaactagtagcagatgcctccttactcccgggccgcacggatgtcaaagccgacaagcgtgccaacctggacgagattccattgttgaaaaccaattgggagtggatgggtgagcacggatcagacgtgacggagaagttcacgcaaatgttcaagtaagccgatgggaggcttatccgttaaacacatcagagcgtggtgtctgacgctggctctaatcgcgcttcttttcctgattgtgatgccgttgctgcaaatctttatccaaagtgtatatgttgatgaaaaatttcaatgggatgcgccttttcgaacgttagctacttcaccatttgcaggcgtgctatttagctcgatttggctaggcatctgtgtgattgcaggaacgacggtacttgcacttccgctagcctggatcatgtccaacactcgtcttgcacactggcgctggttggatgtcgtgttgctgattccgtttatgaccccgccctatatcgggtccatgggctggattctgtttatgcaaaaaaacggatatctggagcagttgttcccggacctgcatttcttaacgtcgtccttcttcagccttggtggcatggtgatgatcatgagcctgcatctgtttccattcctgtacctgttgctgcgcggggcgctggtgaggattggcgggagcctggaagaggcgggtgccgtaatgggcggcggctttctgtacaggttccgtcgaattattttaccgctactgctatcagcttacggaatgggcgcgttgctcattttcgttaaaacgattgccgagtttggtacccccgctacctttgggcgacgtatcgggtatgaggtcatgacttcggaaattcacaaatatatctccagctggcccatagattttggcaaagcgacgtcaatggcctcggtgctgttaaccgcctgcctgctcatgtggtatgcgcagtcggtgatcaaccgaaagtttacgtacaggctggtaggtggtaaaggttcgcgtccgtcccgtctccgtatatccggctggactacggggctgagtgttgcattcattttattgttgctcattgcgtccattggcattccttatttttcaattctttcagcctcgacgatgaagctgagaggaatgggccttgcctgggataatttgacgctcgactcttacaaggaactgctgtcttggggatcagagagcatggaggcgctcctgaacagtgtatttctctctttgggcgcttcgacgcttgctgtggtgctgggcacttggtttgcgcttgtcattggcggctcacgcacgagaatccaacggacggttgatgcatttagcttgcttccgaatacggttccgggaattgttatggtggtcggcctgattttgtggtggaactcgccgtggatgccgatccctttgtataacacatacggcatggtcattctgacgtatgttatcttgtttgttccttatacggtgcagtatgtcaaaagcgcctttacacaggtggacacgggtctttttcaggcgggacaggtatttggcggacgaccgtcttacatattccgccggattgtactgccgctgattgtaccgggaatgctcgctggttggatgatgacatttacgatcgcttcacgcgagctggtaggatcgttgctgattttgccgccatccgttcagacgtctgcaacctacatatttgcacaatttgagcagggacaggtgtcacttgggatggcgatggccgtcatatcggtcggaatgaccacactgctgctgatcttaatcgaaagcttaaacttgcaaagaaagtggaaatgatcatgaccaagcttaggatttggggaggagcgggcgaacatggccgctcctgctatgtttttgaaggaacgcagcatcgcgtcatgctcgattgtggcgtgaaaaaggaaggaaccggacaatatccggtttttccgccgcaaaaggcggagggactgactactgtattgctgtctcatgcacatgaagatcattccatggcgctccccttactgtacaagtatggataccggggagtggtctggacgaccaaggccaccgctgagcagttaggctcctattttcgctcctggcatacttatgttgaatcgagaggagccgacttgccatacgacgaacaggatatccaatccattgcttatcgctatctagaagatgaatcgccagcaggagaatggcttgaggcttgtccgggtgtgagaatcatgtggggacgcagtggacatttggctggtgcagtgtggtatgtggtagaaatggaagggaagcggttgtttttttctggagattacagccgcgaatctgaacttcttgctgccgatgcgccagacttgggtgttggagaggggctgcatgacctacctgaatggaagtcagagcccaatctagcggacatatccattatggacaatgcctatggcatggatatagacccgcagcctgttaagctggagcggctgcgggtcgagatggagcggacattagggtctggaggtcatgtgttgttgccggtgcctgcctttggtagaggacaggacatgatcgtatgggctagcgagcaattccctgaacaggcaatgattgtagagcacgacatatggcagggattgaaacagttaaaccgctggaaagaatggctgcgtccagaagccccggcgcgaataaaacatgtgctaaacagtgacagggtcttcgtgcctcgtaatgctgcggaacgagtgagtctgctggaacagaacccaacggttattatcataacaagagacggcatgatggattccccacaggcgcgttggtactatcagtatctttcggataaccgcaacatgggggagggtgaagatagcggagaaagcattagcaacagtgttatattgaccggacatgctccacagggttcttttggcaaacatctgttggaacgtgcggatgaaaataacaactgtgtagctcggcatttgatttataaggtgcatcagggattatcagatgtgcggcaaatgctgaaggagctgcctagcaaacaggttgtactcgttcatgcgccgaagctgcagaccgacctggtacgagatgagttgataagagaaggaaatggtggatgtgaaggtcctgccagaaaagttcactctctggagccgggcgctacactagaggtttagtatcacaatatcattcactttgtgccctcctgcatcaatcggaaggcatcgacttctccaagtttggtcgagatagagctacgtccggcgcttttacgcagacggagcggtgtggcggtacgcttaagcaacgccttgatttctccaggctccagttccggtctcagtgaaaggagaagtgcgatgcttccggtcacatgggaagtagccatagaggtaccgctcatttcgtgatgcttgccatggatccaggaggatgtgatcttttcgccaggtgcgtacacgtctacaaattgcccccggttgctgaaaggcgcgatgcgtctgtatttgtcggtagcccccactgaaatcgtctgagaatagcgggctggatagtcaatacttcggcgcttaccctcatttcccgaggacgctacaaccacaatgccgttatgatatgctttattcaccatatcaagtagtgccttgctgcgcgacttcataccaaagctcatattgatgatatcgacacgatttaatacacaccagtcgataccaaggatgatatcggagacgtaggcggctccattatgatcaaaagcttttacgggatgaattaaagcccgtggtgctacgccgaccataccttcgtcatagttggacgccgcgatagttccagcaatatgagtaccatggccgttatcgtcatagggtagcatggttcggttaagcaaattaatacctctggcgagagaatgacgaagatcgggatgttgaaaatccgctcctgtgtcgatcacaccgattctgacccgattccctgtcgaggaaggccaagccttgtatgcacgtacctgtttgactccccatggcatggaaaggttcttttctgcttttggtatatgagcagtttcagcgtggaccttcatgtgggtatcttcttcaacggtgacaccgttgtgatatttgcccagcctgtctccccctgaaagcggagcgattaaagcacggattagtcgggccggttgtacttgccgtaatcccgcaagctcgggtttcagcttcctgagataggacaggcattcccggtattggtgaggcttatcgaacgtgatgatctgtttgttccgtccactgccggacggctccgaaataccctcatgcagacgctgcaaaaaatccggatagtccatttgagacggtccccctccgatgagccatgctgaggtattgtatgagcaagcgtcaactgcggcatgggaaacctgccccttttttatggaaataggcctgcttgtcgtgtcaaagtggccgtggacacatacgatacatggagggcataagctcttgtgcaacaactttggggggttctcccggagcgggtacagtcgaagacgggggggaccccgtctttttatgtatgccgtcttgtttagagggatattcctggaaattatgacgatacccatctttaacttgcaatttgcttccaaataggttttacttagttttgataatggatatgttagtattgcatgtatcgtgtatgctctgaaacatgttcttgtgaattacgtgtgagaggaagtgtccctaggtgagtaccccactcaacttgaagattgacccggagaaagtccacgagactccaatggtggatttggcatttatggtattgaaagcagccaatactccgtattattaccgtgacctgatgaaggaagtcgccaaattgcgtggcttttccgacgaagaaattaatgacgttattgctcagctatatactgaaatcaacattgacgggcgttttgcctgtgtcggtacgaatctgtggggcttgaaacgttggtatccggtagataaatccgaagatgccctgacaggcgccaagcgtcctcgtattattaacgacgaagacgatgacgacgaagatgactatcatgaggaagaagaaacatacaactctgatgacgacttcgatgcagatagcgaagacgaggatggcgaagatgagctgttcgacggagaagaagatgatgatgatagtgatgaagacgtggttatagacgatgaagacctcagtgatgaggaagattcagaagatgaaaatgatgatgagtcgacggaagacgacgattcgcttcgttaggaaaaggctgcaaggggagatgcgttctcccctttttcatgaccgttttcttgaaaaccccttctgatttaaagctttcaggtggattctctccaatctggttcaatggacaaattaacacggataacttccttgacagcggattggacacggggtaaactattgcttgggcttatgattgattcacttatatgtttgctttttgtataaaagtgccccgtactacgggagtgcttttttgttttttataggggtgttttcactcatgaaagagggctaagggcggcggacatggaaaatgattccgctgccttcttcatggatgataatccgtgcaaacgggttacgataacatcataatgtcgcctgaattttgcatcttatctaggagggttttgaacagtgacaaagtatatttttgtgacaggcggggttgtgtcttccttgggcaaagggattacggcagcttcactggggaggcttttgaagaacaggggactgaaggtaacgatccaaaaatttgatccttacctgaatgtcgatccgggtacgatgagtccttaccagcacggtgaagtatttgtaacggatgatggtgcggaaacggaccttgacttgggacactatgagcgctttattgatattaatctgtccaagaacagcaatgtcacaacaggcaaggtatattccagcgtaatcagcaaagagcgtcgcggagaatatttgggcggtacggtgcaggttatccctcatattacgaacgaaatcaaggaacgcgtgtaccgtgcaggccgtgaagcaggttcggacgtaattattacagaaatcggcggtacggtgggcgatattgaaagcttgccatttttggaagctattcgtcagctcaaaagcgaagttgggcgcgagaatgtgatgtacattcacgtaacactcattccttatattaaagctgctggtgaggttaaaactaaaccaactcagcacagtgtaaaagaactgcgcagtatcggtatccaaccgaatgtcattgtttgccgtacagagcatgaactgtcctccgatatgaaggctaaaattgcattgttctgcgatattgatgcgaatgcagtggtagaatgccgcgatgcttcaaccctctacgaggttccgttgaacctgcgtgaagaaggattggacgaaatcgtagttaaccacctcaagctgacaacacctgcaccagatatgaccgaatgggaagggttagttgatcgaatcagcaagctggataaaacggttgagattgccattgttggtaaatatgttgcgttacatgatgcgtacttaagtgtggttgaatcactttcccacgctggatttgatgcgaatgcagacgtaaaaattcgttgggtgaacgctgaagaagtgacggacgagaacgtagctgacatgctgggcggcattggcggcattctcgtaccgggtggcttcggcgatcgcggaattgaaggcaaaattagtaccattcgttatgcacgggagcaaaaaattccgttcttcggcatttgtctgggtatgcaggtatctgtcattgaggttgcccgttccctggctggtctcgaaggagccaacagctcggaaattaacccggctactgattatcctgtcatcgatttgcttcctgaccaaaaagacatcgaagatttgggcggtacgatgcgtcttggcttgtatccatgcaaactggtggaaggttccctggcttcggcttgctacaacgacgagctggtgtacgaaagacaccgtcatcggtacgaattcaataacgaatatcgtgaagttattgaaaaagcgggtcttcgtatttccggtacttcaccagatggacgcttggtggaaattgtggagctccctgagcatccgtggttcctggcggtacaattccatccagaatttacttcccgtccgaatcgtccacagcctttgttccgtgaatttgtaaaggcagcattgcagcttcaaggttaatgctatggctgtaagacctcctcagggaggtctttttttatcccatgcttcctgattatgaaagaatattccacaattatgtataagagcaggattttctttttgcaggagcgaatatagttttaggtatgggacggatattgtacgtcatcggacgctgttatggcaatagctgcatgatcctcgttttaagatcttaggaggttaaaacattggaaaagaagaaagtattaatcgtcgatgaccagaatggaatacggattttactaatggaagtgttcggaagtgagggttatgagacctttcaggcggcgaacgggaaaattgcacttgaaattgttgagaaggaaccacctgatctggttctgctcgatatgaaaatcccaggtatggacggactcgaaattctgaagcatctaaaaaccatgaatcctgatatcaaggttattatgatgacagcatatggagaactggacatgattaaagaggcgacggagctaggtgcgctcatgcattttaccaagccctttgatattgacgaaatgcggatcgctgtgaacaaacaactcagagatgattaggtgagtcactatggttgagaactctgttaacacaacagggttttttgtttgtgattatgggaaatactgaaagtaaatcctctccttatacaattctatgaaaaaacggcgtcctaacgtgatttttgtatgtgttgatatgcaaaagcttgtttagtatttaacatgggttgtggtataataagcccgtatgtgatgtcggctaaaatatagacaaacccaaacacctttaggaggactgtaaccatgccattggtatctatgaaagacatgttgaacaaagcactcgaaggaaaatatgcagtaggtcaatacaacattaataacctggagtggactcaagctattttgggcgctgctgaagaagaaaaatccccagtaatcttgggcgtttctgaaggcgcagcacgtcacatgggcggattctacactgttgttaaaatggtagaaggtcttattcatgacatgaaaatcaccgttccagttgcgatccatttggaccacggttccagctttgaaaaatgtaaagaagctatcgacgctggtttcacatccgttatgattgacgattcccacagcccgatcgacacaaacattgctacaacgaaaaaagtggttgaatatgctcattccaaaggcgtttctgttgaagctgaagttggaatggttggcggtcaagaggatgatgttgtcggcgacgtaatgtacgctaagctggacgactgtctgcgtatcgttaacgaaacaggtatcgatacactggcacctgcactgggttccgtacacggaccttacaaaggcgagccaaacctcggattcaaagaaatggaagagatctgcaatgcaatcaaacttccactcgttctgcacggtggtactggtatcccaacacatgacattaaaaaagcaatctctctgggaacttccaaaatcaatgtaaacactgagaaccaaatcgtatttgcgaaagtggttcgtgaagtgcttgctgagaaaccggatgcttatgacccacgtacattcatcgctccaggtcgtgaagcgattaaacaaaccgttatcggtaaaattcgtgagttcggttccaacaacaaagcgtaataatgaatcaaactggtcgtgcgtctgcacgggctagatgtattttttagttgtagctgtagttctgctgcacaaaatatttaaatctgtacagttgaatagtttggtatggaaagcacaccgcttagccggtgtctttccattttcaccactaaaaaagttaaaagatttataatttgagattattgtttgaccgactgcaaaacacgtagggggaccctcaagcttatggaaaaattgatgatcaccggtggacggccgcttcaaggtacagtttccatcagcggtgccaaaaacagtgccatcgccttgattcccgcagccattctggcagagtcggaagtcattttggacaatttgccactgttgagtgatgtggcggtgtattccgaaatactggaggaacttggtgcaacggttacctgggaaggtagccagatgaaaatagatccttcctccattaaatccattcctatgccgaatgggcctgttaagaaattacgagcctcttattatatgatgggagccatgctgggcagattcaaggaagcgatcatcggtttgccaggagggtgcaatttcgaaccccggcccattgatcagcatatcaaaggtttcgaagcgctgggtgccacggtaacgaacgagcacggcgctattcatttgcacgccaaagaactgcgcggaactaagatttatttggatgttagcagcgtaggcgctaccattaatattatgctggcggctgcacgtgccaaaggcgccacaattatcgaaaatgcggctaaagagcctgagattatagatgtagcaactcttttaaactcgatgggggctattattaaaggtgccggtacggaaacgattcgaattgaaggtgtgtcggagctgcatggctgccgtcattccatcatacctgaccgtatacaagcgggcacatatatgattgctgctgcggcaacccgtggaaatgtattgattgacaatgtaatccccaaacatatggaggctctcactgcaaaaatgcaggaaatgggcatcggcatcgaggaatatgatgaaagtattcgcgtactaggtgcaccttcctatgaacatgtcgacgttaaagccttgatataccccggattcgccacagatttacaatctcccatgaccagcttgcttacccaagcgcagggtgtcagtgtattgagcgattttgtgtacagcaatcgttttaagcacgtccctgagctggtgcgtatgggggctaaaattcgcgtagagggtcggtctgctattatagagggtggtcagctgaatgcagctaaagtaaaagcggcagatctgcgcgccggagcggcccttgtcattgctggacttacagtaagcgaaggtgtaactgaggtgacgggtgtcgagtacattgaccgtggttatgatcaccttgtttccaacctgcgtcttttaggcgcggatgtatggcggcagactgaataattagaccatgccattttttcgaactcccggaacgaaagcgatagaacgggcaacacctatgcagccgctgcttgatacaagattgtggttcatacctaacaatcctttatcggaaaaccggaataattcggtataattcaggcagatggctgcataactttatttgttttggttaaaattatgttaatggtgtttatgatatcattgtctatcatttagatgtatgaatggacttaataattgaataggtggttattatatggatctgcaaatttccgatctggaagaaatgaagctgaccgacctgtacaagctggccaagcaataccagatcccgtactacggaacgctcaaaaagaaagaattaatattcgcgatcctgcgcgcacaagctgagaagagcggattgatgtttatgcagggggttctggaaatccttcccgaaggttacggctttctgaggccgatcaattatctcccgagtaccgaagatatttacatctctgcttcacaaatccgcaagtttgacttgagaacgggcgatcttgtttctggtaaatgccgaacgccaaaagagaatgaacgatattttggattgcttcaagttaacgccgtcaatggaagaagtcctgagcaagctgctgagcggctacattttcctgcactgactccactgtatccgcaaaccaaattagtccttgaaacttcccccaaccatttgtctacgagaattatggatgtactggcccctgtcggacttggacagcgcggactcattgtagcacctcccaaagctgggaagacgcttctcctcaaagaaattgccaatagcatttctactaacaatcccgagatcgagctttttgtcttgttgattgatgaacgccccgaagaagtgaccgacatgcagcgttctgttaaaggtgaagttgtggcctctacatttgacgaacttcctgaaaatcacattaaagtggcagaactcgtgttggagcgtgcgctgcgtctcgtagaacataaaaaggatgttgtcatcctgttggatagcatcacacgtttggctcgtgcgtacaatctcgttatccctccttctggtcgtactttgagcgggggtattgatccggcggcatttcaccgtccaaaacgcttttttggtgcggctcggaatgtggaggaaggcggtagcttgacgattcttgctacagcgctgattgatacgggatcacgcatggatgatatcatttatgaagagtttaaaggtacaggcaacatggagttgcatttggaccgcaagctagcagaacgtcgtatctttcctgcgattgatattcgtcgttccggcacacgccgtgaggaagtgttgttgaacaaggaagaattggataccatctgggccattcgtaaaaacatgacggaaagccatgattttgtggaaggcttcctcaaaaagctgcgtaatagcaaaactaatgctgagtttttggcttcgtttgatttgacggcaccttcttccagtagctcgcaaagcagttctggtgggcaacaacggagaactgcgcgttctaccacagcgtcagtcccggccacaaccaactaaaacccattcatgtattttatctgttccgtaagtacacagtcgttaccattcatttgttaatggcgtaggcttaacggagcgaaaggagctccataatgtatttggtgtatgccgacgaaaaaggcaatgtatatgatcatgcttctttgtatgggcttgcccgtagtgcagacatgattgttgagatcatggaggatgagcttattccgttaccggaaggagctacattggtaagcctgcccagcactcgcccggtcggtatgaaccctgaaacaggggaaatggtttctcttcccggagatatgcaagcagtaggggctttattgccgcaaggttttacacgtttgtgcctaccggggtatgtgaagaccgataaggagtacaaacttcccttgttcggttattcggctgtagtctggaaagacggggcattttatgtaacggcagagcagagtgacagtccatccaagtggaatccggaaaactgtgaccgtcatcaagttaaactaggtgtgcagcggatgacggagcaatatcccgaaaatcggctgtaccaacatttgtctaactgtgcgctgggctacgaatgtcttacttcctcgaacacattcctgaatcgctgggaagggggagttccggtatcttattcttgtaatgcgggttgctttggctgtatatctgaacagccggatgacagtggctttgtatctccgcagacaagaatgaacttccgtccccgtgtcgaagaaattgtagaagttatgctggaacatttgaagacaccggagtccatcatcagttttggccagggttgcgaaggtgagccttccacacaagccaaactgattattgattcgatcaaagaggtgcgctccattaccgatatgggatacatcaatatcaatacgaatgcgggattgagtgatcatatccggggaatcgtggatgcgggtcttgatctgatgcgcgttagtaccattagtgcgctggacgatcactacaatgcgtattacaagccgcgcggctacacgttggataatgtagaaaaatcacttcgttatgcttctgagcagggagtatatacgtcgattaactatttgatttttccgggtgtaacagaccgagaggaagaaattgaggcaatgattgaatttgccaaacgtactaagctcaagctgattcaaatgcgtaacttgaatatcgatcctgaaagctatctggagttgattccacctgctcaaggtgagatccttggcatgaagcaaatgcttgagatttatcgtgaggaactgcctgatgtagtcatcggttcttacactcatgtacccccacaagggctggcacgtcccaaatttgccaaggcctaaaacggtcaatagcaacttgaaactcacctattttacgccatctttgaatgcggaaaagagttgttgaaacgctcatattcaagtgctataatgtgaacatgtgttcatacaactctggactgataggacgttcagggcggaaagaggtgaaagttcaatgcaacaagctattcaaccaaaatttaacgtaactaatgtcacttgtgcttgcggaaattcgtttgaaactggttctgtgaaaggatctctgcgtgtggagatttgctccgcctgccacccattcttcacaggcaagcagaaatttattgatgctggtggacgcgtagatcgtttcaaaaagaaatacggtatctaatggattaccgcaggttataaagttattagagccttctgcaactgcagagggctctttttgtaataatgtgtatttgctttttatgcggccttaagatatacttattttcaccgtgctagatggggaggtagcggtgccctgtaactcgcaatccgctatagcgaggttgaattcctgttagaggtgttgttgatgtgaggctggtccctgcgcacaatgttgacggctgggtcctccgcaatgagtacttgtgaacctggtcaggtccggaaggaagcagccataagcaagcccactcttgtgccggagggttgcctagcccgagttgttgttcagggttgccgctcggatcacaacgatcaataacaggtgcacggtatatattagtgattagaacatcttggcaatcattgcgaagatgtttttttgtgttttataaattggaaggtgtctggtttagattcggacgggagtatagtataatgaagtgaccatgaatggtcatgaaagtgaatgggaaagagggtaacgcgcattggaacatatagcgttgtaccgtgcttggcggccgcaggctttcaaggacatggtaggacaacagcatattatccagacattgcagaatgccatccgcgaaaatcgcacgtcccatgcctacctgttcagcggtccacgaggaacaggtaagacgagtgcggccaaaattttggccaaggctatcaactgtgagcatggacctgcgccggaaccttgcaacgaatgcgaagcctgtaaacggatcacggccggagcggtcatggatgtacaggagattgatgcagcctccaaccggggcgttgaagagattcgtgatttgcgcgataaagtcaaatatgcgcccacagaagtgcggcacaaggtttatatcattgatgaagtgcacatgctgacgacggaagcgttcaatgcgctgctcaagacactagaagagccgccgccacacgtgatgttcatattggctacgactgaaccacatcggattccggcgacaattatttcgcgttgccagcggtttgacttccggcgggtatcgctggaagaacagacagagcggcttgacctgatatgtcaacaggagaacatacaggctgatttagatgcactgcagtacattgcgcgtctttcagatggcgggatgcgagatgcagttagcgttttggaccagatatcctcgtttacagatggtcgggttacttatcagcaggtgctggatatgacgggaggtattgcgtccgagcaattcggtaagcttgccttggcgttgctgaaagaagatgtgggcacggtgctccaaatgatcgagaactttatgcaggaaggtaaaagtgcggataagtgcatggagaatcttctgtactatttccgagacctgctaatgatcaagatggtgcctcaggcaaccaaaatgacggagcgagtgctagatccagagcgatttaaggaagtggcagatgcttttaccaaggagcaactctttgcgatgattgacacccttaatcgttatcagagcgagatgaaatatgccgttcagcctcaaactttgtttgaggtagctctgttgaaactatgcagtattccgggggaagcaggagctgttgttcagtcggccgcacagcgctcaggtgctgcagctgagcaggaagatgtggtaatgttgaagcgccagcttgctgagttggaaaagaaactggagcgcgcgctgcaaggtggattgggcgctggagcgggacaggaagcatcgtcgggtggtcgtcaggcttccgggggtcgtgcccctgctccgcggatttcagcgccagccaaacttccttctcagttggatcgctatatcgctgagaagtcgagcgaagcattcgcagcagcggggcgtaagtggagtcagattttacaaggggtaaaagaggcgaaagttacggttcatgcctggtttatggacggtgagccagtttctgtgttagaggacagtgtgctggtcgcatttaagaacaatattcatcgtgaaactaccgaaaagcctgccaataagcaggtcatcgagaaagtattgcatgagcagttgggccatccttatcgtttagtaacgatgatgcaaaaggattggaatgctgcgattgaaggagtttccgaccagcctgccgaagaattgcaactggagccggagcatgatacgccgggaaagtccaaggagccctggattgatgaagctattcaacttttcggggaagatctggtagtcattaaagattaaatcaagtgtctagatgtatacttcattaaaggagatgattgaaatgaacaatatgaaccaaatgatgaagcaagtgaaaaaaatgcaggaacaaatgctgaaagcccaagaggaacttggcggaaaagtaatcgaaggtacttctggcggcggtgttgtgacggtggaggtaaatggacataaaaaagtgttgtccatcacgatcaaaccggaagccgtagatcctgatgatgtagaaatgctgcaagatcttgtactgactgcagtcaatgatgctttgtccaaagcagatgaactggctaatgatgatatgggtaaatttacaggcggcatgaaaattccgggcttgttctagtctgctgcataaaggagaaacacgctattgtattatccggagccgattgcaaagctaattgatgcttttacgcgcctgccaggagtagggccgaagacggctgcccggttggcctttcacgtactgaaaatgaaggaagatgatgtgattgactttgccaaagcgctagtcaatgtaaaacgcaatctgcacttctgttcagtctgcggcaacattacggatacggacccttgtcggatctgtcaggataagacgagggatgcttccgtcatttgtgttgttcaggattccaaggatttggtggctatggagcgtaccaaggagtttaatggcttttaccatgtgcttcacggggcgatatctcctatggagggaattggtcctgaggatatcaaactcaaggaattgctgaatagactcagtgatgaacgcgtcaaggagctgattttagctacgaacccgaacattgaaggagaggccacggccatgtacatttctcggctagtgcgtccttttgaaatcaaggttactcgtattgctcacggattgccagtgggtggagatttggagtatgctgacgaggttaccctgtccaaagcgttggaaggccgtagagagctcaattaataggtgtatttatacgttataaatagggagtctggaatgtccttagggtattctcgactcacttgggggagccgctatggctccttttttatttgcggtgatagatggcagtatagatcgttcctggttctaagtttgtcctttgttcaataagtatgaataaggtaatcttgcagactgtgcacataattcagcttgtgaggaggatgaacggatgtgggaacggatgaaacaaaatttccgtcgtcaggagaatggcaaatcagaagcggagtatcggcaggagttgtttgcccagattcgggcttcgcatgcggaatggttaagagcccatcgtttatttcatgaagcaacgggtaaagatgagatcgactacgctatatttgttctagaagctgcagaacgtaaatatcagatacatttaaaaagtgcgaaacagcaaggcctgcatcgtttccatctgcctgcagatgaaccggggtatgccaatgatacggatcgtgttcacaagcggagagctgaatgaaaggggcggtctggcttgttttgattgcctgtgtcgggatgttactatttctaatcttaaaaaaacgtttgggtatcagctggcttgtagtattcggggcacatatgggcctggcagccatcgcattgtatgttatcaattattcagggtggattacgcaggtgtacatcccgatcaatccagtgacaatgggggcggtaacgatattaggcttgcctgggattgtccttttactgggattgaaaatagtattattcggacaggctatatgaaaacttaaatgttattgtttctatttttaaaatatagttgacggcgaattcaaaaatgtgatacattaattctcggcccttaaagcccgggaatttttttgtgagaacaacaattaaatgaaattaaaaaataattttaaaaaagtgttgacttaaatcccgaatgtgtgttatattaattaagtcgccgatgagatgcggtggtgaaacaaagtaagacataatgcaggtttgatctttgaaaactga

SEQ ID NO: 38 - DNA, 161650 bp, Unknown
  Kingdom: Bacteria, Phylum: Firmicutes, Class: Bacilli, Order: Bacillales, Family: Paenibacillaceae, Genus: Paenibacillus
ctgcagcacaatttcatcgaagatatcttgaaagatcgtggtgtctttaaagcgagtgcgacgattccagctaatcgtcgtatggtctggaactttatccgttaagcccagccccaggaaccagcgataagccaggttcgtctgaatttcacgctcgagttgccgttctgagcgaatgccatagaaatagccgagaaagatcattttaaacaacacggtaggatcaatggcaggacgcccgttgtccgcacaatacagcgggcttaccttctcatgaataaaggagaagtctatatatgtatccactttacgaagcagatgatcttgcggtaccagttcttccagagaaaccaattcaaaagattgttgttggtcttgatgaggtcgcagcatatcaacaccgtccgttctacaatagttacctatattatacaacattaacgcggtgtcgtcttaaataaaatgaacataaaaaaagctgtcgagactttctcgacagcttgcgaagacctctaaggtcttctctcacttctatacgattcataggccagttacacgctatctttataattcacatgattcagaacagacgaccttcgtacacgatctcagccgggcccgtcatatatatgtgattatcttcctcgttccattcgatatccagatcgccgcccttcaggcttacaatggcgtgacggtcgctgtatccgtttagtacagaagcaacaagcgtagcacaggctccggttccacaagctagcgtcggtccggctcccctctcccatactctcatatctatatgcttccggctacgtaccgtggcgaactcaacatttgtttttttagggaacaacggatggcattccagcttcggcccccaggctcccagatcaaagcttggcgcatcctccacataaatgacacagtgcggattccccatagatacagccgtaaagcgaaaaccacttcccccagcttcaataggctcgttaattacgctagtccgctctagtgtagttggaattttcaaaccctcaagaatcggctctcccatatctaccttcaccctacgaacaagtccgttctctacagttagttccacctgctgcacacctgcgcccagggtctcgatcgtgatctgttcacggttgatatgtttacggtcatatacgtatttggcagcacaacggatagcattaccacattgctcggcctccgagccgtccgagttaatgatgcgcatgcagaaatccgctttttctgacggcaatatatataccaacccatcggcgccaacaccaaaatgtcgatcacatagccgaacagctaattccgaggcgtcagacggcaaatcctgatgcccaaaccaaacgataaaatcattacctagaccgttcatttttgtgaattccatagcttacctccgccgttgctgctgatatcatgttcctcataaagctttgatcccatgatatcatacagggcaatagtgggaaagcgatgcggtatgcatgacccgattactaggctgaaaacttcgtacgtccagctgaaaagtgtgtatttccgccgcgacgacggttgcgtcgaccgccccatacacttcccgctcccataagaaacgtaggaatcccggctgccacaatggatagcgcccactcacgcaatccaagcggtaccgttttgaaaataggttgcagcacaggcacgtacataaccaccagcattagcactacggaggagagcacggcaagcacgagataactattttgaaacggattacgatggaaaatagaacgggaactgcggcaatcaaatacatgaattaactgtgccaagactagcgtagcaaaggcaacggactgtgctttgatcaattgtcctgcgtcatccggtgcaatacgtaatgtcagccagaaggccgctagcgtacataaaccaatcaacaagccacgactaatgattttccagcctaatcgacgagcaaaaatattttcctttgcgccacgaggtttgtgctccatgagatccttttctggctggtccacccccagagccatcgctggtaggccatctgtcaccagattcacccataaaatctggatcggtaacaaaggtaatggcagcccggccatcatggcaaagaacatcgtcaaaatctcaccaacattggaggcgagtagataacggataaatttacggatattctcgtaaatattccgtccttcctcaattgcggctacaatggttgagaaattatcatcactcagaacaagcgcagccgcttctttggtcacgtccgtccccgtaatgcccatggcaataccgatgtccgacgcctttatcgctggagcgtcattgacaccatctccggtcatggctacgacatgtccgcgtctttgcagcgatttaacgatccgtagcttgtgctccggcgaaactcgtgcatacacagagacggtatcaacagctttgtccagcgccgcatcatccatcgcagacaattcctgtcctgtcaacacatgggatccgcgctgaagaatgcccagctgctgtgcaatagcctctgcagttgtaccgtgatctccggtaatcatcacagtgcgaatgccagcacgacggcacttgccaatggcttcgcgaacctcacgacgtggcggatcaatcatgcctgtcagcccaataaagatcagctgtgcttcagcctcctcaaccgtggagacacgctcatgcgagcggatatcacggtaagcgacaccaagtacacgtagcgcctccgaggccattccttcgttagctgccagtaccttttggcgcagcgtacccgttaacggaacgacatttccttcccataaaatgtaggaacactgacccagcagtacatccggggcacctttggcaaagacaatgtgtcctccctggtggcgtacgagtaccgacattcgcttccgatccgagtcaaaaggaaattctcggtcccttgtgtacagctcatatagcccttgtcgcgtgactccgcccttggcagctaacgtgatcagcgctccttccgtcggatcacccttcagttcccaaacggcggacggcgtcggctctttggttttctttttcgaacgtagctcctctgtatcggcttgaacaatttccgcattgttgcaaagcacactggcttgcagtagtctacgcagagattgtccgtttttaagatcggcaggaaggtctctgtccataatatgcccgtgtgggtcatagccctctcccgtaactccccagaaacgaccgtccagccatagcttggtgactgtcattttattttgggtcagggtacccgttttgtcggaacaaatgacagatgcacagccgagcgtttcaacagaaggcagcttacgtacaatcgcctttcgtttaatcatacgctgcacacccaatgcgagcgcaatcgtcacaatagctggcaacccttccggtatagccgccacagccaagctcactccagccaagaacatgctcatggctggctgtccatgtaaaatgcctgctacgacaacgagcaccgttagcgccaacgctacgataatcaaaattttgcccaattgctccaatctgtgctgcaacggtgtctcctgcgactccgtattttcaatcaagtctgcgatcttacccatttcggtactcatacctgtacgtataaccattccttgtgcggttcctctggtcatcatcgtgcccataaaaccgatgtttttttgatccccgagtggtacttcggcggcatgaatagggcggcaatgcttactcaccggaactgattcacctgtcagggcggactcctctacatcacagccgttcgtactcaaccaccttacatctgcgggaatgcgatcaccactttccagcagcacaatatcacccggcaccagttctctggcctgaacttgaattcgtttgccgccccgcaacactttggcggttggggccgacagttgtctcaaagctcgcaatgaacgctcagctctgaattcttgtacaaagccgagaattccattcagtacaacaatagctataatggtgatcgcgtccaaatattcgccaagcagtccggatatcagggtcgctcccatcaatacaagcatcataaaatccttgaactgattgagcagcagcaagattgccgaaactcgcttcccctcgctcagctcattccatcctgacctttctcttcgttccgcaagctgttcctccgaaagaccctgcttcgggtcgacttccagacttgttgaaagctgttcattgcttaattggtgccagtgtgcttgttccattctccccaattccctcccggtcagatagtccgtttccgtcggttgtgcgtaggatggctgcccgttattatatttttgtgccgcgattgctgataagctggacagactttctagattcaatctattcggacaggacctgaaatatcacaaagccgcttaagttttgtcccaaagttatgtatcatagaaggaaggcgaaaatacatttgcttcaaaggagaacataattatggcattggacggaatcgtaacccgcgctatcgtacacgaactgcaaggaatccggggcgggcgcattaataaaatacatcagccaaatgatcgcgatatcgtgctgaatctgcgggcacaaggcggaagcgtaaagctgctgctgtcggctaatccgaccttcccgcgtgtacattttacagaacaaagctttcttaatccgacagaagcccctatgttttgtatgctccttcgcaagcattgcgaaggaggcgttattgagaaaatcacgcaggtgggcatggagcgtattattcacatggatatacgtcaacgtgatgaactgggagatatttcactcaaacgaattatcattgaactgatgggtagacacagcaacattattttgcttgacccggaaataggcgtgatgctggatggcattcatcatgtcacaccgtctatcagcagctatcgggtcattatgcccggctttcaatacacggagcctcctgcacaaaacaagctgaatccattagaaacggaagagccagccttcatatcctcgtatcaaacagcgatcgaggccgaagaagctcccaaacgctggatcgtgaacacttttactggactcagtcccctcgttgctgaagagatactaactcgagtaactattgaagtatctggtgatagtgatcgttcactatggagcacattcagtcacatcatggatgacgtgcggaatcatcgttttcagccggtatctggactaaacgcacaagataaagtgatattctcagccattccactgacattgatccaagaagaacgtaaggagtacgctactatcagtgagtgtatggaggacttcttcggtgaaaaagcagaaagggatacagttaagcaaaaagtcagtgacctactgcggtttctgcaaaacgagcggagtaaaaacgtaaaaaaactcgactatctccatcaggatttggccgaggcggaagatgcggatcaatttcgcatttatggagagctgctattcgcttcgctgcatgaggtgaaaaaaggggacaaagaagtgacgctcaccaacttttatgatgaggaacagcgtccaatgaccatcccactggacccgctactcaacccatcggataatgcacaacggtattttaaaaaatacaacaaatataaaaacagcttggctgtcattgacgaacaactggagaaaacgcacgaagaaatccgttatatggacaatcttcttcagcagctagcccacgcctctatgaatgacattgaggaaatacgtgaagaactggttcagcagggctatctcagagatcgggtcaaaaaaggaaagaaaaagaagaaaaacgaccgtccaaccctgcacgtctatacatcatccgaaggtatcgagttactggtcggcaagaacaacttgcaaaatgaatatgtgacaaatcgactggccggaccaaatgacacctggctgcacacaaaggatattccggggtcacacgtcgttattcgtgctgagcaattcggggatacgacgctggaggaagcagctcaactcgccgcctactttagccaggccaagcagtccagcagtgtgcctgtggacgccaccctgattcggcatgtacgtaagcccagcggagccaagcccggctttgtcatctacgaccatcagcgtacgctcttcattacacccgatgaggaactggtcaaaaagttgccgaatcgcatcaaaaacggctaagtctcaccagcctattgaatccacaaaaaaagccctttgttctttgcacgatacacttcttgtgttccatgcataaggcaaggggctttttatttacttttgtccaacagcagccttcctcaattcctcgacaacctgatcttccacactacggctacccagatcaccgtggaaaataacaccttggcgtgcaccgtgaaaatccgagccgccagttgcaatgagcccatattgtgccgccatcgcagtatatcggctctcagcctcagcatcatggtccgaatgtcgcacctccaagcccacaggcttcgcctcctctataatagagcgaaccagctcatcatttccgtataagccagggtgggccaccacaggaacccctcctgcttcacgaatccagtttattgcctccgcaggctctacacggggtacagacacatatccgggtgctccttccgccaaataacggtcaaacgcatcccgcatatccttcgcatatcccttttgaaccagcgtatctgccatatgtggacgtccaatgctttcatctggtgccagcggtctgcccatcgtagccaccacttcatccagtgtgatttccacgcccagactacgcaattgactcaaaatcaaatcattacgggtatcccgcgcctggcgaagcttttccaaccgctccaaaaaaactttattgcggtaatccataaaataaccgagtatgtgaatatccttaccgccagctcgagtactaatttccactcctggcaccacagtaattcctatgcgttttccctccttcagagcttcctccagaccagctaccgtatcatgatctgtaatggctacacctgccagccctttttccttggcccagcgcacattatctgcgggtggctgcatgccgtcagatgcttgggtgtgtgtatgtaaatcatatcgttttacgttaatctgttccttcattatacatcctccttctctttcacctttgccagctcgtcctgcgagtccctcagcacgtccgttccctgatcatgacgacgcaagtaagacaggaaggtgactaccggaatcggcaacaacgccgacttcaaatgaattgcataaaattctcgtttgaacgcgatatctgaaatgttcacaatttttaacaaaccgagcgcaacttcatgcttcaccgaagaaggtgatagcatggtaattcccagtccagcctccaccgccgatttaaccgctccagtgctccccatctccattacaataccaagtcgagaggcatccacaccacgacttttcagctcattttctatcacttgacgtgtaccagatcccttttctctggctacaaaaggatgcttaaacacatcttccagaaccacttttttagccttggccaacgcatgtcctgaaggcacaatcagtttcagttcgtcctgcattacaggttctaccacaatatccggatgctggactggggcctcaatcagtcctaaattcaactggtgttttagtatatcatccataatttgagtcgtattcatcacattcattgccatgcgtatatgagggtattcctggccaaacggccccaacattcttggtacaatatactcaccaatcgttaggctggcgccaatatgcaatcttccctccagcatgtgagtaaaagcagacatcgcctcgtcagcttccctaatcagttgcatgctttttttcgcaaaaggtagtagtgtcgctcccgcctctgaaagctcgatttttttagtcgaacgttgcagcagcttcgtgccgaaataatcttccaaagactgaatttgcatcgtcaccgcaggttgtgtcatatgcagcgcttgtgccgccgccgaaaagctcccacgctccgctacggtataaaaaatgtgcaactgatgaaagttcatactgacagccctctcccctctgatctctctattttaccataagaaaaacatctgtcgaagcatttccaagtaaacttactgaattggggagttttattgctggaaataaaaaaagcatgcagctgataactgcatactttctactcaaattgacggtaatcataagttcggagattttttcatctagagccgagcgcccaatcaccgtctatttttgcttacgagtgcttttcatcagtgtcatgcgtcgcgaatggcgtagccatgaatagtatgacttcaaatcccttaattcaatggtctccgacattcgacccaaaaaggtaatgacaatcatcttgtgaagcggattccccgcaatatccatctcgccgggcaactctccaaattcggccacgacgaccagatcaccatcaattaaatatacatcctcttcgttatgatagtaggactccatcctgttttgcttcaggcattcccaaagccaggcggcgatatgattcgtctcggactgtttctgctctatccgatctaagtagcgagttttcgcatgatttgtaatcacgatatcggcgacttttttatcgcccatctccacgtagaacggttcgtatgtactccatcgctgcattgctttgtcacgcacgggatcactctccccaccagataggtctttatatctaccaatatattcatatgttacctcaacagacccgggactacaagttacaaaattgaagtttatgggcggtttttaaagattttttaggtctaacagcattaagaccattatgcaaaagtcctgactttacaaaaaaaagccagcccgtaggctgaccttttaagaatattttacaatttatagatattagaaacttatatttcatattctttcatcttttccttatcgtcgttgtactccgtcctaatctcatttcgaaaagaacgctcgaccttacgcacataggaaagtctgcgaatatttttaacggtgtcttctgcccgatctgcattcatatatataactacataatgcatacgctttgaaataaagtggacatttccgtatttctccagattgcgggcagccttgatatcgcttacccaaatgatgtaccctgtccgctcggcaaacattcgcttcatctcccctccactcggtatcattcctatgacctatccacaggagcatttccctccgctaccacatccgccctttttcacattcggatcattgctcggcaccttaatggtctcggacacggaatatgcaatcgtttcagacatggcatgaagcatatcatccagcgccttttcggctcgtttgaactccttaacctccacgaattgttccagttccagctcaacgacctgcactgcatccttcgcttcatgatagttcggatgaaaatgcccaaaacgctccgtttccgcgaatagctcctttttggcatccagcttgcgtacacacgcctgaatagacggattcaattccacacgctgtttccaatataaataatccgatacctcaaaggatcggttgaccatatcgcccaattcataggcgttaataagcacttctgccatattgaccgtattcaattcggctacgctcatgaatgttcatctcactttatataaagttctaccctgtaaaagtagactcatttatcataccacatccttcttttgagaagaaggagtttcatgcacttcctggctctactatgtaaaaggaaccagcagccgcatgtctgaccattcacttggctgtaagctcgcttgagaaggtgtttcgtcatccattcctgaggcataccagcctgtgacactccatggtgcaccgggaaccaccgcctccggtatccatttaacctctttcccaccgattcgcagtcccacagcggcctgccaacgtatcgcttgctcgatcaactgccgggcagtggaagtatggtaactcctccattcttttgtccatgaggaggggactgtagatctttctggaaaatagtcagatggatcaggcagcgtgtgctcttgttcgtaaaaatgcagcgtgcgccctgtataaaccaaacctgctcttccctcttgggaaaatataggacgggcctgaatcgggtcggactccatttcactgttgggactgcctgaacttatgttctctgtttccgaaatcaatgggtaatgatgagttggctcgtccacaccttccggttcacgacgtgggcctaatccaattgcagcaagcgtttttcgtattttgacagcagagctcgccggaataataaagtccctatcgcccagccgttccagtaatccttctagcgcgggatggcgtgcaactatgtctgcatcctcctgtgtgccacatcgcaaaagtgttacctttgcaaaagcggtccgtccgacatcacctgcccactgttctaccgtcatacgtacatgatcaggcacacctgttcggctgtatttatccagaagagcaggaattgctttggcttccatccctaactcgattgcctctgtaacactttctctggtgagccggtatactaccatacgatctcctgtcacacgttcacagcagcattccagtcgccagcgcacatcatatgccacatctggtggaaccaatatttcaaaatcaggttgtacataaaaagcaccttgctcttgatgtgtatcctcgtaattattgggacgaagcatttctatcacagatacattccagcgaaaacacagttcacccgatacagtctggccccaatcgcccattccaaaagcagtcagggccttaagccaacccttcaattcctccatgaaaggttcattgaaattataatcagagcccgtttctcccgcaaacccttccggatttgagattgtaggaacaaggtctaaaagggcaccattcttggaatccgctctgctcgtactctcatgctggattaggcctacctgaagcatccattgcagcagaaacttgatagatatccacccttctgtccctacatactgggagacggcacacagcatatagcgaaaatgctgcatagacgcttcggccttgccgtatctttccatgagtgtagcaaaaatatgcttgcgcatttgccaagcagacaaacgaatccaagtcgccagttccgtttcctgaatgcgaaaagatacagtttctttcactaacagccccaaactgagtagcaaatccatcattaccaccgtttgcactggatacagctctgcatgcgcataatgcaacccaagacccatcaggtcatctgggcgaaagggggtcagttcattcaatttttgcaatgatcgcttatgtatggttcctttggccgtcaaagggacaccttgcaccgcaatacgtgacaacgcatgcagtaattccgactccaggcctgtcattgattcatgtaccgttatcggatgatccgaatgcatcatgttcattggattttgctctaacaacatatcgtacagatccggtagccgatgaaccggaatatataaaattcgttcgccccacgatttggtaacagcctccagccagcctcgggcacgtaatccacgtagtgccagtttcgtttcgactccgcttaacactccccgggtaagctgtataggttcttcttccttcatgggctgtcccgcgtaccagataaagcatcgcctaagcaccagtagctcatccgatgaaagctcattccagctgtcttgcgtgttcgttacgcccattcttgattaggcctcctttttcttcccacgatcaggcttagcattccggcctccgttagcctctgtcacactaaatctgcgaaccgcatattcatagccttgctcgatcagaaacaactgacgacgagctgcaaaatccgtctccttgctattctccgtcactagcgcataaaaataagctttattctcgcccgactttggtcgcaaaatacggcccagtcgctgcgcttcttcctggcgagagccaaagctacccgatacctctatggctactgccgcatctggcaaatccaccgcaaagtttgcaaccttggacaccaatagggtccgaattgtacccttgcggaacgcatcgaaccaacgcacccgctcggtctggctcattgaacccgtaatcagtgggacgccaagctcctgagccaatatacgcaattggtccaaatattgaccaataataagcgtgggcaaaccgctgtgctgctgcatcaggctacgcaccgcctccagtttgaccggattttcggctgcaattcggtactgctgtctgccctccgcacgcatactgcgctccaagagttcagctgtcattggaagccgtagctccacacaatcgacctgagcgatccagccctgccgctccagctccttccacggcatatcgtatcgtttgggtccaattaaagagaacacatcccgttcacagccatcctctcgaaccagcgtggccgttaaccccaaacgacgggtagcctgaatgtcagccgtcgcccggaatactggcgcgggtagcaaatgaacctcatcatatataatgagtccccacttccgctcactcagcagtttcatatgctcaaaatccccatctttggtacgacggtgtgtcaaaatctggtaagttgccaccgtaatcggacgcacctcttttttctgaccactatactccccgatggaatcggcaggaatatccgtcttttgctttaactcttctacccattgacgtacagatgtagtattagatgttagaataagcacctcgcactgaaaccgattcattaccgccatacctatcactgtttttccggctccgcatggaagcaccagtacaccactaccccctaagccgtccgctccttcaaacgcatcagcggcctttacttgataatcacgaagctgcaacttcgtttgtccctttcccaaggtaaaactaagctgattcccttcaagatagcctgccgtatccacaacgggatatcccaagcgcgttaattcctgcttgagcaagcctcgattttcgggcgggaccgatgcgcttacctcatcaacgcgaagtaaaccaagctgttttagctcttgcttggtcagaagctcatccagtaaagcgggggtctctgctcccaagatcaagcgatcacctattgtatagctgttggctttccctgtctttaaacctccgtctggctcatgttcagcacggtatgcgccaatcgtatctgtgctataagttcgctcttcttccgtaccctcccttgaaagcgtcaacgtcccataacgagaaacgagctgttcaatatccttcaacaaatcacgtggaatatcccaacgagacatggagttcaaactattttgaatgtcctcagcactccatccgagggcagctgcgttccacaaagacagtggagtgaggtgatatgtatgaaaagcggacgggcttttaaccagctccgcataaatctgcaactgtgaacgagcccgttctgaaccgggcaagcccatttccagcagaacggtaaaatcacgttgtacaatacaaggatgttctggattcataactacctcctgataatctaaccatacatcattttaagttatataataaatagcttatccgtttattcgcatatcaaccagaacagcaaggagttcaacccatattcgggttgaactcctgattagaagctcggggtaaaagacctccccaaaccaatgcctaccttaattattcttctagtggacctgctcggaaatatgactaagcgcctctccagcgttgtctgcaaaaatattacgaacagccaaatccccgatcgagacaatcccgatcagacggtctccttccgtcacgggcaaacgacggatttgctgctctgccatcagctcagctgcttggtccaccgacatgtccgcactagctgtacgaatacctgtcgtcataactgtatcgaccgaacccgaacccgaatttttagcagcatagccgcgaacgacaagatcacggtccgttactacaccgatcaacttatcactgccttcgctttccacaaccggaataaaaccagtatcattgtccttcattttgaccgcaatttcataaatattgtcctgcggggtaaccgttacgcattttttagtcataacttcctgaacttttttcatgggtactccctccttttcaagagtagggtaccccatttcattcagctcatactccagattgaaccgttcccaattcaactcattttagcccttaattgcccctgcttttcgttccgcagcgtatcccgtagacattgcaataaacaaacgaaccgcgttaatcatcgcatcctcatcaaaatcaaatttcggatgatggtgtggataaaccgctcctttaactgggttacccgctcctacgaacatgaagcaacctggcacacgttccaaataatacgcaaaatcttcagcaggcatcagcttcgacgcttcctgtacattctcctcgccaaaaacagattttgcttcattaaagaaacgatgtgcttcatgtgcgtcattgacaactggtgggtatcccataatatagcgaacctgtgctgttgtaccgtatgttgcggctgtaagctctgtcacctcatgcagtcgctccttcattaccgttcgcgtctcctcatcaaacgtacgaatcgtcccactcaagcgacacgtttctgcgatcacattttgcgcagagcccccttggatggttcccaccgtcagcacggcaggtcgcaaagggtcgactgaacggcttacgatactttgcagttgcataacaagagctgaacccgccaccacactatcattagtggactgaggcatgccaccatgcccacccttacctgtgatttcaatataaaaatcgtctgccgccgccatcagcggccctgcgcaactcgcggccgtcccgaccggaaaaggtgtccataaatggatgccataaatgacatccacaccttccaatacactatcctttatcacactgaccgctccgccaggcaacaattcctccgcaggttggaacaacaaccgaatttctccttgcagctcgtcccggttcagactaaaatagtaagccgttccaagcaacgcggatgtatgtccgtcatggccgcaagcatgcatggctccgtccacgctggagcgatattcacattccttttcatcctgaataggaagagcatccatatcggcgcgcagcatgacgacaggcccgggcttagcaccacgaatggtacctacaacaccgtgtccccctacctgacggcgaatctcgattccccaactctccaacttatccgctacaaaagctgcggttttgctttcttgaaaggaaatttcgggattcttatgtaaatgtctacgccattccaccatgttttcttgcaaacgatcaaaccaggtctcgtctatcacatgttgtgtcattctgctccacctctccttttaaagcatcgggcaagttcccgattaatcatgcagcgtcaccacgtatgcaccgctactctcaagtcttcatttttatcctattgtagcagatatggaattgttgcgatatctgttgctccagggagcttgcagaagcccatcaaacataatatgataaaatggataaacgataaaatgataaccgtctgcgaggaatataccttgtgacgaataccgggggaagctgatatgagaaatacgaagccggagactcgaagaagaggcacaccggatttccaattgctgatcctcactttgttactggttggattcggtgtaattatggtatttagctccagctccagcgtagctctgctgaataaagaatacaattttgattctttatattttgtgaagcgccaatctgcttttgctgtacttggactttttattatgttggtagctatgaatattaagatggaaaaatataaaaagctttttgtacctttatttttcataactatattactgctaatcatcgttctttttacaggctcacttaacggcgcaaaaagctggctcaggtttggtagtgttggcttccagccaacggagcttgcgaaaatttccatcattctttacttatccgcactcatcgtcaaaaaaggagatcgctttagagatctgcggactggctacatacctgtaacagtcattgtaggttgtgttgcaggactcatcatgcttcaacctgatttaggttcctgcttcattttggttgctacgagtggtctgattatttatgccgggggagccagtgtcaagcatattacagcatccattgttctgctcgtgctaggtgcttccatcgtgtttggtattgggtcgttgtttggaggagattctggaaccacagatggacaagctgctgcccagcaagattataaaatcgggcgctttcaagcctttcttaatcccgagaaatatagacaaggaacgggatacaatctggtacagtccttacaagctataggtgaaggcggcttaaacgggtcaggctttggtaaaggtattatcaagcttcactatcttcctaattcatttaatgattttatcttttccgtaatcggtgaagaattcggatttatcggaacagccatattcctgatgctatatttgtatttcatttggcgaggcatgatcattgctctgcgttgtcatgatccgttcggaacgttggtaggcaccggcatcatgggtttgatcgccattcaggccttcattaatatcggcggtgtaacccaaacgattccaatcactggcgtaacgcttccatttatcagctttggtggctcctccctacttgtcatgatgttttccatgggcattatgctcagtatttctcgtgagaacaccaaacaagcggtgcaggaacgcaccacaggggtagctgtccgtaatgaagtacccaatcgctttcaaactcgtagaaccaaccgttttcgctaaaaaagaacttccaaggtccacttacaacggtggctttggaagttcttttggttatgtataaaatacgagagccctctgcaaaaatggctatactgttgattcacaaaacgaaaactggcgattctataaccaccagttttcgtgtttttattcgggttatcccacggaatttcccgacatgtatacaattggttaaaaacatcaatttgtcggttcctgattcttttacactgcgtcgtccttgaacgcgacaccttccacttttacgttcacttccacaacccgcaaacccgtcatactttcgacggcttctcgcacattttgctgaagaattcgggatacctcatgaataggtgtttcgtagagcacgacaatacgtagatcaatggcagcttccagctgtccaacctccactgatacgcctttttgtacatttttaccgctcagccttttggcccagccttccgataaaccgcctgacattgcagcaatgcccggtgtctctaatgcggccatcccggcaattttacctacgacatcgttggaaatcttgatgtttcctgcttccagttgttgaatttgctctgccatgacctatgtcccccttcatccatcctttatttgtattgtaaagcctcagccactccaaatgcaaaccctacgtatgaaaaacaactttcgtttacaacctatatcattttgggtatattaatttagaaaatccatacaagtgacagctttcgccaaacttgtacacatctattgatatcgaggtgctcttcattgaaaaaatggttatctcccgctttgctcatagcgacatttgctcttagcgcagtcgctcattacacccattggaatgcaatagcccaatttgtcatttgtgcaatttctgttgtattcgtagccggttttctcggcagggcgaccgaaagtgtcgcgcattatgctggccaacgtctaggtgggttcttaaatgccacctttggtaacgcagccgaactgatcatcgccatctttctcgttaaagaaggtctttacgatatggtaaaggccagtcttaccggttccatcatcggtaatctgctgctggtgctcggagcaagtctgttcgcaggcggtttgaagtacaaagtgcaaaatttcaatatatcgctggctggattaagtggttctctgatgattgtggctgttattgccttgttcgttccagctgtctttctgaacacacacgttatcacggataacgaatcagatacgctcagcctgattgtcgcaggcacgctcattgtcgcgtatattgcgtggcttattttctctatgattacgcataaggactatttagctgacgtgaccgaacaaaaagatgaagaattgccacatgagcatgcccctgtgtggtccagaaacaaatccattgcctatttggtactcgctaccgtcatggtcgcttttgtcagcgaatggctggtaggtacactggaggtgtttacgacccaatttgggctcagcgaattgttcgtaggtgccttcctcgtcgctattattggtaatgcagcagaacatagcgctgctattttactggcgatgaaaaacaaaattggtgcatcggtcgaaatagctgtcggcagcagtttgcaaattgcactatttgttgcccctgtgctgatttttgtcagttactttatgggaaacacgatgaatattgttttcaccactattgagctggtcgccattgctgtcgctgtatttatcgccaaatccatcacccaggacggctcaaccaactggtatgagggactcatgctactggtagtgtatgtattgttaggtgtatccttcttccttgtgtagctttaaaggttttaaaatgtgcattaggatggtggaagggcgaggcgcttttgccatcctaaaggaacattttttttaaaaaaaggcatcaaaaaaagcatgctctcaaactccgcatgctctcatcaattcaaccgtcttcctaattggccttattattcatggcctcatatagaatagccagattgcgttccagctcactgaccagctgtttacctaccatttctggaagaagtccagcgcgaaccgcaaaatccacttccttggaaaatccgtacatctgagtatccagcacttcctcatagagagggcaataacgggttgccagattctccatctgtacttcaataagcttctttattttatctgcatcttcctgaagcagattaatagccttgatattcaattgttcctgcaaatcagatgaagtcatggattcttcccccctatgtctcaatgtcgcacaagacgtcctatccttaatattagaccaaattgcaggctaatacaagaacctgacaaaaaaagcatccctacagttacaggtagggatgcttttgcttcaagaataaagttagctggctactgaaatatgaagtccgtgcttctcgaatacctcgatgatcgctttcttagcttcctccgcatctggtccatgaacgtgtagttcatagctatggctgctgactagggtcgtaaacaagcccagtatacttttcacatcaatatacttattttcggaatgaaggacgatggaagaggtgaacttgctcgccgtctgtgcaatttcaacaaccgccgcgttattattggacatagagatccctcgctttactgaattgtcatgtatcgttactcacccataataatacattgaaatcgctttctcagcaagaacggatatcgttattttaaattctcagggtttaatggctccagctcaggcagtacaaagatgccgtctttacgaatcaaaacatcgtcaaaataaatttcaccaccgccatattctggacgctgaatcaacaccaaatcccagtggatcgatgaacgattaccgttatccgctgtttcataagcttgacccggtgtaaaatgcaagctgccggcgattttctcgtcaaacaaaatatccttcattggatgtaaaatgtgcggattaaatccgatggcaaactcgccaatataacgtgctccctcgtcagaatcgagaatatcatttagccgcttcgtatcgttactcgtcgcttccacaatcttaccattttcaaaacggaatttaacattttcaaaagtaataccattatacaaggtttgtgcattgtagctgatagttccgttaacggaatcacgtacaggcgcgctgtaaacttcgccatccgggatattgcattgacctgaacacttgatagctccgatttgcttaatagagaaattcaaatccgtacccggtccgctgatccgtaccttgtccgtccgattcatcaggtctgccaatgcatcttgagctttgtccatttttgcataatccagattacacacatcgaaataaaaatcttcgaatgcttctgtgctgatattcgccaattgagccatgctgtcattcggataacgcagcactacccatttagtgtgtttcacccgttgttcgctatgtaccgcatgctgataaatggaattatacattttcattttatcttccggcacatctgacagatcatttacattttcacctgcacgaattccgatgtagcagtgcatttgcttcatccggttaaggtcaatctcagcccaggtctccagcatctcctttgtcgcgtgacgaagcatggcgctctgtaccttacggtctgtaagttgtacaaaaacatttccaccttttttaccaacttcatgaatgatggcgttaagcaagtcgcgctctgtaccaatcatttcgatcaatacattttctccaggctgcacttcaacagagtaaccgaccagattttctgccagcttaagtattctaggatctttcatgtagtgtctctcctttatctatttcattctttttgaacaatggttaattcaaaattcattgtatcacgcccgccacgttacttgtagtccttaaaagtaactctggttatcaaagcctcttgatgcagctcttcattcgctccctgtcgggaaatcctgcattccgatgaaagctttaagggtaaacctgtttggcgatctatggtcagatgatacacagtacgcacaatggattgctccagctggttgctcatatcctcacaactttgtacccatatttggctcaacttcttttgcagttctcgattcgttcctgtatgctgcgtttttaatatcccgatttgagggtttaaagtattcatttcttttactaaacgatctttcaaccagcgctttgccgaagcagattccggttcaatcctcaacacccaagttccccgggcagctcccgtttccatacgaatgctcttattcagtgtatttaattcctcaagctcctgaatcggattgaagcgatttaacataccatttccaaccagagggggataaccggatgtcagcgcaacccattttccactctgacgaagaaaacgttcttgtgtaacatcatgctcggacttaccttgtttcagagctgcgtagccaccttgcttacgaaaagccactgcagagccccagtgcatggtcaattcatcgtgatttcttagtctaccgcgatattcaaactgcttattcgtcggcagaccactgtcagctctaattgcagtccgtccagtaaacgttaccatctctttgccggccattcctgcaacagctctcttaaaaatctgctcaggagtatattgtcgatccagtgcacaaccacttaacacacctattacaaggaacacacaaacctgcatcacccattgctttctccaatccatccatcatccgtcctatcctgaacataactatactcatgagcaataagcctgcttcaaggcagttatgctacctggttcactttatcgtgttttccctataattcaatcatacacacggtatagctacgtttaggattacctgtctgcaatgggttatgcaagacaaaaagagaacattccctatggaatattctctacacattggctacatgatcaacaactattcgattgcgtccttcatttttcgcttcgtacaaggccatatcagccctataaaataaagattcaatactgatctgctcatccagccagttccattcagcaatcccacaagaaacagtcacctgaggctcggtttcatgctgcacacggtaacgtattttttctgcatattcgagcgcctgctgaacccccagctgcggtaaataaatggcaagctcctcgccgccccatcttgcacatacatcctcatcgcgagtcgccgaacgaacgatattgctgacgcttttcaaaatttcgtcacccgtctgatgcccatgcgtatcattcacctgtttgaattgatcaatatctaccaaaataagagatccacagaaatccttttcctgatgttgctgaatgatttggtccacatagtgacgtacatacagacctgttaacatatccatattagccaatcgccgcacttcagcgtgcagcatagcattggttaccgccaatccgatatgaggggctagcatttgcagcattttgtaattatcgtaagagaaagagtgtggaagcttgctggacaatagtataacccctttaggagtaccgctggtcttcataggtacagccatcaaagactgggagtctgtcgcatccataaaatgagaggatatctttccatcctttctatagtccgacacaatcactggttctcctgttaagcgtatcagcccagcaaatccatcttcaagagggtaactttccagtcttaagctttccacattactcgacatgactttaaaacagtttccatcctgatcaagctgtacaatacaacaaaagtccgccatgaacatttttaataactcctgcacggcaaattcaaatatttcatttaacttcaggctctgattcaagcgctgaaccagttcattaatgagacgcaattcatggataagtacattcgattgctcaagcagcttcgcattttcaaatgcagtaccagccgtatccgccatcatggcaatcagctctacatccacttttttcatactatccgcacccgatggaagaatcatatggaaaacaccatatacaccctgcttgccacgtaatgggatggcgatttcagttatttcatcttgtgtaccgacaggctcgttcacagccatttgccctttcataaatgcacggacgcatacatcttcatcccgttcatgcagcagcaaaggtttgacctgcggattgcgactgtgtcgatcctgactcatgtacaaggtgatatctacatggggaaacaaataggcgatgctcccgaatacctcatccagcacgccttccacgtcaattttgtcatgcatccgttttacaatctgaaataaaatagaacggcgtctaccttcacgatcgcttcgattctgcatcccaaggatatcttccataaatatgtactcaaacttcgagtaaaagcaggatttaaaatgtaaagcagctactaacaatgtgtcctgatttgagacagaatgttgagcaggccgtgtaaaacgaagagcggcaaagggctccctcttataattacggcatagtatgggaaccataaacacaaacgcaaggcttccatcacgaagtttgcgttggctcacttccacctctctagatatgcaacaacgttcgaccaaatccaaatcctcgtcatcatcttcttccctaccagcaacacgaacacctataaaattaaaaacagcagtatactcttcgttaatccaggatataccattgctctgctgtaaccaactccgatatccttggacaagaagctgattaatataggggaaatcatagggtgtcatatccatgttctggagccaggcaaaagacgtatatcctttatcatcaaacagcggagcaccgctagcctggactgttttactgtcaagcatttgctgatccgttgttgaaaattccgacatattaaggcgctccttcacagcaaagttagctgtaccaagacagcggctatacaccactatagctcataatatgatctattttactctcaactttagaaatttgcatccatttttcagaaattcgtcccacttttttagttctaaagccctatcgacaaattttgacgttttcattctttttctcttcttgacattgacctactcttacatatagtatatattattgaaaaagactgtacggcagaactatctactgtgcggatcttaaattttgggcgtaacagtttgtgtcaccctcatcttttttgttgctgacaggacagcggctgaacttttctgtcagtagtgcgtcttaccttaataggtagcgccgaacaaattggagcgcaaagagagccccactcaaattttaattatgaaggagttaactctataatggcacgttacactggtcctaaatttaaattgagccgtcgtctcggtatttccctgagcggcacaggtaaagaattgaaacgccctttccctccgggacaacatggtgcaaaccaacggagaaaaatcagcaactacggtatgcagcttcaagagaaacaaaagctgcgtcacatgtacggcttgggtgaaaaacaattccgtaccctgttcaacaaagctcaacacatgcacggtatcgctggtgaaaactttatgttcttgctggaaagccgtctggacaaccttgtattccgtcttggctttgctaattcccgtgcaggcgcacgtcaattggtagctcacggtcacgttactgtgaacggtaaaaaagttgacatcgcttcttaccaagtaagccctggcgacgtgatcggtcttcgtgaaagaagtcgttccctgtcttccatcaaagaagctttggaaaaccgcaaccacttggtagcttacctggagtacaatgacgcagctctggaaggtaaattcattcgtttgcctgagcgtggcgaattgtcccaagatatcgatgaaaaacaaatcgtcgaattctacaaccgctaatccttgcattagcaccaaaaagcacccgaatttattcgggtgctttttatattctctatgcatcgagcctgagggttttattcaatggggatgtataccttcatactcaaatgatctggataggaggaattcatcacgtccgtaatttcaaaatcaggcccctccctccgttcaaaattagaattaggaagccatgtgccatagataaagtctcgtatattctgaacccgtccatctgaacccgaagcgtcaaactcagcatacttccctgctggaatctccatatatatgaaaccctctgccagttcttttgactctttttcaactgcctcgcccaccacaaatgaaaatgcaccgttatcttcaaatcgacaggcaaccccatatgacattcccggtgcaattttgttcgggatacacataaaatattcatttgctccaaagtgtccataaaatcctgggatttctttatagtgctgctcattattcagatttgttttatattcatatcctacaattttgaccgtttcgagctgcaatatcaccggcttattcacatccaaatcccccatcgtatttttttggtaatccagaaaattgattttactttgcccaggaagctcaatatcaccgttacgatacttcccaggggtgatcccaaaattcttttcaaaagcgcgggtaaaagcctcttgtgagttgtactgatactcaatagcaacgtccaacactttttgattggattgttttagctgttcagccgcctcggacaatcttctccttcttatatattgttgaaccgtaaaacccgaaatggcctgaaaaacccgctggaaatgaaaagctgaaaagcatgcctgtgaagcaatatcggcaattttcagatcctcccggagattcaattcaataaactcaatcgcacactgaattcgtttaaagtagtccatataatccttccccgcacttgtaattgttttggttatcgatcctacacccaaattgtgcaatccacgttttcagtatgtataactctttacctacatgtttgattatttgtgctaagattaccatgacttttcactttgcagaaataaaaaagcagcgctgagatcgatacaatctcagcgctgcttttgaatatattttcattatccaagcttgattttagcaaatttccgtttacctacctgcacaatgtcgccttccttcggcgtgtatgcttcgttcacatcggtccatttctcttcgttaatcttgaccgaaccctgctgaatactgcgcttggcttcaccgttagatgctgcaaagcccagatgagtcagcaactggatcacacgaatgccaccttcttctaactgatcagccgtcaaggtgaactcttcaatatcgtcaggcagcgcacgttgctggaatacggtcacaaaatgctgcttcgctgcttcctctgcttcttcaccatggtacatgcgcactaacgttccagccagcttcattttggcatcacgtggatgcactgagccgtccttaacacctttcgccagctctgccagctcctcgttgttgatatccgttgcaagctcaaaatatttcagcatcagctcgtcaggaacggacatggacttcccgtatatttcgttcggctcctcatcaacaccaatgtagttccccaaacttttgctcatcttctggacgccatccagtccttcaagcaatggtaatgtaatcgtagcctgcggctcaactccgtattctttttgcagggttctgcccattagcagattaaacttctgatccgtcccccccaattcaatatcgctttggagagccacggaatccatgccctgcatcagcgggtaaaagaactcatggatgctgatcggcaatccgttttggtacctttttgtaaaatcatcccgttccaacatacgggcaaccgttactttggccgacagggttactacatcagcaaaagacattggccctaaccattcggaattgtagaatacctttgttttttcaggatcgagaattttaaaaatttgttccttgtacgtttgtgcattacgctgtacatcttcctcagtcagttgcttgcgagtctccgatttacctgtcggatcaccaattcttcccgtaaaatctccgataatcagttgcacttgatggcctaattcctggaactggcgcagtttgtgcataacaaccgtatgtccgatgtgaatgtcaggcgcagatggatcaagacccagcttaattttgagtggctcgccgctaacgaccgatttaataaccttacgcttcagctcatcctcaggtacaatttccgctactccacgacgtatcacctctagctgtcgctcgacctctacctgttgctccggcttcaattcttcccacttcatcctgtatacctcctatttttcatccaaaatattacatattagacaaaccaaaaagcccctttcatcccaagggacgagaaggagctgctcgcgttaccaccctaattaaagaaacgcatgtcaaagacagacatttctttcacttcattcctataacgggcctacacccggtactggattactatgatagcttcgcaaacctgcaaatgctttccattcatccagacagctccagacggtaattcaaaggagggacgctaccgattcacaccacccatcggctctctgtacaacgtgaatccgccttctactgaagtctttctatgcttttcacgatatttactttgacctatttataacacactccttttatgtagtcaacgacaccaaaagacaggctttttagcatatgggttcattttgtaattttatgctataataatggctgttataaaggaggaagacttaatggttgaagaaaaaaacaatgtatcagagccaaagccttcccgcttgcggacaaccatgcgaaggctcggccgtgtcataaagtgggtcgtcatcatcggttttatgggggcactatttgcaggaggagccgccgccggctatgttgcttctattgtaaaaagcgaacccgtgcgttccagatccatgatcctacaggaagtagataagaatgcaatcacaggcttcgcttatttcaatgatggctctcccatcggacaacttcggacagaagaagatcgaagacctgtcacgtttaaggagattccacaactcgtcattgacgcagtcattgccattgaagataatcatttttacgagcataaaggtgtcgatctgtcgggaacgctgcgtgctgtgaagcaaaaggcgctgcatgaatccgtacaaaccgggggtagtaccctcacccagcagcttgcgcgtcgtgtctttctaaatctcgatcgcacggatgaccgcaaggtcaaagaaattttgctgtcgctgcgccttgagcgcttcctaagcaagcaacaaattattacggcctatctcaataaagtaccttttggtaacggttcaagcggttacaacgtctttggcattaaagcagcggccaaaggtatctttaatgagaatgatctgaacgagcttaatatagcccaggctgcctatctagcaggtttgccacagcttccttcttcttattctgctttcaacggtaagggtgagtttaatgaagctggctttaaaagagccatcaaccgccagcacctggtactcagtcgaatgctggaggaaaacaaaatcaataaagcacagtatgatgaagcgatggcttttgatatcaaaaaatctctcgcaccacgcactgttaaagcttataacacctatccatatcttatgatggaaacagaacgacaagctgcgcaggcactcatgtctgtcaccaatccgggtcaagcagctaatgccagtgcagataccaagaccaaggatgataacgatttactcaaagaagccgaacagcagcttcgcacaggcggttatatggtgtacaccaccattgataagagcgtatacaaatctatgcgtcaaattgcagaaaataaaaacaacttctctgccactagtaaaaccaagggtgacgaacaagcagcggcaattctgattcagcataaaacaggcgccattcttggaatgatggaaggtcgggacttccaaaaggagcagatgaattatgccacccagatggtacgtcagccgggttcggcaatgaaaccgattgctgcctatctccctgcattggacagcggtcttgtgcagcctggtagtatcgtggatgatgcccctattattttgaaagatggcagtaatggatatcacattccgaaaaattctaacaaccgctatcaaggattggtcacggcgcgttatgcactgaatcaatcgctaaatacgatagcactcaagctgtttaacgaaaaagtagggattagcaatgcttgggcttttgctaaaaaactgggtattaccaccttggaatctagtgataacaacgcccaaacgggtgtacttggcggcttagcccacggggtgaccgtcgaggaactcacgaatgcatatggagccattccaaatggcggtgtgtttaatgatgcctatatgatcgaaaagattgtggattcgcaaggcaatattgtatataagcatcagcctaatcctgtgcaggccttctcaccgcaaaccgcctacctgatgacagatatgttgcgtacagccgtgtcggaaggcacaggcagactggtgaagcggaactttgatcaatccggtaagattccgattgccggcaagacaggcactacgcaatcctacactgatgtttggttcgagggctttacgcctgacgtcacactgggtgtatgggttggttacaagcaacctgtcaataagcttgaaacgaaagtccaaaaagagcgggctcgccgcttatgggctctaatcatgaatgaagtaacagctaaggatgctcagctgttccaaacggacagcttcaagagacctgacggcattgtaagccgtacagcatccgcgtatggttcggacatttataacagtaagtatccacctaaaaacagtgaaaatggtgtgagccgtgcgaaatatattacctaccaaggtgtgaattatattccacgcgatggtacaccggatgatatgttatatgaacggaccgttaggaaacgggaaaagtcaatctcagaattgattaaagagcttcagcaagcctttaaggtgatgagacgacataactcgttgtcctattatctgcctcaggatgcagataaggaagctcctactcagattgatccacgcaaggacgatggagcagcccctaacgctccatctagcgtcaacgtaagctatagtgacggtaaagccataatcagctttagcccaagcggaaacagcgacgtcgtaggataccgtctgtatcgttctacagatgggggtagcttccaacggcttggcaaggtcgttatggctgacggctccaaggtgttttctgacagccctggaggcagcagctccagctactacgtgactgccgttgatgtgggcggtcatgagtccgggccaagcacgaaagcaagcgcagcacctgtggtgccacctgcagattctgagtctccaaacgttccgggcgagggagatggaacaggtgcgcagcctacagaggttcctactgcccctggacagcctcaagctaaagccgctggctcatccgtagcgctccaatggagcgcaggtaaatctgcggacgctattacaggctataacgtgtattacagcgaaaacggtgcggagccttttacaaacataggctctaccgcatctaccagctttgaatataagtcagggaaaaagctaaaaggttggtttcgtgtcacttccatgaatgccatgggggaatcggctccttccggagccgtccgtccataactgaagacaaaagcagaaagtgataggttgggtgaagatgagattcgccctaacaaaaagggagtccccttagccattaaggctttggagactcccttttttaattctaatatgcagagcacttcaatcctctatggtggataagtcacctgtaggaaggttaagctcccaggctttcaacacgcgtctcataattttaccggaacgggttttgggtaacttttccttaaactcaatttcgcgtggagcagcatgagcaaacagcccttccttaacgaagcgatagatgtcctgctttaaagcttcagacggtgcatagccttcacgcagtgcaacaaaagctttgataatctctccccgcacggtatctggttttccaataactccggcttccgctacagcaggatgctccagaagcttgctctccacctcaaaagggccgatgcgctccccggaggagttaatgacatcatcaatcctaccctgaaaccagaaatatccgtcctcatccatgtaagctgaatcacccgatacataccaaccgggaaagcggaaatattcctgaaacttgttcggattgttccatatacgattcatcatggatggccatggtgtacggatcgccaagtggcccatccggttaggaggcaacacctgccctctgtcgtccaaaatagcagcctggatacctgggagtggctttcccatcgaacctggcttaatcggcagctcagggtaattacagatcaactgtgctcctgtttctgtcatccaccaagtatcatgaatgcgttgtgtatacacttgccatccccatcgcaccacttctggattcagcggttccccaacggataaaacatgccgcagactgctaagatcatatttggaaacaacctgctcccctgcgctcatcagcatccgaaacgctgtaggagcactataccatatggtcacttcgtgacgctcaatcgtgcggtaccagtcttccgggctgaaacgccccccacgaatgacattcgtcgctccatttagccatggagcaaaaataccgtatgatgttcccgtgacccagccaggatcagcagtacaccaatacacatcatcttctcgcaaatccagcaccattttcccagtatagtaatgctgaatcattgcattttgcacatgatacacgcctttgggcttgcctgttgagcctgatgtatagtgaataattaatccatcttcacgattcaaccattctggctcaagttcctctgaggatgtgagcatttctgtctcaaaatcgataattccctgctcgcgttcatccatatcaccaaccacaaaaatatgtcgcagctcaggaagctcctcacgttttacccgtgacagaagcgcaggtgtggtcactaatgctactgccccactatcctccaatcgatccttaaccgcagtttccataaacgcctcaaacaatggaccgacaacagcccctacctttagaacaccaagtaaactaataaccagctcgggtgaacgcggcatgaaaataaacacccgctcccctttaccaataccgtatttgcgaagcacatttccgaacctgttagagctagcacgaagctgagagaaggtgtaggtttcatgacggtttgcgtcacaatacaatagtgccgctttctcccctcgtccttcctgtacatgtcgatcaatggcttcatgtgccatatttaccttgcctgtttcataccacgtaaaatgacgctctgcatcttcccactgaaagttgttgtaagcttgttcatacgggcccatgttggatgtgggaactacagtctggagttcttcaaacttcatacgttcagcctcctcacaatagattaatgagaatcacacagaacaagataacgcttacaaaatcaataaagcagatgaagccctttggtttactgattgatttaaattgtgaacattttatgtctaaaacagtatatcataggtcaggatgtgacgaccatccttttcatttaattgtttttttgctataagtaggggatatgaggaacgagcttatggcgaacaaggagggcgtacgcatgcagcatttaaaactgtaccacttggatacgctggatcataacggacaaacaatctatgtagaaggccccgtatccgcggatcaactgcgttcatttcaaatgcacaagcaattagatgcctttcgcaaaccaaaggaacagttcgatgcattagtggatatttcggaactgccagaaggcagaattatcattgcccacaacggggaaactctcctgggatatgttacttttcattacccagatgagatggagcgctggtcggaagctggcatgaaggatttactggaacttggagctgttgaggtagccgatgactatcgtggtctgggcctgggtagccgaatgattcggattgcctttgaggacggccagcttgaatcctatattatttttacgaccgaatactattggcattgggatttaaaaggcagcggtctctccgtgtgggaataccgccgcatgatggaacgtctgatgaaaactgtagatatggtctggtacgccactgatgatcctgaaatatgttcacatcctgctaactgtctgatggtacgaatgggaaaggatgtgccccttgcatcacaggagcagtttgaccatatccggtttgtccgaagattcatgtattaaaaaattataccattagcccaaatgcttgagcatgaactccacaatacgatgcgaacgatgtgaagcttctaccgtaaattcagcataattaacgtgagccgatccatcagccttatctgacatagaccgtaggacaacataaggcacagcgttcatatgagctgtctgagccacagctgcaccttccatttcggtacaagcaccgtccatttcctgatgcaatgcagtcactaactcacgacttgcaacaaattgatcgccagaaagcaccttgccgacaatataacgatcgccaaacgatttgcaggcttgctcagctagacttacaagctcaggattagccacaaactctgaggtgtcctgataaggaatgactcctctggcataacctaaaggcgttacatccatatcatgctgcatacatgttgatgagatgacaatatccccaatgtttaaatcgggatgaacggcccctgccactcccgtaaatataatctgttccacaccaaaatgatcaatcaggatttgtgttgttaccgcagcattaaccttgcctacaccggatttgcagacaacgactctttgcccgtgaatgattcctgtagtgtacgtgattccagccttgaccgtcttgcttgcttccgtcatcgctgccagcagcaattcaatttcttcatccatagcacccattaatccgtaaagtcggctcattacgcatccctctattcttggtttgatgatgatgtccataagaagctttatatccgcgaaaaaagctccatcaaaggagctttcatcgaaggtatatcctattcagcactgcgtctagtctaaataattaactgacaaccgcaaaatagtttcatgcggcaaaataacgcgagggttctccacgttttcctttttcatcagcttggtcagcaaacgcatcgctaccgcacccaaatcgtacatcggttgcgcgacggttgtcagctgaggacgaaccatagaggccatacgaatattgtcgacactgattaccgaaaaatcatcaggaactttcaatccctcatcctgaatactgtggattgcaccaattgccatttcatccgtagcagcaaaaattgcacttggcttcttctttaggccgagaaaatatttcattgcttcgacaccggattcataacggtagttcccgattcgcacgagatcctcctgataatcaattccggctgtttccagtgctctcttgtaaccttggaaacgtgcatagccgtttgcagggtcttgaagagtaccactgatcattgcgatttgacggtgtccatggcggatcaacgtgtttactgcatcataagcagcggcttcatggtcgatatcgaccgaaggatagcttcctttttcatcactcgttgcacatagaacaatagggaccgcagctgtatggaacgcctgaatatgctcgtccgttactgtaccacccatgaacagaagaccatccacttgcttttcaagcaatgtgttgatgacacgaatctctttttcttttcgcttgtcggcattacacaaaataatattatagtgatacatattcgctatatcttcaataccgcgcgcaatttctgcaaaaattgagttcgatatatccggtataaccacgccgacggtcgttgtcttcttgctggccagacctctagcgaccgcatttggacgatatcccaattgttcaatcgcttcgtacactttcttgcgggtctgaggtttcacattaggattattgttaactacgcgggacactgtggccattgagacaccagcttcgcgagctacatcatagatcgttaccgtcacattccttctctccattgccaataaattttcaaccgaatcctagatcaactaattagaaccatgatacgacaaaatactactttatgcaacgacagcacacatttatctatgtgagatgatcgtggagtgcacgggctgtaatattcgaatgggatgtatgccaaacagcctctccgtccttgattaaaatggcctgcggggattcatgcttcacctgaagcctgtccgcggtttcattggacaccggccgatcttctactacataaatgataccgtattcaatattttcgttgggagcgccatgcaaataggactccacttcctgatatgcgcctgcacttatcggacaacgtgtgctatgtttaaagagaagcaacggcttgtctgatgacgcttccagagccgtatttaattgttgaacagtagtcatttttgtcatcgtcgccattggatatacattcctttctgtgtcttgtcgtatggcctattctcatcgtaacaaaaagaacatgtaaaatccaatggtgaccatgaaaattttcatattttttagttttttgtattcgtaaataccgattcactggtaaaaccggataattgaaccaattttctctctacatcattcatccaatcttcgtctcccagacttctcgcatagcgataaagatccaataagagattaattcgaagctccatccgctcctccaaagcagattgccaatccacattgggattgtccgcttcctccagtacaagcttgcgaatgatttctgccagttcattgttgcgagcaaaagatattctccgtgccgtaggtttgctccctagactttgtaatagtgccttaatgtctttcgtcacatgctgcaaaacctcactggaaaagcatgacgagcatgagaatacagggacgtgcaaaatttcaaccttgcccgcatagattacctttcgcagttccagtcccatcggtttgccacattgacattgcttatgcatttaaccacctcattacgtaggatcaaactatacgaggatctcgtcagaatccaaatatatctatctactagtctaataaatatttgttaactccattaaatctatcataccttgttttatttcgactttgggacctcaaatccttccacagattgcagctatgaacaaattaccaaagctttggcgggtcggaaattgacgacaattgctgttaaagagcagactactaacataagaatctgcgaaggaatggacttcgggcgttctttttcttaagatgtaaaagtacagattacaaaacagaggtgtcatcatgtgacgcacgaaaggatggttggatgtcaagacttgccggaaaaaaggttatcgccctagtggatgaggaattcgaggatctggagctgtggtatccgatttaccgtgttcgtgaagaaggcgcagaagtgcatttagccggtgcggaaaagggtaaaaaatatattggaaaatatggcgtacctgctgaagcggaatatgcctttgaggaactgaatagcagtgattatgacgggattctcgtccctggcggttgggcacctgataaactgcgccgctatcccaaagtaatccaactcgtacaggagtttcatgctgctcataagccgattggacaaatctgccatgcaggctgggtactgatctctgctaaaattttggatggtgttacggtaacctccacaccaggtattcgtgatgatatggagaatgcaggagctatttggaaggatgaggcagttgtaacggatggacatattgtatctgctcgtcggccacctgatcttccaccttacggaaaagcgttctgcgatttgttagcagataacacccggaaataagagaataagtcctgacactcagggcttgaataacccaatctaatggaatcaggataattgctaattatgaattttccataatcacaagaggttgtcaacaagatgaaaaaaagaaccttcaaaaccactttattcatggttttgaaggttctttttcatctaaaccatgctacgccattatggtttgctacgacaaacctaacagtacggagttcggctcctcctgaagatgtatacggacattacatattactgccgtccaggcccggccggagtgcagctgacattagctgcagtgagcttgtcttcgatcgctgcaccagtggacatgccaaagcaaacctgagcgactgtctttgcctcagatgcagtcgtattcagcacacgatgcttgacccgcaataatgattggggagacatgctgagttgatgtatccccagttccagccaaagaggaacggaccgttcatctccagccatctcaccacatacactcacatcaattcccgcttgatgtgccgcttgtgcagtcatgcgcagcattcgaagtacagctggatggtatggatggtacatatgtgcaatctgctcattcatacggtctacagccagcacatactgaaccagatcattcgttccgatactaaaaaaatctgtttcagctgccaatagatcagcgatcatcgccgcagccggtacctcaatcataattcctcgctgaatgttcggattataggcaagtcctcttgcatccaaatccgccatagcctccttcaaaagagcatctgcctggcggacctcctccacggatgaaatcatcggatacattaccttgatatttcccattgcactggctcgcaaaattgcagtcaactgggttttaaacaattccttccaatccagactgatccgtatagcacggtaacctagaaaaggattttcttcctctggtagttgaagatagtccaacggcttatctccaccgatatccaatgtacggatgactacggagtggtttcctgccttttccgctatcagccgatatacttcatactgttcctcttcatctggagcagatttgcgatccatgtataaaaattccgtgcggaacagtcctacaccttgagcgccatgcttcaaagccgcctccagctctttaatcgaactaatattggccgccagcctcagagtggttccatccttggtcacggcatctacagaagcaagtacctgaagctgctcttttctgcgtcgctgctcgtcgcgcaaaattttataatgatcagttaccgttttttccggattcacataaactttgcccaggtctccgtccacaaccatcatgtctcccgtttgaacgggcaaattcagattgctctccagtcctgaaacaagtggaataccaagtgcacgggccatgatcgcagaatgcgaagttttaccaccattcatagttacaatccctaaaacatagctaggattcaagtgtgccgattgggagggtgaaagctccttggctaccagaatatagggctgtgtgtccttgggaagagtcacctccggtgcacctagcaaatgcttgagcaaccggttccccacatctttgatatcaattgcccgctccttcatatattcatcgtccagtaaatcaaacattgtcacaaaatgatcaatggcttccttcacggccacctcggccgccttgtactgacgctcaataattccacgaatttcattcatgaattccggatcttccaatatcgcaagatgagcatcaaagatgctggattcttctggccccaccatctctcgaaactcatccttaataaactggatttcacttttggatgtgcgtatcccttcatacaaacgttcaaattcctttgcaagatctaccgcatccattttttgatcaggtaaatcccactcccagctcggcaggacaaatgccttcccgattgccacacctgctgcggcgccgatgccttctatcatgtttctacccctccaacattcctgtcatgcagcacaacggacattaccgaggcctgaccttttttcactgttttaaacggagcaaagctccacgacttgacgcgatctggattcgtgatgaccataggagtcaccagcgatggagcttgctctcgcagcgcctgcaaatcaaatttgatcagcaattgccccggttccaccgtatcgcctgcttctaccatagcagtaaaattcccttttagctgtgaagtatcaatccctatgtgaagcagaacctcaagtccctctcgtgtggagatgcctaaagcgtgcatggtcggatacaagtgcatcacagtaccatacactggagacacaagttcaccacgttcaggaacaaaagcaacaccgtccccgaccagcttcgtcgcaaaaattttgtcaggcacttcatgaatcggtagcatttttccatgtacaggagcgttgaacaaaatttgagggagatcacgttccatcagcttcgcgatttcctcacgaatcagttctgaatacgttccgaatacaacctgcaaattacccccacccagattgataagtccggccgatcccaaagccttcatcgctccggtatcaatcagcctgtcattgtggacggtcagtcgcaaacgtgtgatgcaggcctctacctgcacaatattttccttcccgccaagtgcttccaaaataagcggagcactataaggaatattgccggcccaatcctccagaaccgaaccttcctcgcgcccaggagttggaatacggaaccgccggatagcccatcgaaacagtacataatatacaagcccgtacgccactcccactggaattaacaaccaggcgttatgtgagagatgaaaattaaggacataatctataaaacccgccgaataggaaaatccgtgatgaatatccagctcaaaggtaagccacatggccagcccagacataactgcatgaacgaggaacaaataaggtgccgcaaacaaaaaggcaaactcgatctgttccgacactccagtaaaaaagcaaacaagcgcagctgtcaaaaatgttttttgcacctttggcttcaaatcttcacgcgcttcctgaatgatcgccagcgcaatggcagggatcgcaaacatcataatggggaacaacccggacatgaaatagcccgctgtcggatcgccagcaaaaaaccggggtaaatcgccctgcacaacgttgccagacggcgttttatatgtacccagttgaaaccaaaaaatattattaagcagatggtgaagaccaaaggctgccagcaaccggtataaaataccgtagataaacagtccaaagccgcccaagcttgattccagacctactataaattgcagccctctctgtatgagtggggcaataattagcatgagtcctgcaaacacagccgagaagaggccaataagcagcagaacaaatcgggtacctccaaaaaattgaagcacctcgggcaatttgatgcttttgaagcgattataggccacccctgaaatgacccccaaaatgataccaatgagcgtcgccggttgaatgagtccgtttccaaatctcaatgtgacctgatcgtatatagccataccagccaatgctgccagtcccgcctgacctgcctgattcgacatacccagggcaacaccaaccgcaaataaatatggcaaaaaataaaaaatcccgtgtccagccgcatttgccatatcagacaccatagggaatccccatgtggaccaaggaaggctgccgagacttagcaatattgcagcggctggtagcaccatcgtcgggagcatgacagcacgaccgagctgttgtaaggatccgagccaattcatggcattcctctcctttctatccctgatggtaagccgaataaatacttttgtcaaagcaatgattccatctgccaaaatatttatttacgctactacaggtcaaaaaatttatcatcacaacagataacactatgaatccgtttagagcaatttcatcatcaagacatacatacattatatggattcctgaaagtataatatactgtaccatattcctcgtttcgcaccaaaaaccttcaaccctgtgaagcaagggaagaaggtttttattcatctgcgtatagcacagatcactgatccatgtttatcctttacgtacagcttgggtcactgagtcctccaccttaatgcaacgatccataataaccgtcattccatgctcctgcgcaatgtcagcggcttcctggcttataattccctgttgaagccacaaaatcttagctccaatagcagctgcttcacgcgcaacctctgcacagtattcactgcgacggaatacattgaccagctccacaggttcaggtacttcagcaagactggcataacaagtctccccaagaatcgtttgccctgccgccgcagggttaactggaataatacggtatccccgcttctgcatggcataagaaaccatgtatgaggtacggtccgatttatcagacaaaccaacaaccgcaatattgcctacttgttccaaaatgcttttaatctcttctctcgacggattttcaaaagccattctgttccctcctattcgcatcttcgtttgtttttattttacccattctacagaagcaccaagcgtcgttaaatggtcaaagtactgcggatacgatttggcgacatgatgtgcatccttaatcactaacggcttctgtgcgcgcaaaccaacaatcgtcaaggccataataacacggtgatcaaagtgcgcgttaatttccacgccaccttcgacaccctccggtctgccatgtacgataatttctgcttgacgttcttctacccgagcaccagccttggtcagctcattcaaataatcggtaatgcggtcacattccttataccgtaaattctccacgttataaaaacgggacgtgccttcagcaaatacagccgcagccaccattgcaagcacagcgtctgttgcagcatcaccgtcaaactcaacagctttcaatcggccattgcccttcacaacgacggtatcgttctcatgtgtcagtggcacttccatcatacgcagcacatctacgatagcgcgttctccctgtttgctctgctcttttagacgatggatggtaacatcggaattcgttactgcagccgccgccagcaccgctgcactccctggatagtctccctgtaccgtatacgtacgtggctggtaggattgccgccccgggacacggaaagacatgtaatcatcgcttgcatgaatgataataccagcctcttgcaatacctccagagtctgcccaatgaccaccttagatttcaaatcatgcagcacttcgatgtcactgtcttcctccagtaaaggcgtaaggaatagcagggcgctcaaatattgtgagctaaccgagccggacacctgaattttaccgcccttcgcctgaccaccctgaatacgaattggcaacttaccttcacgatgatctactttcacgcccagttgccccagtgcatcgattaaatcatcatggggtctcttgcccaatgagtcggggtatgtgttaacaaatgtaacatccggacatagagatgcaatacccatcaaaaaacggagcaccgctcctgcgtttcccacattcaattccttcacagcttgaggatggctaccaaaacctgtaatcactattttttcatcatcctcttccagtactgcacccagatcggcgatacaacgacgcatagcatcactgtcttcactatgggctggataataaatggtactttgtccttcagcaagtgccgcagtgagcagataacgagtagtgtagtttttggaggacagggccccaatctctccttgcaaggaaggggtaggtctaacgataacatccataatgtacatgctccttttcggttcaaaccatcctattttacgttaattatacaagttgtagcattcatttctccacccaaaaaataagaaatattaatctaagtcccccaagttgaattccgtcggttaattaatctttatctgcctttaggattaagcagattgacagcctagagctagcttagctatcatacatagagtgtgtgtgacattttgcacacgtcaaaaacatacgtagcacccaatatatatcagaaaagaggtccggccatgacgcaaatcgccctgattgaaccttctgagttgcgcgcacgtctgcaagcaggagagcaattgcaattaatcgacgtccgcgaagcggaagaagtagcggaaggcatgattgaaggtgccaagcacattccgctcggacagcttccgggtcgtcttgaagaaattgaacgcaccggtgaaattatctttatttgccggagcggttaccgcagtgaacgagcctgcgaatatctacagcagctaggttatgaaggctgtactaacatgactggcggcatgctgcaatggtcacaggagcaatagaaaacctacttaacaaaagagacgggaaccttctcgtcttttttgttttgactcaaagcttagacgcggtaatgcattaaaatattttgtccctatcataccatagcgccaaaagattacacaatcctctactgccatcataatcgtgtccataattataaattaaaaaacggaagcttcttctacccatagggcaaaaaagcttccgttgtattacataatgctattcatgcatatccgtccgttcattagaaccattgatgatggaatacgccttctttgtccacacgtttgaacgtatgggcaccgaagtagtcacgttgtgcttgcagcagatttgctggcaaacgctcagtgcggtagctgtcatagtatgcaagcgcgctggagaagccaggcactggaataccttgggatacagccacggaaatcacttgacgccatgcatcttgatacgtttcaaccacatttttgaagtaagaatccagcaacaggtttttcaaggcaggatcgcggtcatatgcatccttgatgttttgcaggaattgcgagcggataatgcaaccgccgcggaagatcatagcgatttttccgtatttcaaatcccaatcatattcatcagaagctgcacgcatttgagcgaaaccttgagcataggacacgattttacttgcaaacagtgctttacgtacactttcgataaattcttttttgtcgccgctgaaggactcagcattaggaccgctcagcactttacttgccgcaatgcgctcgtctttcatagcagacaagaagcgggagaatacggattcggtgatcatggacaatggcacacccagatcgagcgcgctttggcttgtccatttacctgtacctttttgaccagcagcatccaagataacgtctaccattggcttgcctgtttcagcatcatactgggagaaaatgtcagctgtaatttcgatcaggtagctgtccagttcccctttattccattccgtgaagatttcatgaagctcttccgcattcacattcaggactgatttcaacaagtgatacgcttcaccgatcaattgcatgtcgccgtattcgataccgttatgcaccatttttacatagtgaccagcaccgtcaggaccgatatatgtacagcaagggtcgccttccactttagcagagattgccgttagaatcggctctaccagtttataggcactttcctgtccacccggcatgatagcaggaccattcaaggcaccttcttcaccaccggatacgcctgtaccaataaagcgaagtcctttttcctccagctccttgctgcggcgctgtgtatcagggaagtaggcattgcctccgtctataataatgtcgcccttgtccagatgaggcacaagctgttcaatcgtggcatctgttgctttaccagcttgaaccatgatcaggattttacggggggattccaatgagttcacaaattcttcaatagagaaagtacccgtcagttttttaccttctgcttctttgataagatcgtgcgttttttctggagagcggttaaaaaccgagacggtgaagcctctgctctcaatgttaagggctaaattcttacccattaccgccaggccgatcacaccaatttgctgttttgccatctggttcctcatcctttgcaacatattttgtcttctatatcgccgctttaccgcattacactttatgtgaatcggaacacgtgcacttctattttaacgtttttgatgtaagaagtgaacccctgtctattcacagatcaaaacaccccatttacatgaggtgttcagatgtactacgcttccatcatcagcagttggtgggatagcgtttgcaggcgttcatggcaattcccgattttagccgtatctccgtctgtcatcgctataaacagcttctccaattcatcgtccacttccattttaagcagcagcagtcgggtttctccttcattggaagcgtacatatcctccatttcctgtgcggacagcaccggccccttctgataaatgacacgctgcttaaagcctgtaacctcgaccagacgaatgacctcaccaaacaaaatattttctaccaaaatatgatgatccttgactcttttgacaatggcatgacctcgggtgcttccaatcagcttctccaaccactcagccagcttggcatcgcggattacataatctccagccaacttgtagtgtcctgtgcgcagctgttgaaaacggagcttcaccagcttacgcccggttctcaccgacaaaaccaggtacgactcatcctcgctccagtacagcgaatacccttccgatatcaaatccttgatcagattatggatatgccgacggctaaaccggagctctagattgcaatattctacctcacagcccttgttcacggcattccctcctttttcaagtccgattcaagaagtccggctacagcaagcctgcggctttcccgcttgatcttcccttgctctattttatacttcattttatgtaagggtacttggttatttgacctatttttatgagtaacagcgaacaatcctacttttgccttatatgcttgtttcaaacctagtctaaagtcggccaagcccggcggcattatgctataattggacatattacgccactcgttatggcttaacccagttacaggaggaaaaggaatgacatttagtggatttactgcaaaggacttcgatgttttcgaaataccgggattggagcctcgtatggaagtgctgattcagcaggttcggcccaagctggaggcaattggcgaggaattagccccatttctgacggacttatgtggagagcccatgcacgttcacgtcgccaagcatgcacgacgcaaagtcaatccccccaaagatacttgggtagcctgggcggcaaataagcgcgggtacaaggcgctgccgcattttgaggtaggtatgttcgcttcccacctattcgttatttttgcaattatttatgaaagtcctaacaaagctacatttgcccaggcactcgaagccaatctgagcgatgtgcgctctaacctgcctgatcatttttactggtccatggatcatatggctccggaaggcacagaacaacaacatatggataatgaagattttcaaacgatcatccgcaagctgcaacaggtaaaaaaagcggaggtcatgtgtggaatccgtattgaccgagaagatccacttgccagcgacggggctgcattattacaggcagtgcgttctacctttgagcatttgctgccgctgtaccgaatgtctttctcgaaagagtagccctcgccgcttttcaaggcgctgttcaggcctctacagtcttcctgcgtggattgcgcgccagagccaggtggcagccaaacatgagcagcatcacgaccccactgatgataaatggagcagtgtgtccggcacggtcccatagcactcctgaaacgagcgggcctataaccatgccggagccttgaagtgttaaaaaaaagccccacaccgttgctcgctcgctttctggaatcaatcgggcaagaaaggtattccatgcaggcaaaatgagcgcatatcccaaaccaataagagccacggatacaaacaccagcggaatagatcgaacgattgagaagaaaaacagcgtaattccggctagcaaaaagccaacatgtagaaaatactccgttccaagtctgtcgaccaacttgccacaagggatcagtgccagcacagtcaccccaccgcctgcaatcagaagcacgctgtacaggtttggtgaaatcccgaggtccgtccgagcgtatagcgtcagtacggggctgatcaaaccgataacaaaagactgcaaaaatagcgccgggtaaattaacggattgacgttaagctttgttttgagcacaccgatcgtctcctggattcctttcagaatttgctgtttctgctttgtgtacccatcagacgacactagagcgctctgttcgaggtcacctttatcaggagaccttttcggtcctggcagcataagagcaaccaacaacaatacaatactgcatcctatcaaaatcatgaacaccatgccgtaagaatgcccatagtgggatatggcaaagttcataatgagcggacccaatcccgttccacccatagacgcaatttccagtgtgcccatcgccgcgccattgctgttattaggcccggacatttcggtcgttccggtcataacacaaggccagagcggagaagtacccagaccgagcagcagacacgcaacgacgagccacacgggctctgtcaatacgctcagcataataatcgctacaagcgtaaacaacagtgcggtcgacatcgttccgcggtagccgagccgttcagccatccaacccgccggtgcccgaaacgcattgtctccaaaatactgaagcgaaaaggccaaaccaataatcccggccgacaaaccaagcgtttctcccatatataccggcaggatggataccagaagagatcctttcataaattcgaccagaaataccaaaacccacaatttgctaaaaaaaggagtccacagccgctgtggagctttttttcgtccattttgcctcatctaattcacttcctccaccttcgttttttggctgtatagaccgggttctcagcctactccactctttcgcaaataaatgcgccctcaatcgcttgcattcctacttcaaactgctatactcaattttgttctattatcacttgcacaggattgtcgaaatcctgcacgaaaggttgtgacaacactaatgaatcaaagcaacaccccgctttttactgctttgaaaaagcatgctcagagcaacccggttcaatttcacatcccaggtcataaaaagggagtgggagcagattcggaatttcgcgaatttatgggggataatgccttttccatagatatgatcaacatcgctccattggacgatctgcatcagccatcaggcgtcatcgaagaagctcaaaagcttgcagcagaggccttcggagctgattatacgtattacagtgtacaggggacaagcggagccatcatcaccatgattatgtccatttgcttgccaggtgataaaattattgtacccagaaacgtacacaaatctataatgtctgccattatctttgctggtgcaaaaccagtatttatttctccagtcagtgatgagaatctcggtattcaccacggggttacaaccaagtccgtacgccgggcattggaacgtcaccctgacgccaagggcgtccttgttatcaacccgacatattacggtgtgtgcgccgatttgaaggaaattgtagatctcgctcacagctataatgtgccggtcctggtcgatgaggctcatggagtactgattcattttcactctgatctaccgatgtccgccatggaggcgggagcagacatgtcagctacaagcgttcacaagctgggtggttccttgactcaaagctcaattctgaatgtaaatacgaaaaacggatacgttaacccacagcgtgtacaaacgattttcagtatgctgacaacaacgtcgacttcgtatattctgctggcttcgttggacacatcccgacgtaatctggcccttaacggtcatgaaatagcacaacgcgctctggaattggctgaatattgtcgttcagaggtcaacaagattgaagggctatattgctttggcagcgaaattcttggcacggaagctacctatgattatgatccaaccaaaattacagttcatatccgccatttgggccttaccggatacgatgtggagaattggctgagagatcactacaatatcgaggttgagcttagcgatatgtacaatattctctgtttggtgacccctggtgataccaaagaggaaattgaaattttgttgaaagctctgcgtgagctggcttctctgcactattccacaggtcaggagcatgagctagttgtaaagataccggatatccctcagctctccctcattccaagagacgctttttatggagatacggaaatcgtgcctttcaaagaatctgcaggtcgcattattgcagaattcatctatgtgtatccacctggtattccaatcttactgccaggagaagttatttcgcaggacaatattgattatattgttgatcatgtagaagtaggcctgcctgttaaaggacctgaggaccgaacagtacatcaggtgaaggttatcgtcgaaactgacgctatttcataatattgaactgtcaatacatgcttaaaaaacatgttgatagtcaagaaaaaaagcccccattcgggggctttttttcttgaagagctatacagctgctgcatccaattctattcgtattgggcaacaagctcgctatatgcggcttctacacgtttccactcatcttcgtcctcaatattgtaaagcaccatttcttcgttttcttcttccatacgaagaataatgccatccgcttcaggattgcctcgctcaagcagaagagcataaatgtgatcttctacgtcaaaggtctctaccagcaccatttctacatctttaccattttcatcagttagcgtaagaaccatttcttcatgttcgtggtcatgatcgtggttgcaggcttcaccgtgttcatgtttgtgatcactcatggaaatacctaccttcaaattgttttattttcccccgtatcgtaacatgatcaagggtgcaggtcaatttgtggtatgcctaattaatcgctgtaatgactttttcggacaccaaggtatagctgccgtctttgctctctttaatatagaaaccaacccggtaattccctgctgttttgaaatcatacgtaaagtcgttcgtacggaaccagaagttatccttttgcgctcctttgatatcttgagactgaatatccttcacgttgcccgaagggtcggtgatcgctaccttcactccggagatatctgttttcaaggtatcaatttgactaaatacattaaatttcactttattgcctttattcacgttaccaaacacagtatctcccttgaacaggaacatatgcacgttaggctggtcgaaaacaacttttccaccggatggatcaaaattgacaagtccgttaaaatcacggatgggcacataggttttcccatcaatgacaactgcaccatcttttgacacttctccattaataatcaactgcacttggtccttggcggattccgccgaaatggcggtccctcccattattgaaaaggccatcatcagggccatcactcttctccatttcataactactaatccctccatcgtcatctgtttaaaaccttctgtcgtacatttatacctagctcagccgcacaagttgcgctgtgtttcacaaattgtccaaagtttttacataaggagccaaatctttagttccggtagcataggtgataaaatacgactgtagaagtcctagtacacaaagtctggaggataaatccataatgagcctaacgatacaaatgcttggcacaggcagtgcctttgccaagcattattacaacaacaacgcgctgctggacagcggagaaggcaaactgctgatcgattgcggtacaaccgcttctttagcattacaccaaatgggcgtccctctgcctgatattgacgcaattttaatcacacatattcacgcagatcatgtcggaggtttggaggaattcggttttcaaatgaacattcttcatcgtcgcaagcctctactttatatcgccgaaccactaatctaccctttatgggagcatacactcaagggcggaatgtcacagcagggtatgattgacaagcttgaagatgtattcgaggtaaacgtaataacgcctggtgtacccactacattagtatccggtattcaggtggagctaatccctacaaggcatatttctggtaaaaacagttattccatattcattaatgaccgccttttttatagtgcagatatggtttttgaccctgatttgcttcatcatctggtgcatgaacgaggatgtcggagtattctccatgaggttcaattacaaggcgctggagaagtccatacgacattggacgagctgctaagcttggcgccatctcttcaagaacggattcatctaatgcactatagtgatgatatggaacagttcagggagaaggcaggggtcatgtcctttctggagcagcaacgagtatatcaacttacagagttggaacgtgcagagtagcatgctaaatacagcttgaacaattaacaaaagccgcctggctttcctacaaaggatagccaggcggcttgctgttcttgaatataatgatgaacttgcattctaatgttgcgagttaaggtcagaacaatggcagttggtccaggttattagaaggatctccatcggcatctccccgaattcgtttgcttccatccttggccttgaacacgttaacgcctgcaattgagcctgtctcaatctcattcaatgcttggctataatctaaaatccggccggtagatgtctgaaaagacgtaaggtcgccatccccgtttttacgtactgctgtaatttgctcccgttctgtattagccatgctgtatcgctccttatccatagtatagtggaggaacttttactagcatgcacattgtacagatttgtatgcaccttacgctgtcgactacaactttttacgcatacgtacatgcggtattcccgcatcgtcaaaaggctcatcggagatcgtctcataaccgagcttttcgtaaaacttctcggcttgacattgggcatctagcagcgagtatcttagccccaattcacgtgcacgttcctccagtgctagtagtaatacacgtccatagcctgcggcacgatgctccttgagaacggcaatacgttgcattttagctgtatcttcctcatagtatgtcaaccgaccagtggccaccatttcaccatgttcacaaattagcaaatgatgggccgtatctcccagcttgtcataatgatcaacttctaaatcgagaggaactttttgctcttcgacaaacactttggtacggatcgatattgcctgctgtagctgctcctctgttgttacacttataatttctgcggccatcatctgttccccctatcattaattccaaattgcaaactcgctaaattcgaattatatatataaatgctcatgaagtacaggctgacttctatttttccactttacatatatggttaatacatgatattatctagtaaccgcaggacggtagctcagcgggagagcattatcttgacagggtaagggtcatgggttcgatccccatccgtcctattcgtcaaaagccttgatactcaaggcttttttgtttgtgtcgagataaatccagttatcctgtgaaaagaaaataggttattgactaagatttagtcaataacctatttttcaatcaaaatgatgcctacttcttcaacaaagcctttcacattgatccttctattatatagaagaaaaaaagcaaacctccagcacaatacgcatagaactcttagattacgatataaacctccccgctctcactgtcaatctccgtggggtaagcagtcacacatccagtatccggctcttgcacctggccagtggaaaggtcaactttccagtcatggagcggacaatggatcgctgagccacatatcattccttcagataaccgtccccctttgtgcggacaacgattctcaagcgcatgcacgctgccatcgctcagacggaatacagctatctctgtattatgaatgcgaactgtccttgctccacgtcggtcaatttcgttcagatcagctattctgattctgttggttgtcgtattagtctccattttgtcagccccctattccattactggcttaagttccggcagttgcacaaaatttttgcgcagctcttcgttgtgaataatttcgtgccacggatcagtcgtcgtgcttaacgtctcctcaattctggtcaccagttgcttcctcgtctctgcattcgcgagtgcctgtttgatggattccactccgacccgttccacccaatgggctgtgcgttcgttccaattggcctgctcgcgataatactgcagataggcaccggtccattccatcacttcatcctcagttttaacggtacaaagcagttcagctgcccgaaccttaataccgccgttacctccaacgtagatcccccatccaccgtcaatagcaacgacgcccaaatccttgatcgtcgcttcagcgcagttacgcgggcaaccagatacagccagtttgactttggatggcgcattcagacgttcaaatgccttttccaaccggatacccatacccatagcatcctgagtgccaaagcgacaaaaggtgttacctacgcacgtcttaaccgttcgcagcgtctttccataggcatatccagacggcatatccaactcggcccagatccccggcaaatcctccttcttcacaccaagcaagtcaagacgttggccacccgtaaatttcaccagaggcacattgtatttctctgcgacagcagcaattttcttcaagtcggcaggtgaagtaactcctccataaatgcggggcacgacagaataggtgccatctttctgtatattggcatggtatcgttcattcgtgaatctggattccttctcatcctcataatccagcggccatagcatacctagataataattgagggccggccggcatttggtacatccttctggctcgttccagcccagcacattcatcacttctttgacgctcttcaatcccatctcccgaatgccatcaatgatcgcttcccggtcaagcgtcgtacaactacaaattccctctttcatcgtttctccggcttctgcgcctgcgtatagctgtaagagtccctccactaatggcttgcagccgccacatgatgccgatgcctttgtgcatgccttaatctccccgacactccggcagccagccgcaaccgcctctccaatgtcacccttggatacaccattacatccgcatacaatttcgtcatcaggcatctgctctagcatcatggcgccactagcttcaggttgaccgggattaaagccaagtaataactctttctctcggccaaccaccgactcgccacttttgatcaaagaaaatagcatggctccgtcagacgtatccccaaacagaacagctccgatcagtttttcttccttgatcacgatttttttgtagacgccgccaatatcatcctgataccgaagggaacgtgttcccggttcatccttgtaatcccctgctgaaaacacgtcgacacccgataccttcaaccttgtcgaggtaacagaaccactgtagccgggagtctccattcccgcgagccgctgagccagtacaccaccttgctcatataatggagcaaccagcccgtaagtgattccccggtgttctgcgcattctccaacggcgtagattccggggatattcgtttccatgtaatcatttacgatgatgccgcggtttacagggattcccgccgacagcgccagttcaatgtctggtttgatgcctaccgccataacgatcagatctgcttccagctcgctgccatcggcaaatttcaacccttccacgcggcgacgccccgtaatagccgccgtccgcttattgaccagaaaagtcattccctgctcctccagctcgcgccgtagcataagggaagcagcctcatccagctgccgatccataatatatccgttaatatgaataaccgtgacgtccatccccaagttaagcagccccctagctgcctccagcccaagcaatccgccgccgatgacggctgcttttttgtgcgtctttgcggtctccatcatcgtttcacagtcacgaatatcccggaaaccgataacaccttccttgtcggctcctggaagcggcagaataaaggctttagaacctgttgccaacaacaacaaatcataagagatgcatacgccggagcgcgacgtcacctgctgcttttccgtatcgatagctgtgacaggatcatcggtatacaatcgaatattgttgtcttcataccaactccagtcgttgatgacaatatcctgcaaaccagcccctcccgccagaacggaggacagcatgatccggttatagtttggatggggctcggccccgaataccgtaatttcatagctacctggtgcaagcttcagcaaatgttcgagagtgcgtattcccgccattccgttgccgatcaacactaacttttggatatcgttcatcaggtcactccccttccatttgtatccttaaaacataaaaagcctgcttcacatatggggattcaaaaatatccctcacatgagaaaacaggctccattgccgtttcatcgaatacgccgttgtatccatcagagtatggaattaaaaagtactgtagctaatatataatggttcaaatgatatgtcaacattccttacgcaatatcttataaaaaattatattttatcaccatgtaacatatctatgacgtataaaatatcactctcctacaaaattaggattgattttcagactaaaacacgccaaaatggtttaaaagtccgttttaatttgaagatggtgaaaaaaataagcagacagataaaattccatgtcatatttgttatcaatgaataccatcccatccctaaccacccttcatgttacagagaggaggagcccgcttgcgttccttgttggtaattcacttacattctgaccatgtatctgagcagacacacgccgtttcctcatggcaggcaggacctgagtaccttttagagtccaacggatacctaactctgccatgccgcaatgaatccgaaatcaaacagctaatccttaatgcagatgcggcggtactaaacatacctgtcggcactatcagcatatggagtgacaggctggagcaagccaaagcggtcccattgctctggtggtgcagcgcagaatcagcgctatcatcgacagaggcttgtgaagctgatgtcactgtcgatggcattctaaccccttcaatggcagcccatgaactgaattgggctcttcattttagtgccaaacgcttttttgaacgccagcattggcaaagtgaacgcaagcaactgaccgctcgactggaagaacgcaaatggattgatatggccaaaggaatactgggggaagtaaacggtatcccggaagcggaagcatatgatgtgctacgcaaaaaagcaatgaacgaacgcaagcgtatcgttgatgtggccatctccatcgtcaaagcacagcaaatgctaaaagcataaatctgaaaggggcctgaacatgaatatcattgaaatattaaaagaagtgggtcgtggcaaaaggggcgcccgagatctgaattatgccgaagccgaagctgctgccgaacttattatgacccagtcagcaacccctgctcaaatcggagctttctttgccgcggagcgcattaaaatggagagcgttgccgagctggaagcattcgtaaacgtttgccgtaaatatacccatcgcttcccgatgcaggaaggtattgattttgccggtccgtacgatggcaggaagtcatcgtttatcgccaccttcgcaacagccttcgtactcgcctcatgcggaatacctgtaacgatgcatggcagcgcacccctccctcccaaatggggggttacgctaccgcttttactgcaggaaatgggggttacgtccgggaacatgacacgcgaaaccgccattcatgccgcgaagctgactggtgtactattcatagcctccgaacagtggtgcgcgcccctgcgagatctgcggtccattcgcgaagagctggggcttcgcacggtgctgaatactgccgagaaactggttgattacggttcttccccctatattgtattcggcgttttccacaatactgtgttcgagaagacggcgaaactcatgcaaaatctcaattaccgcagggctctgatcgtccaggggagcgaaggatcggaggacctgttcatcgatcggccgacccggacttacctgcttgctaacggcgaggtgtcactacaggttattgatccagaaatgtacgggctggattcggtggtaccagagcataactggacccccgctgaacaactgcgcattacggaggaagtgctacaaggtacagcttctttagccttttcgaatcaagtgttactcaacagtgcggtccgactgttcgttgcaggacgagtcgattccatagaggaaggtttgtatacctgcaaaccgctgctagaaaacggggacgcctggaatttgtataaacaatggcgggaagctatgctcagaacaaaaataaaaacgggagcaaacatatccgaaacccgattgcaattataatatcggcctcacgcagtctagtgattgcaggccattaactgtccaatccaaaaagaccagccctcattcatacaatgagggctggtcttttatgcaaagaaaaagtcacttactccgtcctgctctagaactcagaccattccccattatctgcacttgttgcaactgcagccagatgaaggggacgaatacgtacagctgccgttttgaagccaggcatccggcagaacggatcaagatcgggtcgggtcgcccgatttacattttgtatcccgccccaatgcatgggtacgaaaagcgtgtcttcgcggatatgtggtttgattcggctgcggacagtgaagttgccgcgctgtgatgctatttctacccactccccgtccctgatatgccagcgtcgcgctgtccgcggatgaatttccacataattttcaatctctcgcgcggccagcgacggacttctgcgcgtttgtgcaccggtcaaataatgagccagtacacggccgttcgtcaaaataagcgggtactcctctgatatctcctctcctgctccacagctttcaaccaccgtaaaaacagccttttgatcggaatgggcaaaggtttcccgaaacatcatatccataccggctctgtccgtagacgggcatggccaatatactccttcttcacgacgcaacctgtcatatgtgatcccataataatcggcagaaccgccccggctggcgaaccgcagttcttcaaagatatgctcagcatccctgtaagagaaatagctgcccttgtttagctttgcagccaactgacacaaaatgttccagtcatctctagcctcgcccggtgcgggcctcgccgcttcccgtaacagaacgcggccctccagattggtcatcgtccccgtattctccaaataagacgtcacaggtaaaacaacgtcggccatccgcgcggtttcagtgagaaacatatccgccacaaccagcagattcagctttttgagggcttcctccaccagccggacattcgggttagatacaacaggattagagcccatcacgaacagagcttggatttctcgctgatgaacaagctccatcatttcataggcggacaccccttttcccggcaaactgcttggttcaactccccacacggacgccacatagaatcgatcttcttcattctcaatcgatctgtagccaggaagctggtcagccttttggccgtgctctctccccccttgcccgtttccttgtcctgtgatagccccataaccgcatccttcccttcctatcttgccagtggccagcaccagattaagaaatgcacgcaccgccatatgtccatctgtctgctgttcgacacctctggccgtaaaaacgatgccagtctccacactgccaaaggcacgtgctgcctgccggatcatttctacctcaattccgcacaacgcagccgattcgctcagatccacacccttcaaatgagtcaacagctggtcataggcgttggtccgcttgcggataaactcttcattcgcaaatccttcatccacgatgacctttagcatggcattggccagcacagcatccgtacccggcttgatttgcaggtgcaaatcggcggccgccgccgttggtgtcgcgcgcgggtcaatcacgatgacaaacgcgccgttttccttcgcctcgtgaaaataaggcattaacgtcggctggcattcagcgatatttgtacctgcgagtacaatacaacgagctaatggaatatcagccagtctgcaggtcagtccgcgatcaacgccaaacactttactaccagcggatgccgctgccgacatgcagaagcgcccgttataatcgatatatcgcgtacctacagccactcttgcaaatttaccgagtaaataggccgtttcattggagagtgaacctccaccgtaaattccgattgcatcggcaccctgtgtggacagtagcgtagagaaactgctagctatagtatccaatgcctcctcccacttgacgggaacaagtttgccctctttgcgtatgagaggctgtaccagcctttccgcatgagtcgcatgctgatgcgcattcattcccttgatgcacagcctaccttgcgaggctgcattaggcttcccttccgccttatacactgtacggatgatacctgcgagtgtctccgtacccgtgctaacggtcatcttacattgcacgctgcaaaacgggcactgcgtatccattactgaagatacatgtagcccagtttccggtttgctttctcctgactgacacatcaaagtcacctccccttcgccatttttcgtaattttattgtctgcacacgctagatatatcgccacaactccaactcagcccgtcatcctgtcagcattgtggtccgtaggctgcccgccagttcacttcgaagagcagcatcaagcacactttcccgtagcgccataacgccagtcctttcaatccactcccacattttctccccgtaccgggcactatgtcggtatattcgcaagcaaactgcagccagcaggactgcttctgtcgggtcctcctccaatccaagcagctgcccctggcgaaccggatgctcagcatgaccaccggcataaacctcccagcctgctggagatcgggatattccaatatcgtggacaagtacacctccgggatactccgatccaggacaaacagaaactgtaaccaacgagggcaatgcgagacttccccataaagttgccaaccgctctcttagccaggctacttctacaaatgcctgatccatcaggtccgactcaacaaaagcctgattctcggcatttaggttcgtaaagcgcagatctgcagagggcgcttctcctccgcactgcgcggcgacctgaaccgcaacgccaacgcctaatggatttgtcgcagatctgtcgcgcaacccgagagattccaaataataaagtacagccggacgacataattcacacccctgctgtctggtccaatcgagacgggacactacttcctttggtgtctgacaggctgcgtccaccatagctgttttaagcgaatcatgatcgtaatgcgtacatccacatacagggacaacttcttgggcggtgggagtaactacaggtccggaagctgtcgatcgggacaaactatttttgaccagtgcagccaccagcggccgacagcccccacaggaaccggatgctttggtccggcttttcacttcttccaccgtcttcagcttatccgtggcaatcgctcgcaaaatagcccccttactcacgctattgcacgcacataccgtttcctcttccgggagtgcggctgccgcatcctctgctctgctcacgctgttatcccgggatgtaagctctgtagcgggcgcgctgcgccgtaccattccgagtagcgaggtactttcagatgtatctccgaacaaaatggcgccagtgacagcaccggcatgcatcatcacttttttgtaaaccccctgcatcccgttatactccatgaccgctatctcgcttccctcttcgcgaatgtctcctacggaaaacagatgaatccccgctaccttgagctgcgcatacggaaccgtcccttcatagggagccgtttcacgaccacaaataacttttgccagcactttgccctgctcatatagtggcgccactagcccgtatgaaatcccacgatgctcagcacattcgccgacggcataaataccgggaatactcgtgcgcatataatcatccacgacaatggcacggtttacggtcagaccgctgtcctgagctaattcgatattcggtcggataccaaccgccagcacaaccaaatccgtttccaacctgttcccgtccgcaaatatcaatccttgcgccctgtttcggcctatgatgttgaccgtttccttcgccaaatgaaacctcatgccctgttgttccagctttcgctgcagaagcatagccgccgtccgatcaagctgacggttcataagatactgcgcattatgaacaacctcagtttccatccctagattcaacaggccttgagcggcttcaagtcctaacaacccccctccgataactgtggccttacggtatgttttggaatatctcgccatggtttcgcaatcattcacatcacgaaaagcgattaccccctgttttcgagctccgggaatgggcggcatgaaaggcaatgagcccgttgccaatatgagcatgtcataaggttctttgatgccggattccgtttccaccatcccggctgcaacatcaatacgacagacgcgttcacccgcgtacaactttaccccgttctcttcataccagtcccagtcatgggtaacgatgtgcttaaatgagctctcctcctgaagcattttggacaggagcactcggttgtacccgggacggggctctgcaccaaatatcgtgatttggaactgctctggctccagatcaagtatttcctccacacatttgatgcctgccataccgttgccgacgacgaccagttttttcatcatatcaaaccagccccattctccaataaaataagacagaaaaagcccttctccattcaatggaaaagggcgccgttgccattaatgtcggcacatcgttgtaccgatatatatctaagattactgaattgtgaatgtcatgtcaatattcaatacatgaatgttatattttcacctgatatttaatttttttacgattttgtgttatgtatattgacataaaacagttccttttttataatttgattaaaatcactccaacgtgatcataccaaatcgactcacaatgaggtgtgtcaaccacggcaatgaggccgcaaaccgtttcctagataccatgtaggggcgatttgcggctttttcatgttcaaattacattttttagacaaagaacaacaattagaacaggagagatggagaatgaacaaaaaaagtttctggaaaagcggacacaagcccaccctatttggctcctttctgtattttgatatcagttttatgatatggggaatgatcggaccattagccgttgtaattgctaatgattatccaatggaccctgtacaaaaagccaatcttgtcgccctacccatacttggtggttccctgctgcggctcgtgctcggattcatgtcggattatatcggtccgaagctcacgggacagattggtatgcttgtcacgataatccctctcttgctcggctggctgtgggttgattcgctagagcacatgtacgttgttgccctgctcctgggcgtagccggagcatcatttgcagctgcgctgccgttggccagtcaatggtaccccaaagagcatcaaggcttggctatgggaattgccggtgccgggaatagcggtaccgtccttgcgacattgttcgccaaccgcattgctcaacattttggcagttgggaagccgttttcggattggccatcctccccatcttaaccgtcttcgttctgttcagtatttttgcccgcaacagccctcaccgcccagcaccaaaaagtctgtcgcaatatgcttcggtgctcaaacagagggatgcctgggtattctgtgccttttactgcgtgacgtttggcggattcgttggcctttctaattatttgactattttctttaatacccaatatggcctctccgcggtacatgccgccgattttgcgaccatttgtgtgattgccggaagcttctttcgtcctgtaggtggctttttgtccgaccggattggtggttcacgcatgttaatgtacttgtatgcaggagccgggattatgctcgccggcattgcgtttttaccgccacttgccgtggtagttgtgctgctgttcgtaggcatgatgtgccttggcgctggcaacggctccgtattccagctcgttccgcagcggttcggcaacgaaatcgggctcatgaccggtatcgtcggcgctgctggtggcataggcgggtactttcttccccttatactgggtcatctatacaaatcaacaggttcctatatgccaggcttcatctgtctgagcctgatcacgttctgtgcctttaccctcgtcatcatcatgcaattgaaatggcgtaacagctggatgcgacgctctgctacagttactgatgaagccgtcaagcgcatcggagaattaaatgcctgatgtttattaaacatagagctgcgaagcattgaattgtccctcaaccatccctatagtcaaaaaaatagcttaacttcgtttatataaaatgaagttaagctatttttcatgcccactcagtcgaatcgcacctataaaaactacgataattatcacattgaatcaatattttccgaaaatattatgaaaattaaatgaaattttcattcgaaaaacattgaaaatcgctttcattttcataatttttcttatgtaaacacttatataaccatttttcacacaacatacttcttcacttggtttaaaataaggcgtatacttgttcacgaattgttcaaggattaactaaatgtaattttttagaaagaaggaattgaaatgcgtgcttttcattttacggaagacggatctatcgaaaccaaattaaccggaaaagatctacttgccaaccccctgctgaataaaggagtggcttttactctggaagaacggaaacagcttggacttgatggtctccttcctcctacgatattaactattgaggagcaggttcagcgggtttacgagcaatttcagagccaaccggataatttgcgtaaaaatgttgcgttaaatgatctttttaatcggaataccgtcctttattatcgtttgctctctgagcacctaagcgaaatgctcccgattgtttatacaccaacagtaggccaggctatacaggaatacagtcatgaatatcacaagcctggtggtatgtatttatctatcgataatcttgcgggtattggagaggcttttaagaatttgaacctagaccctgatgatatcgacctgatcgtagccacagattccgagagtattttgggaatcggggactggggagtcggaggtattaatatctctattggtaagcttgctgtgtatacagctgctgctggtatagatcctagccgggtgctggcagttgttcttgatgcaggtacaaacaacgagaagctattggaagatcctttatatatggggaatcgtcataaacgtgtacgtggagaacaatatgaccaatttattgacacatatgttcaagcagcactgtcctttttcccgaatgccctgctgcactgggaagatctgggcaatgtcaacgcacggaacattatcaataaatacggaaatagtattctgacttttaatgatgatattcaaggtactggagcggttacgctcgcgggtgtgatgtctggtgtccaattgtccggaatcccactgagcaagcatcgggtgctagtctttggtccaggagctgccggaatcggcaatgcagaccaaattagcgccgccatgatgctggaaggactgtcagaagcagaagcaagacgtaacttctgggcttatgattaccgcggcctgctcaccaacgaaacagaaggactttttccattccaggtcccttatgtgcgtgatgttgcagaatgccgtgactgggaacatgctgaggatggcaaaatccctttgcttgaagtcattcgccgcgtgaaaccgacgattatgatcggtacttccggtgttactggggcatttagtgaggaaatcgttaaagaaatggccaagcatacagaacgtcctattattatgcctatgtccaacccgactccactggcagaagcaactccgcaagatttgatccactggaccgaaggaaaagccctcattgcaacaggaagtcctttcgagccagtgatctataacaatattaagtttgaaattgggcaatccaacaatgctttcgtattcccgggtctgggtctcggcgcaatcgtggtaaaatccaaaattataacagatagcatgtttgcagcagctgcccatgcagtagctcaaatggttgatttgtcgcagcctggtgcttccctgctgccaaaaatcagcgagctacgagaagtatctgaagcggtagccgtggctgtagctaaggcagcagttcaggatggagtagcgcgtcatcaaccggacgatatcgcacaagcggttcgagatgcgatgtgggactgcaaatataaacccatcaaacaatatggtcaggaagccgtcctggtttaaaaatagcgaacaacatcaaatgtgtacttgcatacgcaaagtgattatttaactgatgtccgccatttttggcggacatcttcattggaggcgacatcatggctacaggtcatatttttattatcttaattcctattttctttgtcattttaattggttatttcgcaggattgtttaaggcttttaaccctgcttcttctaagggtttaaatacactcgtgacgaagtttgctctacctgcacacttgtttattggtatcacgacgacacccagagagacgttgattcaaaagtggccctttcttgtggctttgctacttggtgtaatcggcttttatattgtattgctcattgtttatcgcttaattgccaaaaaaggcctgactgaatcctccatgttcgcattgaattcgacacagccttcttttgcattcatgggaattccggttctgggcagcttgttcggaagtgcggcagtcgccatcccgattgcgattactgggatcgtcgttaatgccattcttgatccgcttgcaagtattttgggaacggtcggtcagcgcaaaacaacagaatccgacggcactaaaggcaacttatttaaagtcactatgaaatcagtccttcatggactcagcgagccgcttgcctgcgtacccttgtttggtgtcatattgactctatgtggattccacgctccgaaacttttgcaatccatgtttgatcaaatcggcaatattactgctggtacagccctatttgccatcggggtaaccattggtatcaaaaagattacgttcagtccaaaagcacttagcatcgctgtgctgaaagccatcgtgatgcctattgttatgctcggtattgctgttctaataggactatcccatgaagatgtaaccaaagccgtactgcttgtagcttttcccggctcggctgtggccgctatgattgctacccgttatgaaacactggaaacggaagctgcatctgcatttgttattagctcagtcttatcgctcatttcactacccttactcatttcacttcttttatagggacagaaacttaagaaccctcaatgcaatccaggtatttataggtataaagcataccccgtttgctctcatttatcttattttttaaatattgttcgaacaataaagtgatttagtaagaattgagttggaaaaacaacataaaatccagttttgccgacaagcggcggtcccatcgtttcattcactagtggccgccgttctttttgaataaccttctactctcccttttaataaatacctaacatttagaaagcaaattgtcgaaatatatatggggtaggttgtatatgaaactaaattgctaattcaaaggagaagaaaacgtgaaaaacttgaagtggagaactatgtccttttttggtaaaaatctattaatctcttttcttaacatcgtattaataggtgctattcttatcacatccagctatatacttcaaaagaacattctcaccacgcagctgcaagaccaagttaaagtattgactaaaaaatgggcagaagatgttgacaaaacaaaagtacaacaagcattaagcgaaaaagattataacggttctgctcaacaggatttacgcaaattcctagattctatccacacattttatcctaatgttgcccaagcttacatatttggcacagaactaacagaaggaaatcaaacctccattattggcgttcctacaaatttagtccaagctttccaagactcaaagatgaatattggggatatgtacactcttccagacgaaaatgtacaaggtgtaaataaaatgcttcaatctaaagactcagcgtttagcagcttttatactgacgattttggtacatggacgaccattgtttacccaattacagatgaaagcggtaaaatcacaagtgcgatatactttgacgtagacgcgagctctgtacctaacggacttcataaattgcttgtatatggtgtttcattgctcattctgttccttgcgatcttcttaacggtccaatatttactggtaaaacgtaccctctccccgattcgtagcctgatgaagggcattgaagaagtcagcgaggggaatctgaatgtacaaatcaagacaggcgaggacgatcttggcattatcaatcaaaaatttaattctatgatcaaacgccttaacgataccatggtgaaagtacaggatacgacgcaagaagttacgggatctgcccaggaattgttaagcattagcgagaaaaacagtacgaatacgaacgtcattaacagcaatattcaggaaataacccaggggcttgaagctcaggatcacgcagcacatgaaagctccagagctatgaatgaaatgtcgacagttatccaaacgattgccgagagctcctcttccgtagcggatcaagcttattctatggaaaaacgctccgttgaaggcaatcaggtagcccaaaagctttccgctcaaatgaactccatctccactacaatggaaagtacagctgattccgttaatgcgctgcagaaccgttctaacgaaatcagcaacatcgtcagcatcattacaggcattgccagtcaaacgaatctgcttgcactgaacgcttctattgaagctgccagagtcggtgaagagggcaaaggttttgcagtagtagcgggagaggtgcgtaatttggctgaacagtctcaagagtctgccaaacaaattgcagagcttattgaagaaatccaaaaagaaattgatcagactgtaaaaggcatcagccttggtacaaaagaagttcacattgggctagaagttacgaagcaaacaggcgaaatgttctctgaaatcttagatgcgtctaataaagtgtcgtctcaaattcaagaggtatccagcgcaacggagcaaatttcagctagcacgcaggaaatgtcagctacctctgacgagctgtcttcgacagttagcaaaacagtcgacagcagcaaacaaatcgagcataccattggagaacaggctgagtctatggcttctattgtccaagcttctgacaagcttacattgatgtccggggagctggaagagctcatttcgttcttcaaagtgaaccgggaagcctaattttataacttccaagtaactcaagataacaataaagaacctctagtctgcatagaagcaaactagaggttctttgatatactcttacatacttcttaatttataaatccttccaaagctgaggttggtttaccgtcagcctgccaagcacctttgttataaccttgattgtaacctggagttgcagccggctcccaataaaatacccctgtacccttgccgcctccaatgttccgaacctttgttttgattgcagaaataaatgccttggaagcagcgggttcgttatattccattccgatttcactgatgacaatacctttgccgtatttggcaatgaggttattggcattggtaatcgtctggtccaccttaccctgccagtcagaaggagacggatacagagacagcccgatgagatcaaactgagctccattatcaatcagcccaccgatattccagttcaacacggaaccgttatccccgttggctaaatgtacgatcgttttagtactgctgctaaccgattttacagcattattacctgtattgacgagccaggcatagtttttcatgttcaccgaagctttgccgtcttcccagagcattccattgttcgtctcattaccgatctgcacccagtccggtgttacccccttgcttttcatcgtgttcataacatagaccgtatgagaccagactgcatccataagttgtgtaaatgtgaaattgcgccacgcataaggtttgttctgttgccctggatctgcccaggaatcactataatgtagagtcagcatcacgctcatgcccaattttttagctcgctgtgccagctctgctgccttttcggcattcatgtatccgcttgcataatctttcatgtcagggtttacccacacacggatacgtaccgagttgatctgatagtcatctcgcaaaatttgcagtatatctcgacgaacaccctttttatccttccaagtcataccttgcgcttccattcctgctacccagcttatatctgctcctttggcgaaagcaggggcggccgaagccgcacccaaccctacagagccgaacggatacaataagctggataacaagatcaacatcgcaaataccatcgtgcggttacctgttttcataagtcatctcccatccgaattgtatacttctcattgcctctgtccaatctaccagctcactcactcgggaaaacgatagagatcacactttaatatcatgttctatttattgcgctctgtctttaaaaccttaacagtgtaggcatccaattgaacgctaccgtcttctatcgcatgattttcaagcatatccgcataagttcgtccatccaacgtaatcttttgcggctcatgcgtgaaattcagtataaaaatataatcatgaaccccatcggtacgaatcgccgcattcactccatgaggcaacttcacattgagcgctttactgattcctgcatcatcaattaaacttctgtaaaaatgactgtggaatagtccgatgttgcgtgatgcgatgtaataagcctttccctgtcccaaacggttcaccgtcaaagccggacgtcctgcataaaagtctgagccgtacacagccagtacctctgcaccctccgtatgaatgagatcacacaattctacagcttcatactccccttgcagatccagctcattgccttcaaccggcaaaatgtgattacggtcatgatcatgcaatccgtcaatctcttccgaccagatccccagcgtcttacgaagcgggcccggaaagcctccaaggaagcacaaatcatgttcatctacgataccagaccaataggttgctacgaaaacgccgccattttcaacaaatttctgtatacgctcccccacaccactgcggaccatatacaacatcggagctaccaaaagtttatatttggagaaatctgcatccatatgaatgacatctacaggcacaccctgctcccaaagtgccaaataatgcgcttcagctgtctcctcatatttcacacctttgttccgcggtccctgtgaatcgttgattccccaacggttctcccagtcaaaaatgactgcggcctccgccggtacagatgtcccgataacctcctccagtttttccagcgcattaccgacatgggtcacatccccgaatacccgagtgtgctcatgtccgacatgatcgacaaccgcaccatgcagcttttcactcgaaccgcggcttttccgccactgaaagtattgaacggtgtctgacccgtgtgccacagcctgtaaagacgatagcagatgcattcccggccgcttcagcttgctaacgtcttgccagttcgtcaaacttggcgtgctctccatgagcatccaaggcttgcctcccttaattgagcgaataatatcgtgcatcatggccactttagcagcctgacggctatcatccccctcacagtcatgccacgttgggtaactatcccaggatataacatcgagcagatcagcaaacttccagtagttcaatccttcaaaaaactccattaaattggttgtgactggaatggctggattggcagccttgagcggcataatctcatgcttgataaaatctgcggtctgatcggtcacaaaccgtctccagtccaaattcatggcatggacctgtgtttcaccgtgaggtgccggggactcaacttggctccagtccgtaatcgtatgactccaaaaggtcgtccaccatgcgtgattaagcttgtccagcgtaccgtatttatcctggacccaagcgcgaaatgcctcctgacaataatcacagtggcaatctccaccaaattcatttgaaatatgccagccaataacagcaggatggttagcataacgctcggctagcttcgtattcatgatacgtactttttcccggtaaacaggcgacgtagcacagtgattatggcgaaacccatgcagattacggacacggttagcctccacacgcagcacctcaggatatttttgtgacatccaggctggtcttgctccactcggagtggccaaaaacgcatagattccgttctcagcaaacgaatccagaatacgatccagccattcaaacgtaaatacgccttcctcaggctccaatgaaacccatgagaaaatgccgacagacatcacgttacatttggctagtttcattagacggatatcctccgctaacacctcagggtaatgctgccattgctccgggttatagtccgctccatgcagcatacgtggaactcgctcactaatgggagggtacttgattatgttttgattcgtcactacaaatcatctccttctataaattctattactctttgacagaacctagcgtcatacctttaacaaaatacttttgtaaaaatggatatacaatgagaataggcgctgcaccaatgaaaatttgcgctgcattaaccgtcgtttgagaaagtaattccatctctttgggactcatgctcatggaactcatgtccttctgaataattacagtttgcaggaacgtcgccagcggataatcctttgcattgctcaaatagagcagaccgtcaaaccaggagttccaatgaaataccatactaaacagcgcaatcgtcgcaatggaaggcatggatatcggtaaaaaaatactaaacaatgtccgaaaatgtcctgctccgtcgatcaatgcggcctcttccatctctttgggaattcctctaaaaaagttcaacataaggatgaccagaaatgtgttgaccgctcctggcaaaacaagtacccagaagctgtccatgaggtggatcttttgaataaccatatagaatggaaccagaccaccgttaaaaatcatgctgaatacgaacaaccatgaatatacgtttcggctacggaacacagatgtttcctttgaaagtggataagcagctaaaaaggtaataagcagtgttaagccggttcccaatacagtcctacagacagaaatccagatggagtgcagaaaaatcgggttattcatcgtcttcttataggcttctaatgaaaattgtaccggccacagtccaaccagattagcatctgcagctgatttagcactaaatgatacagctaacacatgaatcagcggaacgatacacatgatggacaaaatcacaagcaagcaaatattaaacacattaaagatgcggtatggcgttgttttatgatacatgactctccctctttcagcctcgtggaatcaaaatatgcggtatcctgcccatttgtaagcaagtcgataagatatcagaatgagaatcatactgataacggatttgaacaacccgatagcagtggcaaagcccatttccccattgattaacgctgtccggtagacgaatgtatcaataatatcgcctttttggtaaactagcggattataaaggttgaaaatctggtcaaagccggcgttcagtacattgccaagtgcaagcgttccaacaacgactaccatcggaattaacgaaggtacagtgatgtgtagcgtctgtctccagcggcttgctccatccatttcagaagcctcatacaacgaaggattaatacccgccagtgcagcaagaaatacgatggtgttgtatccgaactccttccatatatccgatactatgacagtaaaccgaaaccagttattatctcctagaaaaaagataggctgaatcccgaaactaccgagaatacggtttataaatccatctgtagccaacaggtcaatcagaattccgcccaagatgacccacgacagaaagtgtggtagataaaccagtgtttgaatggatcgctgaagtccaaccttgcgaatttcattcagcagtatagcaaaaacaaacggaactaccagattgaaaaacatctttaacacagcaataattagcgtattccagacgacttgaagactgtcctcccgttgaaacaaaaagcggaagttatccagtccaacccactcggaacccgttatgcctagccaaggtttgtaattttgaaaggccatcacgatgccgcccatcggaatgtagctgaatacaattaagaaaatgatggctggcagcagcatgatatgaaatggccacgtacgttgcagacttctcattgcagttcctcctgtaactctcatggtatacttcaattataaaagcgttttcgcggtcccaacagttcaaaaaaccaacatacatggcacaaaagcaaccattttttaagctcgccaaacgaataaaactttttttcaaatacaccatgatagcgcattcatttctactcgatacgggtaaagctgtagtaaaaaggctgcccacctcgggacagccctcctactctgttacaacatcattggtttttactttcgacgcttttataccattcgtttacttcatttgtaatttgttcgccaccagctgttttccacgtctgcacaaaggtatcaaaagcagagatcggctgcttgccataaataatttcattgaaggtctgactttcaatcttatccagatagtcctttttagccttcatggttggcgtagtagggcccgtgaactgatctttcatggagatatctttctgttccataagcactttggcagctgcgggagtatctttcccgtagttcaccattacatctttctccagacgggtcttcggttctgcgccgttagccaaacttagcaaagccttcatttgggcatcaggtatacgcgcaccatcacgaaccagcaaataacgaatagagtttacataaccgcctggtattttatcgatagacattagctttccgcccgcatccaaatcataatcgtagcccttaaacagcccattcgacaaatcgccgtccggtttggcattagcataatggtcaaacaaataattttgataagtgaaaaaggcttcaggatgctgcatttgtttgttgattaatacaacaccattggtgtattgcgttccgtgacgcatggctttgttgtcaggacccgctggaatcttgatcggcttccacacggcacccggcgcatttttgactgtatcctgaagcggccagccgctcatccaatatggtccaggaatcataccggctgttcctgcgactgtaggttctgccgttttattttcatcccacaatgctgcttcctgaggaatatatccctttttgagccactcgctcagcttttgcaaacccggcttcatgccaggctgcacggagccatattccaaactgccatttgtacctttgttccactgctgaggtagagtgccatatgccccgaaaatccaagatgggtcacccatccaagtgttcatggatgttttgaaaccgatgctgagcggaatcactttgttcggagccagtccgtccggatttttatttttaaaggcatccatcactttttccagatcatccatcgtctcaggagccttcatacccagcttatccaaccaatcttgtcgtacccacaatacataatcatggttgtaggcaaaatcaagcacaggaatacccattttcttaccatctcggctatactgattccatacgtttgtatcctgattcatcgcctgcttccaataatccgaagcgtacttatcaaacaacgggcccacctctgcaaacataccagaatcgatcatgtcttgtgccagttgctcattctccgtccccagtacaacgacgtctggcatctcctgaccggaggacatcgccaaacgcagtttcgtagcaaatgcgccattcgtatccgtgacggaccagagtgatttgatattaataccgaatttctctttagcccattttgtcgcaatgttattttcgatagattcaccatttttaaatttcaaggcgggatctacaccccataccgtggaaattgtgacttctggattgtatttttctttgtatacgttttcagttttagctgtgctgtccgcatttccatcattccccgtacctgagcagcccacaaggcccactcctaataccatagttgcggcgagcaacgacaacagctttttcttcgaatgaactcgcatattgttccccctctaaaaatcattatctactcttttattataagagggcttttcttcacagcctatgtcacaaaataaatatttctgcacctttcccaactgatctttgctggtttcgtccttactggtcccgaaattcatgcggagttattccgtaatgctttttgaacatcttactgaaatattggggattctggtagcctagttccgtcgtaatttcgtatatttttttgttggaatatttgagcaaataaagagcccgctccattctcattcggataatatagtcacctagaccttctccggtttcagctttataaattttagacagatagaccggatgaagataaacctgatcagcaatcgtcttaacagacagctcctggcctttatcctgggagatgagctcctgaacctgcttgaccacatagcttttagcgctttgctcgcttgcggaccattcagatttaagtttgttcatcatggaaaatatccactctttgaggtgggagaacgaatgaaccattttctgcgcatgtaacggatcgaagcctacttgatccatctgcgtaatgaaacgtccttgtttgtgcgctgtatacataaaggcactcgtcaccgagataaacagctcatataaatgctcgcgtgtatatcccacctcttccatttttccaaatacacggctcactttcgcttcggcctcgtcccattgtctggattcaagcagatgagtaagcgtagggggcatatatagcccctccagtgacttaactgagctgtgtggctgttctgtctgttcttctatgaatagcagtgtatccgtctcctcctgatggttccagtataaggatctaatcgctgtctgatatagcttaggcagttcctctggaaacttaaaccatccggttaatgcaacgtaaatttcccctttcaagtaattgctcacattttttcgaaaggtctcaatcgccgcactcaaaaaacgattctgctcatccacactccgttcaggaaatgaattccagttcccttctattaatacaattaagcagtcatgcggcgctttgcaatgccaaacgtgaaaatcaggtgcgaacacttcttcggcaatatttccaatcgcatactcaattaaggagactgaatgatagtccatatcagaaaaatgctttcctagctgaataagcagcatactggcaggatgtcccgtgcgtagcttgatttcgtactcagacattttgctctctattttgggtactggtaaatcacgcccgagtagcaaatcatgcatcaaatgggtccgcagtacaccaaaatcgtttctgcggctatattgtaattgatgaaccttgtcaaatgcttcccattcttcctttagcgaatccatagcggctgacacacatttgataaactcatcatcatctaccggctttaaaatgtaatcaaaagccttaagctggagcgcttttttagcatattcaaaatcggcatagcctgtcagtaacaaactccggatatgcggccatcgctcgtttacttcaacaatcaactccagtcccgtcataccaggcatacgaatatccgtaaccagaatatcaatatcgtacgcttccagcacatccactgctgctaatgcggaagccgcttgatgaaccctctcgatgcctagcgtctcccacggaatggtagctgccagactttctgttacataactctcatcatctactagtaatatctgaaccatctgttccctccgttttaactatattcgaatttggcgaaggctcaattaaaccattcgcatgctctccttctattgagagcgaccattttaaaactgcacgcaatcctcccattggagacaaagagaattccagtcctgcatcttctccaaaatgtaatcgcatacgttgatgcacattccacaaaccgtatccatgatcctctcccacaggcttgtcaagcgttgatgtcagggcagttatagcctctctactcaaaccgagtccgttatcatccacaatcaggtacatatacgagccaacacgctcggttaaaatatgaattacaccatcctccgcttgaggctctatcccatgcagcaccgcattttccaccagtggctgcactacaagcggcggaatcagcagactgctagcctgtgaagaaacatgaattaagaacgttagccttggcatacgcatctgctgtatgttcaaataatattgaacaaattcgacttcctctgacaatggaaccaaatcccgctcctgtctggttgtgtatcgataatacctggataaattatgagccatggccacgaccgcctcatgattgcgcagtttcgccatacttgtaataaacgaaaaacaattataaaaaaaatgcggattgatttgtgactggagctgctttagtcgcgcttccttgacatgtagctgctcaacatacaccttctcaaacagctcctgaatctgttcgaccatcagattaaattgactagacaggaaagcaaactcgtaactcccccttagacttaatcgaacagcatagtctccatcctttagtctccgaaatgcccgcacaagctgaagaatcggcacttgtacctgtgaatgaagcaagtaagcgccaatcaagcctaccagcagcgagccaacaacagttatataaaacagtcgattcgatgagtaaatcggagacatcatatcggacaaaggcatataatcaatcaaataccaccccgtcgtttgcgaaagaacggcatgaaccaggtagctttcttctccaattttcacagtcagattgtcaacttcatggagccccattttttctaattttgaaatcagctgtccagacaactcttcattggcagtacgattatagatcgctcctacgccttttttataataaaaaggctcctttcggccatcacctttgaagcggtcaagcatatcctgaatattactgctgtcaaattcaactttaataatcgtgttagcggtttctggattaccaagcgaagaaaacggggataatgtatacaatgaaaatataaattggtctttcccgtatgatctttttttggatacctgccagccgtcttttatcagctgatttagttttttctggtcatataaacctgctccattctccgatacaactcgtccaagcgaaggagaatagatactcagcccggttctccaattagaagagctttcctgaagtccaagcttggtttgaatccgtttgaccaggttaattccatccagattgagaaccttatccttcaaaaaaatcgcttgaaaactggctacatcgggatcatgaatcagcagatgcggccaggaggaaatcatttcaatattcgtattcacttggttttgaaaaaaagtcagctgattataattagattgattcagctcctcacgtaatacacctgtcgttgtctgattagaatagacatacaggatcagcacaggtataagcaatacgataacgatggagacgattttagtataaaaattaaatttaaacatgagttctacacatcctctgcacaaaaaacaggcatacttaaatggtatgccagagccctgaccttcgttgccgtcagtacatactatacattatcaatggttggcggtgataatatgtttgatgctaagcaaatggaatggtttgaccaactatccgctgaagacttggccattttaggtgccggcttcaatacactaggtgatttttttgattttctggcgttgattaaggccagacaggaaacaacccaaggtaataaaaagtaatagcactatttcacaacaaatttcacacgagttccatcctcatactcatccaattggtgactgacccatgatcctgccccacgattatccttagggactatgtatttgatatttgcacctttaccaccttctgagcacatagccatcggccattcgtcacgatcgtatcctttacgagtgggaacacctgcaagcgaatgcttgcgattttgctcggctccttcacggtcaattgtgcataccggtgattttcccgcctgaatggcttccttaatatgctgcgccgtttcagggtaacgacctgacgggaattgcagcgtaacctgagccgatgaaggcgggttctctcctgtcattttcgtaagaagattgcctccttcaaaccagtaagcgcccaaagctagcagcactaaagctataaaacttagcaaatttttcttcaatttccctctccccttcaagctattccagtagataccttcaactaaggtaatccccggattttatttttcgtaaccccttactgactataaaaaaaggttgaatattcgacgacaaatagtatagagaggaggttgtacgaatgaacgatgagatcaaactggccgtgagccaaatgcaagccgttataatccggttactgaatggaagtaccttaattggctggcctaagttcctatctgaccaagaaactcagcaattcaagctctacgatgacgaacacgtatatacgatttccgttaatgacgtggatacggtcgcaagagttattgtataagatacagggagcgacttaatgagacatccagtggacaagcccgaacaaagcacaccacaggagaagactgatcagaatcccccaaaataaacctttaaaaagcttcataccttactgacaacctttccgactgggctttttccccattataacatgtcagaaagacagctgtcgcagcttgctcttatatcatcttcgtatcatatatattaaattttaaaatcacgacacaaaggaaataacgaaattattccgaaaatcatgcctaatcaccagtgaaaatgcaatcatgacataataaaagtcacattttaatcaaaatttaatgaaagttttccgaaaatgatgtataattattgacataataaaacgcacgaggtgatcatcatggcattattaaacagagttcatgaattaaaattgcaactgcctaacgagcatcatagcatttcccaatacgtggagcatgcattgcattcgattgacagttttgtggagcaacatcgtcaatttgtagccgctcaggctctatatggtgaaaaaatcaatggtacagaagaaagactgttccgagacacaatttctgagattaaagcccaactggttgctactttggaaaagacagttgaagacttcgcacacaaaggcgataagcactggaaaaatcattatcaggacggcgtagaataagctgaaaataacccccggtctttggaccgggggttattttgtataagtggatgtggcaatatgcgtagactattttaacactctagccgatgtcgctacagtcttaccaccatagactactttgatactggaacttccggtatcaatcgccttcacctgaccgccagtaacctgtacgatcgacggtttggaagatgtccataccgctgagcttgtcacattggtagttgagcctgaatcataaactgcattcacactaagcacttgagaggaacctttaggcagcttcaggtttttattgctcaataccagtttgagcagcttaggtgtgaccttgatctcaacgttaaacgacttatcctgatatgtgcccgtaatcgttgcgtttccaattccaacggctttaatggaagagccttttacgatcgctacggaagcatttgatgttgtccattttactttactgctcagcgtagcttttttaccttccgtatatatgccgatgactttgatggacttacttcctttcaaattcatatcagcactcgaaaagcttggtgtcaatgtagaaatggctccttccacaatgacaggtactttcacatatttgttcatatacatagccttgattccagagttaccgccattcaccgcttttactttaccatttgctactgtaactgcggctgttgtacctacccagcttacctgattggtaacatcaaggattccgccaccagccatgtgtgcttttactgtcggaatacttgcttcttggcctgcaaccaatacatattttttctcagaagcggtcagcttgagcactttgtattgcacagtcactggaatatccagtttgagcgcacctaccgttgctgtcaatgttgcactgcctgggttcactgcaactagcttaccatttgctattttaactgcactttcactgcttaagctccattttacatcggattgaactgctttttttgctccattgaccaaataagcagatatactcggaagagaagttttgcctcctgtttcgagagtcagactggctttgctcgaaaccagtttttcaaccgttggaagtacattaatcttcagagtcttgctcaaaccgtgataggacgctgtaatcgtcgaattgcctgcatccattggtgtgattttaccttgctcgactgtggcaaccagcggattggaggaagtccattctgccgtgttggttacatctgttttgccgccagtcaggttgacatcggttgcactaacctgaattggggaactacccagaaagaccgatttggccccagttgcactcaatactaacgcctgagaagaagaacgcacatacaccatcgtttgtgctttaagttcatctttgcttgccttaatgtaagtcacgcctttggcaagtggacgaacaagaccatcttcaacggtagcaacagccgcattcgaagaagtccattcgacaccggatacattttccgtcccacctccagtaagtacaccttgagcagtcaattgctttgattctccgccaatcgtcaaattaatgggactagacggatttaattgcagcttgctgtaaggcgattttactgtaatcgttgtacttaccgttttcttctcatatgtggcaacaatcttaatctgcccttttgacacaggagtaatgagccccttatcaacctttaaaatgcttgaatccccagagatccattctgccttttgggtaacatcttctttgcccttttcagtcaatgaccacacttttaattgagcggggcttccacccagattcaatgtagtcggattttgactgtcccactgtaccgtggaggtcgtgctctcctcagcccggatcaaacccgctggccatgctgcaaatacaaacatcagcaatgcaagtaagaaggtactccgtttgctcatacgtttcatacgctccattcgtttctctcccttagtttcatctctataaaataggatataattaacaatcccattacttttatcggttagcagcttactaaattgaacccttcatcaaaaaaaggtgaataattacagttaaagttctccacgcagtgaccttaccacaaacaaatgctcttctttagataaggtttgtccatcttcaaggattacattgtgtgccgagtgactaaccagctttacattataagcaatcagctgatcttctctccaaatcatcaccgccgactgaaaatgaatggcattatcaaactgtaacggaacactcattacataaccgatagcgttgagcttcgccggatggcggcttctacgctcacgccccggaggaagcatggtaatatacgtaatattttcaaaaggaatagccagcattttcgggcctaaaataacgcactttcgtatatcatcccatttttcaagcgtgccgcgcaccttctgggtatgatcgttgttgccgtgatataaaatgacctgacgtcccttccattgacgcatgtcctcacctccagtgctagcggttaggaatctcccaccgaatcggctccattccatgctcctgcaaaaatgcattggtacgcgaaaaaggcttgctgccaaaaaagcctctgtgagccgccaatggactcggatgaacggatttcagcaccagatgcttgctggtgttcacgaagcttgcttttttctgagcatggctcccccacaaaataaacactgctggctgctcgcgctcattaatcgcttcaatgacagcatccgtgaaacgttcccaacctattccctggtgagattgcggttgtccttcacgcacggttaacacgttgtttagcagcagcacaccttgctcagcccaaggaacgaggtatccctgattcggaatgggagtaccgatatcatcgcgaagctccttatatatatttagtagagatggcggtgttcgcacaccaggtctaacagaaaagctcaaaccgtgagcttgtccctctccatgatatggatcctgtcccaatataaccgctttggtcagatgaaatggcgttaatttaagtgcggaaaacaagtcttcttttggaggatataccttatgtaacttgtactctcgggctaacgtataccttaattcattaaagtatggcttttcgacctcttctcgtagtacatcatcccagtcattcccaaacatacccctgtctcctctcaatatgtagatctgtgaaaacggtaagctttttgatccaaaaaaataagctgaactcctcatccggagccagcttatttattcgttacctgtgttatatgccgaaggaccaggaaaatatccttacggtaatcagctaccgcaggtctaaattcgatttccttattataacattaacgataatgatgtcaagtaactgaaagcttaattccctcagaagaaaagctctttattgctgtatttattacgattttgtatgagcattcaggtattccaatgcattatataacataacagcagcttcggcacgtgtaatctctttttttggatgaaacttttcatttgcatccaaggtattgaccttgtagactagcgagcgttgaatgctaccttggtaagaaggctccagttcgctgtcatccgcaatattcgcaggtgccattttaatcatcggaagagcgcctgctttttccatgccctgaatcagcatgtaggtgaactcttccttagtcagagctttggcaggatcaatatcctttggaatctctacgccattataatgcgcgtgataaaggcttcggcataccatgcagtatccttaacatgggtaaacagtccgctggcctgtggtgccgtattaaaagcaatcgcggccaaactgagctggagtccgccggagatcaactgaatgccttgggcagcggtcactttagatgacgggagaaactgcgtgtcagagacacctttgagtagaccctgatctttaagggatatgattttttctttgccgcttacgttgttcaaatccttgaattgactgtctgccgcagacaattgacttccaaaggagaaggacaaaatggctacggttgtaatggctgcgaatgcactttttctcatactcatgttaagttccaccttgtagttgaattaggccgcttggccattaacaacttcattgacgtagtataagctggaaaagttgcaggcagacgctgttgcttcttatgctacatgccttcctttttaatataataccttctccagactgcgtgccaactcatcatcgggaaggggcttgcgatgcgtattctctaggtagatatatttctctgtttctggcattaaatattgtttggaccacaggaacatatccggactgtctccctgaagacgaagaaatctccgcacagtgtccgcatgagaaatagtgttatctagattggttaaccaatctgcccggtagaaatgctcccatcttccagttcctgcgagcgataaagcttctttacccattcggtagctccaaacggcatgagaagcttgtataaatgctcgtggataatctttttcaaggaacagcccataagcgctacataagcttgccagtccacgtgagccacttagatgcagttcaatctgcacaagcagttgattatacagcctgcgacattcatcttttgacaactgcttcatgattcgtagacaccgctctcgcaattcaacccagtccgggattgccgactcggctttttccttgaaccagcgtatctgttcaggaaaaggcctttttccagtagcccagtacagccgttcatcacggccttccttgccttgtagccaataccccataatttgccgagctggatggtgatagaattcctcccctgctcgatcatccttgtgcgggccataaacgatcgtacaacgggaataatcccggtataattgggaaatctcttgaagcttactactgtacagccgcccgataaaatcagtaagctgatcttcagcatccacttcacccttcgtccataaatttgctactaaatccagcgtatatacatgtggcaaaatattacctgaattgactagcaggtactcgtccgcccctgaagtaaacgctgctgttaattcctctacaatcaagctggctgaggagggaaattgggtaagatggtttgacgcttgcaagtcgtggaaggtcacatggtaatatactccattcttgcccccatcctgcgcctcaggcaatgctggtatacgataattaagattcccatggcgccgagataccattttaccgtaaccattatccgcccatattttgatcaccccttcgggtacttcaatatgcccctgcttgtataactcggcaatctcaccatacatcgccatacagcacacaggatgctccacaaattcacagatcatattgtactgcttgcgaaccacatacgagattaattgtccacgtttgtccggcgtattaaaggaaggatcatcttcccaaaaaggcttgtcaccctgcccgcgaaaagataatacccatacaatcttctcttccttttgccgttcaatcgcttcctgccacagctgttcaaacaactcgggatgctctctgtagctagcttgtttacccggaaaggcgcgcaaaaacatctccgcccccaacggttcagcatgatgatgtgtgatccataagcccatgtctgctgcaagcttatgatggatacctgtgcgtggtaaatcggttccgggaatcaccatatttccaccacagcgcagtaacgcttcaaaaacgggctgccacacctgctccgtcggtggataatcatccttccagccaatcaagcatacctcatcattgacaaaccacccccgataccggatcttggacggtatactgtcaacattctgactcggcattactatggtatcccgcttaggcggtagaatctccgcccagaaccagaacggctccacacccagagcgaaacggctgtaatgaagcagtccataaataattcctaattcatcacggccaataatatggagtaccgttcccttgctaccagcaacaaaacgcagacaatagccctctggccaatgcggacagctatctccttcctgcgcataacggataatgatcgagggctctacttctgttagcaatggctcgcggccaaacacttgcttatgatctcgcgcaatcatgttccaagcgtgggcaatgggcacactttcatcagtttgaagattgtatccgctttcagatgaaatagtcagaggttcacaggctttcatttattgtcatctcctatttttttcaactatgaggattcttcttgtctttattttataggttgtcaacatacatataaagctgtaccaacgtaaatatagctttttttcggtaaatcatttgagagttgaagcttcatttgagaaagaaaaaagtaaggaacaggagagaaataagaaagacttgactgctacactaaaaatgttccaaaaaacagactgctcttaaagattcaagcgcagcaaaaaggagacttgatatgaaattaaaaaaacgatttgcctctttgttcctgttggcattgatggcatttatcccggtccaggcatatgcttctgggtccgttccaaccactccctctggaattccgatttccgaaatcgaaaacagaacagatcaaattatgaaaaaatatataggaacagcgattcctggtgctgcggtttccatagtaaaggacggaaaaattgttttttcaaaaggttacggatacgcaaacatcgagaaacaaacacccatgagtacggaaacaacctatatggaggccggttccgtatcgaaattgttcacctggacggcagtaatgcaactggttgagcaaggaaagctggatttgaatacggacatccgcacatacttgcctgacggctttctcaagccttcttttgataagcctattaccctgaaatcactgatgagccacacggcaggttttgaagagcgcctggaaaaacttttggttcatgatgctgctaatcttaggcctctcaaggagcatatcgcacccggaaatcagcctcaacagatttatgagcctggaacagtgattgcttattccaactatgggaccaacctggccggttatattatagaacgtgtatccggaatgccttttgaaacctatattcagaaacatatatttgagcctctagacatgaaacattcttactttacacaacggtatgatcttatcccagaggttatcgaacataaagcaacaggctactccaagaaggatggaaactgggtggcaaagccgaatgttttctttaatgatgtgccggctggtgcgttaaacattacttcggaggacatggctcattttatgcttgctcatctgaacatgaaccattccttaaaatattcgctgttcaacaagaatgaaaccttgcgagaaatgcatgaggcttcgtatacccactatcccgagcttccggggaatgcccatggcttttgggaacggttcgcgggggattatcgtgttatcgagcacggtggaaatacagattcattctcctctctggtctctatcgtgccagatcaaaactttgggatcagtattctgactaatgtggaaaatgaaatgtccggggcgagaagcgaactcattgacctgtttgtcgggggttccgacgctactccgcaagcggacagcacgttgaagcatagcgcggatgtggcgggaaaataccgctctgctcgcgcagtatcatcaggtatattgaagcttatacccgtattatccaatgcggaagaagtggtcacagccaacggccatggcggaatcactctgagtattccatccatgaatattaatgttgattatgtagaaaccaaaccctatttttttgaacgcgtgactccagggagcactccttatgatcacgcgggcctaaacatcagccgtctttttttcttaaccaatgccgatggtaaagtgacgcagttgtcatatggagtgatcgatgaccaattgccgatatccttcctgcaaacatctattttcagttatattctggtcgggggatgtggtatttggtttgcgcttgggtctattttcggtattattggatggctgcgaaagctcaagaacgcaagaaagcagaagagtacttcgcggtttcccttccctgacagtgtaacagtaatccccttgctgggtctacttgtgatcgtcaatctcattgcttcaagcatccaattgataggcgacccctatcagcctatgtccaatttcaatttgaatattatctttttctgggtacttgggcttgcctttgtaccggccacctatcttgctgtaagaagatgcagtgttacccaaactacatggttaagaaaggtatacaccgcgacgctgattctttcgtttctagctatttcgattttcctgtattcctataatttctactttttggtatagctccactcgataagcctgccataccttccagtgtaccgataaagattgtcatcgtgaacaaccctaatctgagctaaataaaaaaactctcctctgcatctagcagggagagtttttaacacactcaatgagatttaaatacgtgccggattgagcctttgctttcagtatgttgttgaatctgtttattctgtatctggctgagtatttaccaattttatatgaacatctctcaattgtttctcagtaacccccgaaggtgctcccattaatagatcctgcgctttgctattcattggaaaagcaataacctcgcggatattcgattcatttgcaatgatcataacaatcctatcaattccaggtgctatacctgcatgaggcggcggcccaaattgaaaagcattaaagagtgcaggaaatttactcttgatgtctccatatgtataacctgcaatctcaaaggcttttaccataatctccgtatcatgattccggacagcacccgaggacagttcaatcccattacacacaatatcatattggtacgcaaggatatcaagaggattcatattcagtagcgcatccataccaccttgtggcatcgaaaaaggattatggctaaatccaattttatgagtatcaggatccaattcaaacataggaaaatcaactatccagcaaaatttatatatatccttttccagcaaatccagtctttttcctaattgatttctgacagcaccggctattttttctacatttttaagttggtcagcagcaaaaaacagtgcatatcctgaactagcttgcgtaacatgtattaattggtttttcacctcttcagagatgaattttgcaatagagccactaagagacatatcatcattgaacttaatccatgataggcctttcgctccagcctcaacagcaaagtttactatatcgtcataaaagcttcttggctgtgcaccacaaccaggaacagcaataactcttatcgttttattttcaaatactttaaaatcagtctctgtaaacagctctgtaacatcatggataattaatggatttcttaaatcaggtttatcgctcccgtatttgagcatggcttcttgatatggaatcctgctaaaaggctttgagattttaaaatttgtaaattcggagaaaacttcatatagcatattttcaactacattaaagacatcttcctgtgttgcgaaagccatttccaaatccagctgataaaactcgcctggtgatctgtctgcccttgcatcctcatctctaaagcaaggagcaatttgaaaatatttatcaaagcccgaaaccattaataattgtttaaattgttgaggtgcttgaggcaaggcataaaattgacctggatgcactctactaggaactaaatagtctctggcgccttctggagatgaacttgtcaggataggtgtctgaatctctaaaaaattcaaatcgatcatctttcttctgatactttgaattactttagaacgaagtataatattattgtgtagtttttcattccgcagatccaagaaacgatactttaatcttaaatcctcccgagcttcatttgctaaagttacttcaaaaggtaatggattcactaccttccctaaaacttttatctcattggcagctaactcaatatgcccggttttcatagtgggactaatcgtattttcagatctgttacatacagtacctgtaacagaaatggttgactccctactgatctttgatacaaaatctttcaattcgttattatcagaaacaacaacctgcgttactccataatggtccctaaggtcaataaaaataaccccgccatggtcacgcatattttttatccatcctgcaattctcactactttgccgacatgtttttgatccagttctccacagttatgagtcctataactatgcatgaaaaacctcactttctttttatcttagtaatttctatttttctccacacttatactcacattatcgttaaagctttatacctttcatttaggtattccgcagtttcaaccattattttttgtcctatttcatcaacatgcctgttcttccaattctcaaagactgttcccttgacccattggttaaaagcgccaagggctggtccgcagtgtacttgataatcaaccttactgtgtttgtctccattcattgcaagtcgtgtagaataagtaaagtaccatctaaatatcaacgccatcttacgtttaggaatcctttcagctttttcaatgatctcagccgggtaataagctttaatatcttcatatacttgttcaatactcttcttaaaatacttttcttcaatatattttttggttccgctatcaatttcatctatggagttataattacggtaaagatcatataatttattcgccctggccgggaaaaaaactccttttttcataacctgaattttcgctcctatttcaaacatatcccctgcgggagcgtagtctgtatcctgtatatttaactgctggagcaaatcttttacatcatcacttgtccctgcttcaaccgtacattggttgattgatcctgtcatgataaaatccgcacccagtataaacgctgccgcagctgcttgtggagtccctatccccccggctgcccctacccttatacttttattgtatttatacttaagtaacgcttcatccctcattttaagcattaacggaaccagtacatatgcaaccgcatgatccgtatgcccgcctgaatcagcctcgacgcacagatcgtctaccataggaatttccatcgccatccgggcctcatcccggcttatcctattttcctctagcagtttatttacgatattctgaggcgcaggactcaagaatgcctccacaacctcgggtcttgatactttcgctataatcctgttctgcggtgttacgatccccttttcatctcgttttaaacctttcaatctgtaccttaccaaagaaggcgttatactcataaacgcagaggcttcaatagttctaacaccgtattttatgtataaatcaacgatgttattttctatttccaggtgatcgggaacatgaataagattcattccataggcttcgccttggttcaattctttctgaatatactttatagcttcttcaagggccccaatcttgactccccctgccccaaagaatcccatcattcctgccttacctgcctttacgaccatctcttttgaagatattcccttatacatcgaacccataagatacgcgtatttaagtccataatattgtttgaattcgctatgaccaagagactctgccgtaaatcgttggccggatatactattcttcgactttacttcctgtacctgctcgctacgttcttcatcctccctcacaatcagcggttctgcttctcgttgtattgcattaaccaaccctgttatgacttttccaggtccaacctggatgaattgggttacatttttacccattagatatcttatactttccgaccatttgaccggacttacgatttggttgatcagcgtacttcttacatcttgctgcctgtagggtctggcatagatatttgaaatgactggtatttttaattttgagaattcgaactgtgacgcataggcctcaaatctctgtctggcatcttccaaatacctggagtgaaatgctccgcttacatttaaaatcacatagtttgtggctcctgcatcctcaaaaattggctgcgcccgttcaatcatttccttcggtcctgagatgacaatctgacttggcgaattaaaattggcaacatcaatctcccttaaattatttttctcgataacttctctaaatacttcctccttcaagcctatgaccgctgccataccaccaccggtagccttgaccatcagctctcctctttttttaaccagcttcaagcccgtttcaaagtcaaatgcctctgcggcaaataaggcattgtattcacccaggctatgtcctgcaacataatcgggttttcttccagtctcttttaatgtattaagataactcaaagcgtttacgacaaatagcgccggttgggtaaaatccgtttgtcctagttgattggcaggatcttcaagacacagttttttaatagaataaccaagaatagcatccgcttttgcaaccaattcctgaaattcgtcaaatagttctactcccatgcctttggcttgagccccttgtccagggaacagatatgcgatcatttgtgtcctcctttttgctagtgaatgcatattagtcgaatatttcaaatagacgatccaaatttttcatatcgttttgaaaaggtgaaagaatagaacaaatacttgccattttcttgctaccaaaattgtacttcacaaaattagcaagagtgcctgaggggccaaggtcaatatagataatcccgtccccgtctcccagacattttaaagcgttccgaaaacggataggttttctagcaacatcccaaagaaaacggttgtcaagggatgccgccttgcctccgtacatagatgagaccatatttatggtcggattccttagagttttaagctttaaaaacgctgtatattccaaggctatagggtccattaaggaagagtggaaagcaaactggaccggcagtctttgacatataatctcattagctatcaagtagcgttcaattttttccagttcctcacagctgccagaaatgacaaaatgcgagtcgtagttgattgatgctaactctgagttggcattcaatacggatatttggtcatacagactgaggtcgccaattacggccagcatgccaccctttggacagtagttttctaccatttgtgcttgcttgacaaggctttgaagagtatcttcataactcatacagccagccacagcaacagatgcaaactcaccgaggctggaacccaaaacataatcaggataaatccccttttccagtaatacctgtgtgagggcatactccaccatgaaaattgcagggtgagtatataacaggctatcaaacacgtcccccctcccacggttgtcgtcgtacagcatttttaatacggacctgcctgtaatatccgtatgaatctcatccaacttggtcatccatttccgaaaaactgaatttaacctatataattcttttcccatgccgtagtattgtgagccttggcctgaaaacataaaaattacagatctgtccattctaacctcccacaacatactcattgttaaaatcctaataaaaccatttaaaataaatatttcacagcaaattgcgaactaattgcatttgggaaggtgtaggattgctttcgttaagaacattctccatatgttgtcttattgcaggtttgaatttcggctctgttatgatatatagctgcccctttttgattccctcaaacatctgatttgctacatcctctggaagtattccattctggacagccttgcgggccaattgattaatgacttgtctttccgggggaagatttcctagtccggtctgcttactcagctccgtcggtcggttccgttccgcatccataatttgggtacgtacgaacccagggcagacaaccgaaactcctacattggaacctatcaatctgagttcttggtgtagcgtttcagacaagcttaaaacggcatgttttgacgcgctatatattccattaccggggccggacaacagtccggcgatggatgctgtattcacaatatgacatgcagttttctgtttcagcataataggaacaaaaacttcagttgcaaagagaatcccccatatgtttacgtttattacccactgccaatctgccaccgtattttcccacaataagcagcccgtgccggcgtccacccctgcattgttgaacaaaagatgcacagctccaaatgtctgaaccgttttttgcgctaatgcacgtatatcagcttctttggaaatatccgtcactacggataacgtttctgcgcccatgtctttcaattgtttttcagcccttagaagggcctcctcctcaatgtccgcaagaacgaccttcatgccctcatttacacatcggtccgcaatagcgcggccaatcccactggcagctcctgtaactacggctatcttatctttaaattccctcatgatttacctccagaataatttgtaatttctatctgatagtgatcggttccctgtttatgtttaaaactgggttatcggtaggggaatcctgcggacatctttatcctcatggagtgcctcccatgaaatcctgcccccctgggtccaatacatcgctatattttccatgtttttctcctctagcagcaattgagaaacggtctctcctattttccctgagagaagcgcactcgtgtttgagtcttctacgctttctcctataaataaaggaatagatgccccttcgggtccgttgccgctatcagctatttcgagaagttccctaagacccgtgagtagatcctgccgcgtactcgctacgattgccgcccggcatgtcatcgcttcgcgacctgtctgaagtgtaaaggcaatatcttgtaaggcatcatcgctctgctgctccagatatcccagtaattgattggcaagcgccatcagtctctcccggtttatgtccgagagaatcaccacttcgggctgatctgccactcgtaaatgaatgttgtctttttctgaagggatatattcttccagaatgaaatgcacattagagcctcccgcaccaaaggagcttacggttgcccgcaacgggaattcccgtttttctccctgcatctcaattacaggccgctcccattcctgaactttccgctgcaaataaaatggagtattactgaaattaatattagggttaagcttctcggccttaatggtaggaaccagttttcgatgccacaattgcaatatgaccttggttagctgtgatatccccgaagccgcttctgcatgccctatattggatttgactgagccaatggcacaaaattgctgctcggtcgtgaatttctggaatgctttattcaaagcagcaagttcaatagggtctcccaatgtagacccatttgcggctgcctctacataactgatcgtccgggggtctataccggctttcaaaaagttttcttcgactagttgcgcctgcgcattggggttagggattgtatatccattgctatgtcctccatgattggttgccgtggatttaataaccgctaaaatgcaatctccatcctgtacagccttatgaagcggttttaagagtaccgctccaactccttccgctggaaggtagccatccccatctgcaaagcttctgctatcttcatgacttccaatcaactgattttgactggattcaatatattttttgggactggtcaatagattccccccgccagctaccgctatttgacactctcccctgatcaggctttcacatgccatatggacagctacagctgaggaagagctcatcgtatcaatggatatgctcggtccctggaaattgaaataatgcgacatggggtttgcaactgcaacagacccaaatgatgttacccgttgagcagagtccggttcggtatcacaggagcagtatttgtgatacgtagcgcccacatagacgccaaccttgttctggtgtttcttctgtaatgtctctcgcgtatatcctgcactttcaagcaaattccatattatccccagaaagagttgttccatcgggtccattaaactgatctcatagggggtgagatgaaagaatgctggctctgacaggcttattcgttccatgaaaccgccccacttgcagtaggtttttcccggcttgtttctctccttgtcaaaataaagatcatgctcccaacgatcttttggaacttcggtaatgcagtccttgctttcttggagattgctccagaactcctgaagattttccgcacctggatatttcccggacatcccgataacagcaatgtccatcgctcctgtttcttgtttcttgtcctccggaggctctccctcagttgccgaaaattggggatgacggaatatcggagaaggggcttttacctgctccataccaaaccattcaatcaattcgccttgatgcgattccaggaaatattctattaaactctggatattcggatattcaaaaagtaaggtcctcgatagcgggccgaagtttttttccagctcatcggttaattccattgactttatggagtcaacaccatagttttccaggtttttgtcctcttcaatgcggtgttccggcagtccagtggacgaagagagcaggcgctttaggtaacttgtcattttttcacgcagtagctcttcttcctggctggacactgccttatttgttatagaagttgtgtcggcttttgcacccgcagctgctgcctgatctatgccaaacaaagcgatcaattggtctcgataggcttccataaaatattccgtcaaactccgaatatctggatattcaaaaaatagagtcctcgacacctgatcgaatgttttctccagttggtcggtcaactccatagactttatagagtcaaccccataattctcaaaaggtgtattttcttcgattcgatatacgggcagttcgatggacgttgaaagcagggtcttcaagtaatggactgtcttttcacgcagcaggtcctctgctctgccggacacttcctcgtttgctgcaaaagttgtgtcagctttcgcgcctaccaccgctacctgatctataccaaacaaagcaatcaattggtctcgataggcttccacaaaatattccgttaaactccggatattcggatattcaaaaaatagagtcctcgatatctgatcgaatgttttctccagctggtcggtcaactccatagactttatagaatcaaccccataattttcaaaaggtgtatcctcttcgattcgatatacgggcaggccgatggacgttgaaagcagagtcttcaagtaatggaccgtcttttcacgcaacaggtcttcttcttggccggactctgttttgtttgctgtggagggaacgatgttagcttctgacccgagcgcctgatcctgagatgctttaccgctttcttcaagctgtccctccatgatcatcatgttgctgattagatctacgtctccttcgatcaccatgacctgatccgaaatacaggctatactttggtacagggcgctcattcctgtctctgtcctcatcgcatacatacccaccttctgcatggccttctccgtctcttggtcagggcgcattccgccatctttccataacggccaattgatggacagcgttttgcctgtacgctccatggaggataccaaggtattgcggtaccaggcatatgcgtccataaaagcattcgcggcagcatagtcagactgacctgcattaccacccactcccgaacctgacgaaaacaggataaagaagtcaagagcaatgtccttactggcttggtccagatttaccagtcccgcaaccttgggcgccagcactgccctgaattccaggctagtctttttaataatgtagttatcctggattattccagcactgtgtaggatgccgttgattccgccgtatgtctgtttgatatcttcaattaagccaaccatagcttccttccgtgtgacatccacctgtctgtattccacccgggcgcccaatgccttcaattcctccaatgaggtctgcttgtcctgatccagtagggaacgtccagtaagaatcaaagtcacttccttggcctgacgcgcaatctctttagcaaaaataagacctaaaccctttgctcctccagtaatcaaataaaccccgcggtctttccatggaatatccggtgtctctgacggcatttctgctttactccagacaggaacccaacgtttgccttctgcaaaccggatgcggctatccgtcggatgtcggctgcttgtctttagtatttcaatgagcccttccattttttctgtaccctcaacttcaattagctgaccatagatctttggattttccttttgcgcagttttgagtatgctgcacagcccagcgaagagcagcttttcatgttgaggcatcgttacaatctgtaccagcaccttgcctctgggtttgtcattcaggatactttttattttttcaaaaacctggacagcatacatttcgaagcggcgatcgacctcttccataccggattgcagagtgatatattccattcctgccaaggaggactcgatatctcctgcagcaatggtatctatttcgcaaagcattactacatgtcgttcgtaaatgggaaccatcgtgtcctccgcaacaaccgcctgttctttccagaagggttggagcatcattgcaccaggtgttttctcacatgcgcccactaccttgtaggagcatccctttatacgcacgcagacttggcctgcgtcatcacacaaatcaatgtcatacttctgcgtattatgaccagtcccgcttcctctgctataccggatcaacgcccacatttcacagggacattcccgaaatatttcgattccctcaatggcagtcggccgtattttctgtagaggatcaatgcctgaaggccgcatgatattttcatcattcgaaaaaaagtatgccagcggcatttgcaaagcagcgtttattataaagggatgcaaaacaaataagccctcagtattcctaataccggaaggcaacgatagcttggccagcactaacccctgtcctatatgcacttgttcattggcctgatgttccagactgtcgtcggctcccatgtcccacactgcttcgtcgtctatcccaggcgaaacatgctgaaagcattccttctgcaaagcctgcatatcccacgtttccgcttcatttaacatctccaattcggcactaccctggctgtgtaagacagggtccccggcttctgttaatctgctgtagattttgaagccaatcgctccttgatctcccggaaagagccctatatgtatttctaacggctgatctcctatagcgggagcatgtgtccatacaatatctttaataatgatgtttgcctgccccttctcctgtactgttaacgactgctcaaccgctgcccgcaccatttcaaggcatgccgcttctgacaggacaagctttccgtcaattacggagtttttcagataaaactcctggccgctaaaggttgaactaaatctttgctcagaaagtacggaggtgttttgatgcagtaatggatgtagatgtgcaaccgcattgacgacaggcttttcttcatctaaatgtatccaatagcgttctctgccaaaaggataggtgggtaaagggatacggcggggctggacattaccgtaaagtctgctccagtccatatggacacccttgacccacaagtctgagattctgccgtacttttccgctagaatctgtaaatcaaccgtttcatcgagcgttttctcctctgaggccatgttcaagctctccttgtctcgcttggcctgtccccggtaaagctgtgcaatactctgtcttcctccaataaagccccgtaacttgtttctaagttcctccactgactcaacgaccacagcgaggcgctcttccatcgcttcgcgtcctgtctgcaaggtataagccacattcaccagatcgtgatcggaaaactcattccgatccattgcagcaaccaattggcttacctgctccttcaatgctccatcactttttgccgacagaactacgacgaccggtcttggaggagtaaaggcattttgaaagtcatcctgttccgcagggagatattcctcaaggacgatatgggcattagccccaccggctccaaaggaagatatcccggcgatcctcgggtattcccgttgctcgccgtcctcctccactatcggacgctcccattcagaaagcccctgttggactacaaatggcgttttggaaaagtttatattagggttcactttttgggaatgcaggctaggggcaattttccggtttttcatttgcaagatgattttagcgatgcctgcaatccctgcggccgcctctaaatgacctatgtttgattttaccgagccaatagcgcaaaaccccgtgtcctgcgtatctttcttaaatgcctgggtaagcccggtgatttcaataggatcgccgagctccgttccagtaccgtgggcctcaatataactgactgcccgggcatttacgcctgctttatcaaaagcctctctgatcagttcaccctgtgctaccgggttaggcacggtatacccgtttgtttttcctccatggttgatacgggttccccgaataacggcatagatatggtccttgtctgcaatggctcgtgacaaaggtttgagcagtacgacccctgcaccttcgccagggacaaatccattcccaccttccccaaagcttttacaccgtccctcaggcgatagcattctcatcgtactgagaaagatatagcttgaaggatgaagatataagttgactcctccagcaacagccatttcgcattcaccgttaaagatatgctcacaggcctcgtggattgcagttaatgaggaagagcacatggtatcaaccgggatactaggcccctttaagttcaagaaataggatattctgttggctaccgagctgaaggaggttcgcggaaagacgggttgtccttgttcccacagctttggtccatatagattgaaccccgttccggtaattcctgcaaagacgccaatccggccattatactgttcggcgagctgttctctgctatatcctgcatcctcgaaaaccttccagcattcttccaggaatattcgttcctgaggatccatactcattgcttcccggggagatatattaaagaagagaggatcaaaatctgcaaaatcctccacgaatcctccatatttactatagcttttgcccttttcaaccgcttctttgatgtcggaacagtagaaaccttccctcttccagcgttccgcaggaatttctgttatacagtctttgccctgctccagattgctccagtactcttccatatttttggcctgcggatatcgtccgcttataccaataatggctatttgctcgtgtttcacacggtctctgctagtagccgtgttgcagatacgattgttttcttcctttggcaggggtgacaaagaaaactcgctggcagcatgcaaggttgcggaaatggagacggatttctcttccgtctttatcgggcttccgattcctgtccaccgtacgcattccttgtgataatcagcaataaaatattcggccactgcttccaacgtctgatattcataaaacaaggtcattgatatttctccaaaaatcccctgcagcttttgattaagccttgtaatcatgatggagtctatgccatagctctccaaaggctcgctgacatcaatcttgtcaatgctcagcttggtaacttctccaaacaacagttttagctgatgtaaggttttttccagaagcagttcaagattcacctctgaagaagctgactcttcaacatattctttctcctgcggttgggactccaagaaatacttttgcaatctggattgctcaccttctatgaccaataactgatttagaccagcggccagaccgttatatagagcctggataccgtttgaagcttgcatagctaccatgccaatactttgccaagccctctccgtgtcattgtccacatgcatccctccgtccttccagagaggccaattgacagatagcgtctgccctttgcgctcctttgaggatacaaggctgtttcgatacgcggcataggcatccataaaggcatttgcggcagaatagtcggcttgaccggggttgcccataatcccagctattgaggagaagagaataaagaaatcaagatgtagccccttggtcacctgatctaagttcaccagtccggcaacctttggtgccattactcccgcgaactcttcctgtgatttattcatgataaaacgatcctgtattactccagcactatgaagaataccatcaaggcctccatactcttccctgatctcaaggatcaatttggagacctcttccttccgtgctacatctacctgtctgtactcaacgcgggcccccagcgccttcaacttctccaatacggcctgtttgccttcgtccggatttgaacggcctacaagaactagcgtggcttccctgactcgctgggcgatatcctccgcaaaaataagtcctaaacctcctgcaccgcctgtaatcaaataagtcccccgatccttccagggcactcttcccgttgtctcggtgggtttcaactcgttccagccgagaaccaaacatttgccatcctcataccgtatccttttatcctttggatattgactgttctcttttaatttctcaatcatctcttccaaacctacagattccaattctacgaattgccctacgattttcgggttttctttctcagctgtctgcagtaatcccaatagtcctgcgaaaggttgctgcgcgctgtgtgcggaaactgcaatctgtattagtacgctacccttggattcctctttgagaaccatttgcacttccgtgagcagctgggtggcatacgcctgaaagcgttcatccatgctgctttggctggcatgcagcttgatgcaacgggttcctttcatgagcgattcaatacttcgctccgcgaaatgatccagttcgcaaagcaccaccagatgctggctaaattcagggcgtgccactttctgaagagcaacttgctctttccagaaaggctcaagcataaggactcccgtatccgccaaggaccccgcagtccttgttccgctttgcgcagtctcatgcgaagccatttgagcttgaaattggcgtatttttacaatggcatcctctttctgtatccgtccgctttttacctcgcctagaatatattgaaaaaagtccttcatcttctattgcctcccagcacgtagaaacttctcatttacgtatacatatattgaggatttcactggcagcctcatcaacagacagggtatcgttcatcatttcatccaagagtctgccgcacaatatatcatcaaagtctacatcgctctcaccttgcgaaaataatgcataggcttttacttgatccttgctttcagaagtccagtaatgctctttagcaaaagggtaggtaggcaggctgatacggtgaggcatcttccctgtgtaaagttttttccaatccaaatttattcctttggcccatagctccaaaagcttggtatatttctttttggaaatccaaagatcgatcatttgttgcaaatcttcgtcccccgaaaaaatagacaacgattctctgttgcgtttagcctgtcccctatataggttgagcatgttatgacgtccatccacaaaactctttaattttccctcaagctctgcggtagattccacaagtacggctaaacgctcctccatcgcttcgcgccccacctgaagcgtgtaggcaatatccgataggcttgcggaggatagctgaccctgaagagcattcagcagctgtcgtcccttttccttaagctgctcctcgctcttggctgacaacacgatcatagcaggtccctgagagtcagattctgttccagactgttcctgatactcgggaatatactcttcaatcacgatatgggcgtttgccccgcctgcaccaaaagacgatattccagcccgtcttggatattcttttgtgattccatcgcttgtaattaccggtctcttccattcctccaggctttgttgaacgataaatggagtattgttgaaattaatttcagggttcaacttcctggaatgtaaggatggtactagctggctgtgcttaagctgcaacaatattttagtcactcctgcaatgcctgctgcactctcacaatggcctatattcgatttgaccgcccctatggcgcagaactgcttatccgttgtgaatttttcgaaagcccttgtcaatcctgcaatttcaataggatctcccagagctgtaccggttccgtgggcttcaatataactaactgtccttgcatcaacatccgcacgctggagcgcctcttcaatcaaccaggattgagcttgagggctaggtactgtataaccgctggttttacctgaagcatttagcatgctccctttgataactccataaatatggtcgccatctgcaatggccttctccagcggcttcaacacaatcgcaccgacaccctctccgtcgacaaatccatctgcctggtctccgaatgacttacattcacccgttttagaaagcatcgtcatagccgacagcttgatatagtggataggatctacaattaagttgactcccccggcaatggcacactcgcttgtaccgctatacagactttccaaagccaaatggatcgccgtcaatgaggaagagcaagcggtatctaaggacatactcggaccttggaaatccaaatgataggaaacccggttcgagatggaattatattgaggtcccaaaccgtaatttccgttcataacacctgcaaatacaccgactcttctactctcacaaagattggcaggggtatacccagcatcctctatgcttgcatatgctgcttccaggaacagtctttcctgcgggtccattgtttcggcttctgcgggagaaattttgaaaaatagcggatcgaataaatcaatgccttcgataaaaccacccgatttcgtatagattgtgccccttttccctttttcttggtcaaagtaggtcttccaatcccaacggtctttcggaatttcagttatgcaatttttaccttctcttagattgttccaatattcctctatattacgagctcccggatagcgtcctgacatcccaacaatcgcaacatccctgatattggaggatcgtgtcgttggcttttccattgtgctgtcagaaggcttaaggaaacgccctccccggtcaaacctcattgggacagtagcgagtaattgcgaagcagggccctcttcaactctggaagtctcttcggtcaactcctgttccttcattcctaccagcttcttcaacgagtccttttgcgtttgaagaaggtatgctactagatcatctatggtgttgtactcaaaaaacagcgtgctggcaaaatcctcgatgacttcacgcaaaacatttgtgatttgcactaccaatatcgagtcaattccatactcttccagggcaaccgttgagtcgatacttcccggttccatttttagcgtctcaccaagcaaatgtttaaagtacgccgtacttttttcacgcagcacatgttctacctctgcttgtgctacctctattttgggttgagttcgttgtttcactgataccgtttctacggttcttttctctatcaatattgatcttcgtttgtgctgtcgcttttgccgaaccaagccatcgctttgggctgcaacaatctgctggccccaatcatgcgcctcttgcgccgggaagaacgctgcatggaaaccttctttgtccaatacggtttcccatatttgaggatggagccctgggcatccaggaatacgccattccggatcctcatacgcccaccagccatctagcaatccgaaggtaaggtgggtaaacacgctactacctgtgatttcattgagcaggagcaagccgttgcttttcaaaaccgcttttgcattacgtaacgcctgacggatgtcttttgcggtatgaagtacattagcggcaatgacaatatcatatttacccgtctcaataccttgcccggcaataggttcttcaacattaaaaatctgatagctgagatacggattatgcggcccatactctttttctgcatgcatcaaaaaggctttggaaatatcggtatagcaatattcctgaatgtgtttgctgtatgggcgtaatttcaggaaaagcgcagcactggtccctccggtgcccgcgccgatttccagaattctgatttccgcagcggcgtcggccataatcctctcctggatataagcagcagtagtatcggcaagtacctcattaaagtagtccacaaccagattgttcttataaattccttccactagttccattgaggaattggggaagatgatttccgtcgcaggcgattttccggtaagcacttctggtaaagctcgtagcgttgtctcaaccaaattgacccttgctctcatctgcggatattgcagccaagtacgcttgcgctcttcccattcatgccagacatcatctcgatccgtcaagctggagtttctacctgataggtcgttatccatctgtgccaaaatctccatgctctcttttagccatttgccatatagctcaggaagtccgagtttatttttgaactcgtcgacagactgacgatctgtccctgataaccccatggacaagagctgctcccgcaacaacctgtgtaggagatgttccatctccctttcctggagatcgctcatatcgtctgcggcataattttcgataaaatggcttcttgattgtattgctgtagcaatattttcctgtatatccctgaggttcggagccgaattaggcgggtagagatcaatctcttctgtcggattagtcccttccatctccagatgtcttgttgttttcataagccccatttggtcgatcggtgaggcaagaagcgtcccaagcgcctccatcccctcctgcgggtcaatgagcccaacacctatttgcgccagtctggagtagttttctacctcctgccgtccattttcggaggcattgttttcgccgctcccccaatatccccagttcatgaccttcaccggacaacgccattcctgcgaaagacgatgcgcaaacgcgtctttaaaggtacttccggcagcatagctactttgtcccggattctttacataggtaatcatggaagagaagaacaatacgaaatccaacggctcattttggaagacctgagccatgcgtacactgacatcaacctttgctgaaagccctgaccggagctcttcctccgtcaaatcttccaagcccttctccaaaaatgaaatggctgagtggaccacaccgtttatgttggagtaccgctgttttatttcctcatatgcccgctgcagctccctttcgtctgctacatccgccgtgatatagcatggaacaggtcccaggccttcaaatccgtccagtttggcctggatagaggcatccttttgccttctgcctagccacaccatctgagcctggtaggtacaggccatatacttgctccaagcctctccgatagtgccggcgcccccgatgaccacatagacgcctctgactttgtatagcgtctgtccttttaaacctgaagtctgtttgaatggaatcaattgctgccgataccactgcccatttctgaaaacccacatccgtccttgccggtctgaaggcagcgtaaatatatcggatagcggccagtcatcatcggattgcaggtcaaggatacggattttccagttcggatattctttggccatggtgcctaccagcccatgaagacttgcgtgagtcgggttgactgtatcgttctgatccatcggctgagcttgattggttatcgttgtccagcctagctttttcgtcccgtatcccaataaaagcatcgctttgaccattctaaagaagagaaggactccctgctcctgttccttgatcatggattcagcagtcaccgattcgacggaagcacagggtgcaatccacagaatatggtcaacggctccatattcttctacctttgaggctactgtttcaatggaatcgtgcgcttgaagctccaagaaatgcgccctaggataatactcccggatggcctgtctgtctttgtcagcaccacctgcaatgaccaatcggtctgtcggtgagggggaaacgacatctttttttatagcaaccgggtcccatttcgggatgagcattacagatcccacaagcgggtcggcggcactttctcctgccgctgcgccttgtgcattttcaatgccgatttctccgtccagcgcccgggtggataatcctgttattctgacgcaaatagttccttcctcatcacacaagtcaatattaagcttctgtaccttgtcttctttcttgctgccctcgctgtattgaatcaacgaccacatggtcggggtgcatgccccataaatctcaatctcttggagggcaaacggcatatgaggcgtagctggtacagcggtacccggtagccctccgttctcttggcccatgattaacccgatggatgcatgcaaggccgaatccagcaagctggggtgaaggaccaagctgtccgccatattagaaatgaaggaaggcaatgccagctcggctagcaccctgcccggatgtgtatataccttctccacacatctgtatgccgggccataatccatacccatttcctcgaagatttcgtaacattgcgatccgttaaacctgtgttgaccaaaatctgcctgtaacgccttaaggtttagtgttggtttttgctctacgcaaacctgcaccgcatcaccttggctatgcacggtatgccctctttcgcttcctacttgcccgctatacacttcaaagcttatttttctggtgtcttccagggatagcctggtgtgtacaggaactggctggttgtccaccacaatgggccgaatccagtttacatttttcaaacggattcctgttgtgctgttgtccatatcgcctgtggaacattctacagccgcccgtaccatctcaagataggctacgccaggcagaaccttttggcctttcacaacatgatccttgaggaaaaattcatcgcctgtaaacgttgaactgaaccgctgctccagaaagtctgaagtgttctgatgcagtaaaggtgtcaaaaaggaagattgggacgaagcggcttctgttattgcggcgctcttttcctcatgtacgggtatccaataactttctctggcaaaaggataggttggcagactcatcctgcgaggcttcacatcctcataaagcttgttccaatccaaaatcagtcccgtaacccaaagttcagcgagctttccatacttccctttgtccacccatgcatcaatcattttagccatatcttcatcgacttcctgagtgacaagccctcctctattacgctttacctgtcctctatacagttcttctacaccttcctttttttgcaggaagccttccaatttccaatcaagctcttggatggatttggcaatgatcgccagacgttcatccatcgcttccctcccaatttgcagcgtgtaggcgatatctgagagacttgtatgcgggtcattcagctctctgattgcagacagcaatctttgcacctgctcgtccagcctttccttatttttggccgacaacacgaccatgacaggattcagggatgtaggagcagcttgctgctgactagcttcttctggaatatattcttcgatgaccacatgagcgttagagcccccagcaccaaaggccgacactcctgctgcccttgggtattctctggtttcaccgttgatggcaactacaggtcttttccactcttctaacccctgctgaactttaaagggactatcgctgaagtctatattgggatttaaggtacttgcatgtagcgaaggcacgatttgtttatatttcaactgcaaaagtacctttgtcaccgcggcgataccagcagcgctctcacaatgcccgatattagacttcgccgacccgattgaacagaactgcttatccccggtatatttacggaaagccttttgtaagcctgcaatttcaatcggatctcccagtggagttcctgtaccatgggcttctatatagctgatggttctggggttgattcctgcctccttaattgcctgaccaatcacacgggcctgtgcgttggggttaggtacggtatagccgttggttttccccccgtggttcactgcagttcctttgataactccatatatgcggtctccgtctgctatggctttggctaatggcttgagcagcaaagctccgactccttctcccggtacatatccgtctccctgtccgaagctttcacatctcccattgcttgatgcaaaacttccctgtcccaacaataggtatttgttaggatggatggagacgttgacccctcctgctactgccagttcgcattctccatgctgtagtccatgacaggccatatgaattgatgtcagtgacgaggagcacatagtatctacagcgatacttggcccttgaaaattacaaaaatacgatacccggttggcaaccgccgaggcattaccgaaaaacccaatcatccttcccttggcttgttcctgggctccataaagttgatactcatgatacatcactccaacgtaaaccccgacattgccttctatgccgccaagctcccgctctgcacaaaggctttctctcgtataacctgcatcctctatcgtttcataaacgcattccaggaataagcgctcctgcgggtccatcgtttccgcttcccttggcgaaatattgaaaaacaacgggtcaaaccagtccaccccatcgatgaaccctccccacttgctgtaggttttcccaggcttgcctctgttttcattaaagtacagactgtgatcccagcgcctcttgggaatctctgtaatgcaatcttttccatcccttaggttttcccagaactctcggatacctaatgctcccggatatcttcctgacacgccgataattgcaatgtctaatgccttcttctcctgatgtggctgtatacctgtcgggagaagccatggacgcctacgattagccgatatcgaggtcaaaggctctatggttgcttttataggtgctttcgggcctgcatcaggagccgtattcttctctgtcgcttctacagcatcaatcagccgaccgcgatacgagtcaaggaaataacccgtcaatgaccggagattttggtattcaaaaaataatgttttcggtagtgagccgaaagtcttttccaattcattggtaagctgcataaccagtatggagtcaatcccatacctgtccattggtgcatgtacatctatactttcagcgggcagcttgatcacggttgaaagtaccgtcttcaaataaccctccgctttttcccttagccattcttctccgataagcggtgctccctcgctttccattacagatcggcctgagacatcagtttccgagagctggcctaaaattgccgctttaatcctttggggatatccttcgatcaccataacctgacttctgccggaagacagactttgatacaaagctttgattccactctccgtttgcatggcaatcatgcctaggccctgcatcgccctttccgtttccaggtcgacatgcatgcctccatccttccacagaggccagtttatcgacagcgtttgcccctggcgctgctttgctgtcaccaaagcatttcgataggaggcataagcatccataaagccattagcagcggagtagtcaacctgtcctacattgccaaggcttcctgcgcccgaagaaaataagataaagaaatccaggggcaggtctctgctggcctggtccagattcatcacccctgagaccttcggagtcagcacttctctaacctcttctttagtcttcttgatgatgaagttgtcccgaatcactccggctgtgtgcaaaataccgttaaggccgccaaattgctcgacgatgccatgaattagcccggtaaccgattcgttgtggcccacatccgcctgttggtactctatatgaccacccagcgctctcagttcgtttaactgagccttttggtccgcagaaagtgatgaccgacccaccaatatgatgatggagtttttcacattgcgcaaaatgtctctggcaaaaataagccccagaccgcctaagccaccagtaatgagatagatcccaccatctctccacggcaggtctgcatcttcacgtaaggcttcaatttcttgccatattaaagcctgtcgtttgtccccttggtaccatatccgttcgttataccggccactccggttcccttgtagtttctcaatgattccttcgacatcatcctccacatcaagctcaagcaactgacccatgacattcggattttctttttgagcggttttcagcattgcaaagagcccggaataaacctgttggtccttccgagcgtgggttgcaagctgtatcaaaactttctgtttgggtatgtccagcaggatgctttgcaattcttcaaatatctgaatggtataatcttgaaaccgaccgtccatatccgcgctggaagactgtaaaacaaggcagcgagtaccatccatgcgggcttcaatatcctccctggcggtaccatccacttcacacaggatcacaacataccggatatcttcgtttgcgttcacccctgcggtgacaggcatctcctgccagacaggttcaagcatcagtgtacccatatcctcagtgatgctggcttgtcccacatctccttccaacgctctggataaaagtcctttgaactgcacgcaaatctttccgttctcatcgcacagatcaatatccaccttacttaatccattcgacgtctcttcactcccatcgtgagagatccgggcccacatctctggagtgcatttttcggatatcttcagttcctccaaagcaaagggtaacgcaggcttgcctacaggcaaattttcttccgaacccattaccaagccgattgtggcctgcaaagttgaatccatcaaagacgggtgcagaacaaattcagtttgagtatggagtacagaggatggtaaggacagcttggccagcacgtaatcctttcctcggaagattgcctcaatgccacggtgtgccggtccatagtctatccccatggctctgaaagcttcatagcattggcttgaagaaagtggtgtacgggtacattctgcccgtaagacattcaggtccagatactgtagctcgcccgccctctccaacacagcgactccctgactgtgtataatgccctcagcgtcggctccttccatcccgctgcatatttcaaacgcaatctctccattgtcctggggatatagactgatgagtaccctcaccggtccgtctgctacaaccacaggccgggcccatacgatattttttagccgaatatgtgtctcgccttctactacagcccccactgcctcttctacagctgctcgcaccatttcgagataagccaccccgggtaatgtttgttgagccttgattctgtggtctgacaggaaaaattcccgacctgtaaaagtagagctataacgttgtccggagagatcggaaatattctgatgcaataaaggatgaatttgggcagtcatagctggatttatactgccttgtccagtgcccgtttcggataaccaatagcgtgccctttcaaaaggataggtcggcagactgattcgtctgggcttgatatctccataaagtgcgtcccattcaatgcttgcgccattggcccacaatttggctaccttatcaagtcttttcttctcagtccaggcccgaaccagggttccggtgtcttcgtccgaatccaagagttcgattctgtcccctgcatagttcacacggccgatcagcactttttccgacgagcttccgttaataaaaagttcaagttcatctatcagattttctcttgaatccgtcaaaaacgcgagacgccagtccatagcctctcttcccacttgcaaggtataggtcaggtccgtcagattaacgctttcgtgcaacttaacaaaattcatcatatctgctgcataggttttcaaggattgttcacttttagcggacagcacaaatagtcccgggttgtctttacccactgggggtagattcaccgcagagactacaggaacatattcttcaataaccatatgagcgttagtgccgctaaatccgaaggaacttacgcccgcacgccggggtactcccggttcgggctcccagctttgcagaccggtgctaatgtagaacgggctatcctccagagaaatatgttcatttaaggattcgaaatggatggtaggcggcaattggcggtgcttcatggccagcagcactttcatcacactggccaccccggccgcagtcatcatatgacccatattgcttttcagtgaccccaatgcgcaatagcccttcttgcttgtataggatcggaatgattccgtaagtccctccacctcgataggatcacccagctttgttcctgtcccgtgagcctcgaccatggagatggtttcgggatgaatgttaaaccgtcgatatacgtctttttccagcgagatttgtgaatttacacttggggcagttattccgttggtttttccatcctgattcattccccatccccgaataactccatatatggagtccttgtctctgactgcatcagagagccgctttaataaaatgaccccaactccttctccggggacaaacccgtttgcacgggcatcaaaggtaaagcaccgtccatccttggacagcattcctgccttgctagtcataacatgcattcccggaccagccataatcatgactccgcctgccaaagcaaggtcacttgtttctaaaaggagactgttgcaggcttcagcaatggccaccagagaggaagagcacgcggtatcaatagccaaagaaggacctttcaaatttagcagatacgaaatccgagcggatagaattgaaggtgaccctcccatgagaacctgcgcatttaacccctgcccactcatggacctcccataatcactggctgcacaacctacaaaaacaccgcagcggctctccgacagtgaggctggatttaatccggcatcttcaatgcatttccagctgctttcaagaaacaggcgctgttgaggatccatcatctctgcttctgcaggggatatattaaagaacaacgggtcaaatttatctacatcctctaaaacacccatccatttgctataggtttttccctgagccttgagatcggtatcgtaatattcatcgattgaccatcgcgttgaagggatttccgatatacaatccctgccctgagccagattgtcccaaaattcagccaaagtcctggattcgggaaattgccctgccatgccaataattgcgatagactccttatgttcctgaccgagtggcatatttggcatagcttttttagaatcagtatgcttgaccgttttgtgggaatcattgctattcggcagctgtccataggcgaattgaatccgttctttaacctcttgttgattcacaaacgttttatcctgcatttttatttctttttcaatagtagccgccagcttttctcttatcgattgagccatatggtttttcagttcaattaatgactccctgggagactcggacagttttcttgccagctgcatggcgtacggcaccacttcattcctctgcacaacaggaaaaggaacccctttggtttccagttccgaaccgctatatctagtacctgtaaataaaatttcctgtgccatactaaccccgaatttctcagggaaaatcagggttgaacccgctccgggggtaaagccgtacttcataaagttagtagtatagatgctttcccgactcatcacgataaaatcgcaaaacatccccatgcaccagccagcaccaatcccatgcccctgcatagcagcgatgacgggcagcttgcaatccaaagcaatcttgtaaacattggtatcgctatatttcgcctttccctcatggatagccagcaatccctcttgggtgcctcctgtggcaaagtaggtgtcatatcccgtcagaatcacaactttataattctcgttagcttgcaccgtcttgaatgcctcattcaggccaataatcagttcatcggaaaatgtatttttgtgcaccgtgtccttcattttcaacatgacaatcccgtgctcaaattcctgcaattcaaccacagactgtacctttatctggggtgcgcttatctcctgcccatcctccggcctgtggaagctgtccaatggttgcaacgtgaaagccagtccttctgataattcctgtggactggcttccaatgattcatccgggagctcgccaataaattgaagcaattgtttttcagcatcttcataatttatttcccctgcttgcaccgcacgaaaaatatcttttgaatccataaacatgtcctcctagctgtatgaaataggacaaatatcgtgttggctgtctacgagtgtaattggttgaataactggtcggcctgttcaaaatccaactcaccctgcagtactttctgtatcaaggcttgcatgggctgcttaggcttcggctctgtagaagcctgattggtatctcccgccgacttgttcaattcctttgccaaaaatttggagaattctttaatgttaggataatcgtacactctggttgctggaatagctgttccaaagcgtttattcacagcctgcacccactctacacctataatagagtccagtcccatatcaataaattgatcgtcccggccaatatccttttcattcatactcaaggatttcgcaagactttctaccagttccttctccaatgtttctatccgtacagccgttggcgcatatgtcgaccgctttgcctcatccctggcagcgggcggcgacgaagaaggcttggcctcaggttgcggcggggcaggcttggattctgccagcgcggctgacttctccggcttatctgctaccatctggatgttggaaacggagctcagcaaaatgccctgcggtttttcaggtactttcgccaaagtctgtctctgcacattatcgttgctatggttaactgcaggagggctggaaacgagttcttgtaccgacacctcggctacaggagattccgcctcgacgtcccgggattcgcccccacgcgcgaagatccaatagctctccttggcaaatggataagttggcagactaatccgacgagggctggtattctcataaagtctagtccaatcgaagagcagccccttaacccaaagctccgccagctttgtatacttacccttgcttatccaactatccaccatttttgccatgtcttcgtccgcctcaagaacagctaggatgtctttattcttctttgcctgaccccaatatagcccgtcaatattctcatcccccgctaaaaagctctccagctttcctgtaagttcacgggtagacttaactataactgctaaccgttcttccatggcttcccgtcccacctgcagagtaaatgctatatcctccaggctgatttgcgagtattccggctctttgagttcagcaagcaacctttgcacctgttcttccagtcgctctttattcctcgccgacagcacgatcattaaaggattttgcagtgaaatggcagcctgtctagtctcctgctcctcagggatatattcctcaataagcacatgtgcgttggagcctccggcgccaaaagaggaaatacctgcgattcttgggtattcaaccgttttcccattcattgtgacgacgggtcttttccactctcccagctcctgctgaactataaaaggactatcgctaaaatcgatattcgggtttagtgtttttgaatgcagcgaaggcacgatttgtccgtatttgagctgaaggagcacctttgtaactccggcaatccctgccgcgctctcacaatgcccaatatttgattttgctgatccgattgcacaaaactgcttgtcctccgtatattcctggaacactttttgcaatccggcgatttcaatggggtcacctaaggatgtcccagtgccatgcgcttcgatgtaactgatggttctggggttaattcctgctttcttaaatgctcttccaatgacactggcctgcgcatggggattcggaactgagaatccgtttgtcttccctccatgattcaccgaggtcccctttacgaccccatatatatgatctccatctgcaatagctttggccagcggtttaagcagtacagctcctacgccttctcccggcacatatccatctccgccttgtccaaagctttcgcaccgtcctttactcgatacaaacctcccttgcccaagcatcaggtatttgttcggatgaatggatacattgacgccgccagcaatggcaagctcacactcgccttgttgcaagctttggcaggccagatgaatggtcgtcaatgaagaagagcacatggtgtccacagccatgctcggaccgtggaagttacagaaataagatacccggtttgcaatggaagccggattgccaggaacggcaatcattctgcccctaacttgttcctgtgccccataaagctggtactcttcatacatgaccccgacaaaaacacccacattcctatccagcccaaggccccgctccagtccaagcgcttcccgggtatagcctgcatcctctatcgtttcatagacacattttaggaataggcgctcctgaggatcgatgatctgtgcttctctaggagagatattgaaaaacatggggtcaaactgatccacacctttaataaagcctccccacttgctgtaagtttttccggactggtccctgtcctcgtcaaagtgcatactgtgatcccagcgatctttggggatttccgtaatgcaatccttcccatcacgcaaattgttccagaattcccgtatgttttctgcctcgggatacatgccggacaagccgataatggcaatttcctccgatccgcctgctctttccggttgcggttggaaacttgcctgaactggcatgaaacgcgattgcttccgactatcagaaagtgaccttaccgggtcgttttccttcgtagaaggtttgaactctttcgcagcgttgacctctgtctcgattccaagcaatttaatcagctgcttctggtggactttaaggaaatattgggtcaattcccggatattctggtattcaaaaaataaagttttgggcagtgttccaaacgttttctccaactcacgggttagctgtttaatcataatggaatcaatgccatacttctccataggggcatcggtttcaatctgccttgccggcagcctgatggatgtagcgagcaattgctttaaataatttgccgctttttcggcaagcaggtcttgtccgatgaccgaacccatctcgctttcccttatcatagaggaggcatctccagcctgattcagggacggttgctgcaggagcgtttctcttagctgactggcatgcccttccaacaccatgacttgattcttttcggaagccaggctctgatacaaagcccgaattcctgcaccagtctccattgcaaacatccccatcccttccatgatcttttctgtttccccatcaatacgcattccgccttctttccagagaggccaattaactgaaatcgtccgcccctggcgttgtgctcgctctaccagtgtactgcggtacttggcataggcgtccataaaggcattggcagcagcatagtcagcctgtcctatattcccaaggctccctgcaacggatgaaaaaaggatgaagaagtccagcggaatttccttacaagcctgatccagattcaccactcccgtaacctttggcgccaaaacgttttgcaattcctcctgtgtttttttaataatgaaattatcgctaaccattcctgcgctgtgcacaattccatccagcttcccaaactcttcctgaatatcccgaatcaaatcttcaaccgcccttttatcggcgacatcggcttgccggaatactactcttgcacctaaagcttctatctcctcaatccttgctttggtgtcaccacgaagcggggagcgtccgacaagaattaaagcagtatctctggcctgtcgtgtaatttcttcggcaaaaatcaaaccgagacttccggttccgccggtaatcaaatatactcccctgtctttccacggaatgctgatcgcttccccggaggctttaatttccgtccatacggcaacatgccgtctaccttgttgatagcggatatgtggttctatagagctgcgactgttttcttgcaggatatttatcatacctgctgaatcctgctccacatccatttctatcagctggccaaccagtactggattctccagccatgctgtttttaagagtccggaaagtcccgagaatacctgttggtgatcctgcaccggaacgacaagctgaaccaatgttttgcctttggattccgttttaagaatatgttgaattgcctcaaacacctgtgtcgcataagtcctaaaccgtgcatcaatgctcttctcttcagattggagaatgaggcactgcaccccgttcatttgcgattcaataatttccccggaaatatatcccggttcacataaaattaccagatgctgttgatagtcaggtgctgttccttccagagcaatcgcttgttcttcccacacaggctcaagcatcaaagtctcaggtgctgtccattcatctgggccccctgttcctccttcagcaactcgtgatgagaatcccttcattctcacacaaacattcccctgctcgtcacacaaatcgatatctaacttttgcagcgagccattttgcctgctgtcttcactattacggatccaggcccacatctctgatgtacatttgttaaacaccaccaactcttccaatgcaaatggtaaagctggcttaatggaagctttgcaatcacccacactcataatcaagcctatcgtcgcctgaagagcggaatccatcaaactggggtgcatcacaaaatgttccatcgtagagtaaacggaagaaggcaaggacaacttggcaagaacttggtccaccccgatatatatcttctcaattccctggtgtcccggcccataggaaacctgcatcgctgcaaacgcctcatagcactgacgggatgagaaggagcccagactgcactgctccagcaaggttttaatatctatagcagggatgtctgccaccggaacaattactgccctgccttcactatgcaccaccagctccgtgtccgttgctccagacttgctgtaaatttcataggcgatctccccgccatcttgaggatagagcccaacactaacgtccaccgactcctccccaaccacaacaggccggatccaatccacatcttttaaccggatggacgtccacttgtcttctggagatcctgcaacctgctctagtgccgcccgcgccatttcaaggtaggccactccaggcaagagcctctgcccccttatcacatggtcagacaggaaaaattccttccccgtaaaaatggagctgaactgcagtccataaatattggacgtattgcgctgaagtaggagatgaatgccgactgctgtctccctttccagcactacaccgcttgctcccgtccgtttattgatatcggttatgcaatatcgttctttggcaaagggataggttggcagactgatacggtttggtttagcctctccgtacaacagggcccagtcaataacgactccttttacccaaaggtcagcgattttgccatagcagccttcgctaactaacacatcaatcgccgtgcccgcaccctctccgtcttcacgagctctattttcttctctatggcgtttggcgtgtcccacgtataagccgtggataccatcccggccttccacaaatccttttaatttctcttctagctcccggagagagcctgcaacgaaagccaaacgttcttccatcgcttcgcgccccacctgaagggtatacgctatatctaccagactgctgtctgtaaacggatgctccccgattgcagctagtaatagctgcgcctgctcttgtagttgtccttcactcttggctgacagcaccacaatagccgattttggggtggtacgggtaatagaatcctgctcctgctttccaggaatatattcttcgattaccaaatgggcattggcacccccgaatccaaaggagctaacacctgctctccgaggaatattttcccctcgagtatcccgctgtggcttccactcctgcgcctcctgaacgatatagaacggactgccttcaagttttatataaggattaattgcatcacaatgaaggcttttgaccagctttttatgctttaactggagcagcacttttatgacgcccgcgattccagaagccagttccagatgtccgatattggtcttcaccgagcccaatccgcaatgggattctgtaatcccgggcccttctgtattctcataaagctctttgaaagctgctttcagtccgttaatttcaatcggatcgcccagctcggtacctgtcccgtgggcctcaatgtaagagacagtccttgggtcgattccggcctttgtatatgcatttaccaacacatccgcctgagccctcggattaggagctgtcagggaattggcccggcctccgtgattgacggcagtaccccgaattacaccataaatatggtctccatccttctctgcatccttcagctttttcaggaaaagcatgccggccccttcaccacgcacgtagccattggccttattggagaaggttttgcatcgaccgtcctcacacagcattcctgctttgttgaagctgatatggagttcaggtgtgataatcacattaacaccacccgcaatcgccatctcgcagcttccatcctctatggccctaacggctcggtgaatggccaccagtgaactggagcaagccgtttcgacaggctcgctcggaccatgaatattaaggaaatagctcattcgattgggcccaacagacggtgccataccgctggaggaatacgcctcgacacccacatttccctgataaatcacaccgctgtagccactgttcgcggtacctacaaagattcctgtgcgggttcccgacagactcccagcctgaatgcctgcatcttcaatcgccttccagatataggtcatcaacagacgttgctgcgggtccatgagtgcggcttctcgcggtgaaattccaaagaatagcgggtcaaactcatagatcccctcaataaacccgccccacttgatgtttgttttattggcctcctgctcagggtcaccgtaatacgtcttccaatcccagcgatcttcagggatttcagtgatacagtccctgccttcctcaagatttttccaaaactcatccacatcccgggccatgggaaatacaccgctcattcccacgatagcaatgggttcaggagcagcctgagtcagctgcgggttggacaacacattcccgcctgcaaaccggaaacgctgccgtctaccgcgggtactgtcttccctatcatcctccacggcctgcacagcaggctcagtccgggcatgcacggcaaactgctcgccaagcacggcatcatattcgtccaccaaatacctggtgaagtcatgaatcgttgtgtattcaaaaaatatgtccggcgtcagctcaagccggtgtaagtgattgatgttgttggtaaattgtgtgagcaggatggaatcgaagccatactcactcatttctacatgtgcatcaatatcttcaagtttgactttcagcaattttgacacggcctgtatcatagcggcctgcaccttgtccagcagatctggtacggcattgctttcagaggaagcttctgaaattcctgtcaccttctcaggctgcctagtctctggagtcgtgattaaccccatggttttcttcatttttgcaagattgccttccatcaccataacctgatcaacgcctgcgatcatgccacggtacaaggcctgaatgccggaagaggttgacatgccgctcatgcctgtacgctgccttaccagcttctccgtctcctcatcaatacgcatcccaccctctttccatagcggccaattgatggatagcgtttgaccctgtcgctgcttagatgctatcagagtgttccggtatccggcataagtatccataaacgcattagctgcagaatagtctgcctgtccctgattacctaatcctccggctacagacgaaaatagaataaagaagtcaagcggcaagttcttgctcgcctgatccagattcactgtccctaatactttgggagcgagaacctccagcatctcctcgctatttttttggagtatgcggttgtcgcgaatgacacctgcactgtgaatgatgccattgatgtttccgaattcctcctgaatttcctggattaaatcggtcaccgcctgctcctgagtcacatcgacctgtctgtatatgattcgtgcccctaatgcctccaatttctttatctcagcccgtttgctctcatccagcgcggaacgccccgttaaaatcaagacagctttatggactttatccgtaatctctctggcaaaaatgagtcccaatccaccggcaccgccggtaatcaggtacactccgccatccttccacgggttacccgccgcttcctgagagatgtgaactttgttccagctggaaacccaccgtgtgcctttctcgtaccgaatctggatatcctcgaggctacggctgttttcttctaagatacctatgattgctccccagtcctcatcctgtcccagttctattaactgacctaccagttttgaatgctcaagccgggccgtttttaaaagaccggaaagtcccgagaaaagctgctgctcctcctgtccgcttatggcaatctggatcagcaccttaccactgggtttttccctgaaaatgctttgaatctcttcaaccacctggacggcgtaacgctggaactgttccgcgattccgtttcggtcgggttgcagtacaatgcattgcacgccgtccatccgagcttcaacttgttcacgggaaatccaggacggctggcagagtaacacgacatggcgatcatatgcaggcatttcggcctctagagcaatcccttgctctttccatacgggttcaagcatcaagttactagaattagactgaacatccgaggaaatcgagtccctattcagaattcttgatgaatatccttttatcctgacacagatggctccggtttcgtcgctcaggtcaatatccagcttctgtgccttttcctcagctatgccgtctgcattataacgaatcaacgcccacatgatggagctgcaattttttataatttcaacttcttgaatggcgtaaggcagagaaggtttgatctcgccagaccccagcgtcaagcctatggttgcctgcaaggccgaatctatcatagttggatgcaggacaaattggctttggttgtcagaaacggaagacggcaagcataacttagccagcacttgaccctctcccgcatacaccatctcaatcccttgatgtccagggccataatccattcccatatccctgaaaactctatacaattgtgtgggatcgaagttccgactgcatacattctgcaagtctttaatattcagtgctgggacctccgcagctgatcttcgtgcagcactgccgtagctatatatcacaatccctgcatcagcttcttcgctctccccatatatttcataggaaatctcttgatgatcatccaggaaaagtccgatgtgtaactgtagtggcccatgctctacgataataggccgtgcccaaaccacgtttttaaggcaaattccggttggcccgccctcatcagatcctgttgcctgatccacggctgcccggaccatttcaaggcaagcagccccggataaaactttacgtccattcaccacatgatccttcaagaaaaactcctggcctgtaaaagtcgaactgaaccgctgttccgagaaatcggaggtgtttagatgcagtaaaggatggagcgaagcagcagtgacagaagtcatgcctttgcctgccttgctgtcaagctcaggcgcccaacagcgttctctcgcaaaaggataggtcggtagactgatccggtaaggtttgatgtccccatacagcttgttccagtcaatagttagtccctttacccacaactccgctattttttttagttttctcttcttgatccaggtttcaagcaacgatttggcatcttcatccgcctcaaacatcacaatcccgtctttgctctttttcacctgagccgttaggacgccagcaagcggatcatgattcacaaatccttcgagcgtttttagcattgcctcttttgaatctgccacaaaagccagccggtaatccatcggctcgcggctcacttgcagcgtatatcccatatccgagaggttaagattttcctgggatgcaataaagcttctcattctttcggcagacgtttttagttgcttttcacctttggcagacaaaacgaagagaacgggattatggatatcggcggctgttggtgatgttgtagatgttcccgtcccgggacgatattcttcaataataagatgggcgttcgtaccgctaaatccgaaagagctcacagcggcgcgccttttgtccccgcgggaaggttcccacgcgttcaattctgtattgacataaaaaggagaattatcaaaatcaaaatgctcattcgggttcttgaaattcagtgtcggtactagttttctatgcttcatgcatagcaacaccttttgcacgcttgctattcccgccgctgcagaagtatgcccgatattgctttttaccgaacctatggcacagtagttcttctgatcggttttttctttaaaagcggttgataaagcttccaattcaatagggtcacccagcttggttcctgtcccatgcatttcaacatagctaatgctttcaggctcaatctgatatttgttgtatatttcccgctccagctcaatttggctgtttgtgcttggagcggtaatcccgttggtttttccatcttgattgattccggacccgataataactccgtatatatgatcccgatcagcttcagcatccttcagccgcttcagaaccagcgcccctactccttcccctggaacaaagccgttggcgctattgtcaaacgctttacaccggccatctggtgacaacattccggatgcagacatgcctacatacgattcaggagtcagatataacgacaccccgccaaccaacgccatttctatctctccgttagataacgcctggcatgccagatgggttgcaaccagcgatgaggagcatgccgtatctacggatatggccggacctttcagattgagaaaataagagattcgagccgccgcaatagcgttgctgttcccagtagtattggtgaactgcgcttgatgcttgtaccgcagcatactatattcattatttaaaattccaaggtaaaccccgcattttttatttcccaactgtgagccactatagcctgcatcctcaattgccttatatgcttcctgcataaagatgcgctgctggggatccatcccttccgcctcggtaggagaaatattgaaaaataacggatcaaaatattccatatcctctaaagcacccagccacttgcaattgattttcccctcttgcgctggacgaggatcataatattggcttacatcccaacggtccttcgggatttcaataatggaatttttgcctagagagagattatcccaatattgctgcacatcttccgcaccaggatatcttcccgaaatcccgacaattgcaattacgtctttattttccgaaggcaaaggcgatgaatcctctgctacctttaccaggtggaatggctcgggctcctccttaggcgatagccttggggaacattgcatcgtgtcaggtctcttcgaatggactttcgcaataggcttgtccgtgtccgggactgtgttcaaggactgttgattggagcttcctccacgcttattgatttcttgtgccaaaaatgtagcgaattggcgaatggtcggataatcgtagaccttggtcgctgctatggatgtgccaaatcgtttatttatgtttcgaacccactctacgcctataatggaatctagtccggtatctataaagtttttatccgcctcgatctcgctccgttccatgtacaaagcctcagccaggctaaccgtcagttcttcctgcaactgctctgcagaggcgctgcactcagccatgctggcctgcacctgcttttcaaacgaaatcggcatcaaattcacctgaatggaagcctctgccgatttctccggctctaatgcaacggatgacggtgaatgctctgctggagaatgatccgaaatagactgggcagagaatggcgcaattgatttgcttaacaattccttctctacaaatttgctaaaatcccggatagttggataatcgtagacttttgtcgctgttatggatgtattgtaatgcttattaatgctacgaacccactctacgcctataatggaatccaatccaagatcaacaaagttcttatccgaatcgatatcgctccgatctatatataaagcctgggccaggcttgttgtcagctcctcctgcaatatttccgccgatattacagaaggaatagacgacagcgcttccgtcttcttctcatcctctaatgtgtgcgatgtctcctccagtgaagttaacatgatcgttgtcccctcctggttggcagacttgcttagatgcggctgacggtccaacaaattcggtaaggatatagcgcttggtttttcagaactattcaaaaaaacggattgcattagggctgttggctgcatcgcatgagtctggacgggaattgccttttcctgagcttccgtaacggctctttctacagaagagactctttctacagagggactcataatatccgtgatccagtaccgctccctcgcaaaaggataggccggcaggctgattcgccgcggcttggcatccccataaagcatgttccaatccatcgacaatcccttaacccagagatcaacaaccttcgaatatttccttttccctatccaggcagcgatcgttttgtccatgtcttcatcttctaccagcgccgtcagcgcctccttattccgtttgacctgaccccggtacaactcaggaatactgtcccgtccttccaggaatccttccagtttgtccaccagctcctgcatggaccctgctatcactgccaggcgctcttccatggcttcgcgtcccacctgcagcgtgtaggccacatcggccagactgctttcgctgagctgtccttcccgcataacggctagcattctctcggtctgctttttcagtcgttcttcatttttggctgacaatacgatgatcgcaggcttttgggccgtaacgctcattggcaccttctcttccgcaatgtactcttcgatgatgacatgtgcattggagcctcccgctccaaacgatgaaatcccggcaatcctcggatattcccgcgtctctccatcgatctcaaccaccggccgtctccattcccccagctcctgctggacgacgaacggcgtctgaccgaaatggatgttcggattcaattcttgggcatgcaggctgggaaccagcgtccggtttttcatctgcaagatgattttccccaccccggcgatgcccgctgctgcctccagatgtccgatgttagacttcacagagccaatggcgcagaatcccgtatccggcgtatccttcctgaatgcctgagtcagacccgtcacttcaatcgggtctcccagctccgtgcctgttccgtgggcttcaatatagctgaccgtccgcgcatgtacccccgctcgctccagggccgcccgaatcagctccccttgggctgtcgggttcggcaccgtatagccgttggtcttgcctccatggttgatgcttgtcccccggatcaccgcatggataaggtccacatcagcgatcgccttggacagcggctttaataggacgacccccgcgccttctccagggacaaacccattgcctcctttgccgaagctcttgcactgcccgtctgctgacagcatgtggttagcgcaaagtccgacatagctgagcggatggagatacagatttactccgcctgcaatagccatttcgcattctccgcggtacagatgctcacaagcttcatgaatcgcggtcaacgaggacgaacacatcgtatcgatcggcatgcttggcccttgcaaattaaagagatacgaaatcctgttggccactgaactaaaggatgtatgagggtatatttgcgttccttttctccataaatccagtccgtatagatcgaaacccgttttggtaatcccagcaaatacgcctacccggcggttatgccgcatcgcaagctgttctcgggtgtaacccgcgtcctccagtgcttcccagcaggcttcaatgaacagcctttcctgcgggtccataccgagtgcttctcgtggcgcaatattgaaaaagcgcggatcgaaatccgcaaatccttcaataaaaccaccccacttgctgtagctttttccattcgccaccgcttcctgtgaatcaggatggaagaacccttccagcgtccaacgctcacttgggatttcggtgacacagtccttccctgcttttagattttcccaatattcgttcatgtccctggaccagggatactttccagccatcccaatgatcgctatcggctcacgcatttccgcaggggcagacccagccaagcttcggacaggcttcgctgccgcctttgccgcagccggcacggcttcttcctcggcgcacaacggtgccgcaagtatttcctctacaggctgcatgtcatggcttattccggtccactgcatgcactcctgcgggtattccgccacaaaatattccgtcaaggcgtgcaaggtctggtactcataaaacaacgtctgggacagctctccaaagaagcccgccagcttggcattcagctgggtaatcatgatcgagtcgattccatacctctccagcggctcatgggcttcgatgcggctgacgctcagccgagtcacctctcccaaaagcaccttgagtcgatataaggttttatcgtagagctggcctgcatccagcttaggggttgcctgattagaaatagctacttggatggcacggacgccggcttgtgagacgcctttcgccaagtaggcctcgattttctcaggctccccttccatgaccatcacctgctccttgccggaggccaagctttgatacaacgccctcattcccgaccgggtctgcatggttgtaatacccatgttttgcgtcatgatctgttccgtgtccgcatcgatccgcattccgccctctttccatagtggccagcggatggataacgtctgcccccgccgttgcttggcccctaccagggcattccggtattcggcgtatgcgtccataaaggcattggccgtcgaatagtcagcctgtccaggattgcctaggctgcccgatatggaagaaaagagcacaaagaagtctaggttctggccgctgcttgcctcatccagatggaccagtccgctcaccttcggtcccagcacctccaaaaatttttcactagtttttttaatgatgaaattatcttgaatcacccctgcgcagtggatgatcccatggacacgtccaaattcctgctgaatgctgtccaataaaccgataacggtgtttctatgggtgatatccgcttgcctgtacaccacgctggcgcctgaagactccagctcctgcagcttcgtctgcttgtctcggtccagcggcgaccgccccgtcaaaatgaaggtcgctgcttgcgtctgccgggcaatctcttctgcaaccagcagtcccagactgccggagccgccggtaatcagatagaccccaccgtctctccatggaagcccctcttcttgcccagatgtttcaagcctgctccagcaagcgattgtccgttgtccgttctcatagcgaatccagccatccatcgggctacggctgttatcctccagcttcgccaggatgccttcctcctgttctccctgttccacttcgatcagctgcccgatgaatttcgggttttccagccgggctgtcttcaacagtcccgaaagtcccgaaaagagccgtccttccccagagttccgcaccacaatttggaccagcaccctcccctcaggcttgtctttgagtatgctttggatgctctcaaaggcctgaatagcataggcctggaaccgctcatcaatccggctcttcccggatcgaaaggcaagtacctgcacagctccgttcaaactcgcttcgagtcgctcgtgcaaagcttcgtctggctcacaaagcaagaccattcgccgatcataggcagggacttcggcttccagcggtacatcctgctttttccatgtaggctcaaatagcagtgtacggctactcgtaacgtcaggcgcttccgcagctctgaccaccgtaaattttggttcacgctctgccgctctgccgcctgtaatttcgtcctcactcctaggcgcccaatactgctcttttgcaaaaggataagttggcaacggaatcctagagtactgttcatttgaaaacaagcactcaaagtctaacgaatatccctgaacatacagatctgcaatcgtagtcaaaagctccaaatactcacgggtatcgcttgcgttttgacaattgtaaatacattcatccccgtatcttttcaaagatgtttgtatgcgttgatctttttcgtgcagttcagaatgataaacttgaggagcactgcctttttccagccactttttaagggacatgacaagctcgccttgattacgggcaacacatgcaagccgatgattacagtgctttctcccaagcaataatgtatagctcatattaccgcaatccgccttaggctcctgttcacaataagcgagcagttgctctacctgctggcgtaattgttttgaagtccgtgccgacagcggaatgaaataacctggcttttcggaatgtctccgttccgtctgtggagcctcttctatgaccatatgagcattcgtaccgctagcaccaaaggagctgaccgcagcacagcgtctgactccaggctcaacctcccagtcctgcagatacgtattgacataaaaaggactatccgcaaactgaatgtttgaattgcccgaccggaaatgaagtgtaggaggaatttgcttattctttaatgacaataacagtttgatcattcccgtaattcctgccgcaatttgcgtatggccaatattcgtcttaatggaccctatggcgcaatattccttcttgtcggtatactttctaaaggttcgagtcagtgcctgatattcaatgggatctcctaatttggtgccagttccatgtgcttccaccatctggatttgctctgggtggatatgaaatgtatcgtatacattttgctcgagtcgctcctgagatttctgacttggcgcagtaagtccattcgtggtgccgtcctggttgatcgctgagcctaaaatcactccatagatgtggtctccatcagcaacagcttcatgaagtcgcttgagcacaatcgcgccaagcgcttctcccggaaccattccatctgccctatcatcaaaggtatagcagcgtcccgagcgagacagcattcctgcccggtcaccatataaatagcagcgaggagtcgtatgaatatagacaccaccagctaaagccatatccgtttctccggtccataagctttggcaggccagatgaactgcaactaacgaactggaacaagctgtatctacagctattgctggtccgtgaagattcaagtagtaggagattctagcgggtatcacggaacccatatgaccccaaagcgcttgtggaggcaggtcttcacccagcaattgttggtaatctccctcggcacagcccacatacactccacaacgacgaccctccatccctgtccccgcatagccagcatcttccagagcatgccacgcttcctccaggaacaatcgctgctgcggatccatataggtcgcttccaatcctgagatattgaaaaaaagtggatcaaacttatcaatatcccccaaaaaactgccgtgattgcagtagcttgcatgtttttcctggtatttcgaaagatcccaccgggttacctcttccactaaatcgtcaccgttcttaaggtgattccaaagctcatgtacattatcagatccagcaaaccgcccgctcattccaataatcgcaatgggctcccttggtgttaaagctttctctttatccttcttattgggtctgtcctcctcaaaggatatacttgccgtttcaacgggatgaagaatatgatccgtgtctttaggtttttggatgtcgcgacttgcatcttccatgttgtctattggattagcgctctggtccaagacttgtgaaactttatctccatattggcttaaaatgtatagcgtcagttgttttaccgaactgtaatcgaagatgtcggtagtttgtaaatgaatccccagcccctgattgacagcctgcacaaagttgacgccaagaatggagtccagcccataatctgcgaatgactcatgaatatcaatcatagtaaagtccacattcaaagcctctaccagcttccctacaataagctccttgacatactcttcagccatctcgcttgttacatcaatatctgatcgaattccttcgtcacgctgtttcatttgagatttgtcgtgttcaggctcctgtttgttccgaatcataccatcgctctccgccacaataatttgttgacctatatcatgcgcttcctgagcagggaagaaaacggaccggaaaccctccatttccaataccttttgccaactttcgggatataacccgggagagcctggaatgcgtagctccgggtcattataaagccaccatccctctaaaaggccaaaggatagatggtttaacagagagttaccgctgatttcatttataagaatcagaccgttttctcgcagcgccgctttgacattgcgtaacgtttggcgaatgttccgtgtggcgtgcaatacattggtagcaatcgcaatatcatatccacctgtatcaatatcttgtccctgagccgactcttccacattaaaaatctgataagtcaggtaaggatttttcggaccgtactctttttgtgcatgtaataaaaatgctctggatttgtcggtatagcaatattcttgaatatgctcccgataaggttcgagcttctggaagaccaaagcgctagtccctccagtgcctgcaccaatttcaatgattcgaatcggtaccgacgggttatgcttgatccgctcatttagataggaaactacgatatctcccagcacttcattaaagtaatccgctgcaggactgttcttatatataccttctaccagtttcatggaggaattaggaaaaatgatatcggtggctggtatcttcccggttaaaattttcggcagcttgagcaaggtcgatcctaccaaaaatacccaggctgagagatccggatttttcagccatgcccctttcttccattcccactccttccatacagcctgcaaatcgaccgaagcagtacccgctacgctatatgactctccattgcagtacaaatactgattccgtaccaaaatctctatgctttcttcaagccaacgatcgtataaattcagtaagccgttttttgttttaaaatccgcgatcatagctttcttttccatttgcgcatatggacataatcccatcaagcgcaaatggctccataacagcctgcataagatatcattcatttccttcatctgtaagcctccattcccgttcagtccctcgtgtcgctccatcctgttccgagtaagctttgctgtcgactgtagtcgaggacattgtctcgtatgcatccgctagataagaaagatccggcatcttctttatttttacactggcagaaatatgactctggatgttttggatatacgaaggaatagcttcgggatttgaagcatcgatgtcttccttattcatttccgaaacatttgccgttttggcaagtgccttttgggcaatgaacgaatctgttggctttacagcatctgcagattcaatggaagccgatttagttttaatatccgtgatccagtaccgctccctcgcaaaaggataggccggcaggctgattcgccgcggcttggcatccccataaagcagattccaatccattgccagtcccttgacccagagatcaacaaccttcgaatatttccttttccctatccaggcagcaatcattctctccatgtcttcatcttctaccagcgccgtcagcgcctccttattccgtttgacctggccccggtacaactcagggattccatctcgtccttccaggaatccttccagcttatccaccagctcctgcatagaccctgcaatcactgccagccgttcttccatggcttcgcgtcccacctgcagcgtgtaggccacatcggccagactgctttcgctgagctgtccttcccgcataacggctagcattctctcggcctgctttttcagtcgttcttcatttttggccgacaatacgatgatcgcaggcttttgagccgtaacgctcatcggcatcttctcttctgcaatgtactcttcgatgatgacatgtgcattggagcctcccgctccaaacgatgaaatcccggcaatcctcggatattcccgcgtatctccatcgatctcaaccaccggccgtctccattcccccagctcctgctggacgacgaacggcgtctgaccgaaatggatgttcggattcaattcttgggcatgcaggctgggaaccagcgtccggtttttcatctgcaagatgattttcccgaccccggcgatgcccgctgccgcctccagatgtccgatgttggacttcacagagcctatggcgcagaatcccgtatccggcgtatccttcctgaatgcctgggtcaaacccgtcacttcaatcgggtctcccagctccgtgcctgtcccgtgggcttcaatatagctgaccgtccgcgcatggacccccgctcgctccagggccgcccggatcagttctccttgggctgtcgggttcggcaccgtatagccgttggtcttgcctccatggttaatgcttgtcccccggatcaccgcatggatgaggtccccatcagcgatcgccttggacagcggctttaataggacgacccccgcgccttctccagggacaaacccattgcctcctttgccgaagctcttgcactgcccgtctgctgacagcatgtggttggcgcaaagtcccacataactgagcggatggagatacaaatttactccgcctgcaatagccatttcgcattctccgcggtacagatgctcacaggcttcatgaatcgcagtcaacgaggacgaacacatcgtatcgatcggcatgcttggcccttgcaaattaaaaaggtacgaaatcctattcgctaccgaactaaaggatatttggggaaatatttgcgctccctttttccataattccggcccatagagttcgtagcccgtcttagtaattccggcaaatacgcctacccggcggttatgccgcaccgcaagctgttcccgggtgtaacccgcgtcctccaacgcttcccaacaggcttcaatgaacagcctttcctgcgggtccataccgagtgcttcccgtggcgaaatattgaaaaacagcggatcgaattctgcaaatccttcgataaagctcccccatttgctgtagctttttgcattcaccattgcttcctgtggatcaggatggaagaacccttccagcgtccaacgctcacgcgggatttcggtgacacagtccttccctgcttttagattttcccaatattcgttcatgtccctggaccagggatactttccagccattccaatgatcgctatcggttcacgcatttccgcaggagcagaccccgccaagcttcggacgggcttcgctgccgcctttgccgcagatggcacggcttcttcttcgacatacagcggtgccgcaactgtttcctccgcaggctgtatgtcatggctcatcccggtccactgcatacactcctgcgggtattccgccacaaaatattccgtcaaggcgtgcagggtctggtactcataaaacaacgtctgggacagctctccaaagaagcccgccagcttggcattcagctgggtaatcatgatcgagtcgattccataggtttccagcggttcattggtttcaatgctgccgacgctcagccgggtcacctctccaaacagtaccttgagactatgcaaggttttgtcgtagagcaagcctgcatccagcataggtacgcttgcttggttaggtactgcctgaatggcacggacaccggcttgtgaaacggctttcgccaggtaggcctcaatattctcaggttccccctccaagaccattacctgctccttgccggaggccaagctttggtacagcgccctcattcccgaccgagtctgcatggctgtaatgcccatgttttgcgtcatgatctgttccgaatccgcatcgatccgcatcccgccctctttccatagcggccagcggatagataacgtctgcccccgccgttgcttcgcccctaccagggcattccgatattcggcgtatgcgtccataaaggcattggcggtcgcataatcagcctgtcccggattgcccaggctgcccgatatggaagaaaagatcacgaagaagtccaggtcctgaccgctgctcgcctcatccagatgggctagtccgctcaccttcggtcccagcacctctataaattcttcccttgttttcttgatgatgaagttatcttgaaccacccctgcacagtggataatcccatggacacgtccatattcctgctcgatgctgtccagtaaatcgataaccgtcttcctgtcggtgatatcgccttgcctgtacaccacgctggcccctgaagcttccagctcctgcagcttcgtctgcttgtctcggtccagcggcgaccgccccgtcaaaatgaaggtcgctgcttgcgtctgccgcgtaatctcttctgcaaccagcagccccagactgccggagccgccggtgatcagatagaccccactatctctccatggaagctcctctttttgcccagatgttacaagcctgctccagcaagcggttttccgttgaccttcctcatagcgaatccagccatccatcgggctacggctgttatcctccagcttcgccaggatgccttccacctgttctccctgatccacttcaatcagctgcccgatgaattttggattttctagccgggctgtctttaacagccccgaaagccccgaaaagagccgcccttccccagagttccgcaccacaatctggaccagtactcttcccttcggcttgtctttgagcatactttggatgctctcaaaggcctgaacagcataggcctggaaccgctcatcgacccggccttttccggattgaaaggccagcacctgcgcagctccattcaaactcgcttcgagtttctcgtgcaaaacttcttccggctcacaaagcaagaccattcgccgatcataggcaggagcttcggcttccagcggtatgtcctgcttcttccaggcaggctcaaatagcagtgtacagctacttgtaaccgctggcgctttcgctgtttcggttcttactgttctggcctcaacctctggagcccaacaacgctcctgtgcaaaaggatacgtaggtagacttattcttttcggtatgacattggaatatagcaatcgccaatctatatagaagcctttggcccacaactctgccagcttgttcatttcacaatttgcaatccatttgttcattaattccttgaaaacttcttcctgttcaaataattgcactgaatcttttgactgattgttttctcccctccagcagttctcgatatgtgcttgttcattcgtgaacgattggagcttttgtaccagctcgctcgtattctttacgataaaagctacccggtttttcattgccattcgtcctgtctgaagcgtaaaggatacatccgacaaattaatgtcttcagaagctatcaaaaaatctgaaagctcttgtgcatacactttaagccgatgatgatgccttgcagataatggaatcagatagatagcatcttcgttcacagaatgatctttaaatcgttctgattcagcattggctacaaattgttcaaatatggcatgagcgttagttccgcctattccaaaggagcttaacgccgcccggtgaggagccgacgccttctcccatttttggagacgatcaacaacataaaagggtgaatcgggcaaatggatatcatagtttggtttttcgtaattaagcgaaggaggaatctcattatggtataggcttaaagcaactttaatgcaccccgccaaacctgctgcagtatccagatgcccgatattggttttgaccgatccaataccgcaaaattgttttttggtcgtatactgcctgtacgtttcatttaaggcagcaaactcaacaggatcgcccaattttgttccggttccatgcgtctcgatataactgatagattcgggatgaattcgggttgattctatcgtcttctgaataacctcagcctgacctttgacacttggggcataaaaccctaatttgtcggttccatcgttgttcacacctactccccgtaaaagcgcataaatatggtcaccgtctctaacggcatctggcgctttcttcagtagaacaaccccgaccccttctccgccaatcatcccatctgccgactcgtcaaaggctttaatatgtccatcactggagaaattcaagccgggttgatgcacatagcctaaactggtgaaaggaaagatcgtggatgctccgactaaagcgtacttggcttcaccggatagcaggctttgcgaagccagacgcaatccgactaatgaggaagagcagttcgagtgcacaaacagactcgggcctttaaatcctaatttatgagagatcatggtaggaattgtcccaccctgtgctaagatccaggttacatattcatccgcgttcttcaggacattaggtgattgcgatgccaaattgggaataaatgcttgatagaagctactgcttgccgacataaacacactggtatcaggaatttctttgctaatatagccagcatcctcaacggctttccatgaatgctgcaacagcaatttcatttgaggatccataaactctgcatttttctgtgataaactgaaaaactcagggtcgaaatactcttttccttcaatcgtgcatcgtccgggaacatagcctcgattaccgacgatttctttttccagccctaatccaaccaattcttcctcggaaaagaagcgaacactctctacccctgccctcaaattgctccaaaactcggcatggtttttggcccctggaaaatgacatgaaatccctataattgcgagactatcctcaaaataatcggggtaggatggcttgagatcatcttcgcctgaatccattttcggtagggatgtctcagctgtatttgtttgttccagtgtatgtgattgttccatttgagaatcaacattctcacttcttgtttctgtaatataggcactgagttccttaactgtcggatacttgaacaatgctgtcaccgaaatatcgcattccaacaattccttgacccttccgatcatctctgctgctgaaaaagaattcccacctacgtcaaagaaagcatcatctgtacttagatcatcaacattcagaagttttttccatactgttagaacttgatgttcaacatccgattgtggtaaatggatctttcttgttgttgctaactcgatcctgcgatttattaattcttttcgatctattttcccattaggggtcaaaggcagcttatctagctctataaaaaatgcgggtatcatataatagggcaagaaagtttttaaatagtttcgaacttccttcggatcgagaggaggcttaccggactcggaattgttcagcaaacagtaggcaacaagctgcttattccccccctgttccttggcaatcacgatacaatcatcgattcctggatatgttctgacctgaccttcaatttcacttagctcgatccgaaacccgcgaattttcacttgataatccatccgtcccacatactcaatagagccgtccgaaagccacctgcataaatctccagttctgtagagcttagtttccggattgaatgggttgtctatgaacttttcagccgtaagctctggctggttccaatagcctctggccaatccgctgcccgaaataaaaagctctcccggaagaccgacaggcacaggtctaagatgtttgtccaaaatgtaaatctgggtgtttgcgataggcttaccgatcgaaataggcttatctgcgtcgatcttttgaactgtagaccaaattgtggtttcagtcggaccgaacatattccatgcgtcacagctgttatgaacaaaataagatttcaacgtttccgaaagggcttcccctccgcagagaactttcatgttctcttcgttcttccagccggcttgaaagagcagggtccaagtcacaggagtggcttgcatgattgtcggttttattctttgaatttcccgcttaagtctttcggtatcctttatgtttttggagctgcaaatatagcattgagcccccttaatcaaaggcagatataattccagtcccgctatatcaaagcaataggttgtcactgcaagtagtttgtcctgctctgttaaaccgggctgctctcccatggaaataaggaagttggtcaacgctttatgtggaatcatgacccccttgggtttccctgtacttccagaggtatatatcacatatgccaaatggttaggttgtacttcccgtttgattgtctttctacccttcacatcacttttcagatgatcccaatctttatcaaggacaatacagctaacgttgttcccttccaaacgtgacactttctccaacaaccccgattgcgtaatgaccagtgaaactttggaatcctgtagcatatactccaatcggtcctccggatattccggatcgagcggcacgtaggctccaccggccatcagaattcccaacagcccaatcaccatatctaaagaacgttccatgcaaatccccacaagagtatcaggagttaccccatgtttctgcaaatataaggccagcaaagtgctcttttcttttagttccccataggtaagcgattccttttcatatacaactgcaatagcttcaggtgtttttcttgcctgttttgtgaataattcaggaaagcatttatcaggataacttgttccggtagcattccagtcattaaggatgatgtccttttcctctggtaaaagtaatgaatgctcctccaagggccaagtgggattctccataagtgcttccgctaattctatataacgctctgccatctgtatgatggttgaatgatcgaacaaattggagcgatatttgatatttaatatcatttcctcttcccgctcttgcagttccaataccaactcgtattcgccttcctggtgaatttcttcaaccaattcgacgaaaaagatatctttatatggcttgcaaagctgccgaaagcttgaagttggaaggaagttttgataagaaaaggctgcttggaaaacaggtgagctcgtctgtatccgcggaacattcaattctcggaccagagccggaaaaggatacgaggcatgatccattccatcgactactgtcagctgcaattttttcatgaaatccaggaatgtctctgtttccgatatctgactccggattggaagcatattgacaaaatagccgattaaattgtcaaaacgctgctccgggcgcaccataactggcattccaacaatgatatcttcctgtcccgaatactggttaagcaataccgtatacatacctaacaagactgtagataagctcgtatattgcgcttgggcaaaagactttacccgtttgacccatttaagtggaagcggcttggaatatgtttgtgcttccatgctttgagccggaaaaccagagcggtcatatggcagctccagggtcggtaaagcacctgacagctgttgtgtccagtaggaacgatacttctccccttctgcactcgctaacatcgtttgctcccatttaacaaaatcgccgtagctcgctgcgggtggcaacaccgtcgatgtctttccctgtaccacattcttataggcatctaaaaagctttgtataaacatgccgaaagaacttccatcaaaaataatatggtggatgacaaccagtatgaaatgttcctgttcagatctggccataacataaatacgcatcaaaggatcctgttccagcctaaatggttgctttactttattcctaataaatggaataatctcatctgtttccaaggctgaaatatcctccacttgcacatgaagcggctgcgtgggctgcagcttttgataaggtatcccattttcctcttcaatcacactttttaaaataggatactgttctaaaacgatgtgaaaagcccgtttaatgctctcaatctcaatcttcgtattaaaccggaggcatattggtatattgtaagcattcatctcaggggacattttatgtaatagccacaaccctttctgaacttcagaaagcggattccttcggaaactgagcgaatttttctcagtattgacctgtacagtggatttatcttcttcaaccttttgggctaaatatgccgataatagttgaatcgtcgggttctctaaaatttctcttgctttaaccttgataggataggacttctcaaggccgcgtataagcttcatgacaagaatagaatcgatgccataaccatgaagatttgtattcaaattcatttcctcgtgcttaagattcagttcccaacacaaaaattgcactatatactcctgaatcttcgactgaaccaacgaaatggcatttatggtagcgtcatggttttctgcagcggtttcttccatattcgaatgtaatggtgaaaacccactccgatattgataaagtgcttgaagctcttgtttgatataagcattgcggcagatctttctttggattttcccacttcccgttttgggtatacttcccttaagcagcaaatagatatcgtaaatttcaagttgatgcgtatcggatacggcattcagtatgttttcgaccaaccgtttatattcctgctcatgaagggacgcttcaatttcctgtacgacgattactttttcctgaccattgatttcagaggaaaatacagcgatgggcaaggtcaactctggcatattcttttggatggtccattcaatatcgacgggatgatgatttttgccgcgaataatgatgacttccttctctctgccgatgacatagatatgattatccgcaatgaagccaaggtccccggaacgaaaaaagccgccttcttttgtatcggaaagggctacttcaaaagtgctattcgtttcttccttcctgtttaaatatccctctgccatccgtgcggatttaatccaaatctcgccgacttcctccggtaagcattgtgtatgtctttcaggatgaacaattcgtatttgcgtcggatcttcaatctccccacagctcactacggacttcgatttgttcttctcatccgtgtattggactcttcgttgctccagactagggatatctaaattaaggaatctcatcgactgacctggttttatactggcgacggggcacagctccgataagccaaggaggggacaaaatatatcctctcgtagccctaatgcccggaatttatggatgaagttctcgtaagtttccttccgaatgggctcacctgcacatataatcgcttggagatggcgaagtgaatattgcttaattgaagcgatgtccagtgtggagcagcaataatcgaacgcaaaatttggcgctgccgtatgggtagcctgatacttgtcaatcatatgaatccaattttccggatttttagcgaagctttctggcgggagaataatgctcgatgccccgtttaaaagtgggactaaaatattgttatgcagtccaaaagcatgaaattgcggcgtccaggaaacaacacgactattccggtcaattctccattgctcagccttggcctgattcatcaagcagctgtgactaaggattacaccttttggtaaggatgttgagcccgatgtatacatcaaaagagcagtatcctgcggcgctggcattctcatttctatgtcaacgtcaacggcgtcttcttgaaagatttcatcaatattcaggatacggattgaattaaactcctcccgtgtttggagaaatgctttgaaatccgtattagttatgatacatacggcttgggaatccctataaataggcatcatcttctcaaagattttttcatccggctccaaatctgtagtaggtgtaggtatggccacgatatttgcataaaaacatgccagcatgctgctgatatattccaggccctgaggaaatacaagaagtgcccgttcctgctcagccagttctttcaaaaggatactgcccaaagactgtatttgatgtagaagcgtatttccggaaagaatttgaggactttggccttctttctcaaacgtaaacaactctttttcaggaaatttccggcaagtttcaataaaagaagcgatcggaatatcaaggttccatgtttggtcatgttttcgcatcattctccaccaactcctcaaaacacaaagtttatataacatgagctaaaggcttatcaccctgtccattttgagctattattcacgtttgaagcattgcctggagttgcctgctaaaaaaatacatcaaagaaaaaacgagtgatgaggaaggctatatgcttctttcacactcgttgctggttcgcatgaacaaccgcaaaggcattcaacaaatctctatttggttattttccaaacaagttgataattcgttctttaacctccgcttgatgaaaggtcttctcatgcatgataagctcttgttctacgattttgggaagctgttcccggagtggagcaaccaaatgatcctttagcgtgattaaagaaaatctgggtttctcggctagctgccgggcaagatccattacatatcccatcacttctttgcggggcagggtcggaaatggaactccccgtttctccagttcaacgcctcgataattgcccccatttaacaatagttcttctcccaagctgaaccctagttttttaggaatgatatacgtggcacccattcccggtgtgaatccgtatctcataaaattagttgtgtacacactttccttgcttaggactacaaaatcagcaaatagccccattacaaagccaccgcccaccgcatgtccctgcatggcagctatcactggaactttacagcccaatgcaagagagtatatattttcatcggtaaacttcgagattccttcatgtaaagccaacagtccctcttgcgtcccacccgtggcaaaataattatcgtatcctgttagaattacgactttgcaggttgaatcttcttggatcgtcttgaacgcttgtcttagtccatgggtcatttcaagcgtaaatgtatttttatgaactctatcttgcattttcacttgaataatgcctcgctcgatttcaagtaattcaaccacggattgtgacattatgatcttcttcccccctgcatccccatcttgtggcgcacgccatcagtccatccacggaaattgccccgtttcaacgtaccggaaaatccccttaagattttgagaatctgaaaacacctcttgattggacgccaacgctagtggtttacattgacgcaaatcgttgagttcatccataaagcgcttgtagcgtaagatccccttcttggtcaatcgtctgaggcgtaataaatgtttgcgtagcaccatctcgctctgaacatcgtacgcatcaaccaatccccatacatgggcctgttgaaccgaaacgggctgcgtcattagtgttaaataatgcgctttttggaatccaatcctgcggactaaaaatggtagaacgcaagcagggaaaagtccgaatagcaattctgacaagctgaactgtgccgtctcgtcagctatcacaatatcgctggcagcaataaatccgacgccaccagcgtttgcttttcctcgcacatgagaaatcgtgatataaggcccagctgctagttttaaccacagatcatacataggctctggactcattgcatgttcttgtccactttccactttttcacgcattccctcaaaatccgccccaaaacagaacacctctggcagaccctccaaaactacgatcgtaaccgactcctcacacagcgctagcacatgcaagcactcctcgatgagggtattattaatcgtattgtttgcctccggtcggtaaaaccgaatataacaaatcgattcttgaaagcgaacctgaatcgtttgataactcatgattcccacctgtatttacggtggaattcatagatttcttccaaatacaaccgctgtctccctttcccggaagctatcacccccggaatcaattgaaaatccagcttggcgttgcgggttccaaatcgtacggcgccactgccttttagcagggattcatattcatccatagataactgatagcgatcattcaaattacgctcgatttcaaaacgccgcagatgttcctggctttgcggcataacaaccccgctataaaattcagagcagcagcctgacccgtaggaaaaacagccgattcgctttggagcatcgaatgtaccctgatcaatcgtacctgccaaggagaggtacaaagttgcccccataatatttccgacccgttggcaatacgctaatccaggcttaacacgttgtaaataatctgcctcaatctcatttggtttggattgagtcaaccttcgcatcatcgtgcgatgcgctccttttaccattccgccaaaaggagtatgaaaggcaagatactgaaaggtatctttataatccactcctttcacccgtttttgatattccaaaaacgcttgctcgcaacaatccagataggacattaaagacaaatctgcatccccagcctcgctatctggaatcggccggcaagtatccatcacctcatagccgtaatatccattagcgcctgcatcgatttgaaaaacatgaggattttcactaatgagcattgccacggcccctgcgcctccactgggctcagcataagaccaatcctcactcaagacatccccgccttcagcagcaataaatcgtgaaatatcactggcaattacaagcgcttttgctcctggcgagacctgagaaagaataaaattcaccgccatttggagtcctgcagtaccggaatagcaggcttgcttgagctcaaataatctgcaattccgattcaaccccaaatagtggtgaatatatgtactgattgatttcccaaaatcaatacctgattctgtacaggtgataagcatttcgattcggtttttttccgcttctgaaagagcgtccaccagcggttttgccgcatttactccaaaggtaactggatcttcataaggcagggcaaccgccttttctttcattaataaattttcgaaccttgcaggatccaattgcctgtgttgggctaattgcataacatccagataggcagagccaccaaaaacgttcattgcctcaattcccacgacaaccataatcgtccccctctctcaaatacgcgactcacatttttgcatacaaatggccgtattgattccaccaaatcccatgctcagattcatggtattgtgaataattgctggtacagactcattcttcacccaattgcagtccaaatggataggctcctccaaattacgggtagggtgaagtctcgactctttcatttgtaaaagagtagccacaatttcaaccgttcctgccgcgctcaagccatgaccgataatggatttggttgcattgatataggcatgtgacaatttacaatcctgtagtgcctttatttctatctcgtctccaacgatcgagcctgtcccatggggattaatataatcaatctcttccggtagtagctttgctttctccaaagctcttctaatcactcgggcttcgccttcgtaggagggattgggattccggtttcgatccatccccatatcccatcctgcaagtttggcataaggttcctcccgacgcctcacggcagaatcggcccgttctatgactacaaccccgcaagattccccatagatgaacccgtcccgcgactgatcaaatggtcgacacgccattgcaggttcatcggcatatcggtcgcttcccatcgctcccaaggaccgcaatgcctggcattccatatacgaaatatccatcaatgcccccattgcaatacaaacatcaacacgatctgcttgaatggcctcaattgcttgaatgattgcgacttgtccactcgcggatgcaccaccgacggtataagctaacccctgaatgccgaactgttcggtacatagtccgcacaaatcagtatccataaaggaaaccccataggtcggcggtacaaagcacattttttcccgataggcctcataggtctgaaatagctcccgttgctgaaaattggagcctccaaccaccagtccaatacggctaggatcaacgttatccaattgggcatcatcccaggcttcttgaagggttgccatggctacctgccccgaaaatgatgctgtacgtaacattcgtttggataatgccttcggataagacaaggttggcagctccgcacctataaatgaagcttcgcctcttctgccagggcgctgcatgacgccaaatgcatgctgccctttgaacaacgccgaggcaaaagcagccttcccctgcccaatcgccgaagtcacgccaatccccgtaacgactaattcagacttttcataatttttcataatttcgcatatagtgcatctgtcaattcccctatatttttcacgccagacaattcgacacgcggaatatgaagagctaatgtttccatcgtcttgtttacaatttcggcccgatctactgaatctgcacccaaatccaccaatcgatcgccatactcgaacgtgtgatcttgtaattcaggaagcacttcacgaatacaacgtttaacaatatcgaatacttcttccttatgcatgggtatcctcctaaaagataaatgttttaaaactcaacaacccggtattcaataagcatgacctacaaacggatttcgatgaaaaattgtattgaatttctcataaatccgagaagtattcatactccattccgtcttccttggtgctacaatcgtgcagatatagtcacctaaccggtaagactgggcagcatattgtggaaaatgtgaaaatgtactttggaagtatccatccaccaatctggtctcattcatttcaagtacatgcagcgatgttgtaaaacctgtgcgcaatattttcgacaaggcctccttcactgtccaaaaaaccgtcaataaagctgagtactcccctactccccgcacgacagagattctttccttttcttccgtcgtcagttggctttcaattgtcttgtttcgcttagaatcaatcctctcaatatcaatgcccatgggatgcgcttcgggaaaaacaacagccgctccgatatagtcgcaatgggcaatgctcacctggtaactgtggacaccattgatttgaagcatgggctggccaaagacacctgtctccacacttacgttgcgcaggtttggctcgcttaacagcaccgaaaccgcttgtttcgcacttagcctgccaagcacaaagttggatttccgccgatggaataccaaactctcgaagtaactacactcatccgaatggaaaacttcccgatcaaggggagcgtctgcgttataatctgcatggacaaaactgacggccgccttcatcacggcatcttcccgcttcaatattagttgttctgcatacgaggctacgcatatcccccctagtaaactactaccttagcagtccaaatcaaaaaaggccttcaaatcccttatgggttctgaaagcttcctcatggagtatgaactcgtcataagttctccattttaaatcttacttataatttccaacgctactcttactaacctaatatcacccataaattccaactgaatgaccgcttgtcgtttatgtctatctattttcttgactatactcccccttcctttgagtgggccatctaggatacgtatattgtctccttcaataattccagttgatgattctatacaatagctatcattgcatagactctctaacatttgtttctccgaatctctcattgaagcttcaaacttcgagtatctcaataaacgaatgatatcactagaagtgcaaatcattgaatttgtactggttacgaactgcaagtcaggtaaattcgattcaataaatacatagcttgggaacaaaggagcccattctttctttactattcctgctactttaaaaagtctctcttggagaggtataaagggtttgtagacttcagaatccatccactcattaataagctgcttgacctgttcttccctacccgttcgcacaaaaaacacgtaccagctcactaaactcatctcctataaaaacgtactgccaaatcatcttctataatgtctactacccatatacatagcttcgccctttcacttatcctacttgataagctacaatctctcacgatatatccctcattaatggttaacgtgacccgccagcgattaaccacagacaagttcctttatttttcatataatcatataattggaataatgtttttccattataatcctctactcaaaccctgtcaattcacagttgattgggaacggccaagttcatcattggattcacagacctttctgaaaatgctcaatttgaagtcattattatctttcgagtacagcttttatgtttctggcggctcataaaagaactgatccatgtgttttatactagtgaacttgagcacctggggcatatacaagcgataaatcattatgtactattttatatattcaatattttctttcaccattagcactgggccacattacagactcatttgaaatcgaacaggcccttttggttcggacgcattctaaatttaataaaagattccttactcgtaaattgaaaataaatattttcatccatgaggtgattgagtgtaaaaccaggcgctttaccaaatgaatgagcaggataaatttgaatagagtcatcaatttctcgctttattttttgaacgctattatataattctaccggatctcctccatttgggtcacaaaaaccacaaccttcaatgaatattgtatccccagtaaataagcgatctgacaacagatagcatacacttcccacggtatgtccgggggtcaaaagacttttgatttccgtttcaccaaccttgattgaatccttgtctttaattgaatataaatttctacatctaaaattataaaaatcgatttcgtttgttgacatgaatacttgcgggttatatttttctaggagtggatttaccaaattaatatgatcccaatgtgagtgagttaatagtatcgctttgagatcgccattcaattgttgaagataggattctactttcaataaatcccatgatgggtcaacaatagctatgtctcttgttttctcatccattacaaaatatacatagttaatgaaattcataaaacaaactcttaactgttccatatgataagtcagattcatatcagcttcactgaaccaccttcccaatgattaattaaaaacaacaaaattctgtttgaaggatttatacctcttcatttttggagataatttacactcaattataaagcccccatttcgtggtacctatgattataaccattgatgcaatagaaaggctccgactctctgttacaagatcgcttaatcttgccaaaataaaaaacgcctctccgtatgttaacggtgagacgttttttgttgatcctgcgtacctgctgaatgctccactgcagctacaagatctctcattattttcgttcatttaactttgatgtgtccgtggtaattcaaggatgccgaggaccgggatcgaaccggtacggtagtcacctaccgcaggattttaagtcctgtgcgtctgccaattccgccaccccggcataaatttaggaacgctaatctttacacttacttgtcttacaagtatctgagaaacatgcatctgattaagaagtgttctcgttatgtaaatgtcattcaattgggcaccaacatataatacgataattttatcgaattgtaaagtgtttttttaaaaaataataaatttctctttttgtataacttgtgcacatttgaattacactaataaacgtctttccaaactaccagaaggggtgttacgaatgcgtgaaggtatgattccagctgttcttggaacggtagtatcggcttcaggcgctgtgttgctgagcagtaagtacaaacttgcagctacaggcattctcggtttcggactggctcatgttgttctgggagcgattgatctgattgagcatcgctagttgtttgggaagtgccgggtgggatttagtccctcccggttttatttttatcaacgtttagtctggagcacaagcgtttatgtaaagtatagaagctgaatgtacctaataaaaggagctgtgatgtgctatgagagataataactctgaaaaaaatcgtactgacgatcaaatcgaacataaacaatccctcgacaagcgcgagccaggatttaatcgcattcctgacaccgatgcagatacacctgctgctaccgatatgattgatgaagccataggtcgcgggatagacaagttacgtaacgatttcacaaaataaagcatgggtaatagggcacaggtttgtgagcagcccttaattttatttgctttgatatgtacagtgatttcgtaaaatcacttaaagatcagcataatccagccaatgatcgagatccacagcacgatgctgattaagagtccacacatgataccaaaagagaaattaccttcattcttcggcatagtactgccaaatttcaatctaagcttcatttgattccagttcatagaaccccctccttaagttctatttcggaatatgaagcttatttttttagacctatagtcatgttttcgaaaataaaaaagggtttttcgtcctatcaccctgatcgcggaaacaggattacagctataccgaccaaacaaatcaatccaccaatgaaatcgtacaagtcgggtgtctttttatcaatccaccagccccatgcgatggaaagaacaataaagacacctccgtatgctgcatatacacgcccaaaggaggaaaaaatctgaaaggtagcgatgattccatacacagccaaaattactccgccgcaaagtccgacataccatgtcttaccttcacgcagccactgccaaatcaaatatcctcctccaatttcagcgatgccagccaatataaaaagtaaagctgcctttaacaccatttcacatccctaattcttcaaattcttttcgttttttttggatatctcaattagtgcactcgagctaaaatgataatcaatgcaatcacgccaactagaatcagcaggttgctgacctgacgccataagctaggcactccctcggagtgaagcttccgctgattggcatcaaagttcgctttggctccttcagcatctgctgatctagagaatggtctgttttcttcattcataagagtacctccttttcaatccactttaatcttaccaaacttttccgtcgatttcgcggtgcttttatgcatatacttaccacatatttctgattgcaacttcatatatgtgaagtgcatatccatatgtcaatatttcgctgaatataaagtatgatgtcgaatcaaggtagagtgggtatttagacgtctttcattgcaggacggtagttatggtataatttagccaacatgttcaagatcgtaaccagcgctcaactgtttattccaattgcaattaaatttacatccaataatccacatcccggttacaacctgcatattctgtttgtaaacccaggaggaggatacctatgtccccaatctttatagcaagtttaatgataatgggcatatttttatttcaggcagccatcgttttcggcatcatacattggatttcaaaacgcacccaacgtccagcacaaaccaaaatgtatcttgcaatgggtttgctcgttgtaattttaggcttccttatatgggacaactggatacactcacaggaattcaatggatgggccacgattagtctgctggtgattattattagcgcctatatacagcttagaaagcaaaaagaaaaatactaatcccattaccatgcatcaaaggaggagcgccatgaaatctcactcaacacgcttttggttacagagggtgctactactaatgcttgttttactcttcagcggctctcagcaatcattcattgttgccgatgccgccccgccaattaatgttcaggcctctaccaaagctaagcaattactcgcctacctatctaatgtaccggatgatatgctaatttccgggcagcatgattacttagaggcaccggatgaacaaaataacaagctacaacaaatcagcggacaatacgcaggacttcacggctatgagtttggaggattagctaatcagtcccgtacggccctacaagagcaacgtcagcatgttgtggatagtgctatccaatggagtcaggacggcggaatcgtagctattaccttccatcaggcgctaccgggcacacccaaaacgtggaaaaatgtacaagcaaaaataactcaagctgaatttaatcgttacatcacaccgggtaccccgcaatataaacaactgatcgccgatctggatgaggtggctctgtcccttaagactttacgagacgcggatgtacctgttttatggagaccctatcatgagatgaacggcaactggttttggtgggggaacaagcaaaattacgctaagttgtggaatctaatgtatgatcggttcactcatgtccatcatctggataacctgttgtgggtgtggagtcccaatgctccaaacgcatatagcactccctataatctgtccttcccaggtattaaccgggtagatattcttgcagctgatatctataataatgattataaatcctcctattacactgaattgctaaagcttgcgcagggcaagcctatgggaatcggagaaagtgatattctgccgagtgcgaaggtgctgcaaaaccagccagcctgggcctatgccatgacatggggaaaggagctgtctgcaaccaattcacaagcagcaatcagacattttatgaaccaaaataatatcatcacacgagaccttcttcatgagtccctccgctgaaagaaaaaagcttccacttcgctctaagagcaaagtggaagctttttttatactaaatccaaataaagctctctaactatttctgataacctcttctagatcaatatcggcatacgcctcttcaccaagatgtacggatacaatggtgtagatccgcttggacagtctagacatcagccgatcacccggtgctacagaatattcttcccgataatctccaattttgtgaaaaccgctggacatatggatgtacaagttacccctacgtgttctaccatgcaccaacatcaaatctcctcctgctggtaaccaacctaatttccctgttacatgtatatcggttagaacaagataggatataagtccctggtacccttgggactgacccccgtttg

SEQ ID NO: 39 - DNA, 13970 bp, Unknown
  Kingdom: Bacteria, Phylum: Firmicutes, Class: Bacilli, Order: Bacillales, Family: Paenibacillaceae, Genus: Paenibacillus
cctgcttgcagcaatcgggaggatacttgcagcgctttaatcgaatcgccgcccagttcaaagaagttatcctgcgtgcctaccgtttcgacacccagcaccccggcccatactgaagctaaaacctgttctaccgtggtacgcggtgccacataggctgctccggtatggatgcttccttccggttccggcaaggccttgcggtcgatttttccattgtgggtcagtggtaaggtctccagacgcatcaagcgtgcaggtaccatatgtgctggcagtgctgcttccagctcggcctgtacttcctcaatccgcagctcggcttctcccgtgatgtatccgcacaagtacttgtgcccacgctcatccgtccggtcgatgactaccgcttgacgcacacccggcacccgctggatcgccgtttcaatctcgcccaattcaatccggtagccccggattttcacttgatagtccatccggccgataaagtccacattgccgtccgacatccaccgcgccaagtcacctgtgcggtacaatcgttcacccgctacgtacgggtttgccacgaacttctcggccgtcaggtccgcacggttcaagtatccccgtgctaccccggctccgccgatgcacagttcacccaatacgccgatcggcaccggattcaactggctgtccacaatgtagaagcgtgcattcagccacgcctgaccaatcggcacattgccgctgcttggcagcttcgacagctcttcgtcgtagaagctggagtcaatcgccgcttccgtgacgccgtagctgttcataatacgaacatccgcgccgaatcgttcctgcagcacccgataatccgtcacgctgcagctgtccgagctggtaatcagcaattccagactgctcatgtccagcccctgttcatacacatgctgcataaacggtacgatcaaggccggtgtcgattcgaacactgtaatctgataatcgcgaatccagccgtatagacggcttgggtcaatgcgatcatctttcggacagatgaccatcgttccaccgttataaagcgcccgtgcgatatccccgacgaacacgtcgaaggagaagctcgccagttgtagcaaccgtaccgggaactggttcagacgataatcccggcgataggccgcagccgtattcaccaaactgcgatgctcaatcatgacgcccttcggacgtcccgttgtcccggaggtgtagatcacatacgccagatcctgcggctcattgataggttccacatccgtggcatccccgatgtacagcgactcatcgtccagcgccagtacggtgtgcagacgcaagttcgctgcggattcggatgctgcttcgctatcagatgacgaatctgatttcaagctgaatccctcattaaggctgtctctttccatcgtttcaatgctaaccgccgtttccagctcgccctcagactgccctccggccaaagtctgtcggctttcctccagccatgcctgcgcgcgctcctgcaaacctgtttgcgtcagtagcactgtcgcgccgctgtcctccagcataaagcggatacgttcgtacggataatccgcatctaacggtacatatgccccgccggctttccatactgccaatacgccgaccagcatgtccaccgagcgctcgctcaaaataccaacaatggattcgcgcccaatgccttcattccgcaatctacgagcaagttggttcccacgctcgttcagctcacggtatgtaagctgccgctcctcgtatacaactgccacgtgatccggtgcaagctgcgcttgttcttccacataggcgtggaacaacccttctgattgcttttcatcactccatgcagatacgcccactgatccaaaaccgtcgatgatttttgctttttccgaagcagtcaccagctccagctcatctaccagcgcatctggtctgttaatcgcttcttcaatcatatgcagcaaatgctcgcggatttgctctacagctgtgcgttccaatactcgcgcgttgtactccaaatggacatgaatttcatcacccggcacaaccgtaatgttgaaatcatagttcgtttgctccgatacggaagcattggcaatcgtaaaaccattctcaccacggctacccatttgctccatacgctgttccactgggtagttttcaaacaccataatatggttcaccaggtcctgtttttgctctgtcagggcctgaatttcatacaacggataggtttcataagcacgggaggccagtgcctgctcctgtatctgcttcattaacgcagcaaacgtcatatctttctcactgtgaatccgtacaggaacggtattaatgaacaaaccaatcattttatcgatgcccggaatatccgctgatctgccggatacgacactgccaaatacaacatcccgactgttgttataccgttgcagcacaacgccccacgctgcttgcagcagtgtattgaccgtcacttgctgctgcttaaccagcttgttcatccgttccgtcacttcgcggtccagtgtaaacaaaagtttgtccgcttcatattctttagcgtgaccgtccagctgttttgcctgcggcaataccgtctgctgctcgaaaccagcaaaataatcactccagaaccgttcagcctctgctttgtcctgccgctctagccattcaatatattcactgtatggcgttaccgggacaagctccggcttgcggtcttcgaggatggcaaagtacgtattaaatgcctctcctacaattaggaacagacaccagccgtccatcaaaatatggtggaagctccacacaaaacggtaggattcctcgcctgtacgcaaaatagacacccgcatcagctcgcctgagctgaaattaaagccttcggctttgtcatgctcagcaaaaccagcaatgtatgcgtcctgctctccttgtcccattgaacgaacatcttcaaaacggaacccggcatgtttatgacggtacaccacctgtaaaggctgctcattccatccgctataaaaattcgttctgaatatttgatggcgatccaccagttgatttaagctttcggcaaaagcctccacttgaaagctgccttgcagatcaaatgtcgcctgctcaaagtacgccccggatttcggctccattaagccatggaacagaatgcctttttgcatcggtgttaacgaataaatattttctaattctcccgcagtagccgtctgctctacaatatgatccagctctccagccgtcagtccttggaaggacaagtcgcttggcgtcagctctggcaactctttttccacacagtgagccaagacctcacgcaagctctcctgcagcagatcagccagctttttgattgattttttcatgaacgttttgttgctgtagctgatcgtcagttccagtgcaccgtccgtgatcatgccgttgatatccagagcataccgcttggtcaacgtatcactaatggaagctccgatggaataaggagacatgcgaaatgcgttattcttcaaatcctgatcgaattgtccgagatagttaaagctgatttccggctcggcgacaaaagcggcttccccttccctaggcgcagaaagatatctcaaaataccgtatccaattcctttatgcggcaaacgacgcagcccttccttgacgctcttgacacgccgtcccacattccgatcctcgcccatatcgagcacaaccgggaattggctggtaaaccaaccgaccgtacgcgtaatatccacatccggcaaaatagcttcccgtccgtgaccctccagatttacaagcacctgacggatgcctgcccactcctgaattgcggtgcccagagctgtcagcaacaggtcgttcgcttccgtgttgtaggcttggtgtgcctgcttcaaaaattgttctgtttcttcgacagtccacgctactgtcagtgtccgatcatcgcgaagctgtggcttggcctgagatttacgagtgtaatctttaggcaaggatgcctgactcttccctgcttgctcaatctgctcccaatacgcacgctcgttctccaacgctccactgctcgcataagcggatagctggtctgcccacagacggaaggaatccgtcttattgggcaaacggacagactcgccacgtaaagattgctcatagccggttgccaaatcttccagcaaaatacgccaagacacgccgtcgaccaccaaatggtggatcgctaccaacaaatggtctccatcggtgcaacggaacagacccagtttcaccaaagggccttcatctagacggatactgctttgaatttcgctggctttgttctccagcaaatgagcaaagtcagactcatttgtaaaatcaaccacttccaggctgtacagttctccttcttgcacgccacggttccatacttcatacccaccgtccgcattttggcggaatacgatgcgcaaagcatcatggtgctcgacaatgcgttgcagtgcctgatgaagcgccgtttcgtccaaacgatcctcacggtgcagcatcagagcctgattatagtgctcaggattggatggctgctgctcaatgaaccagtgttgaatcggtgtcaataccacgtttccactgacttctccttgatcggaaatgcgggtcacccgctgcacccgtccattcagctcagcaatcgtcggatactggaacagctctctcatttccagcttgtaaccattttgcagcagtcttgaagacacctggatggccttaatcgagtcgccccccagatggaaaaagttatccagcacaccaatatgctcgataccaagtacagattgccacacggacactagcgtccgttctacctcattacgggctgctacgtaatcctcaccggaatccacgctgccctccggttgcggcaacgcccgacgatccactttgccatttggtgtcaacggcaattgctccagctgcacaaaatatgacggtaccatgtaacccggcaattcttgactcaaggcgcttcgcagctcactagccgcgatatccgcaagggtgactacatatgcacagagctgcttttgcccttgctcatcctcacgtgcaatgacgacggcttcttgcaccgcttccagcttcaacagctgcgcttccacctcacccagctcgatccggtagccccgaattttcacctgtgcgtcaatccgtcctttgtattccagcgttccgtcctcattccagcgcaccaaatcgcctgtgcggtagcagcgctctccgctgcggaacggactatctacgaacttttcagccgtcaaatccggacggttccggtagccacgtgccaccccgtcgccgccgacgatcaactccccccatgccccgacaggctgaagctgcatggaacgatctacgacatacgctgtagagttgtggatcggacgcccaatcggcaccgcttccaattgcacgctggcaatcgcataagttgtagaaaaagttgtattttctgtcggcccatagccgttaatgatccgcagggacggatgagcctccagcacccggttaatgtgcggtacggacagcacatcaccaccgaccagcagttcttgtaccccctcgaacagctccgagtcctgctgagatagctggttaaagagcggtgcagtcagccacattgtcgtgataccatggttgcgcacggcttccttgagctttggagcgtccaaaatgacatcctgacttaccagcacgagctgtccaccatttagtagcgcaccccaaatttcgaaggtggacgcgtcaaagacaacagcgccagtttgcaaaatgcgtgtatcagcatctaattgcgcatagtttgtacttttcaccaaacgcacaacattgcgatgttctaccataacccctttgggctgtccggttgtgcccgaagtgtacatcaaataagctagtcggtttccaaaattacgttcttgttctccagcagtgctgtctacgacagacgaggatgattcctttaaaatcacatttttcagatttatataatcggtataatccgcatgataagcctcgttttgctcccaatgtacggcattcaagccttggtcatcctctgccccgtacaccttagcatcgctcagatccagtacgattccggtgtattcctccggttgctgttctgcacgctgcaccagcagcaacttcgcccccgaatcttccaacaggtaacgtacacgttcagccggataatcaggatcaatcggtacatatgcgccgcccgctttgagaatcgccaacatgccgacgatcatatccgtggaacgctcagcaacgatacctacagtttgctcggcggtaacaccgtgtccgcgcaacgtgtgagccagtcgatttgcttttacattcagttcgccataagttaaacgggcatttccgaacacaactgctgtctgattcggtgtacgttcagcctgttcctcaaacaactcatgaatgcctgcttcgtgtggatattccaccgctgtagcattgaatacgtcgacgatttgcgcccgttcttcctcactgatcagcgacaattcctgtatccgcttgtgtgggccctgcaccatatgctctgccacactcaaaaattgtcgaataattcgagcaatttcctgttcactaaacagttcggtacgataatctaggtacagcacgagtctatcatcatccagcatttcaaccatgtgaatatcgaagtcgttcaccgtatctccgcagaaatcgttatctacctgctgaatggcttcatcaaaccgggagaaactcaaggtacggtactgaatagaagcaccaaacagacgctgaatgtccaggctgctttgctgttcacgcaaatcctgaataattttgttgtacgggtaacgctgatgccgcaaaatggacgcctgctccttccctacaccctgcaggaaggtcagcagttcggattctggttcgactaacaaacgcgtagccacggtactgacgaacataccgatggtatccttttccttcttagacgtacggttggcatagagtgtccccacggttaagtcctgctctcccgtcactttatgcaaataaatatacagagccgccaggaagaacgtgaaaatactaattttatgttcctcgcaaaaagccgtaacaccacgatacaactcatgttccagtataaagctcttccggcgtgcagctgtactcagtgtcagcgggttatatgatttcaaacctgtagtctctggcaaatcggcaaacttttctgtccagtacgttttgtccttttgataacggtctgattgctcatagctttgctctacctggataaaatccagatagggattgcccttggtcggcgtatcttgacctgtaccatgcacaatatccatataatgtccggtgatttcattaatggcatgattcatggacacgccgtctgagataatatgatgcattttaaaattaaaccaggtttcttctgctccgagctgcaagataacaaatcggtacagctgcgaatccaacaatgagaacggctgtggattatggcgctttaaccattcctttgcttcttccagggtaacttggagcgtttctatactttccgccgtaaacggctctacatattgatacggaatcccatcctgagcagtaattttgatacgaaaagaatcattttgggcaattacccggttcattgcttgctgcaaggcatctatacgaacagttcccctgatttttactgttgcaataatcgttgatgtgttccgattaggatacagaagctccgtataccaaatccgttgctgtggctggcttagcgaaaacaattgaacattttgctgtgtcatccgtctctctcctcgcaaaatagatattggtaaaaaggaaattcgcatatttatgcggtttgttcctcaggatgctttcgaaattgaagctcatacagctctgcataatgaccgccctcggcaaggagctgatcatgggtaccctgctctttcagttcaccatcggcaaggacacagatcgtatccgcccgttcaatcgtagacaatcgatgggcaataactaatgtcgtacgatccttcatcagctcatttaagccctgctggacttcatattccgattctgcatccaaagccgaggttgcttcatccaacagcaaaatcggtgcatttttgagcaaagcacgagcaattgcgatccgctgtctttgaccgccagacaaattggctccgcgttcaccgacaatcgtgtcgtacccctctggcagctcggctatgaagccgctggcataggctgttttggccgcagcctctacttcctcatccgtggcagtcggtgagccaaaacggatattatccgctactgtaccgtggaacagcgtagcctcctgtggtacataggccatcaaatccctgacctcatccaacggaaattcttctgccaagcgaccacgaacccgcagcacaccttcgtccggtgggtaaaatcccaacaacagcttcatgactgtgcttttgccgccaccactcgggccgacaagcgcggttacctgtccttctggcacaaccaagtttaacctttgcagcgttggatggtcaggctgatagccaaaggtgatgtcgcgcagctccagcgcagccggagtctgttcaatggcatggtctgaacgcaaggtctcaacatcgccatagaattccccagattcacgggctgataaagctgacgtctcgggatcgataagcctagtcaacagtcccttctttttagccgcggggaactgctcttcttccttcgactcatccagaatttcgcggatacgcgccaagcctgccaaggagttttgtaacagtgttacagctgcccctagctccaaaaacaccgttgaaataccggtttgcagctgcacaatctgtcccaatacccccagttccatttgcttctgcgataccagaatcaatccggcgacaagcacaccgcccagcgtaatgaactctatgacaaaattgcacatatcctgcaagcccatatgacgtccctgccggatgctgatacggtttatgtcctcgcttgcatcgttacatagtccacctacctttgtcctcaacccaaacaacttcaccgtctgcaaaccggaaagcaaatcactcaatcgttccgtgaacccgctcatccgtccctgtaactcttcactcgtctttcgcattttctttgcgaaatgagcattaatccaggctgaagccagcccaagtaaaaccgccataatcccaaatcgccaatccagaaccatcaaaatgaccaacgagcccaagaaaagcgaaatttccagtataatcgagcggatatgaacggtgtaagcctgctccagcgcctgtacatcattcgtcatacgggatacaagatcacccgaatggtgtttttcggctttatcgtacgatagcttaacaatgtggccaaatagtttcattcgtacttcggcaatcgccagctttacacaccgtttatacatatagctacacaggggggaaataagacttaatgccaaaaatgtaccactgaccaaatagaccgctcggtataactcctgtacatcgccattaaccgcgaaattcagcaaataatgcaccacaaaagaaagtaaaatcgtgatgctggcattggtcagactattgccaaccagcccggtaaaataccattttcgttgcggcttcatcagggacatcaactgcttaaattcataaaacccctgcttgaaggtcacgacgctcacccctttcctcaggcaacgaaaacccgttttccgccgtatgctgttcttcttcaaaatttttcaaatacagctttcggtacacaccatcacgacttagtaattcctcatgagaacccgattccacaatgctcccctgatcgagtacaataatgcggttcgcctgacgtacggttgacagtcgatgagcaatgaccagtaccgtccggttttgcattaccgcattcatcgcattctgcacctgagcctccgactgactatcgagtgctgaagtcggctcgtccaatagaagcagcggagcatttttcagtaatgctcttgctatggaaatacgctgtttttgaccgccagacaatccgcctccccgctcgctcaacagggtttcatagccctcgggaagttgaacaataaaatcatgcgcatgtgccgctttcgccgcttcgacaatttcttcccgagtcgccgccaaacgtccatatccgatattttctgcaatggtggccggaaaaagcgacggctcctgagataccatcgaaatatgactgcgcaggctggttaaattccaatctgtcaaactttttccaaatagttgaatggttccagcatgctctccaggttcattaaatccgcaaagcagcttgaaaatcgtgctcttacctccaccgctggcaccgacaatcgccaccatatccccttgccctgcctggaagctgatatccttcagcactgtgttcccttcatcgtagccaaaggtcaaatgctcaaagctgactacagcaacactatcaacgtcatcatcactttctgctccgccttcactcattcggttggcttccccatttgcttcgtctttcaaatgaggcgcctcattctctcgcttctgatctaccaaggtcatttcgccatcctgacgttcattctgccaatccagtacctcaaacaaatgctttgcggctccacccgcttccttcatttgcgaaatgatcgtcggcagcatggcaatcggctgcaatatgaacgaaatcaggtataaaaaaagtacaatgcctccagcattcagctctccatgttgtatcaggtatcctccgtatacaatgactaaaataatcggtgttgctagcatcatcacacctaccggagtaatggctgcatagcgcttttctagccgtaagccgcgcttgacgacctcctccataatcaccatatacttcttcaacagcactgcttgcatattgaatgccttgacgataggaattcctccgattgcatcttgccccacagcgttcaaatgagcaattttctcctgaagatccgcggaatatttttcaatcggcttgctcattagtgatgttatgatcattcctattggcatgagcgcaagacttgccaatatcagtttccagcttgtcagtaaaagcaatatgagggatgccgtaaacacaagcggtaaataaaacagattggcaaactgctggataaaaaagttctgtaatactgccgtattattggttagacgggataccaaatctccggtaaatttcctttccacgctggaaactggtaaatcgcaaaacttatgtacgagatcccctctcaagtcgcgcagagcactaacactaaatcgcgctgaagcgtacctcatcacaaacttacagggcattccaattagcgtcataccaacaaccagatagatcatgttctgggtagaggagaatgtcccctgtgccatgtgttcaatggccttacccaaaacaatgtcaatagctgccaaacacaaggaggcgatcaccgttatgaaaacccatagattatacggccttacataacgtgcgagtctccgaaatgcagaatttaatcgaaacaagggcatccctcttttcgttgcccacactttatcagtgcgaactttttatattggctgtggacgtcgttgagataaactctgagtttggatgcatgagtatccgtgcagaataaaatgcgattttgaactatgctggaatttgcatcttggtgtgggttggttgttgattgttgctgagatggtaataacgaagtgtatcgtgatgtgtgggacattcaactctgtctgaatcgtggttgtagggtgcttgtgttgtaagctgtatgagctgcctccgcgtggcccatcggcgaggatgtagaaagaatgttctcgactgcgctcataacctcttgttcttgttcatggatgaaaaagtgattaccttcgaacatctgaacatccataggtgatgtcgtatgttgttgccaggcatggagtgaatctgtgctaacctcaaaatccttcattcctcctaaaacggtcatcgggcataccagtggatttcccggcagataaacataagtttcacataccttaaaatctgcacgcagacgaggcataataatttgcatcaattctgcattttgcagcacctcttcaggggttccctgcattaaacgaagctcttccgtgaaagaatcgtctgttaaatcatggagtcgttttttggagtatggaagatgtggtgcggatttaccagatatgatgatatgcacaggtagctttccagttttgctgtacaactgtcgtgctgtttcaaatgcaatcagtgcccccatactgtgcccaaaaaaagcgaacggcttatgcatgtatggagccattgcgggaaccaacgattgaacgatgtcttgaagagtatccattggagcttctgttgaacggctttcacgtcctggaagttgtataggcagcacggtaatgtcaggcgcaaatctggacttccaagagttaaatatgtaagcaccaccaccggcgtaggggaagcaaaatagttggagcttcgcagtcggttggacctctgttttcgcgaaccaagattgcgatcgagtcgtcatatgaattcctccatcctctatgcagttcataattttacagtaaatccttatatctcttttttccttccaacactttctaactgtttttaaatatacaaactttaaaaccacttggcatgggaaaaaagggctaaatcgatagagctcataaaaataaaacaaaatccatattatgttatttgtttccaaacttcaaaagcaacaatttcactttttgtattagttatctgtcaatcatgatctgttaatttagtttgaaacgaaattttaggttttcacgaattttgtaaaactaaactcactatgatttacattgaagctccaaccccttatcctacaacaattttatctttacatgccattaacataaatgtaacaaattcaacctgatatcatccgacaaattccgcctttttccgcaactctctttaaactcctaaatagtggattgaatttgtatcaagctcacataagccaaaattaataactctttaattttgtaataaatattgttatttaatagtcctaaaggaccatattttgcatatttttttctgactcttcgtctaaaaaattcagttcggattgagtttttctctcccaaagctatgaattttcttttcaaactctaatagaagcgtttctatctcgattcaaaagtacctgttctctagaaatttatagccttacttttaatctttcagtaacggcaaacagcaaggctccctgttgttggagcttgctgctttataaatttcattatgtttgacttcactattggtcgatatgcagagcgttgaaagctttattgtagttatcccccaatcttattaatttagtggaatggagtatttggtatgggtttcttgtatattttccaaaacgcgaaagccttatggtatacaaaaatagcacagcccattaaggctgtgctctcagattgtcgagaaaccccgtcttttgagacgtgggtttctttttctttacatcataaggctctggtctctggagaaatagggggttacccctgtttctccaggcgatccaggtggatcgccatcttcttcatgttctgcacggctgccgtcataagggcttgttccctgacgtttggtagaccgcgcaaacggcaatagcgaaacccatggagctctttggcatccgcgaagcttcgctcaatcgtctcttttcgtttgcggtacagccgtttcccggatgggcttagccg

SEQ ID NO: 40 - DNA, 3920 bp, Unknown
  Kingdom: Bacteria, Phylum: Firmicutes, Class: Bacilli, Order: Bacillales, Family: Paenibacillaceae, Genus: Paenibacillus
atgttctcgctgtccctattgaaggaatgagaaggggactcgtcttttggaagcggctgatatacgccttgttccatttccttccagaatgcgagttctgctgccatggccggactgttcgcatattgagactgcccatccgcccaggtgcggaacgaatccgttttgtgcggaagacgagctgcttgtccgttcaatgcctgctcataagcggtcgtaatatcctcgaacaaaatgcgccaagatacggtatccaccactaagtgatgaatcgccatcagcaaatgatctccatcaggacaatggaacagccccagcttcaccagcggtccttcgcttagatgaatacccgcctgaatttcattcactttggcctcgatcgccgcagatacctcagactcatttctgaagtcggcccgatccagcgtatacagctcgccctccccaatcgcacggttccaagcttcataaccgtgctctgtaggacggaaaatgatacgcagtgcatcgtgatggctaacgacgtgatccatcgccgtgcgcagggccggttcatcaaaaccgtccttgctatgcagcataatggactggttatgatgatgagcatccgtcaggttctgctcaaagaaccattgttgaacaggtgtcagtttcacagcgcccaccacttcgctctgatccgccaatcgggtcaccgattgcactttcagtgccaaggcagacacggttggatgactgaacaggtctttcatctccagtcgataacctgcttgcagcaatcgggaggatacttgcaaggccttgatcgaatcgccacccagctcgaagaagttatcctgcgtgcctaccgcttccacgccgagtactccggcccataccgcagccagtacttgctccaccgtggtacgcggtgccacataggctgcaccggtatggatgcttccttccggttccggcaaggccttgcggtcgattttgccgttgctcgtcagggggatcgtctccaaacgcatcaaacgtgcaggcaccatgtgcgctggcagcccggcttccagttcggcctgtacctcctcgatccgcagctcagcttctcccgtgatgtatccgcacaagtacttgtgtccacgctcatccgtccggtcgatgactaccgcttgacgtacgcccggcacccgctggatcgccgtttcaatctcgcccagctcgatccggtagccccggattttcacttgataatccatccggccgataaagtccacattgccgtccggcatccaccgcgccaagtcacctgtacggtacaatcgttcacccggtacgtacgggtttgccacgaatttttcggcggtcaaatccgcacggtttaagtatccccgtgctaccccggctccgccaatgcacagttcacccaatacgccgatcggcaccggattcaactggctgtccacaatgtagaagcgtgcgttcagccacgcctggccaatcggtacattgccgctgcttggcagcttcgacagctcttcgtcgtagaagctggagtcaatcgccgcttccgtgacgccgtaactgttcataatgcggatatccgcgccaaaccgttcttgcagcacccggtaatccgtcacgctgcagctatccgagctggtaatcagcaattccagactgctcatgtccagtctctgttcatgcacatgctgcataaacggtacgatcagggccggggtcgattcgaacaccgtaatctggtagtcgcgaatccatccatatagacggcttgggtcgatgcgatcatctttcggacagataaccatcgttccgccgttatagagcgtccgcgcaatatccccgacgaacacgtcgaaggagaagctcgccagttgcaacaaccgtaccgggaactggttcagacggtaatcccggcgataagctgcagccgtattcaccaaactgcgatgctcaatcatgacgcccttcggacgtcccgttgtcccggaggtgtagatcacatacgctagatcctgcggttcattgatgtgattgacgtctgtggtatccccggtgtacaacgactcatcgtccaacgccagtacggtatgcagacgcaaacccgctgcggattcggatgtagttttgctttcatccagccatacctgtgcacgctcctgtaagcccgtttgggtcaacagtaccgtcgcaccgctatcctccagcatgaaacgaatgcgttcggacggatagtctgcatctagcggcacatacgcgcctccagctttccacaccgccaatacgccgaccagcatgtctaccgaacgttcactcaaaatgccgataatcgactcgcgtccaatgccttcatttcgcagtctacgggccaattggttcgcacgctcgttgagtgtgcggtacgtcagttgttgttcctcgtacaccaccgccacgtgatccggtataagctgcgcctgttcttccacataggtatggaacaaagctcctgcttcagcagcaacatccgatactcccacatctccaaaaccgtagatgatttgtgccttctcctcgacggtcaccatctccaaagctgccagtggctgctgcggatacagggtaattgcacgtacgagttcggtaaaatgctgtgccaatcgcccgatggtctcagccttgtatagtgccgtgctgtattccagactgcacagaatgccttccggctgctccactgcatccaaggtcagatcaaatttggccgtaggattgtccgtcggatacgttttaaaggtcagaccctccagctcgaactcctgctgttcaaatgttttcagctcaaacatcgtgtcaaacagcgcattccggctcgtatcccgcgttaaattcagcttttctaccagttcttcaaaaggatagtcctgatgctcatatgcactgagcgcatgctctttgacctcttgcagataattcaggaacgttttgtcgccagacggataattgcggatcgccagcgtgttgaggaatacgcctaccaagccctccagttccgcatgcggtcttccggcaatcggcgtgccgacgataatgtcctcctgccccgaatatttatgcaagagcgtgctatatgctgctagcaacaccatgtataaggtggagccggtttgcgcggccagctgtctcaactgctcgctgtcctccaagctgatcgcaaattccaatcgatctccttctagacgctgtacggctggtcttataaaatccgttggcatatccagtgctggaatgtcaccagccatcgtgttcagccagtagctttcctgctcacgaagacgttcactttgcatatcggcatgctgccaaaccgcatagtccttgtactgaatgcgcagaggcggcagttccttgccttcatacaattgagagaactcctgcacgataattccttcagtgacgccatccgaaataatatggtgcatgtcatagagcatgacgtaacgctccggtccggtttccaccagctgaacccgcagcaatggtgcttgtgcgagatcaaatgcacgtacaaagtcctgtgcgtactgctgggtctcttcttcgcttgcctgcacatgctccacgttgaatgcgacgcccgattcaatccgttgaatcacctcgccatccaccatgtcgaatcgggttcgcagggcttcatgacgggcaatcagctggcggaaggcttgctccagtcgcgttttatccaaggaaccttcaatgatcaaagcgcctggcatattgtagctaacctctccgccttccaggtgactcagcacgtacatccgtttttgcgccgaggaaaccggataatatgcacgttcctccgcaacagggatggatacatacgtttgctgtgtctgaacttctcccatcacctgcaccagttgctcaatcgtcgg

SEQ ID NO: 41 - DNA, 209205 bp, Unknown
  Kingdom: Bacteria, Phylum: Firmicutes, Class: Bacilli, Order: Bacillales, Family: Paenibacillaceae, Genus: Paenibacillus
ttcagggtgtaaccttgaaattgcgcttgatattccaaatcactttggtgagttgaagaataacttgcggagttttgctaggcgagtccatttatatggagagatacccaagtggctataaggggaccctctgctaaggggttagactgcgaaagtggtgcgagggttcgaatccctctctctccgccatttaggacaagctagcgaaatattatgttatggcggtgtagctcagctggctagagcgtacggttcatacccgtgaggtcgggggttcgatcccctccgccgctaccatacatacccaggaggcttagctcagctgggagagcatctgccttacaagcagagggtcgggggttcgatcccctcagcctccaccattgtgccggtgtagctcaactggtagagcaactgacttgtaatcagtaggttgggggttcaagtcctctcgccggcaccatttttgaattttgaaaaatatagggaactgtggtgtagaggcctaacatgcctgcctgtcacgcaggagatcgcgggttcgaatcccgtcagttccgccatttttcaattcaatagttttatcgtactaaagtgggaaggggtatccctccgcactttatttttttgttaatggatatggctcggtagctcagtcggtagagcagaggactgaaaatcctcgtgtcggcggttcgattccgtcccgagccacctttatatggaggattagcgaagtggccaaacgcatcagactgtaaatctgctcccttacgggttcggtggttcgaatccatcatcctccaccagttttgcgagccattagctcagttggtagagcacctgacttttaatcagggtgtcgaaggttcgagtccttcatggctcatcagaagtcatcaactataggttgatggctttttttgtattgttttaagctatgttttaatatagcttttttattttacggtatcgacaggttataatgagttcattatgttcgcttagtgcttattctatattctaaaaaagtgaagtggtgatcgcgtgactctggatacagaatggattcaacaacagcttcagaatattattcaagcgccttttaccatagtgccttggtgcccggaaatgatggcagagggagagacagccgattcagttataccggatagatcgtttgtccatgacaacaagctatattttccgtttcgtgcgtcgggaggtgaactggctgcctttgtggtagaggccagatatttgacggatcgagaacggaaactggtagaagcgctattggggaacatggagcaggtctggcagaacggtccacaattgtcggataacccagtttatagcgaggaagagcggatgaatcgttttggacaatggctcatacagcaggctgccaatctaaacagggaagaagaggttcctgatgaattgcagcttcgcgattcgctatcagcgtgcatggtcccgattttactgaatggcgagggaacacaggagggggctattacttatacgcagctccatcgattgttcgcgagctattttggaggggatgtgctgcttactccattggacgaacagtcttggctgattatggctaaaaaggagcttttattaggagccgacgatgaacgggataaagacactgagtccagggatgcagattttacggaatcgttggaggaggttcttacggcttttagcttgggtctatatgagcttattgcgaatgaatgggtgggtgtgttccatttggcggtttccaagccttcgatccctttgcaaagtcttccccaagagctgaatttgttatgggagacgatacatctgggcaagatttttcatgtaacagagcacatccacttttcatgggagcttcatttagaaaggctgttaaaccgcattcccaaggaacaacgcgtactatttttagagcaggtaatgaaatcatctgtcatactggaagactcagaaacgatggctacattagatatcttttttcaactggattgtaatgtgagtgagacagctaagcgtctctatgtgcatcgaaatacattgatttaccgtttggacaagatcaaacaggagaccggattggacgtgcggacgtttaatgatgcggttttggtcaaactatatctgctattgtacaaagtgacaaaaaggaaatagcatttttgtgcagtttgcgaatagccacgttacggggactagggtaagatacaagtaagaaatgtattcgatttcataacttgatcttagggaggcaaaagctatggctggtgtacgtttagagcatattttcaagaaatatccgggtgcagataaagctacggttgttgatgtcaatttggacattcaagataaagagtttctcgtattggttggtccttccggttgtggtaaatctactacgctccgtatgattgctggtctggaggaaatttcagacggtaaattgtacattggagatcgtgttgtgaacgacgtggctccaaaggaccgcgatatcgcgatggtattccaatcctatgccttgtatccgcatatgaatgtataccaaaacatggcttttggtctgaagctccgtaaggtgaagaaagaagaaattgataagcgtgtacgtgaagcagctaaaatccttgatattgagcatctgctggatcgcaagccgaaagcgttatcaggtggtcaacgccagcgtgttgccttgggacgtgcgattgtgcgtgacccgcaagtgttcttgatggatgagccactgtccaacttggatgccaagctgcgtggtcagatgcgtgcggaaatcacgaagctggctaagcgtctggaaacgactgttatctacgtaacccatgaccaggtcgaagccatgacgatgggtgaccggattgtagttatgaaggatggtattatccaacaagctgcatccccagatgaactgtacaaccgtccagtgaatctgttcgtagctggttttatcggctcccctacgatgaactttatcacaggtaagctggttgaaaaagaaggtgcattgcattttgctgcgccgggtctggatctgttcgtaccagaaggtaaaggacagattttaaaagcgaagggctatatcggcaaagaagtgatcttgggtatccgtcctgaggacattcatgaagagcctgtattcttggaggcttctccgaatacgatctttacatccactgtggatgtaacggaaaatctcggtcatgaaatgctgttgtacttgagcggtgccggaaatgatacgattattgcccgtgtagacggacgttccaatactcgtgatggtgttaaagcgaagttggctgttgatatgaacaaggttcatatttttgataaggaatcggaattgagtattctggttggcgaataaaatttgcctctggaagagagtcgcagttttccccaagcggagaactgcgactctttttgtatatcgcatacggctactagcttcggcattgcattcattggaaaattccgatacgatgggtacaatggtacaggtctagatgcaggcaaggtttgttggcaggagtcctagatgggatcaacccagctgtcggaatagagttagcctggaaccatagtgttaaatcaagtggagtgtggattgatgcagtgcagctagactggcgttgggctgtatggttaatagggtaaagctacataaatcaaatgacgtatagaatccggtgttgcagatgaaggggagaatacaatggctaaacaggtaaaggtatccgagcttgtacagcagtttcaaatggaagttatttctggtgaaaaaggtctgcgaagactgatcacagtggatgatttgaatcgcccaggtctggagatggccgggtattttgaatatcatacacaggagcgggtacagcttctgggaaggtctgagttggcttttctggggatgcttcctcctgaggagcgacgggatcggatggagcgtctgtgtacagagctgactccatgtattatcatcacacgtggtctggaggtaccggctgagttagtggaggcgagcgcagaacgagatattcctgtactgcgtactaatatggcgacgacgattttatcaagccgaattacaggctttctcgaaagaaagctggctcctacggcgactatccatggtgtactatgtgacgtgtatggcgtgggaatgcttatcacaggaagtagtggaattggtaaaagtgaaacagcactggaactggttaaacgtggacatcgcttggtagcagatgatgcggtagaaattcggcaaacgtctgattttcagctgcatggcacagcacctgagctgatccgtcacctgttggaaattcgtggcgtgggcattattaatgtgatgacgctgtttggtgctggtgcagttcgtaataacaaacggattacattggttgtccgtctggaggcatggcagcaggacaagcagtatgaccgtcttggtctcgatgaagaaacgacacgcattattgatacagatgttccactagttacaatcccagttcgtccgggccgaaacttggctgttattatcgaggtggcggcgatgaactatcgtttgaaacaaatgggcgttaatgctgccctgcaatttacaaacaagctgactgctacaatttctgaagatatggaagagatggattaaggtttgttcgtttgcaaggaagaacgaggagtgagagaaacatatgttaacggcaacattactgctgaatccgatcgctttttcaatcggggcaataaaggtccattggtatgggcttattttggggctggcggcgcttgtgggtttatatcttgccatccgtgaaggaaaaagattcggtattccgcaggacttttttatggatatgctgcttctgggtgttccatcagctattattggagcgcgtatttattatgtagccttcaaatgggaagactaccgagataatctatgggatgtttttaaaatttggaatggcggtattgcgatatacggtgccttgatcggggccattatatgtgcggtcatttatttccggtataaagggtataacttctggcgtatcgctgatatttgtgcaccaggtctactaatcggtcaagcgattggacgctggggtaattttgtcaatcaggaagcttacggtggaccgacggaagagacttttttgcaaaatcaactgcatctgccggacttcattgtgaatcagatgaacgttaacggggtgtttcatcaccctacatttttatatgaatcactgtggagtattgtaggtgtgattttgctgctcgtcattcgtcgtatgaaatttgtacgtgcaggcgaaatgtttgcgttttacttcatttggtactcgattggtcgttttttcatcgagcgtgtacggacggacagtttggcttttcagggaccggattggctcgcttcctttgtaaatgccctgtggtctcctatggtatggttagggtttgaaccagggcatctggacccaagttacggtaacgtacggatatcacaattgctgcctattttcattgtggtggctgccgtgattttcattttggttcgtcgccggaagggcacatctgttgctcggtatagcgatccgattatctccagtaaagcggggattgatcaggtacctgacgtgacgccagaacaggtatcccgtccaggacaagatgcggttcctccaacagctacggcggataagctacctaaggaagacacggacgaggacaagaaggagcatctatgataaatacgattttgtttgatttagacggcaccatcatggatacgaatgagttgattatcagcacatttctacacattttgaatcatccggatgctgatccgctgacgcgggagcatattattcctcatatgggtggaacgctggacgatcaactccgtactttttcgggattaacggatgtatctgggctagttaaggactaccgtgcttataatcagattcatcatgatcaaatggtgaagccatttccatatgtcattgaggttattcaggagttgcgtgcgagaggaattaagctaggggttgtgaccactaaaatacgaccatccacgatacgtgtacttaatctgttcaatctgacttcctctatggattatattgtgacggtggacgatgtagagcatcctaagccacacgctgagccagtccttaaggccttagcaggcttgaatgctgaagcaaagcatacattgatggtcggagacagttcttttgatattttgtcagctcaggcagcaggtgtgaaatcggctggtgtagcttggtcgctcaagggcgaggaaactctgcgtggatatgggcctgactacatgttgcatgatatgcgggatttgctgaagctggagcttcaaggtgtcaatgtatcgtgagaaaggtgaaccgctattctgtagaaggtcccaatgcgttgtggcagatttatcggacggtgagccgctggaaaggcattaagaactttatttttatacagattgcccggtattgtcctgtgctttctctgaaaaacgtcatttaccgcagaatgctggggatgaaggtggggcaacatgcggccttcggcctgatggtgatggtggatgttttttttccggagcatattacgatagggaacaattcggtcattggatataacacgacgatactggcgcacgaatatctcattgaggagtatcgtatcggtaaagtggtgattggtgatcatgtgctgatcggcgccaacacaaccattctgccgggtgtcaccattggtgacggagctatcgtagcggccggagcggtcgtgcataaagacgtgcccgcaggtgcatttgtgggaggcaatccgttgcgtgatttaagacgttctggtatggatgagtagtaaatagcactataaggaaggccccttatgtattaaggggtctttcttgtgttgtttttctgtataataagtggggtaatgcatgttaattatgtttaaaaattgttaaaagacatattagcaaggcgatatgggagcgtgttgatttggtcaaaaaagaacgtataccagagcttgatatttaccggggaatattaattgcagccgttgttaccattcatgcgacttcaatggctttaattgatgcgcgtcattctctattgttttatccttttttatttttaaatgtgtttagtagctttgcagtgcccgtatttatttttgtgagcgggtttgttttattttacaattatatcgataggccgcttcgtggtaagaatatgcttgtgtttttccgaaaaagactgatgtttattgtgttaccgtacgttttgttttctcttgtgtattatttgaccttggtaacacgcgggttgatgccgctcagtgatcttccgctcgtgctgttaacgggaaaggcgtacacacatttgtattatgtcatcatcatcatccaattttatttggtcttcccgctgttgttgtggggagtgcagcgcttatgtcattggatatcgagtccacggagagcagcctgtatcattttggcagtagggttagtcattcaatgggggtttgtattgctgaacaaatacgtttggcaagaggaaagaggaagccttgcgattacgtatatcagttattttgccttgggcgcagctgtagcgattggatatgaagggtttaaaaagtggctttttccagtgtcaggtacagtaattagacgtggtcagttgatcagttggtgggggttgtgggcggcttggctactcgtgggtatagcttatgtacaaatatggtttatagcatatcgcaaaggcatctatgcagactcactgatctatgaactactccgtaatgcacatgccctcgtatctgcattagtgttgtttcagtgctcggttttattatatcgtcatactaatgataggctgcgaatgttaatcagttggttgggggcatgttctttcggtatttatttacttcacccggcgttactgcgggtgtatcgcaagttagatttgcatggaacaccgatagaatatatcttctccgttgccggtggatggttgttggcgctgtttggctcatggctgattgtgacgctgtgttttcgatatgttccatttgcatggatcggtttgggcacggttccgaagtttcctttccggagtaaagatgaacaggtgaatagataaatattttaatttggactgttagcttaaagctggcagtcttttttttgagtatagaatttataaattttcagtagaactgaacaactcaatatgcacaaaaaaattaacgtaggcgcggtcttgctccgtgaaaatacattgatagatgtttttcatataggattcatgtattttgcattggataaaatatagagaggggcagcagcttggctaatctgtaaaaaagggctgcgtcgttcggttgacgttcacaagtagagcatgataatatatcgaatatactttagtttgttagcactttaccatgataaagatattgtgaaatcatgaggtgatagagatgtctaagccaaaaggattcgagatccctgtaggggttcgagattatcttccgcgtgcagtgtcgaagctgcgggccattgaactgaatgtactcgaatgcatggagcgttggggctaccgccagattatgacgcctacgatggaatactacgatacggtgggagtggctagttctacttccgatcggaagctgtttaaattactcaataaccgggggaccacgttggtgctgcgatcggatatgaccgctccaattgcacgggtggtatcttcgttgctaaaggaagaggaagtaccactccgactttcctatcacgcaaatgtatttcgggcgattgaggaagaggcaggaagagaagcggagttttttcagacgggtgtggagctggtgggtgatgattcgcctgaggctgatgcagaagttgtagcattggcaattgcatcattacaggcagcaggggtgacctcttttaaaattgcgatggggcatgtgggattcctgaacggtttgtttgaggaaatcattccaggccgccaggctgaacaacaagcgctaaaggaactgttgctcagtcgtgatgtagtgggctaccgaacagcgattgaagctttgggcttggctcccgaacaccgggataaacttgaggctattctgcggctgcgcggtggaaaagaaatttgcgaacaggctacccgtcttagtatggagcagcaaacgattcaatccattgcacatttgtgcgaggtatgggaagtgctggaggcttacggcgtatctgagcatgtgttaatcgaccttaccatgatcggggatttttcatattatacaggaatgacttttgagggctatgcggcggagattgggttcccggtatgcaacggggggcgctatgacaatctgcttcagcagtttggtcgatccgtacctgcaacgggatttgcattgaagacaaaccggatcgtcgatggtgtggatggtatccaaatggagacgaagcttcctgtacttatccgctatgacgaacagggacgccaagaggcgttatccgtagcggcagagctacgcgcaacaggtcttactgtggtgacagggctcacgggtggcccggaagaccgacgccgtgagcagcagggcctgtacgcagaggtatacagctatacagctgaaggaagacagccagtacaaaggagggaattgccatgacggaaacattgaaggtagccatgccaaagggacggatttataagcaggcttctgagctgtttcgccgagcaggggttcccattccgctggatgtggacgagacgcgcaagctggtcatcccactgcccgagctgggtatggaatttattatggcgaagcccgttgatgttcctacgtatgtggagtacggggcggcggacatcggcattgtgggcaaggatgttttgctggaagaaaacaaggatgtgtatgaactgctggatctcgggattgcccgttgtcggatgtcggtgattgctttaccagattggcagccaggtattcgtcagcgggtcgctacaaaatatccgaatgtggcttcccagtattttcgggagcaaggccagcaggtggaggttattaagctgaatggctccattgagctggcgccgttaattggtctggcagaccgcattgttgatatggtagaaacggggcagaccttgcgggagaatggattggtcgagcaaatcagcatactggatattaccagtcgtctgattgccaatcgggtcagctaccggatgaaaaacagctcgattcaggcattgtgtgatcgattgcatcaggtgattccaaatgcggtggcaccccgggagtaaatggactaaaggaataagccaagggttaaaggggcattctgcaagctgcaagtaagggggaatggacaaatgaagatcgtatcagcccgtgatttcagtctccaacgggaggtggattacggcacgcctgagcaaaatgaggctgtgcgtaccattattcagtcggtacgccaagagggggatgaggctgtcctgcggtatacgcaatcgtttgatggtgtatcgctgatagcagagcaacttcgtgtgacggaggaagaattgaaggcggcatatgataaggtagagccttcttttttacaggcgattcgagaggcggcggataatatccgtgcttttcacgtgaagcaaaaacgtaattcgtggatggacttacagccagatggtagcttgctcggtcaaattatccgaccgttgaaacgtgtaggcgtgtatgttccgggcggtaaagcagcctatccatcctcggtgctgatgaatgttattcccgctcaggtggctggtgtaccggagattgtcatggtgacacccccggcgacgggcggcaaggcagggatagatccatatacactggtggctgcggcagaggctggtgtaacggaaatatatagggttggcggagcgcaggcgatcgcctctctcgcttacggaacacatagcattgagccagtcgataaaatttgcggtcccggcaacatttatgtagcgttggcgaagcgcgaggtgtatggcgcggtggatatcgacagtatagcgggaccaagtgaaattgttgtgttggctgacgatacagcaaatgcctcttatgtagcagctgacctgctttcacaagcagaacatgacgaaatggcctcagccatactggttacgccttcgcaacgcttggccgaagatgtatcaggtgaagtacagcgccaattggcggagctgccgcgcagagatattgctgctgcatcggtggaggcatatggggctatcattgtcgtcgacactttggaagagggcatccatattgtaaaccgactggcgccggaacatttggaaattatgacagagcagccgatggagcatgtgggtctgattgaaaacgcgggagctattttcctaggagcatacagctcggagccagtaggcgattattttgccggacctaaccacattatcccgacgaatggaacggcgcggttttcttcgccagtggatattgatgattttatcaagaagtcgagtatgatctattacagcaaggaagcactgctgcgcaatggagagacgattatgcagcttgcccgccatgaaggactggaaggacacgcacgggcgatacaagttcgattggacaatgaaaagaaggcggtggatggcgatggggaacgaaaataacgtaacagaacgtacaggcagcgtcagccgaaagacgaacgaaacggatattcagctatcttttgcagtagacggcacagggcaggctgagattgaaacggatgttccgtttctgaatcacatgctggatttgttcaccaagcacggacactttgacctgaatgtacaggccagaggggatgttgatatcgacgatcatcataccgtagaggatattggtatttgtctggggcaaaccttgctggaagcgttgggtgataaaaaaggaatcaagcgctatgccagcgtctttgtaccgatggatgaggcgctcgcgcaggttgtcattgatctgagtaaccgccctcactttgagtatcgtgcggagtatccgtcacagcaggtagggagcttttcgacggagctggtgcatgaatttttgtggaaatttgcgttggaggctcgcatgacgctacacgtcatcgttcactacgggcaaaatacccaccatatgattgaggcggtgttcaaagcgctgggacgtgcactggatgaagcgacatccattgatccgcgggtgacgggagtgccttcaacgaagggagtgctgtagtccatgtccattgctattgtggattacggcagaggcaatctgcatagtgtgagcaaggcggttgaacgtcttggctatgaggctgtagtaacgggagatgcccaagtgattcgttcctccagcggtgtgattttgccgggtgtaggggcattcggggacgctatggagcatttgcgttccagcggattggatcgggtaattcaggaggttgccagcgctggacaaccactgctcggtgtttgtctaggaatgcaactgttgttcactcgtggtgaagaatacggcagtcacgaagggcttaatattttaccaggcgaggtcgttcgatttgctcctgatctgggggttaaagtgccgcatatgggctggaatcgtctgtgtatgactcagccggatcacccgttgttacagggcttggaggaaggacatgtgtattttgtacattcctatcatgcgaagccggaggtcgaaagtgacctgctggcggtgaccgattatggtgggcccgtaacagctatcgtaggcagaggccatgtatatggcatgcagttccacccagagaaaagcggggagatggggatgcgactgcttcgtcagtttttggaactagcggaagcggaaaagcgagcgtaaacgattcatgggtctgcaattggtggtacgccaactttggtcgttgattgatgtaatggcatatagatgttgaatagctcacaagggggtcatactttgttcacgatatacccggcgattgatattcgcgatggcaaatgtgtacgactggtacaaggagattataaccaggagacgatatacaacgaaaacccggtggaggttgcccaagaatgggagcgtttgggcggctcttacattcatttagttgatttggacggtgctaaagcaggtcaaccggtgaacgatgagcttattgggcgcattgcttctgcggtgcaagtgcctgtacaagtgggtggcggcttgcgtacacgtgaacatgtagagcgactgttgtcgctgggcgtgagccgtgtgatcttgggtacggcagcgattgaggaccgtgcttttacggaagcagtattgggtacctacggtgatcggatcgccattggtctggatgcacggaatggctatgtggccacccgcggatggcttgaaacctcggaggttcgagcggacgaattggctgctgagttggcctccaagggagcggaaacgttcatttttacagacatttcccgcgacggaatgatgcaaggcccgaatgtggaggcgatcgtagcgcttgcgaaaagcagtggacgaaccgtgatcgcttccggcggtgtcagcaagatggacgatctaatcacgctgagcacctatgcgaaagagggtgtaggcggtgctattgtgggtaaggcattgtatacgggcagcattgatttacaggtcgccgtacaagctgtagcaaaggcatagggggagtaggcatgctggctaaacgtattattccctgcttggatgtaaaggatggcagggtggttaagggcgttaattttgtgaacttacgcgatgcaggcgatccggtggaattggcggcactttatgatcgagaaggggcggacgaaatcgtatttctagatatttctgcttcagttgaagggcgtgccaccatggaagaagtagttcgtcagacagccggggaaattgccattcctttcaccgtaggtggcgggatatctcatgtcgatgatatgaaacgcattttgcgtgccggagctgataaaatcggcgtaaatacggcagctgtccgtaaccctcagctgattgcggagggtgcgcgcagctttggctcacaatgtatcgttgttgccattgatgccaagtacaacgaggcgtggggcgagtgggaagtgtatacgcacggaggccgcacgccatctggtatccgagccttggcctgggccaaggaagctgaacagttgggagccggtgagattctgctgaccagcatgaatgcggacggaaccaaggacggctttgacctgccactgacttccgcggtatcggataccgtcgggattccagttatcgcttctggcggagcaggcaaacaggagcatttctatgacgtgtttacggcgggcaaagcggatgctggattagcagcaacgatttttcattataaagaaataggaatccctgagctaaaacgggatttgaagcgcagaggagtggagatacgatgagcaacgaattgaaccaacagctatctctggagcagatactggataatgtacgctggaatgaggcaggacttgtctcggcgattgtgcaggatgatgctacgctccaggtgcttacgctggcctacatgaaccgcgagtcgctgaaactatctttggagtcgggagagacctggttctggtcacgttccagacaggagctgtggcacaagggggctacttcggggaatacgcaaaaaatcacctccatccagctggattgtgacggtgatgccctgttggtacgtgtcattccgagcggtcctgcctgtcatacaggagcaacgagctgtttttttcgtaatatttccgcgccaggaacggctgtagcacctgttgcaggaaaagcaggagaccacacgttggtaaatgatgtttccagtgcttcagcagaccgctttgaggtacttgcccagctggaggcgattattaaggagcgcgaagagacacgtcctgaaggggcctacacgacttatctttttgataaaggtgtagacaaaatcttgaaaaaggttggcgaagaagcatccgagacaatcattgccgccaaaaataaagataatgacgaactgcgcctggaggtcagcgatttgatttatcacctgctggtgctgttacaggaacgcaagctaccgctcgatgacgtgctggctgagctgaatcgccgtcatgaacgtcctcgtcgtgattagtacggtttgttgtagtgttgaaagggggagggccgcatgaaaattgactatcatacgcatcacgcccgctgcgggcatgccatagggagtctggaagagtatgtacagcagggaattcggctagggctggatcagctcggcttgtccgatcacatgccactactgcatgtaaaaccggctgactattacccggaaatggcaatgcctatggaggagctgccccgatacgtggaagaatgtttggaactgaaggaacgttttaaagggcaaattgatattcgtgttggcttggaaggcgactacatcgagggctgggaacgagaaatcgaagacatcatcaccgcgtatccctgggattatgtgattggttccgtccactttctcggtgaatgggatgtcacggacttccgtcaggtacaccattgggaaggcaaaaatgtgcttgaggtgtaccgcacgtattatgatgcggtttccaaggcggcagctaccggtttgtatgacatcatgggtcatttggatgtcattaagcgcttcggctatcatccgaggccggaggaaatcgaggagctacgtgaactggagcgtgccgcaatttcagccgttgcccgtagcggtcgggcgatggaactgaatgcatcagggctttcgaagccctgtgccgagatgttcccgagccgccgcatgctggaagaagctttttcgctaggcatcccgctgaccgtaggatcggatgctcatgatccggcgaagctgtccgagcacttggagaaggcacgcgcgcttctatatgaagtcggctatcgcgagcttgccgtatttcagcatcgcgagcgctcgctggtgccgctgacgctttaattattacgtttattgggtctaagtatcatttccagtggttagccgaacgctccctatttatacagggaaaaagcgctcggctatttagcgtattcttatatacatatttataggtatacaagagtgtatccgatttttggaatgaggcaggatcgactgtcaagtcgttttgaagttgtggtatactgaagggtatgaacatgccagttacttttaaaggaggtgccttggttatttatgaaagggaaacatctgcgagtatcggaacctagccctaaaattattgctttgcgtttcgacgcatctttcttttttgagaaagctgtgcgctcgcttgatcgcaatcattatgacaaggcattgaaatattttcgcaaagccgttgaatatgaaccggataatccggtgaatcattgcaatatggcgggtatattatcagagatgggggattatgcaggttcgaatgagatcctgtcctctgttctgagtgacgtagactcgtcgatgacagagtgttatttctatatggcgaataattacgctaatatggagcagtttgaagaagcggagaaagcattggtcacgtacctggaggaggacgaagaaggccagtttcttgatgaagcggaggaaatgatggagctgctctattatgagctggaccgtccaacgaagctgaaccgcattaaggcccggcagggagtagtagagcatgatcaggctcgtgtcctgctggaggaggggaaatttgctcaggcagcccagttgctcaagcaaatttcagaggaacaaccggatatgttcgctgcgcggaataatctggcgctggcgtattactacatgggattgttccaaaatgctaaggctaccattattcaagtgctggaagatgagccgggtaatttacacgcattgtgcaacttggcgatcttttatcagcacgagggcggcggcccggaattggatcgtctggtgcagactttggcggttactataccgtttcaggaggagcaggtattcaagctggcgaccactatggggattctcggacgccatgaggaggcctacagacatttccgcaggttgcttcatggcgatggagagaacaatgcggatgcttctttgtaccattacacggcggtagctgctagcaataccggaagatatgcggaagctcggcggttgtggagtcatttgcaaaagcaggatgcttcctcggaagttccgcggtttttcctgtcccgactggaggaactccagcaggagggtacaccgctgcaagtgctcagctatcattatcatctcccgtttgaggagcaattccgcatgtgggagaagtttggtgctgaccaggtgcctgacagtatgaagaaggacccgctaatccggtcatccttcttctgggccttgcgccacggggatcgggcgactcagcttcaggtcattcaggcgttaagcttgatcggtgatgatgaggtgcgtcaggcactggagtccttcgtagaagacccggaccaggaggatgagctgaaacgccgtgccttgcaagtattgcaagaactggcggagcagggtgagcagaaaatgtacccggaaacggaacattctgatcagttggaggttgagaacgatccgcatacaattgaaggtggtgtatctgcttccccggtcgatccacaatggcaggcagtgctggataaggtactgaccgtcatgagcaagccatcagatccggccatgcagcacgatttgagatcgctttggctggagtatttggatcggcttgccccggaagttccgatggttcagcacactgagggatgggcagcggcgctggaatatttggcagctaaaatgcatcatcattcagtcacctatcaggaagtagccgatcgttatggtatttccgtatcgaccgtaagccgctatgcacgccagattgacagcgtgtgtggtatcaaacagaagctgaagcagccgctctccacgtttaaaaagcaggtctgagacctgctccaaacatcacttaaaggaggcaacaaacgtatgtataaatccataattattggtacaggtcctgcaggctacacagccgctatttatttggcacgcgctaacatgaatccgctgatcattgaagggatgcagcccggtgggcagcttactacaacgaccgaaattgaaaatttcccgggttttgagcaaggtatcctcgggcctgaactgatggataatatgcgcaagcaggctgaacgttttggcgctgaatttacttccggttgggttgaggaagtggatttcagcaaacgtccttttaaagtgaaggtagagggtaaaggcatcattgaggcggagtcggtcattattgctacaggtgcgtccgccaaatatctaggcattccgggcgagcaagacaatgtaggtcgcggagtcagcacgtgcgcaacttgcgatggcttctttttccgcgggaaaaagattgtcgtggttggcggtggcgattcagccatggaggaagcgagcttcttgacccgttttgcttccagtgtaaccttggtccatcgtcgcgatgagttgcgggcgtccaaaattatgcaagatcgcgcgcgtgagaacgaaaaagtacattgggcattaaaccggactcctctggaagttgtgacgggagaagctggtttaaagggtttgaaggtacacaataatgagaccaatcaggatgagctgattgaggtagatggcgtattcgtagccatcgggcatacaccgaacacaggtttcctgaacggacaaatccataccgatgaacacggctatattgtggtgaagccaggcacaacagaaacgaatatccccggagtttttgcctgtggggatgtacaggataaccgttaccggcaagctattacggctgcgggaacgggatgtatggcggctatggactgcgagaagtatctcgaaggcagtgctgttcacgactggagcgaaacactggatcaataaaagagtgactatagtacacaaaaaggctagcaggagagcgaaggaagcctctgttatgccgtatcttttgttcaggaagagaaagcctgctgcgtttgcacaggctttctcctttttatgggtgcatgaggttaaaagttccgctaatcgtacacttttcaacaaggaagtgtccttgaccgtaacgggggcttcaattatagttggaacgtaggaatactattatgaagtaggaattgtaatcgtatatttcataccaggtttttaagtaaacacaaaggtggcttggaacatgtctgaaagtatctatgtaggtgtcgatttgggcggtaccgcgattaaagtcggcatttgtaatgaaaacggacagcttttgcacacatatgagggaccaaccgaaaccgataaaggtgtagacgttgtcatcggtaatatcgaaaaatatgtgcggcatattgttgagcaatctccttatgagtgggatcaactaaagggtgtcggtgcaggcgttgcaggttttacgaatgttcgtgatggtattattgtcctcgctcctaatattggctttcgtgacgtaccgatccgtgcgctcctagagaaccggattggcaagcctgtgaaaatagacaacgatgcgaatgttgctgcgctgggtgaggcttgggctggtgcaggcaaaggcatagaaaactgcgtatgctataccctgggaacaggcgtaggtggcggtattattataaacggtaaaatataccaaggttcttcgggcatggccggagaaattggccatatcagtgtcgtacctgatctggaggctattcagtgtgggtgcggcaaaatgggttgcttggaaactgtatcttccgcaacaggcatcattcgtatggccaaggacgctgtggaacgtggcgaccggacctctctggcgctggaagatcaaattgcagccaaggaagtatttgatgctgctaaagctggagatgaagtcgcgctgcgtatcgtgaaccgggctgccttttatttggggaaatccatggcagcggttgccgctgtgcttaatccagagttgtttattataggcggcggtgtttctaaagcaggcgactttttatttgaagagatgcgtcgcgtatacgccaaactggcacctgaaccgcttcaaaagggtgtatatatcgtaccagcggtgttaggcaatgacgcaggtatcgtaggggctgcagggttgctgctacgctcctgattcacaggttattgataatacgggtactggtatagagcgaagaagcaaaaggagagggaagtccatatgacagacaacctaaaaaatgctgcgccgtgggcaacgctcattattattacggggatgtcaggcgcaggtaagaccattgcggttcagagcctggaagacttgggcttcttctgcgttgataatttgccccctgtactgattcccaaatttgccgagttgattgagcagtcgaacggtaaaataggcaaggtggcactcgtaattgatttacgcggacgagaatttttcactgccttgtcggaatccttgaattatattaaagatcattttacgattcattgtgaaattttattcttaaatgcgaatgatggcgttctcgtacagcggtataaggaaagccgtagacgtcatccgttggctccagacggcatgcctttggatgggattcggttggagcgcaagatgttggaagagctaaaaagctcagctacacaggttattgatacaagtgtgatgaagcctgcaaccttaaaggcgaggattatttcacgattttctcatctggagagcagtatgctttccgtgaacattacttcttttggcttcaagtatggtattcccattgatgccgatcttatattcgatgtgcgcttcctgcctaatccccactacgtggaccaactacgtccccacacgggacaggatagcgatgtatatgattatgtcatgaaatggcccgagactcaggcattcttgaccaagttgctggatatgttacactttttgattccgcaatatcgcaaagaaggcaaaagccaggtcattatcggcattggctgtactggcggtaagcatcgttctgttgcaatatcggagtatttaggaaaaatgctgggtgccagcgagacagaatctgtttctgtttcgcatcgggatgctgatcgggaccggcattaatgaggtgaaatcatgaaagagaccggatcacaacgggagcgcccacgtattgttgttatgggcggcggaaccggcttgtccgtcatgctgcggggcttaaagcaaaagccgctagatattacggctattgttacagtcgctgacgatggcggaagttccgggattttgcgcagtgagctgcagatgccccctccaggggatattcgcaatgtgctgactgccttggctgacgtggaaccagtgatgtcagatatgctgaaataccgtttcggtgcgggatcaggattgtcaggccatagcctgggtaatctgattttagcagcgatgaccgatatatcgggagatttcgtaacggcggtgcgtgagcttagccgtgtatttgctgtccggggacgtgtgttaccggcagccgaggaaggcgttgtgctaagcgccgagatggaggatggcacggtgattaccggggagtccaagatcccggaagcgggcggacgcatcaaacgcgtctttcttgaaccgactcacgtggagccgttgcctgaggctgtagaggccattaatgaagccgatgcgattttgattggccccggcagtctatataccagcatattaccaaatttgcttgtacctaaactcgctgaagctgtagtaaaatcagacgctatcaaaatatttgtctgtaacgttatgacccagcctggggaaaccgatggttatacggtaggagatcacctgcaagctatttttgagcatgtagggcatcatctcttcgactatgtcattgtaaataacggagaaattccaccccaagtacaggaaatgtatgccgagcagggagccaagccagttcaagtagacatgggcgagctgaccgaccggggatataaagtggtggcagatacattagttctgttccgcacgtatttacggcatgatgccgacaaattgagccagcatatttaccaattggtacaaaactggatattaagaaggaggtgagtcccttgtcctttgcggcacaaacgaaaaaagagcttacgatgattgaaagccagtcctgctgtgagaaagcggaactatctgcacttatacgtatgctcggatccgtacaactgtcgaataaaagggtgatattggacgtgtccacagaaaatgccgcgattgcaaggcggatttactccttgatcaagaagcattttcaacttcatatcgaactgcttgtacggaaaaaaatgcgcttgaaaaaaaataatgtgtacattgtccgtattcccaatggtgtgcagcaactgctaaaggatctttatatcgtcacagaaggtttcttattcactgacgggattaatcgggatatcgttcggaaaaactgttgtaagagggcttatttgcggggcgcctttatggcaggtggctctgtcaacaatcctgaaggatcgtcttaccaccttgaaatttcttcgatgtatgaggagcattgtcaggcactcgttgatcttgcgaatgaatttcatctaaatgctcgctgtattgagcgaaaaaaaggttttattctctacatcaaggaaggcgagaagatcattgagctgcttagcatcattggggcgcatcaagccttgttcaaatttgaagatgtacgcattatgcgtgatatgcgcaattctgtaaatcgcattgtcaattgtgaaacggctaatttgaacaagacgatcggagctgctgtccggcaaattgagaatattaagttgctggagagggaagttggtttggagaccttgccggataaactgcgagaagtggcagaaattcggctcgctcatcccgatttgaatttgaaagaagtcggggaaatgctcaaaggggtcgtgagtaaatcgggtgtaaatcatcggcttcgcaaaattgatgagatggctgacaaaattaggggcgaaaatggcctgattccgtaaaaagagtgtccatggggcttttagccccggtttttttagttttttttctagtgtctgtcccgggttaatgttataatgtgataaataaaatggagtaagtagtgtccagatttatttgatgagggggtaagctgacatgtcaaaacatccggtagtcgtacgcttgaaaacaggactgcacgccagacctgctgcgttgttcgtacaggaagcgaataaatattcatctgagatttttgtggaaaaagaagacaaaaaagttaatgccaagagtatcatgggtattatgagtcttgcgatcagtacaggtactgaaatcaatattagtgctgaaggtgcggacgccgaacaggctgtaaacgctttagtaagtctggttagtaaggtagagctggaaaatcaataaacaaagatttgctttgtaatatggtgtatgctcttagtgaaaagccccctttggggcttttttttgtatccagaaaaaatcttcgaacgctcctccgttaactgttctatgtgtggatttgttgaattccatggtcatgctctgtttcggaaatatgtatgcttggctgcaacctttttccgtcatttccgtctggaaggtacaaacatttacaagaaagaggttgaattcaatgagactttggacaaaaacagtagccacggcagttctcgcaggagcattaatggcagggggagtagcaggaggattatggacaggggcagatcgtgcctatgctgcgtcaacagcttcgacggtaaacggtgtaattaatgtgactggaagcggggaagtattggcgaagcccaatattgcttatctctctatcggtgtacaatcagaagggaatacggcagccgctgctcaaaaagccaatgctacaaaattgaacaaggttacacaactgctgaaagaaaagtggagcatcagcgcagatgacattcagaccagccagttttatgtacagcctaactacacctataacgaaaaagaagggcaaaagctcaaagggtacactgcgaaccatacactttccgtcaaataccgcaatttggataaaatcggtcagttgttggatgaggcgaccaagtccggagccaataacgtagataatgtacgtttttccgtggaaaatccttcgacttatgaagaagaagccattactaaggcattgggaagcgcacaatctaaagccagtgctgtagctaaagcagccaaacgcgggttaggtgcccttgtgagtgtgacggtagatggcggagaagcacaaatctttacacaacgtgaaaatgccatgtcaaaatcgctcttggacgtagctggtggcgggacagagatacaatcggggcaagtaacagtgaaagtacaggtgtcggctcaatacgaaatgaactaatatagatcatcaaacgaagccacaagcggcctgcatcatgtgcaggctggcttgctggctttttttgtataccgaaacctttttgtaatgagtctgtcatagctaagggttattaggtgtacatattgaaatcggagagtgtacagattgtaaactacatacaatagggtatagatataataataaaagtagttatcacacatagacaatacagatcattaacaggaggaatacttaatatgagtaagcatgcaaaaaaatggggttcagcactgctggcagcagggattttagcaggagtcgcagctgttcccgtttcctatatccaggcagcatcgaccaaacaagcgacaacacagcaaccaggaatcaccatccaatggaatggtaaaacgttgcccgctaaaggtgttcaagtgaacgggagtacaatgattccggtggccgcactgcgtgacagcctgggaattccagtaagctatgatgcgaaaacagcgacatataccgtaggtagcgggtacaataaactttacattatggcttcttcctcggatgcctacgtcaacgtcaatggaatcaatacacgtagcatggatgccaaacagatcgctgggaagctatacattcctatgagtctgctgaaagactatctaggcatagatgctcaatggaatgctgctcagaaaacagtaacgctgagtaaaagccagctaaatccgatcaccattgcgtctcaaacacttccagcatcgagtaatgcgaaggtgtcctacaaaattaagtacccgcaaatcaacggcagccaactgaatcctgagtctcaacaggccattaacaatgtgcttaaaaagcatgcagagggtatattggcagcaggtaaaaagatgatggctgagggagaggctacaacagaaagaccgtatgagttcggaaatgattttgcgattgcctataacaaaaatggtattctgagtgtgattatgcaggattactcgtatacgggtggcgcacatggcatgacggcacgtaaaggatatacgttctcgctagctgatggtaaactgctgcaattgtctgacgttttgaaggcaaatccgaactacaaaaagttcctcaatgctgatttgaagaaaaaaatcgatgcgcttcaggctggcgaaggattcggcaaatttaaagagctggcggcagatcagaatttttatgtgacgagcagtggagtaacaattgtgtttgatttgtatgattatgcgccatacgcgtatggaattccagagttcacctactcgttcggtcaactgctgccacaaggcggaaagccttttgcgggacagcgtgaatagtaggagtaaataattccaattgtctataacctaaaaaaacaataaagcaaaaaaagctgcctaccggataagaacatccggggcagctttttcatttaccagctatcgagaggcgaatttcttctcttatacaccttctggagaggagctagttagcactttatcaataataccgtattccttggcatcatcagcggacatgaagtagtcacggtctgtgtctttttcaatgcgctccagtggttggcctgtgcgatctgcgagaatgcggttcaatttgtcacgcattttcagaatgcggcgtgcacggatttcaatatccgttgcctggccttgtgcaccaccgagtggttggtgaatcataatttcactgtttggcaaagcgaaacgtttacctttggcgcctgcatttagcaagaacgcgcccatggaagccgccatacctacgcaaatcgtagatacgtcaggtttgatgtattgcatcgtatcgaaaatggccataccagctgtaatggaaccgccaggactgttaatatacaagtgaatatctttttcaggatcttcggcagccaaaaacagcatttgcgcaataatagagttggctacaacgtcattgacgtccgagcctaacaaaataatgcgatccttcaacagtctggaataaatgtcataggcgcgttcgccgcggttactttgttctactaccataggaacatagctcacgtcaaaaaacctcccttaaatatcgttagtggatttggtggacatgccgattacacgtcccttatttataaactgttaccgtattaaccacatgataaacaatttcaaacaaaaagtcaaagaaagtcaaactaatgattaaaaaaaagagccctcagcgctcttattggttaaaacattatatagaagcatttatgcgttcatttaaaatggcgcgcccgcgaggaatcgaacctcgatctcaggctccggaggcctacgtcatatccgttggaccacgggcgcatagttcaatcaatgcaaacaactaactaattaaacagctaattggaaacaaagatgattatatgatatacagcagtgaattgcaagcttttattaaatgcgcatattcaggcaaatggttgagaaatataggttcagatagacttgcatgtggagcaaatattggttaagatatacgtgggacttaaaaagttatcccgggacgttttaagaccagttagagatagagcattagagacagaacttagaagtgtgcgggagtggaaagcatgcgaaagatattagaaatacagaagcagcttctgcccgacctcatggatgttttgaaaaaaaggtacacgatcctgcatcagattatgctgtccgatgttgttggacgcagaacactggcagcttcactgaacatgactgagcgcgtgttgcgcgccgaaaccgatcttcttaaagctcaagggctaattgagattgagagtgtgggcatgaaggtgagcaaagcaggactggatctgctggaacagctggagccgattgcgaacaacttgttcggcctgtcccaattggaggaccagattcgtcaagcctatggtttgaggaaggtggttgtcgttccaggggattcggatgcttctccgttaacaaagcaggagctggggcgcgctggagcaaaagcgttgctgagtgttatggacgacgaggatgtggtcgctgtaacaggtggcacgacgattgccgacgtggcggaacaactggcactaccttctaatggcccacttaagggtgggtggtttgtaccggcacgcgggggtttgggagaaagcatggaaatgcaggccaacacaattgcttccacaatggctcgcaaggtaggcgctcaataccgtctgctccatgtaccggatttgctcagcaatcatgcttacaactccttgcttgaagatacgaacattcaggatatattgaacctgattcgcgagagtcgtatcatcattcacgggataggcaacgccatagcgatggcacatagacgtaaacttgatcccgaaacctttgctcagatcagcagtgagggggccgttgccgaatcgtttggttattactttaacgaagatggcgtcgttgttcacagaatgctgacgcttggacttcgattagaggacatcaggcgtaccgatacggttctaggcgtagctggaggcaagagcaaggcggccgctattcatgcggtactgcgtttcgggcaagaagacattctagtcaccgacgaaggcgctgctgccgagattgtaagtcattacttaaatggttaagatggatttatgaatggtgttgtcttgacgggctttcgggtctgtcttgaatatataaaactaaactaaacgaactttgggaggaactcactcatgacagttaaagttggtattaacggtttcggacgtattggacgccttgctttccgccggattcaaaacgtggaaggtattgaagtagtagcaatcaatgacttgacagattccaaaatgttggcacatttgttgaaatatgatacaacacaaggtaatttccaaggacaagtagaagtacatgacggcttcttcaaagtaaatggtaaagaagttaaagttttggctaaccgcaaccctgaagaactgccttggggagacctgggtgtagacatcgttctggaatgcacaggtttcttcacaacaaaagaagctgctgagaaacatttgaaaggcggcgctaaaaaagttgttatctccgctccagctactggcgacatgaaaactgtcgtttacaacgtaaaccatgaaattctggacggtactgaaactgtaatctccggtgcttcttgcacaactaactgcctggctcctatggctaaaacactgcaagataaatttggtatcgttgaaggtttgatgactacaattcatgcttacactggcgaccaaaacactttggatgctccacatgctaaaggtgacttccgtcgtgctcgtgcagcagctgaaaacatcattcctaacacaactggtgctgctaaagcaatcggtttggttatccctgagttgaaaggtaaactggatggcgcggctcaacgtgttccagtacctacaggttccctgactgagctggtaacagttctggagaaaaacgtaactgctgaagaaatcaacgcagcgatgaaagaagcttccgatcctgaaacttatggatacactgaagatcaaatcgtttcttctgacatcaaaggtctcactttcggttctttgtttgatgcaactcaaactaaagttctgactgttggcgacaaacaactggtgaaaactgtagcttggtatgacaatgaaatgtcctacactgcacaattgatccgcacgttggaatacttcgctaaactggctaaataagaacctttttattgagcaacatcatagagcggaaacaggttattgtttccgctctttatatatcaaatgtgccttaaattcctgtttcgtaaaattataagggtgcggaggaatatggagatgaacaaaaagagcgtacgtgatatagagctgaatggaaaacgggtgtttgttcgtgtagattttaacgttccggttgaggacggtaaaattacggatgacaagcgtattcgtgaaaccttgccaaccattaactacttgattgaaaaaggtgcaaaagttattttggcgagtcactttggacgtccaaaaggtcaggttgttgaatccatgcgtctgactcctgttggcgtacgtttgtctgagctgctgaaaaagccagtagttaaagtggacgaatcagtaggcgaagctgttaaagcgaaagtggctgaactgcaaaacggcgacgtgttgttgcttgaaaatgtacgtttttatgcaggagaagaaaagaatgatcctgaattggcaaagcaatttgctgaattggccgacgttttcgtgaatgacgcatttggtgcagcacaccgtgctcatgcttccactgaaggtatcgctcatattcttccggctgtttctggcttgctgatggaaagagaattgtctgttattggtaaagctttgtcgaatccagaccgtccttttacagccattattggcggttccaaagtaaaagacaaaatcgacgtgatcgacaacctgctgaacattgcagataacgtaatcattggcggcggtttggcttatacattttttaaagctcaaggtcatgaagtgggtcaatctttgctggatgaatccaaactggacgtagctcttggatttattgaaaaagcgaagaagctcggcaaaaaattctaccttccggtggatattgtcatttctgacgatttcagcgctacggcgaatactaacattgtggacatcgatggtattcctgcagattgggaaggcgtggatatcggaccgaaaacacgtaaaatctatgcagatgtgatcaaaaactccaaactggttgtatggaacggaccaatgggcgtatttgaaatcgagcccttcgctggtggtactcgtgaagtagcggaagcttgcgcaactactgaagcatacaccatcattggtggcggtgattctgcggctgcggctgaaaaattccacttggctgacaaaatggatcatatctctactggcggcggtgcatcacttgaatttatggaaggcaaagcacttccgggtgttgttgcactgaacgataaataatcaaacgcactatgcgtgaataaagctttagggcacctaatagttaggagttgaaaccattgagaacaccgattatcgcgggtaactggaagatgtttaaaaccgtaccagaagctaaaactttcatcgaggagatcaaaggcaaagcggaggttgcaggagtggaaagcgtgatttgcgcaccatttacgaatcttcctgctctggttgaagcagtaaaaggcacgtctattaaaattggcgcacaaaacctgcactttgcagaagatggtgcatttacaggtgaaattagcggtggaatgctgaaagatctgggcgtagattacgttgtgatcggacactccgagcgtcgtgaatattttaatgaaacagacgaaacggtgaacaaaaaggttcatgcggcattccgtcatggcctgactccaatcgtgtgtgtaggcgaaaagctggaagaccgtgaagctggacaaaccaaagaggttgtaaaagtgcaaactgtagcagcttttgctggtttggctaaggatcaggctgcacaagtagttgttgcttatgagccgatctgggcgatcggaacaggcaaatcctccacttcgcaggatgcgaatgaagtgatttcctatatccgcagtctgattaaagagctgtatgatgaaaatacagcaaatgctgtacgtattcagtatggtggcagtgtaaaacctgaaaatgttactgagtacctgggtcaaagcgatatcgacggcgcgctcgtgggcggtgccagtcttcaaccggcgtcgtacatcgcgcttgttgagggggcgaagtaagatgacagcaccaaaaccggtagctttaattattatggacgggttcggattgcgtgacaccgtagaaggtaatgcggttgcgcaggccaacaaaccgaattacgaccggtatttacaacagtatcctcatacaacgctgacggcttctggcgaagcagtgggtctgcctgaaggacaaatgggtaactccgaagtaggtcacttgaacatcggcgcaggccgaattgtatatcaagacttgactcgtatttcgaagtccatccgtgaaggtgaattctacgacaatgaaacactggttaaagcagtgcaacatgccaagaagaacaacacgaaacttcacctgtacggacttctgtccgacggcggcgtgcatagccatatcagccatctgttcgctatgctggacttggcgaaaaaagaaggcttaacagaagtgtacattcatgctttcatggatggacgcgatgttatgcctgacagcggcgtagtcttcatgcagcagctgatcgctaaaattcaagaagtgggcgtaggtaaaattgcgactgtacaaggacgctattatgctatggaccgcgacaaacgttgggaacgtgtagagaaatcctaccgtgcaatcgtgtacggagaaggtcctcaatacacagatccaatggaagcattgaaagaatcgtacgaaaaatcagtgttcgacgaatttgtggagccaactgttattgtgaaggctgacggaagtcctgtagggctggtcgaaagcaatgactctgttatcttcctcaatttccgtcctgaccgtgcgattcaactgtctcaggtatttacaaacgcggacttccgtggttttgaccgtggcccgaaatggcctaaagatttgcactttgtttgcctgacgttgttcagcgaaacggttgaaggctttgtagcttacgaaccgaaaaacctggataacacgtttggtgaagtgttggttcaaaacaacaaaaaacaattgcgtattgctgagactgaaaaatatccgcacgttactttctttttcagtggcggacgcgatgtggagcttcctggcgaaactcgtattttgatcaactcgcctaaagtggctacatatgacttgcagccggaaatgagtgcgtatgaagtagcggatgctgctgttaaggaaatcgaagccgacaagcatgatgcgattatcctgaactttgccaatccggatatggttggacactccggtatgctggagccaacgattaaggcggtagagacgacggatgaatgtgttggacgtgttgtagatgcggttaaagccaaaggcggcgtggttattatcattgctgaccatggtaacgcggatatggaaattgatgagcagggacgtccgttcacagctcacacaactaatccggttccgttcattttgactgacgaaaatatcattttgcgtgagcatggaatactggctgacgtagctccaacgcttctggatttgatgcaacttccgcaacctgcggaaatgacaggaaaatctatgattgcatcccgcaagtaagcttgatttaataagtataggcttgaccaacaaatcatgattcacaaaggagattaagtacaaatgactattatttctgacgtgtacgctcgcgaagtcctcgactcccgtggtaaccctacggttgaagttgaagtatatctggaatccggtgctatcggtagtgctatcgttccttccggtgcctccacaggcgctcacgaagctgtagagcttcgtgataacgacaaatcccgttacctgggtaaaggcgttctgcaagctgttaaaaacgtgaacgaaattattgctcctgaagtaatcggcttggatgctgtgaaccaagtagaaatcgatacgctgatgatcaaattggatggtacacataacaaaggtaaattgggtgcaaatgcaattctggcagtatccatggctgtagctcgcgctgctgctgaagctctgggcttgccactgtacacttacctgggtggattcaatgctaaacaattgccagtaccaatgatgaacatcgttaacggtggcgctcatgccgacaataatgttgacgtacaagagttcatggttctgcctgtaggtgcccctacattcaaagaagctctgcgtgtaggcgcagaaatcttccacaacctgaaatccgtactgaactccaaaggtttgaacacagctgttggtgatgaaggtggttttgctcctaacttcaaatctaacgaagaagctctgtccactattatcgaagcgatcgaaaaagctggttacaaaccaggtgttgacgtattcctcggtatggacgttgcctccactgagttcttcaaagatggaaaatacactttggaaggcgaaggaaaatccttcacttctgctgagttcgttgacctgcttgcttcttgggttgataaatacccaatcatcactattgaagatggttgctccgaagatgactgggaaggttggaaattgctcactgaaaaattgggcaacaaaatccaattggttggtgacgacctgttcgtaacaaacacagagcgtctggctaaaggtatcgatgaaaacatcggtaactccatcctgatcaaagtaaaccaaatcggtacgctgactgaaacattcgatgctatcgaattggctaagcgtgcaggatacacagctgttatctctcaccgttccggtgaatccgaagacagcacaatcgctgatatcgctgttgcaacaaatgcaggccaaattaaaacaggtgctccttcccgtactgaccgtattgcgaagtacaaccaattgctccgcattgaggatcaactgggtgaactggctcaataccacggcctgaaatctttctacaacctgaaaaaataatattgcgcaaaaatgctgatggcgtctcttgactcatggtttatgttcatgaagtctgaacgctcaaagctttttcgcatgaataaaacaggcctactcgccaccgcgagcaggtctgttttttgttattatggatgtgtatgagaatttataactttgcaaaggcttaatggttgagtgacttgctatagctgttgttatctcctggaagctgtggtagaatagaaatagtgttttgcgttaatttccggctatttataacatgatatgtacatgttttcataaaagaggctgtgttgttttgcaaaacagatgtataagctcaggaggtgggatttttcatggaaatctttttgaaagtgctgctcgttgtgttctcgattgctgttattgcggttgttttactgcaaaaggggaaaagcgcaggtttgtccggtgccatctctggcggtgctgagcatctgttcggcaagacaaaagctcgcggtatggatttgattttacaacgcgcaactgctgttttgggtgcgggtttcatgatcgtttctgttttagttgcattttttgcaaaataagataaatatgtaccttaagccttcgtttcgcgggaaacgggggctttttttagattttggacaggcagggatgccatcgattaaattcgtgtatactagggtatgagtatattaagagccttgtatcaggagtaaggaacaaggacatgcggatttattactgaaaattaaaggtcacccgaggtggacaatattatgataacagagcaacaactactcgattttatgcgcgagaccgcatacaaacccatgacttaccaggagctggagcagcactttgatattaaggatgcggaagatttccgtgaatttcttaagcttctgaatgctttggaggaagaggggaaaattctgctgacccgcacaaaccgttatggtgtgccggaacgaatggatttgcagcgtgggcgtttgcaggctcatgccaagggatttgcttttctgattccagaggaccgggagcacccggatgtatatattcatgccaatgatttaaagagtgcgatgaatggagatacggtactggtaagagtgtcctcgaagggacctgcgggcggtcgactagaaggtgaagttgtacggatcgtgaagcgcgcagtgcttcaagtagtaggcgtgtttcagagccacgaagcatacggtttcgttttgccggatgataagcgtattaaccgagatattttcattccaaaaacaagcttcaatggagctgtaaacggtcaaaaggtcgttgtgcgtattgtgagctatccagaaggacgagcagcagcggaaggtgaagtgttggaggttttgggtcataaggatgatccgggcgtcgacattttgtcagttattcgtaagcatcagcttccggaagcttttccagatgaagtgacagaggaagcggagaatgctccggacgcgattacggaagaagagattgtacgtcagggacggcgcgatctgcgtgataagatcattgttaccattgatggtgaggatgccaaagacctggatgatgctgtcaatgtagagcgcttgccgaacggaaactaccgtctgggcgttcatattgccgacgtagggtattatgtgcgtgagaactccaagctggatcaggaggcatataaccgcggttgtagcgtgtatttggttgaccgtgtcattcctatgcttccacatcgactttcgaacggaatatgttctttgaatccacaggtggatcgactgaccttatcctgtgagatggaattcaatgagcatatgaaggttgtaaagcatgatattttcaccagtgtgattaaaacgaaggaacggatgacgtacactaacgttcgcaaaatcctcgaagaggaagatgctgaactgatggaacggtacaaggatctcattgatgtattcagcacgatgaaggaattggcattaaagctgcgtgctaatcgaatgcgccgaggcgcggttgattttgactttgatgaagccaaagtgattgtggataatgaaggcaaagctgtcgatattgtaaagagagatcgtacgatagctgaacaaattattgaagagtttatgctggcggccaatgaaacggtagccgaacatttccattggctcaaagtacctttcttgtaccggattcatgaggacccagatccagagaagctgcaaaactttatggctttcgcagctaattttgggcatcagatcaaaggtagaggaaattccattcatccgcgtgcgctacaaacgttgctagaagacattcagggtacgaaggagcaaaccgtgcttagcacgatgatgctgcgttcgatgaagcaggcaaagtatgatgcggagtcgacaggacattttggattggcagcggagtattactctcattttacatcgccgatccgtcgttaccctgacttggtgattcaccgtgtcattcgtgaggtattggagaatggtggggctttaacagccgaacgtcaggaatatttgactgcacgtatgcctgatattgcgcagcaatcttccgagcgtgagcgtgtggctgtggatgcagagcgtgatacagagcagatgaaaaaggctgaatacatgctggacaaggtcggcgaggaattcgaggggatcatcagcagtgtaaccagcttcggaatgttcattgagctggacaatacagtggagggcctgacgcgtctgagtgcgcttacggacgactattatcattttgacgagcagcatatggcgttgatcggcgaacgcacctccaaggtgttccgtattggggatgaggttaaagttcgcgtcgcgcgtgtgaatatggaagattacacaattgactttgaacttgtcgatatgaagcaacggcaacgccgtgaacggactggcggtacaggacagggtggagactttgcgcgtggcgagagccgtggtaaaggcaaaggccgagaagggcgtgaccgcaagggcggcaaggacaagactggcaaagagcgtaaaggcggtcatgatgttaccgggaagccaaaagaagctggcgctggtaacggaggaattagcaccgtaggtcgttcagggcgcggcggcggaaacggagctggagccggctcagctagcaacttcggctttggcagtggcaagggcgggtataactcaccagcatccggggcaagcaagcgacggaagaagacgtctgccagcggtattttcatcggcggagcagctacaccaggtagtgatgccagaccaaacggtgaaggcgcagcacgtcgcaagcggaagaataagggcggaagtggcggcaatagcaccgcgggctttgtgcggaaaaagaagaagtaggtagctagagcttacttactttgaaggctggagctttcattgcagtgaatgaagctgattgaagcataggttatacgggcggtttctgtctgctgtattggatggaagccgcttggttttaagtgtgaataagttcagttagaaatgtagaaggcttgacctttcttgcttttaccatctgaaatttgttacaatatatttctaggtggctctttgtagccggattttgatgcttggatttcaagaatgaattacgttattcataaggagtggtattcatgggtaagaaggcagacgggaaagtgctcgcccagaacaaaaaagcttcccatgactattttattgaggacacctacgaggcgggcatggtgctaacgggaacagaaattaagtctctacggaatggtcgctccaatataagtgatgcatttgctacgatccgtaatggcgaaattcatattcacaatatgcatatcagtccttttgagcaaggcaatcgtaataatcctaccgatccgacccgtacgcgtaagctgctgttgcataaagagcagattcgcaagcttatcggtctgtccaaacaggaaggttacacgattgtaccgctcaagatttatgtccgtaatggttatgccaagcttctgctcggactgggtagaggtaagaagcagtatgacaaacgtgatgctgccgctaaacgcgatgcacagcgtgatatccaacgcgctttgcgtgagaagcagaaaattgcgagataagttgctgtattattggatctggtacaaattacgtggataagttatttgttcctgtaatggtgctattttataaggcttaaatggcttcatttcgtttcgtaatgacctgtaatatggtatactaacgaagtagtcagttttaaagcttttaactttgttcgagtgttgaatcctaggattcagcttttgattttatgcatgcttatgctccggtatttccggttttatccgtggagcccttttataataagggggcgtttatggattcgacggggatagttcgagcatgggtagcgggtagtggggacgcgtccgcttcatcaacgctaaagcctattaaacggcaaacaacaaaacaactacgctttcgcagcctaagaaactgtgtgcgtgcttctacccagcatcgtccatgtgactgggataggggctaacaaatagtggaatacgctgtctcatctccgcctgcggtgagctgaagaagataatcaggctgacccaacgtatagccggttacggggcgatactcgggtgacatcaaaactgtgactacacccgtagaagcttatgtgtcgttatcttcggacaggggttcgactcccctcgcctccattagtagtatcagtgacggccgccatttggtggccgtttttgtgttgtttggattcgtggcggttggttgaagggcgtagttgttagggttgtgggattgttgatgataatacgaggaagttctgatggtgtaggcggtggttgtcgtatatcatataagcaaataacttgaatatataaaaggtggagagtacttgctggattttaaggaaatcggcgtagatggaaatgactttgagcttttgataagagagcttttatttagcatgggaatgaaaacatattggagcggtaaaggtccagatggtggcaaagacctactttgtattgagacgctcaaaagtaagttgttaactactgaaaaacattggctagtccaatgtaagcattttgcacattcagatcgttcagtaggaggcggggagattgataacataattgacttatgtggccaacatagtgcaacaggatacatgttagtttgctctacatatccttcttcttctttagttaagaaacttaaagaaataaatgagaatcctaaatatgatttatccacactttgcttagatggggcggcgattgaaagaatgttgtctacacctaccacttggaatatagctcaaagattttttcctaattcagctaacaatggttggaaagtatatgcgactgaaaatccaaaccgttggatagtaaattataagggtttttatatccatttatttaataggataagttcatatatagagccataattcaaaagtattcatagttctataagtgaaatagagaaaattcccttacctaatcaggaacacaaaatacaacttagagctgtgcattttgatgatagaaacaatagttatatttggtatgttgattacttgtatccatcaggtgagaagcctttttttaaagccgaaactataaaagagtttcttcgccatgggtacattttagaagatcagtatactcatcttttcgatgtccatattacaaatatttcaaaaatgatgattattttgatttcaatcattatgattactatgagccttttttaggaagattttcttggggaatcgaacgtaaggaacaaagtcaccaacactcattgtatgaaaccgaaggatgggaagaagaaggatatgcttccgaaggatcaatagatgcttcttttaatagattagtagcttctttttcacaattaaagtttcttattgttatcaattctattaatagcggagtcgaagcagttgagttgttcagtagaaccaatgattggacagaaatttcgtttcactcttacatttcatttgagcatctcttttctgcaataataatatgcttggtagaggatgaagctagtcttgatcggctaatgagaacattaccgccttccattaacaatcactttaaaatgtcaaaaagaactgtctacacacctgatctccttgaaaatcaagaacctaagatcgtatacgactttgtgatcactattcatcctagttatatgacaaataaatttcttacaagactgaaatttacagagtacttcgataaacttaatgaagctattcagaggtttttaaattaacctgatagtaaacaaatttatatgggtgtaattctctttgtttttgtaggagttaaaggtagagagggaaacgaaaagattttttattaacactaatttagtgacggacacaaaaatattattgagaaagaatttagttgggcgagcttcaaatgaattaatgtaagattttatagaagctaagttaaatacggcttggcttctataatttttgatccatagaaggagtaacgcgtttaatgtggaatacagttttaaatatattctttatgtaaaaagagagtaggtatatcgatggttattgattgtccgttttgtgatattacagtcgaagcagtagaaaaaggtacagttattatctatatggatgagattcaagataaaaaaacagttttattagagtgcccaaaatgtggagaggctataggagcacagcaacgaatggtttattttaatggtacttcagattggagtagagcaataaggatttggccatctgcacaaagaaatttatcagttgaactaccagatatagtgtcaatttcacttgaagaggctgaaaaatgctataaagcaactgcatatttggcttgtgcggtaatgtgtagaagagtaattgaatcgatttgtctggataaacaagttaagaagaattcaattttcagtggattgaaagaattactggatactaaagttattgatgaaaaaatatatgaatggagtaatgtccttcgtttgcatggtaacatcggggcgcatccttcaagtgaaaacataaataaagaagatgcaacagatttgctagaatttacaattgctatttgtgattatatttatgttttgacaaagaaatttgatgattttatgaatcgtaaaataaaggtgaaaaataatgaattaagtgcggaggtataactttaatggaatacattcaggagctacaggagttacataagaaaaataatcttgttcctttcgtaggatctgggttatcacaaccttttaatataccaacctggccgggattggttcggaagcttagtgagtctgtagaaaaaaatctactgccaagcatagagttttacttgaaacaaaatgagcttctgaaagctatagaattattaaaggattttcgcagatatgatgagctagaattacaagaaaaagtcgcattgttaataaagcaagttgaacgaaaaccagagaatagcgacgaacaaatctatagcttattggcaaaaatggcctttcaattatacgttacaactaattacgataattggattaataactatatcaattctataaatgtctatccaatcaatttatataattatcataacgatatttctcatctacttaaccctccagagaaaagtgtagttcatctacatgggaatttgaaagatcacacaagtatggtatttagcgaagaatcttataataatagatacaaagataaaaggtattctaagctgttcgaagtaatttctaatagcaaaacttttttattcatgggattctcgtttgatgactggtacataaaaaacctatttaaaaattacaatgaatattttaaaaaaccgcattatattttgttggattcgcctacagaaaaaatatattctgaattaaaggaaaactatagacttcgagtaatcgcttacgattcaaaaaaatcttcccatgctaatgaaatcagaaaaattctaaatgagatcgaacctaatactacggtaactagtctcaatgacttaaaggagactaaagtagggaattggataagaattaatcctagaataaatgattggttagcatcgatcaagaacggaaataataaaaaggcaatttatgaacatatcagtaaaaaatcctatttcagtatcaaagaaaacgagtatatatgtatctacacaactgaaggcgttcatatattgggaatagttgattttcacaaagagctaacaattgaagaactgttgaactatggaacatacatgaatattggtttcacaaggaacgaactgataaagtttgtgaatgataactcggataaaataggggataaaatattatgtactgcgttcaccataattcaaaatcatcttgctcctatagatattgacacatatagccaaacacatgaaatacccttacctgtgggtccctacccgatttcttcctttaacaaataacctgtgatgcgtgctctcgctctgcatcgcccatgtgccgggataagggcccaacctataatgggatacgctgtcacatctccgcctggggtatgctgaagaagagaatcaggctgacccaacgtaaagccggttacggggcgatactcgggtgacatcaaaactgtgactacacccgtagaagcttatgtgtcgttatcttcggacaggggttcgactcccctcgctccattctcaaaacccgctctttgagtgggttttatttattattattgagtgaagaaatgtaatttggatgtaaaaacaacaaggattcgtcaaggacttgttcaaagaagaactaaagctgaaaatgcactataacagatttttacataatacaagatgattgattatgatcaaatggcactggtcacacatttagtttaaaatagatcgtaagagaaggtgtctttaataggtacgttaatataatgggggttactaacaacatgattacaggtgagattaaaaacaagatcgatacgatttggacaacattatggacagaggggaatacaaaccctttaacaaatattgagcaattaacatacttactcttcattaaaggcctagatgaaggcgaactgaagaaagaaaacgaagcggaatttttagggattgaatatagagggattttctcggaaatgccagcagacttcaatgaagtgcaaaagaaacactggccaatgatacgttggacgcagtttaagaacttacctgcccaagaaatgtatgaagttatggtgagtacgattttcccattcatcaaaacattaggtggtaaagaggaatccgcattctcaaagtatatgaaagatgccatgttccaaattaataagcctgctacattacaaaaagtagtaaccgcacttgatagtatcccaatggaagaccgtgatacaaaaggggacatttacgagtacttattatcgaagctacaacaagcggggacaaatggtcaattccgtacaccacgtcatatcatcaatatgatggtagagcttatgaagccgtcaccagaagatatcattatcgatccggcgatgggttcagcgggtttccttgtttcagcaagtgagtatttacgaaagaaccatcaagacctgttcttagtacaagggttaaatgagcatttccacaaccacatgttctatggtaatgatatggatacaacgatgttacgtattggggctatgaacatgatgttgcacggggtagacgctccaaatattgattatcgtgattcactatctgaggaaaataaagatgcggacaaatacacattagtactagcgaatccaccatttaaaggatcgttagactatgatgctgtatcgaatgacttattaaaggtagcgaaaacgaagaaaacagagctactatttttatcactaattttacgagtgttaaaggctggtggacgtgcagcggtaatcgtaccggatggcgtattgttcggtagctccaatgcgcataaagccattcgtaaagaaattatagatcacaataaattagaagctatcatttcaatgccaagtggtgtatttaagccgtatgcaggagtttcaacagggattatgatcttcacgaaaacaggtacaggtggaacggataaggtatggttctatgatatgaaggctgatggttactcgttagacgataaacgcgcaccaattgaagcgaatgatattgaggatattattgcccgtttcagtaacttacaaggtgaagtagaacgtgaacgtacagagcaatcattcttagtatcagtgggtgagattcgtaagcaagggtatgacttgtcgattaataagtataaagaggttgagtatgaggaagtggagtataaatctccaaaggaagttttgggaaatataaaaaatcttgaagaaaatatcaaaaaaggcttacaggagcttacggaattgttgggagaataattatgaagttaaaaacaattgaagaaattaatcaatataaatcgaaaacagtaaacccgttaaagaatcatgaggtatggtatgaattgtatagcgtgccaaattatgaatttgaagtaccagaaatcttacaaggtaaggatattgcatcgtcaaagcaggttgtggaagaaggagatattttgatatcgaaaataaatcctcgtataaaccgagtgtggattgtaggcaatttttcagaacatttaaaaattgcatcgtctgagtggattgttataagaaatagcaagattagttcaaagtatctttcttattactttaaaacagaaaagtttagaaacttattaagctcccaggtaacaggaattggtggatctctaactcgtgcgcaaccaaaaaatgtggagaactataacgttcctatattttcgatagagtatcaagagaaagttgtaagtatattagaaaagataagtgaacttataaaacttcgccaatcccaaatcacagcattagatgaattaacacaaagtttgtttttagagatgtttggagaagacttagcaggaggggggggatttccgaaaaaaaccctacaagatattgctatagttagctcaagtaagcgtgtatttgtaaatgaattggtgaataaaggaatcccattctttagaggtacagaaataggtgaacttgcagagggtaaagatatttctccagaattatttattacagaagagcattatagaaatttaaaggagattagcggtgtacctaaaataggtgatttattaatgccttctatctgtcctgatggtagaatttggattgtgaaagaggatagccctttttattttaaagatggacgagttttatggataaattttaaagataactctgttaatcctgtgtatattcaatatgctttaaaaataaaattaataaataattatttgaaaattgcttctggaacaacatttgcagaactgaaaattttttctttgaagaatattgaacttataatccctccagttgaattacaaaatgcttttgcggaaagagtgctagtgatcaacaatgaaaatgaaaaaatgaaaaaatctttattgtggatggaggatctatacaactccctactccaaaaagccttcaaaggcgaactcttcccagaataataattatctcgcataggagatgagtatatgctgaacttcgattttttaaaggacaaacagttattcactagctttgccaatgcctgttttgaagcggaaaaggcgatgcaggttagcccagccacggttgcgattttatcgcgccgtgcgcttgagcttgcggttaaatgggtgtatcagtttgataacgatgtgagaataccctatcaggataacctttcaagtttgattcatgatcgtcactttctaggcattattgatgaagaacttttaccaatgctgaagtacgttgtaaagcttggcaatgcagctgtacatacgaatgttgcaattacacgtgatgaggcagtgttatcgttacataacttgcatcaatttgtgtcgtggattaactattgttatgcggaggaatatacagcgactgagttcaatgaaacattattatatgattctgattataagcgtgaacgtccagaggaactaagtgatttatacgataagttaagtgcaaaagatcagtcacttgaagaacttcgtaagcaaaatgaagagcttcgggcgcagctaacagctaatcgtgtagattcacaacgagattatgattttgatgtcgctaagatttcagaatttgagacgcgtaaacgttatattgatctagacttaaagttagctggttgggaaattggcaaaaacgttgagatagaatatccggtaacaggtatgccaaatacaaaaggcgaaggttacgtagattatgtattacgcggtacgaacggtaaaattttagctgtggttgaagcgaaacgtacttcacgtgactccaaagaagggcgcaatcaagcaaaactgtatgcggattgtgtagagcagatgcaagggttacgacccgtcatcttttatacaaacggctttgaaacgcatatttggcatgatcaatatgcagcacgtaaagtgtcaggattttatacaaaagatgagttacaattgttaatcgaccgtcgtcaaatcaagcagcctttaacgaatattgaaatagatgatgatattataaaccgttactatcaaaaagaagcgattttagcgatttgtgatacgttcagtaacaaccaacgaaaaggcttactcgtaatggcaacaggaagtggtaagacacgcacggtgatctcattagtcgatgtgttaacgaaaaattattgggtgaaaaatgtactgtttcttgcggatcgtacatctttagtgaagcaagcatttcgtaacttcaacacactgcttccatacttatcattaagcaatatgcttgaagaaaattctaaccctgaagctgctcgtatggttttttcgacatatccaacgatgatgaatgcgattgatgaagtgaagcgtaaagacggcaaccgtttatttacgatagggcatttcgatttaattattattgacgaatcacaccgttcaatttatcaaaagtataaaagcattttcgattatttcgatggaatgcttgtcggtttaaccgcaacgcctaaggatgaacttgataaaaatacgtacacgatttttgatttagaaaacggcgtaccgacctttgcctatgaattagcgacggctgtagaggatggctacttagttgattatcgcacacgagaaaccacgttgagaattttagatgatggtattcgttatgatgatttatccgaggacgaaaaagaagaatttgaagagatttttgaagatgaaccgcaagtaagggatattgatagctcagccattaatcattttgtatttaacaagaaaacaatcgatcacgtgttaaatgacttaatggaatatggcttgaaggttgaaggtggagacaagttagggaagactattattttcgccaaaaaccacaagcatgcgatggagatcaaaaaacgcttcgacttgaaatttccggaatacggtggtgattttgctgaggtaatcgactatagtgtggaatattatcagacgcttatagatgacttctcaaacccggacaagatgccacaaattgcgatttcggttgatatgttagatacgggaattgatgtgcctgatgtattaaacttagtcttcttcaaaaaaatgcgttcaaaaacaaagttctggcagatgattggacgcggaacacgtctccgtaaagacttatttggaccaggattggataagagctacttcttaatatttgattatttaagaaattttgaatatttccgtgtgaatgaaaaaggtgaaaaagccaaaataactcaaacattaacggaaaggctatttaactcaaaggttgatattgtacgtgaattacaatcgcttcaatatcaagaagcaccgtttatatcttatcgagaacagctattgaaggaaatcgtatcggacgttcgagcattaaatgatgagaattttcgagtgcgccaatacttacaatatgtgcacaagtatcaaaatgagaagacctggcaagctttatcggtcgtgcagaccaatgaagtgaaagaaaatatttcaccgttaattacaccgattgaagatgatgagttagccaaacgctttgatctgttaatgctgacgattgaattagcaagtttgcagtcaaataatgccacaaagccaattcgccgagttattgatacagccgaggcactttcaaaactggggacgattccacaagtattagcacaaaaagatgtgattgatgatgtacggacgatggatttctgggaagaggtttcgcttgctgatctagaaagggtacgtattgcactacgtgatttaattcgctatattgagcgttcgaatcagaaaatctactacacggatttccaagatgaagtgttaactgttgcagaaaatgcgtcgatttataatgtgaatgacttacaaagctatcgaaaaaaggtagagcattacttaaaagagcatcaacatgaggatacattagcgatttataagctgcgtaacaacaaaccattaacgaagcaagatgtggaatacttagagcaaattttgtggagtgagcttggttccaaagaacagtatgaaaaagattatggcgataccccggtaacaaagctcgttcgtaaaatcgtaggtcttgaccgccaagccgctgttaaagcattttcaacgtttatttctgaacagaatttgaacttacaacaaatgaaattcgttgagttgatcattgactacatcgttaagaatggcacattagaacgccaagcattgcagcaagatccgtttagttcagtaggtgggatcatggttgtgttcaaggaccagcttccaaaggctcgaggaattttagatatcatcgatcatattaaccgtaatgcggaggatattcctaaggactattcacaaagtccttttgcatattaggtaattccttgcttatatgatgacgccaattgtatttttgctaagccggggttcacctccatcagcctgaacaccatctattaggatggtgtttttgctatatttaggacataattgtaatagacgtgttatcaggaaaactttagcaggattatgcggtgcatactcctatgttataattaataagtacaatatcttttgaaaaatcaaacttcacgtttctatatataaattcattggacaaggagtacattggctaactatacacgatgaccaggctgtattgcaccacaaattaattataatcggtgcaggcgcatcaggactcatggccgccgttaatgcgtgagatttaggtgttgataccgccgttctggaggggaatgaccggattgggaagaaaatctccatgacaggcgacggtcgttgtaatattacgaacgattccactgtggtggatacggataacgaagcggtggctttgttgcgcaagtattacagcaggcaggctgaatttacgctgcctgtgttgcaacaattcggcatcggtcaaaccattgatttctttcatgtgctcgggctgccgcttacgaaattaaaagagggtttaatgtacccgatgtcactacaggcggcatctgtggtggatattttcgagcttgctctagaggagctgaacattccggtatacctaaaaaacaaagtgctcgatgtcaccgtatctgcagatcatccgcgatttaaaattacatgccgaacggaaacagaggagcaggtggtctacactagcgaatatctgtttctctgtacgggtgttcatacctgccagaatgcggggacggatgggtccggatatacaatcgcccagcaaatggggcattacttgggggagcctgttccggccctcgtgtaattgaaggtgaaatatccataccagaaggcactttccggtatcaaactccaaagacgtgccgacatcctcgtgaacggcaaagtcgcaagcagtgaaacagggcggaatacattacaccgattacggcttctccagtcccaccgatactacagcttggctggacggcagccgttcatctcgcgaaaggggacaccgtatctatccatcgatttgatgccgaaccgcacggaggaagaggttatcgaatttctggagacgaatcaggcaagttcccgcaccgaacgttcgcggagttctttgtcagttttctacacaagaaaatcgtctgcgtcctgctaaaggaagcaaaggttgatcaagagcctaggcctggcgctttggttattccgccgcgaaggcaattactgttacttggcaggcatagtgtataaagatggatagttgtttggcactcacacaggaaccacgcatcggcgaattgtggttttgaacagccacggttcgcctccatttgagtaagacaagaaagccatcagccagtgattctggttggtggctttttattatggctctagtaattgagttgaagaggttttacacaacttgtagcttaaagatatttctaagtgttccggctgttttttctttcacctttaaaagcaactcaagcgttcatcttcttttctttcgaaaagtattgacacggataagaaattgttatatctttatatcgagataaataaattaaagataaaacaacagcgaattatgaatagggaggtatatacatgatcaccattttagaaagaattaatcagcttgcaaaaaaagcaaaagaagttgggttgactgaaatcgaaaaaacggaacaaacggatcttcgcaaagaataccttcaaatctttcggggctctgtacaaagcattctcttgaatgctacgatttatgatccgaatggagatgatgttacgcctgaaaagcttagaaaagaacaggcccgaatcgctaaacaatgaatttaattttatctaatatctctaatttaataatctttaaataaatataacgtggagggtgatttttatgttggcaagtggattgttactgatacgtttggtggttggattgttattggtggggcatggagctcagaaactttttggctggtttggtggctatggtccaaaaggtactggcggttggatggaatcgatcggcattaagcctggagtactcatggcagtgtctgcggggttgatggaattgttgggaggagctctatttactttaggactgctcactccactggctgcattgttgattacggtgactatgctcggagcaattttcaaagtacatggcccaaacgggatctgggcaacagctaatggctatgaatatccgctagttcttattgcagtcgtaattggtattgcgttgacaggagcaggttcatattccatcgatgcattacttagataaaacatgatatttaggtcattaaaagtcatcaacaataaaaataaaggttcctacgattaaaggagggtttcatatgtcacttcaaactacaggtatccatcatattacagcttttgccggtaatccgcaggaaaatgtcgacttctatgccggcgtcctgggacttcggttagtgaagaaaacaatcaacttcgatgctcctgaggtttaccacttgtactttggtagcgaggcaggaagtcctggaacgatcattactttttttcctgcaccaggaactcctaaaggacgaatcggaggtggccaggtgggcataacctcgtatgttgtacccccaggttcacttgatttttggcagcatcgtttggaaagctttgatattcaagttacgaaaacaagccgtttttctgaacaatatcttcaatttgaggataatgagggcttacgccttgagcttgttgaacgtgaagcgggagcgaatagtacttggtcttacgatggtatttcggctgataaagcaattaaggggtttggaggcgccgtgctatttagcgtcaacccacagagaacgatggatgcattggagagcatactcggatttacgaaaatcgctgaagacgccgaatatgcccgttatcagtccgtaggagaaatcggcaacatcgtagatgttccgctcgccaaaatgggtttaggctttggtggagcaggcacggtacatcacattgcgtggcgtgcaaaagattttgaacaacatgaagaatggagaagcgcagtccagcattatggatatcagccgactcccattatagaccgccaatattttaatgcgatatatttcagagaagcaggcggcatcctatttgaaattgctacagacccaccgggatttgctaacgatgaacctgccgaatctttgggacaggaattaatgctgccagagtggtatgaaccgcagcgggctcaaatcgaggcgaatctgcatcctattaaagtgagaacattaacggaaaaacaaaagtaagaaaaagttgcatatgactcttccataagacagcttgccgagtttggcctgctctcagatggaggagtctttttattacgggaaaaattcatgtgtttcgtgtccttccggcctcttgctactccaccagcttttcagacttcactagcatttctcgtaacacatgagcgactcgacttttccggttcgctgctttcttttttatcaagtgtaatgattttttgtatgcatgagtatggctttgatcgtagaactgcttggctgcaatgcgtagtgttcttcttaataacagtgctgatgagcgtgttaacctagagcggaatcccctgcgcaatacccgcaatgtatttttgtaggtctcaaaatcctcggatggagggataagggcaaataaatttaacgaggagtcattgaatccgtaggtttcatacatgattctcagattttccgtatttaacacgttacctctaagataggttggatgttcctgatgatatccgaccacctctttgatgcaataaaaagggattttcaagcgatgtagtctatagccaaggtcccagtcctcgagtccatagagcacaaaccgttcattgaaacctccaatacgaatcaagtggctgcgtctgatggctacacaacgagtaaccagcagcatccagggggctacgtccgttgaggcaaattgtttctgcgtattcggaggaacccttgtgggactaactactttagacagtgcacccgtttggcgaaggatatcttctggggttatgatcggagtaatttcgttcgctgcttcatagtcagcattccataagttggactgcgtaagtatgttgcgacattgctctttttcttcaggggaaaagtcagggtaataatgggtaaaagcatcgtcccacgagtgaggaatgcctgaaagcacggacttgggatatttacggtgataacggctcacgatcctaatgaattccggtaatactacaaagtcagcgtcgcagaagatgatgtacagcccttttgcacggcgcagtcctaaatttcgaacggctgatcgaccgcgttgttcctgatgtgacacatagataagaggataggatgctttgaagccttcgaccatttcttttgttccgtctgtagaaccgtcatcagctacaatgacttcgaatagttgctttggataggtttgtgtctcaaatgaagcgagtgtaagcaacaattgctgggctcgattataggttggaatgatgatgctgtagcggatagccaatatgatctcccccccaccattcttattagaaaacgcttgaacaagataattaataacaatgtattcaaggattttagcctggtctagtcaaacatccctccaggttcgaaacaggcttggtcttattaccgatattaaggtgggggttctgtatcttctgctgttttgcaggtacgttcagtggtgttatgtatgtgtaatcatggtattatgcatagagatgtaaagtaaaagcgagggcgcttcctatccgctgaaagcccactcagcatacagaaacaaacatgagatgaaatgggcaagttatggtaaactatatagagttatagaagacctgaaagaggagtactatatgacacaatttgtctataagcaaattattgacgatctcaagatgaaaatttttgctggaaagtttgcagatatgagattgccagatgaacgtagtcttagtgagacttaccaggttagtcgtagttcaattaaacgtgctctgactaaaatggagaatgtcggaatcattttcaaaaaacaaggttccgggacatttattaatccattatacataagaaatgaatctatctttaactacgaaggctctaatctaggggtcactgataattttcaaatgcatggtaaaaagccgaaaatcaaagtactgagttttgaggtcattccgccaacagaagagttacagcgcgatttgtttttggagactcatgattttgtttacaaaattgttcgcttacgtctgtttgatgatgatccttttatgattgaaacgggctatatccccattaaaattgtccagaatttaaatcagaccattatcgaggggtccatttttaattatttggaagactcacggaacttggccgtcaccaaatcttttttatccatttttgcagaaccgtctcaagagaatgatcaaaagctgctacatttaaatgaaaatgagcctgtaggtattatggaaggtgtgttctttttagataacggtacgccatttgagttttctcatatgcgatttcattacaaatatttgaaatttaatacctttgtatcggttcactaatgataagactggagaattctccggtcttttttttatgtttttgagaaaaggattggagtctgcgtttgtctcgttattgcaaattttattggttaataattctatatattttaatgtaagagcttttttactgtctttttaatttatatttcatagtatgttcaaaatttcacaaaattggaccgtatcacttgtgaaaaaggttgaatttagtcagcgtagcgttatgatgtacatgtagatgaaatttccggaaataaattacaaacaaaactacttagggagtggacaccatgtcgttatcacccgtgttagcagattattcatctaaaacatatttagaaaaacttgatgcatattggcgtgcaacgaactacatttcggtaggtcagctgtatttaaaagataatcctttgttgagagagcctttaaaagattcagatgtgaaggttaagcctattggacactggggcacaattccgggccaaaactttatttatgcacatctaaatcgtgttattaataaatatgatttgagcatgctttacattgaaggtcctggtcacggcggccaggttatggtttcaaattcttatctggatggaagctacactgaaatctatccgcaaattacacaagatatctcagggatgaagaaattgttcaaacaattctctttccctggcggtattgcttcacatgctgctcctgaaacacctggatctatccatgaaggtggagaattaggctactccctttctcatggtgtaggtgccattctggataatcctgatctgatctcggctgttgttattggtgatggtgaagctgaaacaggcccattagccgcttcgtggttttctaaccgatttatcaaccccatcacggatggtgcagtactaccaatcttgcacttgaatggttttaagattagtaacccaacgattatgtctcgtcaatcgaaagaagaattgacctcatactttaaaggtttgggttgggagccgttctttgttgaaggtgaaaatccggatcacatgcatccagaaatggcgaaagtattggatacggctgtcgagaagattgaagctattcaaaagaatgcgcgtgaaaataatgaccttactcgtccggcttggccgatgattgtattccgttcacctaaaggctggacgggtccgaaggaatgggacaacgtgccgaatgaaaattcattccgtgcccatcaggttccaattccggttgatcaaaaaaatatgcagcacgcacctgctttgttagaatggctgaatagctatagaccagaggaattgttcgacgaaaacggtcgtttaaaccctgagcttgctgaaattttgcctacaggcgataaacgcatgggaatgaaccctgttgcgaatgcgggtaacctcattaaagacttgaaattaccggatttccgtaactatacgctggataattccgtacctggtaaagtgattgcgcaagatatgtcggttttagggaaatacgttaaagatgtggttcttttaaatgaagaaaatcgtaatttcagaatcttcggaccggatgaaacgatgtctaatcgcttggctcctgtttttgaagtaaccaaacgccaatggatggaccaaattattgaacctaatgatgaattcttatcatcctatggccgcgtaattgattctcaattatccgaacaccaagctgaaggattgctggaaggttatgtattaacaggtcgccatggtttctttgcaagttacgaagccttcctgcgtgtggttgactcgatgatcacccagcactttaagtggctgcgtaaagcaacggatcaaggatggcgtgcagatatcccatcactgaatgtcgtagcaacttcaacggtgttccaacaggatcataatgggtatacacaccaagatccaggtttgttaggtcatttggctgataaaaaaccagaatttattcgggaatatcttccagctgatgccaattcattgttggctgttttcgacaccattttaaacgatcgtcaaaagatcaatttgattgtttcatctaaacatccacgtccacaatggtttagtgctgatgaagcgaaagaattggtggataaagggttgaagatcattgactgggcaagtacagatcaaggtggagaacctgaccttgtcattgcttctgctggtacagagccaacgattgaaagtttagctgcaatttctattttgcatgaaaaactgcctgacttgaagattcggtacatcaacgtggtagatttgctgaaactgagaagtcaaaaactagacccgcgtggattatccgacgccgagtttgatcattttttcacaaaagacaaacccgttgttttcgctttccatggttacgaaggtctgatcaaagatctgttctttgatcgtcataatcataacttgcatgtacatggataccgtgagaatggcgatattacgacaccatttgatatgcgtgtattgaatcaaatggatcgttttgacttagtgaaggaagctgctctcaacttacctgacgctgggaagtacaccaacattgtggatgaaatggatgctacgattaagaaacatcatcaattcattcgcgaagagggtattgacctaccagaggtagagaactgggtatggaatggcttgaaataaaaatacagacacttcaactttgtgttggacaaccaagccatcaagcatgaagtggaatatatgatttggtagtggtacaagtgcctgcccccttgacttcaggtatgatttcaatggggatcaggcgctttttgatttagcacacagagaacttggtagggaagttacgagctagtgggtatatacatatacagagaacggaatggattgctatattttgccggagctttgaagaggtgttatgttatatgagaatagtaaaggaggctgtaattatgaaccaacaaattccggagaaggtattgaatgatggcattaaagtgcccgtcattggatttgggactgctggaattaagggtgcagatggagtcaaggcgattaccggcgcgattgatgcaggttaccgtctgatcgacacagcgttcaactatgaaaatgagggtgctgtcgggaaagcggtccagcagagctctgtgcccagagaggaattgttgatttgctccaaactaccgggtcgccgacatgcttaccaagaggccattgtaacgatcgaagagtcattatatagaggaggcctggactattatgatctttatctgatccattggccgaatccccaaattgatcgatatgttgaagcttggcaggcgttaattgaggcgaagaaaaggggctatatccgttccattggggtctgcaatttcttgcccgagcataatgaacgtttaattcgggaaacaggtgtcacgccgagcatcaatcaagttgaattgcatccattatttaatcaggaacatcagcgtgcaaaagatgctgaacagggcatcgtgacggaatcatggagccccttggggcgcggtcacagcatgctggagaatgaagagattgggaaaattgcttctgctcataataaaacgactacacaagcgattttacgttggcatatccaacttggagcaatcccgatccctaaggcctcttctttaaaacaccaaacggagaatctagatatttttgactttgagttgtctccagaggaaatgaacgtgatttcggcatttagcagtgaggatggacggatatggggacaggcccccaagtcctatgaagaactataatcaggaacaataaatagaagggttcaaaaatctgtcgcgggtttttggaccctttgcttttataataaaacgaacacacatctgaaagtgatcaatgggccagtatatagagctatgatgaacattttttaccggatttgatgtatgatatggttgaatgtagtcctttcgaaggaggtcatcatggggattttgtcaaggtttagggatattatgaaaatgaatgttaacgccttaatggataaggtgggagattcggagaaaaccattgacgattatatgcggaatttgaacagtgatctaggcaaggtgaaagcggagacggcttcagtgttggctgatgagagaaggacgaaaagagcactggatgaatgcaaagccgagatcaaaaagctccagcattatgccagtaagtctgtggaagctggtaatgaagaggaagctcgaaagtttctggagagaaaaggtttgcaggcggagaaattggaacaattacaaacatcctatgatttagcttcgacaaacgccgtaaatatgaaacaaatgcaggagaagttggtgtctgatatggagcaactagaagcgcggcacgctgaacttaaagggaagatggcggttgccaaagcacagcaagccttgaactctatgggcagcaagaattctgcttttgaggtcatggaagagcaggtgaacagagcgtatgatgaagcgatggctatagccgagcttcgggcaggaacgaaggacgacctggattctttataaggaatcataacagtatctacatgaagaggtgagcagatgccggttatcgaatacaaatgccccaactgcggcagcggcatggtctttgacggtgagacagggatgttatcctgtcatagttgcggaagagaggacaatatcgaatctattcctgatcctctgataaatcgtattttttcagaagatgaggcccatgagtatcattgtaataactgcggagcagtgattatgaccgaagtggagacgagtgcaacggtgtgcagcttttgtggttctgccgtggttcttggagaccgactgaccgggaagctggctccggcgcaggttattcctttttcgatcagtaaggaggaggccatagatgctttcaaaaaatggtgtaagaatggccgtctgacgccgaatcggttcatgatagcagaccgaatcaagggaataaccgggatgtatgtgcccttctggttatatgaattacataataaaattgaggttcaaggtgaaggtacccaagtgagaacctatacgagcggagactacgaatatacggaaacgaagcattttgatgtatatcggaaaatccgtttgaattatgtaaaggttccgattgatgctgcggagaaaatgaacgacgagctgatggataaattggagccttttccatacgatcagctaaaaccctttaaaacgccatatctagcaggttatattgcggagaagtacagttataacgaagaagagctcttcccgcgagttaaagagaaagtgaaggaatatattgatgcttatattcattctacggtgtcggagtatacgtccgtgagttatacggaaaagcaaattgatactacattaaaacaagcggattatgttctactcccggtatgggtcatacactatgactacaatcaattggagcatacgtttgctatgaacggacagacgggcaaggtagtcggtaagcctccgatcagcaagttcaaagtaacagcttggtttgcaggcattttcggcattactctcttctcattaagattaatcacttggctgatgatgggaggggaattctattgaaaaagcatagagccattatagccgtcttgttgttctttgctgtttttctggcagttccgatggaaatgaagggcgaaccagcaacgacagaaatgaagccattgatttatgatgaagcgggtctgctcaatcaggaagagtatgatgtgttgaacactatggctaatcaatacggagcgaaaagagaaacggacattattatttatactactctcaatcccgacaatatggatgttatgaaaatgacgcaggacttttatgatgaccatggccctgggtatgacagatctcatgggaacgcggtcattttaacgatggatatgagaaatagagaggtgtacttggccggattttataaggcagaacggtatctggatgatgacaggcttactaaaatacgccatgagattagcccggatctgacgaacggcaactatgggctggcatttcaaaagtatattctgagtgcgcacaaatatttggccatccgtccaggggtgaatccagacagtatattttttaaaggatggcttcatttggcggtagcgctgggattggcggcgttgatcgtgggtaagatggtttccaattctggcggtcgggttacggtaaatcggcagacctatgaggatgcaagcacgtcaggggttctggcacatcaagatctgtacactcacacaacgacaacgaagcggaagattgaaaagagcagtagcagcagttcatcaggcggaggaggcggaaccaccagcggcggtcattcgcatagcggcagcagaggatcattttaactgaaaggatggatacagtatgggattcttcagaaaccaatttgcaaatgtagtagaatgggaagaatttagagatgatatgattttctggaagtggagtaatcgtgaaattaaaaaaggaagtaagttaattatccgctccggtcaagacgcgatttttgtaaataacggcaaaatagagggtatttttgagaatgaagggtcatataacatggactctgacattattccatttctatccaccttaaaagggtttaaatttggttttaacagtggcatgagggtagaggtcttattcgttaatacgaaggagtttactgtcaaatgggggacgcagaatccagtgctgatcccgattccccagctgccaggcggtatgccgatccgtgccaatggcacatttaattttaaagtgaacgattatgttacgctcatcgataagattgccggagtgaaggacagttatctcgttgaggatgtgaaaatacggattacttcggtgttggatcagttattgatgaagtggatcagcagagaaggaaaggacatgttcaatctgcaggcgaatgcttctgacatttcaaaaggtattcaagaagatctggatatgcaagtgatggacaatggtatgacgattactggctttcatgtgatgagcttcaattatcctcaagaaatccaagatatgattacgaagacagcttctcatgaaatgatcggtaatctgcaaaagtaccaacaagtgacgatgacggacgggattgcatcgggtaatgtaaaaggcggcggtgcagcttcggatatggcgagtatgatgatggggatgaatatagcaaatgaaatgatgaaaaatttaaacccgaacccaaagccttcggctgagactcagcctacacctgctgccccctctccatctggagacggtattaagcccaatttttgtccgaattgcggtacaaaaaacgaaggagctaacttctgtccgaattgtggacaaaaattgaacggataacatagcgcggtcaaacttctttatttcagaaaatttccgatagggtcaagtaatcctgtaagccaaaaggcagttatcgcagagtatcttctgtgatggctgcttttttatgtagttcgttcaagtattttcttcataaatccgatttattggattgaaaaaggtactcaggataaggtactatagctatatagtatgtatttatattaactaattagttattacattaataaattataggtataggagcacgaagatgaccaaattccaagatcaaatcattgcgcgttacaagtttgatgatgcagagaacgtcggcaaggatagctcagggcaaggtaacgatggggttgcttcaggcacagtaacacctacgatttcccatgctaccggtagagcagctttgacgcttgagggaggccccaatggtacatcgtatattcagcttccttccgatctgtttaaagatgtaagcgataacaccggtgtgacggttactgcttgggtcaacttcggcagattcacagatatgtgggaacgtgtttttgactttggtaaagcccatacagggccctatatgttcatgacacggaatctgcgcggaacccttttcaccgaggtagatttgtccgtagacccgggaagaggttttgtcagggatgagtggatgcacatagccttgtccgtaattggtacagaaggcggcacattaagcagcgcgggtccggtggtatatgtcaatggtgaggtggtagcggacggttccattagtcaaacttccagcggtaactatgccaagctgcgtaaatggttcgaaacgtttacagactcgtccaactacagcaacaattttattggtcgctcccagcatgcagcggatgtagactttgccggctccgtttcagactttcgaatttataaagcaggcttgtcggcagatgaagtcattgaggtcatgtgcgattcgttgacagatgaggagatcgtgaagcttgctagagataaatatttgtcctttccaacgacgattgtgaccaaggatttatctctgccaaccgttctgatgggtgaaagagtagaagtggcctggaaatccagccaacctaatatactctctgacgatggtcatgtgcaggcgattacctccgcacaaggagttaccgtcacagctttattgacgaagggcttaagccagattgaggaaagctttgaagtgtccgttcttcctgaacagctgcctccgtacacgctgaccattcatggaaataaggaagtagtagatgtcagcgaagtgatgtacggcttgttctatgaagatatcaataacgcagcagatggcgggatttatgcagaactcattcagaatcgatccttcgaatctttcgagttcgatacgtattcccatgcttccggtgaatgcggctgctctaccggacggaaccgcaacccgttgttcgcctggtctggtgatacggataagatgactccacaacatagcggtggattaaatgagtttttaggcgcaaaagacaaagaagtgaactcttattatgtgacggtagcggatggtgcaacgattcggaacaagggcttttcggattctaaccagaattgtgccatgtccatccaagagggtgccaaatatgagtttaccatctgggcgaaggccgattcagcgggcacaatcacactgcaactgcaagactcaaatgaaaaggctattagtgattcggttacgatacaggtggagggcggcaacacgtggaagaagtacggcatcgattccaagcttgtgctgacaggctcagctacggttctcgggcagctggcgcttacatttgaaggggacatttcggttgatatggtttctttattcccacaagatgtatggggcgcaggagaggaagagcaatccccatcggcacatgctaacttccagggtaatcctaactaccgactgagaaaagatttggtgaacgcactggttggcatgcatccgaagtttttgcggtttccaggtggttgtatttccgagggttcatttatatgggaaaacgtatacgattggaaggaatcgattggggatatcgagctgcgcaaggaaaactttaatgtatggggctatatgatgaccatgggtcttggttatatggaatatttccagttggcagaagacctgaatgcagctccgcttccggttatggcctgcggcgtgctctgccaagcccgctcggattatgctcatcccgctggaggcgcattgagagaatactatattaagaactttacggatctgatcgactttgcgattagtgtggattttgaacataatgaatgggctgctatgcgtaaaaaaatgggccatgctgctccgttcgatctgcgttatttgggggtaggtaacgagaactggggcacggagttttttgccaactttgaagtgttcaagacatcgattgatgagtacatggagaaaaactatccgggttatgagctacacatcatctccacggttggcgctcaagcagatgacgatgcatatcagcagggctggaagttcttaagcggtaatatgaccggttcggctaaggttgcttttgcagatggtaaccaggtgacagaagaaacggtaacctggtatgagaagcaaaaggactatatggacaccattgcagacgagcactattatcgttctaacgagtacctgctgaataacgtggaccgctataactactactacagagcttataatgcggacggcagtattaattggaaagcaacatcaaaggtttttgtcggggagtacgcctcaacggataaaaatacattggcaggcgctgtagcagaggcagcggtgatgacgggcttcgaaaagaatgccgatgtcgttcggttggctgcctatgcaccgctgtttaacaaggtgctgacagatggaacttacagatggacgccagactgcatctggttcgatgacgaaacggtgtggtttacgccgaactactatgtacagcaaatgtatgctaaatatttggggaataaagtattgagcacttctttctctacttacaaaaacggcaagccaacggacctcattcctcagggtggaattgaaatcgcgacaggcaatgccgaggttatgattaagcgtgtgactgttacttccaaccaggacggtagtgtgctgctggatcaagactttacccaggaattgaattcggcctggcaggtcattcccggttccgtgggctcaacagtagaggaaggcaaggggcttgtgctcaaagctcaggatagcggtctgaatggtctgtacatcttgaacgacagctggagcaattacaaggtagaggtggtcgcttcccgcatttccggcacggacggcttttatgtgggtgcgggtctcatcgatatttctgcggagaaaaaggacgtcgttgaatacgcgatcggctatggcggcaaggctaccggcgtgaaggtttacaagcagggcatagaaggctacacattgggtgactactcttccagtacagcggcaggtaacttgagagcagctagctatgaagagttggctgacaacacggactacaccataacagtgaactacggcggtgaaacgggtagtaatctgatttgctcatacaccgacggcgagacaaccagcaaggtgctggactacaagctggaggcttacaacagagacgtgttcaactcggtaacccaagatgctgagcatgtatacgtgaagctggtgaatgccgacaacgtggataaggtaatacagctgaatctacaagatttgagtgttgagtccatcgctaagctggttacactaactggcgattcctcgcttgttcatgtacctaacgtgaacaagaagaatgatgagaaggtaatgcctaccgaacagcagatcacgcttcagacggattctgtcctcttagacttaccggccaactcggtaaatgtgctggtgctggatcttaaaccttttctcgcttaaaaacaaaaaggggtgtcccaagtagccggtttatggcttttggaacacctcttttttctatgaatagagtcggaatgttgagttgatttcccagacaggcattactgcgtgcttctgtttaccaattcacgcgggttgatgccatcgtctatcgttagcggggtaggggctcccgtagcgattcgctcccagggcaccattttaaagttctgattcaactttttgccattttgaagattttcgtcatcttgtgcaacgaagataccatgcgggaaatttttgcctaatccgtagccaagaacatcaataccgtctgtgacagatgtaccatcaacggtagggctcgcgctaatcgtgaagttgcttatatatgcattgtctccttgtcgttcatagatcgcatagctgctgtttccttggctggaggccatgaggtaccctttgccatctttaccgtaatacaatgtaagtccctctatgtcatcgtgaagtctgcgcccatctgcaatatccacacgtcgcagcggctcggttgaaccgtctggctccgcactatacttccaaatagcgtaatcctcttcagcgatgtagaccgtgccatattcatcatcagcaaccatgccttcggattgcgtattcagcttgaactggcggacaagcttacctgcaattttgccgcttccgtcgtcagtcagctcatattgctcaaattcaccctctttgcccaacacgagcgcgtaaaatttatctgtcttgaggctatggtataagctgaatccgtacacttctttcatagatgctttaataggtttgccaaccacgttggtcagctttcctgatgcaccgtcaatggaaaagatatcgatcgtgttgttggttcgattggttgcccctgcgatatcaatttttttgccgcccaatgtgaaaccgtaacgaagatccacgttattcatttttccgaccttcatgttttgcagttgcttaccttccagatcatagactaaaatcccgccgcctttattggttgctaaaattctacttttctccggatcgaccgggttgagccagattgcagggtcgtcggctgcgtcttctccatcttccacagcttctgtttcggcagaggggattactttataggtgggaactgcgtccttaggatctgcatatttgctgttctctgcttcaagcgctgtaagaagttttgtaggaagatatacatttccattcactattttaatttcccggtccgcttttccgcttagtccagctaaacgatattgcttctcaccaactgtaaaggtcccgacaatgccatttttcaatttgaccaaaacagactgatcatcactgtcccatgtaattgtcgcccccattttatctgcctgtgttcgtagtggtgcatacccggatggctgaatgtctgccgcatgggtcagttctggtgataccagaatccccgttaacatggctaataatgcgagtttagttgacttcatatgtatgccccttttctgaagtgaaaatgatataaccgactcagtataaagcgagaatatcaaaaggatacaatgaaaatgtaaagagaatgtaaaggaggtgtaagcattcaatggactggtttccagtattgttgtctgtaattcttgggagacattccgaatttttctttaaagcatttggagaaatagcttgcttgggagaatcccgtttcctccgtaatttgttggacagaccagtcagtttgcagcaaaagactgcgtccttgatccaggcgataatccattaaatactcaagcggtgtgcgctggaaagcgaccttcatgcatctggcgagatagttctgatgtacgtgaaaatgggtctccaaatctttattggtgattgtatttttgtaattctgttttaggtatatttcgatttgttccgccaacttagaggagctgtctttattattctgatcatactccaaactctggaaaacactcgcaaacgtctgttgggcctcccatagtgccagttttctaggttttaaagtagaggctagtaaatagtctaatttcgaaaatagctcatgtggattcaccactttttgaattttgggcaaatgaatggtcgtatgttctgaatgaaagtgcagctcgggaatgggagtgctgggtatgataggattgggcgaggattgtgcgcaccacatgctattggtttgaaaatggaaccagtaaaaggaggtttgttctgtacatgcctcaatgggaaaatgatgtttatccggttcaagaatgagagcgtaatttttagttaccttccacacttcgtcctcttcgccaatgtgcagcaatccttctttaatgattattacgtcaaaataacccagattatacctattcggatgccaatcccctttttgatatgtagtaaaattcccctcaatgaaataaggcagcggaggaacaaggaatgatagaaagtctgttttgctcatggaagccagctcctttgtgtgtgaaatcgtataagttttagttaaagatcgcgattttttttataaattcaggttgataaaataaggactgtagcaaggggagctcaggttagcttgtacgatattatcattactttatccttattttctcaaaaatgaaagcgttctatttccaggaagggatgtttatccaatgaaaacggcaaagccagttaagcatgtcgtcgttgacgatttattttggaaaaagtataagcaggttgtggcggaagaggttattccttatcagtggaaagcattaaatgatgaattaccagatacagaacccagtcatgcgattgaaaactttaggattgcagccggggaatccagtggggagtattatggaaccgttttccaggatagtgaccttgccaaatggctggagacggttgcctttagcttaagggatcatccgaatcctgcgcttgaagagcgggctgatgaagtgattgaattgttgggaagagcccaagctgaggatgggtatctaaatacgtactatctgcttaaggaacccaacaatcgctggaccaacttaagagacaatcatgagctgtattgtgcagggcattttatagaagcggctgttgcttattatgaaacgacgggcaaaacgaagtttcttcacattatggagaaatacgtagacctgattcagcaggtttttggtacggaagaaggtaaacggaaaggctatccgggacatgaagaaattgagttggccttgatcaaattatacgacgtaactgcaaaggatcaatatctcaaattagcgcaatattttattgaacagcggggacagcatcctatttactttgcagaggaacaagaacagagaaaacatattcaaacagagcccacctggaatgatgataacaatattaattttggcttaggcttcgaataccagcaagcacaccaacctgtgcgggaacaaaaagaggcagtcggccatgcggtaagagcggtgtatctgtatattgcgatggcggacttggccgcgaaaacaggggatgcttccctgttacaagcctgtgaaacgctgtgggatgatgtaacgaatcacaaaatgtacatcaccgcagggatcggttctactgtaaacgcggaagcattcacttgccatcacgatcttcccaatgacagcatgtactgtgagacttgcgcctctgtagggctggccttttgggccaatcgtatgctgcgtttagcgccagaccggaaatacgccgatgttctggagcgtgcgctatacaacgggacgattagtgggatggacctggacgggaaacggtttttctacgtgaatccgctagaggttaatccctttcaaaaatccagaaaagatcaggagcatgtaaaaacagaacggcaaaaatggtttttctgcgcctgctgtccgcccaatttggcacgaatgattgcatcagttgaggacaatatgtatacccaaacggacgatacgttgtatacgcatctgtacattgccagcaaggtgaacatgactttatctggtcatgaggttgaaattacacaaactcatcattatccatggaacgcggatctaacattttcgatccacgtaacagagccgacttccttcaaatgggcactacggattcctgggtggtgcaagcaggcagaggtgaaggtgaatggggaaaccatatcattagaccgtctggaaaaaggctatatcgagattcagcgtacttggaaggacggagatgtggtaactctgcatttggctatgccggttgagcgcattcggagtaatccgctggtctccatgaaccagcagcaaattgctctccaacgcggaccagtcgtgttttgcctggaagaagtggataatggagggaatttggcaggattaagattgacgaaggatagcctcattacagaagagttcaacgaaaatctgctgggtggcattgtaaagctgaccatagagggataccgggtaaaaaattcgaatgcattatatagctcggagcctcctgaatttgttcctcaacaaattaccgccattccttactacgcctggtgcaatcgggccaaaggggaaatgcgtgtatgggtttatgaatcataattcattcgcatggggagaggaaagatcatgagtacgagaattgtgagtacggaaccaccggaaaaggcagccagtaccgttccttttcatcgtaaaatcagctattcattaacggatacagcaggcaatctactatactgtattatttccagttatctattatatttttatacagatgtattcggactttctatcgggattgccgggacattactatttatcacccgttttatcgatgccattgatgccccgatttggggcatcctgattgaccgaaccaagtcaaaatacggccagagcagaccctattttctatggttagcgatcccgttcgctgtgtttatggtccttacgtttacgacacccaattggagtgagtcgggcaaaattgcatatgccgctattacgtacatcatagccggcatcctgtacacagggatcagtacgccgattacgtctattctgcctaatctgagcaccaattctaacgaacgcgtagtcttgaactccttccgtatggtcggggggaacgtaggtttcttcattgccacgacgtttacattacctttggtcgctttctttggacaggggaatgatcaaaaaggattttccttaacgctcgttttatttggaatcatggcgattattatgtttttcatagcgtttgccgatttgcgagaaaatgcagcagtgaaaacgaaatctgttcccattgctaaaagctttacagccatcaaacgaaactggccctggatgctcgttgtagctgccaacttgtgttactggattggtttgaatattcgttcagcaactctaatcttttatctgcaatacaatctggacagtaaggacttagtacctttaatcaatggactgacctccttgcaattgatctcgatggttctgattccgtttttcgccagaaaattaagtaaaaatgcgattatgattattggattgatattagctgcgctgggtcaagtcgtgattttaatgggaagtacagacctaaccctcattattatcggctggattattggtgcgttaggatcaggctttgcatgttctatgccgtttgcgatgttgtcagatacagtcgattatggggaatggaaaaatggtattcgggcaagtggtttcctgacctcgattggaagcgcattctgtattaaagcgggtagcggaatcggcggattattgccagcatggatcatgggcagcaccggttatatcgctgggcaagttcaaactcctacggcgttgtctggcattcagtttagctttatctggctgccatttatcgtcttcttgatcggaatcattcctatgtttttttataaaaaattcgaaaagaatgaagcttctattcaacaagatttaattgtgagaagatcatagacattctcttaacaatgttttaatgacatattaaaacattataatgctgctcccaaacctgttcactgagctgagcaggtttttctgttattttatattcaaatgtgagcaagaccattgacaggattttcttttggagtaatacttttatgtagagaaaagtgtacagaatcaagaactagacacatctagccttgcaactttatacattttttcgccatgaaggctcttctgttgaagggtttttttcaatttgagaaaaagaatgtgatgatatgagtcaactgagtgtaaggatgagaacacatggctttctgaataagcatttttcaggagagtctattgattatcgacagattattgcgctgtttatcccgcttctgattgatcaggcttttatcgtgggtcttaatttggtgaacacggcaatgattagctcgtcgggaatggcggcagtcagtgctgtaaatatgatcgattctttgaatatttttctgattaatgtgtttgttgcagtgtctaccgggggaacggttgtcgtggcacagtataaggggagcggtaacgacctcatggtctctaaagccgcatccggcaccatttcctccgtttccttgctggctttatgtatcagtttgtttatgatcgtgttgtacaatccgattttaagtgttctgtttggttccgcctcgcctgatgtattagctaacggtaaggtatatctgctgggaagctgcatgtcttttgtagggattgcaatcgttgaggcagtgtgtggggcgctgaggggaattgggaagacgagggcatcgctggctctttcgctcatcatgaacctctcgtacgtgctcctcaatgtggtattcattaatgtattagatatgggtgtgctgggcatgacgattgccgtcaatgtgtccagatatgcaggggcagtgtgcgcattgatctatttggtcagagtagatgacgacttgcgtgtgcagcttagagatatgctttattttaatctggctatgcttaaaaagattctgtttatcggacttccctttgcagcggaacagatgttttttaatgggggcaaaattttaacccaaattttcattgtgagcctggggaccaatgcgttggcgacgaatgccatttgctcatccctagctaacgtgttccaaatccctgcgaatgctttggctcttacgattgtaaccgtggtcggtcaatgtatgggacgtcgaattgtcgaggatgcccggaagtttaccaaatcgtttatttggctgtcgtcttgttcgtttattgtaatggggctcatactgatgcctttgtttgagccgatggtggggctgtttcatccgcctgctgaaatcgtagatgacatatttgttgtcatactgattaatacgttggcccagattccgctctggtccattgcctttattacaccctctgcgcttagggcagcaggtgattcaaaatttacgtccctcacctcaatgctgtccatgtggttgtgccgggtggtgctcgggtatattttgggcattgtgttcaacctggggattgttggtgtctggctggccatggatattgaatggggcgtgcggggactcgttttcctttggcgcttccgcggcaacaaatgggtccagcatcgtttaatagactgaataggtccactaccataaaattgacttctgggagaaggcattttacggtagtggatttttttctattcctatacttcgttcagatctcttaccctatcctgatccctatattgcctaactgcgctccctgctgcatacggtggaaggcttgtgctgtgtcttgtaaagaaaatacgctatctataatcggatggagtgcatggcgctccatgaactgaagcatagctgcgaattcctctccactgcccatagaggtgccgatgatgctgatttgagggaaaaatatagaccgcaacggaatctctactcgatctcctgagcttgcaccaaatgtaacgatccgaccgttcggcttgaggatatccaaatatttatcgaacgtagcaggaccgatactgtcaaggaccagatccacggtgtctccgttcatactttctttccattcgctatggctgtcgaatgcatgattagcgccatgagcgagggcagcctgcctttttgcttcgctgcgtgacgtgacggtgacccgcgcgcctgctgctaaagccataagcatggcatacgtggctacaccaccgccaataccgggaataaggacgtgctcaccctgctgtaattggcctcttgtgaagagcgcgcggtaagcggtcaaagcagacaaaggcagcacccctgcttcttcccatgaaaggtatgctggcttgctgaccgcattttggacggggatgataaccgattcagcgaatgttccgtctgaaggtccgcccagaatggctggaaccaagggaacatgatgcgtattctcccatccgatacatggattgataattacatcagtacctactagcgaggttgggacaccatcacccacagcctcgatcacgcctgctccatccgaccccagaatgagtggagcatcgttggctgttcgatccgccatgaggaacagatcccgatggtttaagcctgcagctttaagtcttaccctcacttcgttgtgccccggctgtctgtccgtaatgtctgtatacatcaggccctcagggccgcttttgctggcatgaattacggctttcattttaaaacctcccgtggttcgaatttagatgcaattgcatgtatattgaattgtacagagcggcaagcgtccggtaaaatgaacaaaatcgaatgtgagtatcataaatgatcataccaagcaggtgacatatacatggaaagcagtgatttgaaaatttttcaggctgtcgctcgcgagggcagtatcacgaaggctgcgcaagttttgaattatgtacagtccaatgtgacctcgcggattcagcagcttgaggcacaattgaacgtaccgctatttcgccggtctaatcggggaatgacgctaacgtcggcaggagagaatctgttggaatatgcggataccatactgaccttgctggacgaggctgtaaagtccactcaatattcagaccatcctgcgggacctttgcgactgggctcgattgagacggcggcggttacgcatctgacttctttattgacggaatatcacgctcaatatcctgatgtccatctatcgcttatgacaggcagcacccatgatctcgtacaaaaggtattgaattacgaattagatggagcgttcgtctatggccccgtcgatgatccgcatatagagtatgttgcagcttttgaagaggaattggtgctcatctcggaaccagggaaaaaggacatgggtgagctgcttgccaagcctatgctgttcttcgacgtagggtgcacgcatcgtacaagagcggaaagctttctgagcgaagcgggtgtggatgcatatcaggttatggagttcggaacgttggaagttattttgggtggtgtagcctctggtctgggggtgtccatgttgccacaatcgtcgattgcaaaggcagaggaggcgggaagtattgcttctcatcgtttacctgaaaaatatcgcaaattagaggtgtggtttgtttatcggcgggattcggtttactccagtgcactgtcaggcttgctccgctggatgaaaaaggatgttatacttaactgggattaaattgacatcaggggtgtatcatttggaagaacctaatttattgaaaaatccatctacagtagctccaggagaatttgtgaagaatggcggctatcagcgacgagaaccggataagatggcagtattatcagaaacatacggtgcctctatttttttcagaagatgggcggcttggatgattgacttcattcttatcgtttttgggtacggagggctggtttattttacagcgaaaaaagtatctgaagcggcaaccccaaatatgggcttggtagtgatgctcttcctgatgggctccttctgctattatctgttactggaaggactcacaggctatacgctgggcaagtttgtacttcgcattcaggtcgtaaatggagaagggaaaccgccgggcattgtgaaatccttgatccgtacccttatacatttggtggatacgaatccgctacttttcttcgggctacccgctggtatatgtgtgctggtgacacctcggaaacaacggattggagatatggctgcgaatacatatgtggttaaggtacgggatttggggacagtgagcagaaaaaaaaccggaattttgtccggggtaatcatcctgatgacgatcatttcgattgtctttgctgtatctttaattactacgctcattactcaaatcgtgaagcctgaggtatttaccagtaaggatagtcagtttgcggttacggctccgtggaattggtcacgagatgataggattaatgaggacgcggacatctccattaaaaatgaatttaccgaaagatatttaattgtattgtcagaaccgaaaagcgattttgacagcagtatgactcttcaagattataaaggaatcattgaggatcatttggtatcaggaattatggcccctgaattggggaacccttccgacatcgaggtaaatggataccctgccatcgaatttaccctgaaaggggaagtggaaggtactccaattatgtataacgtgaccacgattgaaacaccttcgcattatcatcaggttcttgcctggacctacgcttcgcgatacagcagggcacagcaagagctatgcaagattagagacagtttccgtgaaatgaacatgctgtgaagtgaacatgaagaaataacgatgattcgaagttataagagtaaacaaaaaagcagatgctcacaggagcatctgttttttggtatttaagctaaatttaaaagatgaacatctgaaagactttattctagaaattcggaggcggtggcgatgggaagcactctccgcctgcgtagtggcgctatagtagatttatatagatattttgatcatacaatagaatgtctgattatccgcaatccggccactttcgccaccttaccttgtggatgggctttgaattgaatcgtaacttcattcttgtggcccgtcacagatagaggaagctcataggtgaatgtttcgaatttattcatttcctcagactccagcttgccttcccctaaaatctgaccatccgcagtgatgtcaaagtcaccatggggacggctcaagtccttcaaataagtgaccgccaattggacaggctcatctggaagcaccttcatgacaaaagagaaccagccccctggccaggtatcgcgatatttgcggttatagatggaccccagacctacatgctcgccagtaaaggcatgatcccgttcaggctgcatttcggcaggctgcacaacgtccactgtaagtcgttccagctctagctgatacgctaacgcggtacgatattctgcctctgttgctgcccattcctcctgggaaaagagatcccaatagacggtatatgaacgatcatacatctgataaaacggacgaagcttcaagtctccgatatagcctaagtcggtcatatggaacgtattaggctcgttcccgtcagcaatcagcttcgttgtcagggaatcggccgatccgatcagaacagacgcaagcagacgttcctcgttggactcctgttcaacagggccaaggtccccagccagtacaagcgggccgtacataaatgcaattcggcgcggattgtccggcatttcctcgactctcacggtcataggaatgtcgtactcgatcgtatccccatcgttccatttccgttcaattacaacgtagctggtaggacaagcctctgtgacgtactcttccccgttgattttaattatcatcccttgctccgcccaatgcgggcatcttagcttgatcgcgaaggatttgggctccttgctgatgacgcgtagcgttccccgtccattttgcggaaagagagtgtcttgtttgagctgtacgcccatctcgtcccatgtcacggtagaagggacatattgattgacatagatcgttgctggcgtgtgaaaataaatcgcagtgccgtacatggagtgactttccataccggacccgacacagcatgtgaaatcctcatattgagaattaaaggacttgtgtcctcccatttccagcgatacaaaatagcacacacgtccatctacaggctgctgtgaagccagaatatgattgaacatcgcccgttcatagtaatcggcataggctgcataggcgtcccactcgaacatatgtcttgttaatttcagcatattgtaggtgttacaagtttcacaggtaccttcgcccaagcggtcattcagcttgccaggttcaccaaaatgttcattatagctattgccgccgatcacgtaggaatgcttgtgaacaacccgatcccagaaaaagcgagacaggtctgcatattgcggtttgcccgtcatttcaaattgccgtgcagcgccaatgattttgggaatttgcgtattggcatgtcgccctgccaaggtatcttggctatccgcgagatcattgagcacctctccgtgataaaagcgttccgccagactcaaaaagcgttcttctcccgaatgttccgccagatccgttagaacctcattcataccgccaaattcgcaatgcagcacctgctgcacctgatcatcgtccagtccttgaagtacatcctctagccagttgccgagtttgatttctatagagagggccttgggatgatgcgccagcagatgggcatcacgcaagcccgcaaaaagtttgtgcatggtatatagcggcacccagccaccgttcagatcaaagccctgggagcggatatctccagcttttacttcctcaaaaatctctttcccacgtggaatgccggaaatgtatccgtttccatgactgttttggcatatttccagttcgtcgactacatagttcacgcgttccaacagtctttcgtcgcctgtggaggcaaacatcagcgcacagccggacaggtagtgaccgagtgtatgtccgctgatgccacgcgcttcccagccttcatagtgagccgctttgggctccaatcccgcatattcacgaaagcgcgataataaacgatcgggttccaagctcagcaggtaggccatattcagttccatcgcatgtaaaagtgggccggaatcaattcctactttatgcaagtcaaaagctttagctttcaaaatcatcgctccttagctaagatgaaagtgtatatttctccactacattagcattggaatcgcggtatgtcagtagcttaaccatacaatgggtggacaaatccgaacatgaatctaaagaggcgataacatgacctatctaaaagtaaatgtagatgctccgatccaactgatctcggcaggcgagtttgtttccgaggtgccttggaagcatatgagtcgctccattgataattttgagctgatcctgggtgtccaagagacggtatatatacgggaggaacgggaagattttgaagtaggcgagggagatattctattgctttaccccggtcgtacgcacaaaggataccgggaatcgttgccgggcgtgaaattttattggtttcatttcgatgttcccacgaccccgaatgtactatctaatgaggaaatgaagcaggaaacaagtgctttggatgggcttttgcagcgtcacggtgtgatgcgtgatatctatttaccgcaaagtgtacaggcagataacggggatcggattcatattatcgtcaatcagattttacatgtagccaactcacattatcttacgtatcacagtgccaattatttgttcacctcgctgctgatcgagatatcagaactggcgcttagccgcttgctttccaatcctgctcattcacaggggagtgtgagttttaacaaaattattgagtggacccgtattcatgctgaagaaccgttgaccgtgacggatttagcacgaaaattcaattataacaaggattatatctctcgtttgttcaagcaaaacacaggtatgcgtcccttggagttcattcacagtattcgtatcaacaaagccaaagagttgatttcccgtacagatatgagcattaagcaggttgccgaagaggccggatatacagatgagaagtattttatgcgtttgttcaaaaagagagcccatatgactccttcccaataccggaatgcctatcacaaaacatttatgaacaatgtctagttcatttccgcttggatcgtaaaggcagagctgaatatatccaccattcacttgcagcgaagatcgatgatttgaccgaggactgaccaacctgtcaccagagaaatagcttgtcagactgtaatttggtaatctgatataagagatcaaatgagagcaagcaatacataatacttcatgaaaaaggggcgagcgagatactacaaccaccattaaaggatgaactgactcgaatactggaagggtattcactggatgaagaattaaaagaagagattcatcaggaagctcaagctgctatacaatttcatgtggagcatgaggaaaactacgaacacattggaaatagtcggatcgccggctatccagatctgccacccacgatagagtggccttgtaattcagacggggaatattatacatttattgcccaaattaatttgggcgagctacctttttcaccatttgagggattgcctcatcagggcatactttacttttttcttgggctggatgagcccgcctatgatattgaccataaaatcttttactataatggcgacagcagcgttttgcagaaaacattaccgcctgctgggcgcgtagaggtgttggcggagcaacgggatttcaccgcgtatgcaatttcttttcatccgatcctgacgctaccatcggagggtgagctaggagatattcttgtagatcagtacgaagagctttatgagcttctatatgaacatagcgacacggtgtgggggcagcatcaatcttttgccgggaatacccggcgggatgcttatctacgccgaaacgggctggagggtcttttgtttaactggcataagagtgagagtcagatccataaggaaatcaagcaagcaatgcataggggaaataccgattatgcggagcatttacgatccgaagtgctgactcagctgcaagaatatcaaacgaatcgggaaaagcacgatcaggcttcggaaaattggcatgttctgctctcagtatcttctttggacgaggtcggcatgtgctggtgggacgcagggtatttggaatttttgatagatcaaagagacttgaagaaccttgatttctcgaagacatatgtcaatcttgctacgagctagctaaagttctagactgggaaaataaagtattaaactgacgttgcttcattaagttggcaaatagcaacaaatcacagattagttatgcccaccagctccataaatcgtgagagagcactggtcatgtatgagtcacgacgccttataaacacagtgggcactgttctgtacggttccggtaatggatgacagttaagtcttccctgcatccgtgattcaaccatagatattggtaagacggtgactcctaacccgttttcaacgcatttaaggacaccctctagagtgccatattccatcaccttcataggagcatagccattgtcctctagccatcgctgccaacgtcccaaatagatgcaatgcgcgaatgacgaaagcagtggttcatgtaaaatcaattctaattggaatggttccggagagtagcttgtaatcaaaactagagattcttcgaagacagggtattcaacaatttccggatgaagaattggcccatccacaaatgcgccgtctaccttatatttgagaatggtactaacctgatctacagtaggtgccatatataagcttaattctacttgtggaaatttcttgtgatattgtgtaaaaatcaatggcaatcgtgtagaagcagttgactccatagctccaatgcgcaaagttccccgcggggcagaagaaagcttaactgcctcaatcgcttcctcgaaatcgtaaagcaacttgtttacatgcggcaacagttcacgtcctgcaggcgttaaggataccttcttatgatatcgatataacaggggaacgcccaactcttgctcaagacgttgtattcgtgcagtaacattggactgtacataattcaatttctcagcagcttttgtaatgctttgttcaattgctactgccttaaacacctccaaagatctaatgtccaaaacaactctctcctttttgcatcacaaaatgtgattatctatacactattttttaattttacgtgatgcatagcagtatgtaaacttagtgaataagagggatttacaccaaaaccaagtgattgagtacctcgttatctgatgatgaggaggagaatgggggaaaaggagattctagccggggcaaaatgcagtacacgttaccaataatgaggagggaatctcatgatttcgaaggtcaatgtacaagataaatttttgcaaataattgattattggaatcccagaataggtggagagttgaacgattcatacgtaaaaatggcaaagatcaagggtgaattcatttggcatcaccatgatcacgaggacgaaatgttcttcgtatggaaagggagactactaatccgtttgagagacggtgaaatagctgttaacgaaggggagtttgttattatacctaaaggggttgaacatcagccaattgctgaagaagaggtccatttactattaatcgaaccaaaaactactctaaacacgggaaatgtggtaaatgaacgaaccgtttcgattcctcaacgaatttgatgaaacgctagttgaacaaatagtctaaacctcctaatagaagcaaaactagaattaattgcccaagtaggaggctttattatgattttaagcgaactttggcgtcattatgaaacggataagcgaaattcctaagttcttgatggaggaagatgtaattcatctgatgatctcttgtcagatactaagagaaagagctttacttgagtttctctacagcacaggctgccgaattggagaggtcgaactgtatcgtcgatttttttagtatgttagcggctgatcctcctttagagatccgccgcattcaactaaagggcaggatagttaacaacgaaccaagttaataatatggtatattgaacaataaaaaggaggtattagtattaattaccaatctattaatctgaatgagaaattatctaagtttaatgagcattggtctccgaaagtcattggtgaaatgaatgactatcaatttaaattggtcaagatagatggggattttgtatggcacgatcatcaagataccgacgaggtgtttatcgtgctcgaaggggagatgttcatcgatttccgagatggccaagtaaagatttcccaaggggagatgtttattgtaccaaggagtgtcgaacacaaaactttcgctaaccaggagtgtcatatcttgttggtagagcccaggggcgtagtaaacactggcgagactgagtcagaattaacagcagtcaatgatatttggatctaatgcatttagcttcagttcgattacatcgttaaagtaacgggacacgttaactaaacattaaggggtagtatgccatttggcagctgctcctttttcattaaatcaacgggtagggggttagaattaatgaccgatataggagtggttattatgaaacgtgggggagtaaaatgccaaatagtatgtgtttagggtgtcaatttgcaaataaaataattgaaacgaacactgtttatgagaacgattacgttgcttgcattctggatatcgcaccattaaatgagggcatgttctcatacttcctaaaaaacattaccacggagtcggtgacttgaacgaaattactgccaacgagattatgaaggcatctataatgctaaaaaaggttgatagtaacacaattccatcctgatgggataaccttcattcaaaatggtggaatttaatgatttgtcacattatcatatgtatttccttccacgctatgattctgatagttttgcttgggtggaaccctccgacaccacgaatgcaaaggggcgtttaaacgaaaccagagaaaagttggtgaaatgaataaactagctgtaattgcgctatcgggaaatgttagttcaatagaacaacgacaatctaggactttattttctgctgacagtatgattggaatgataaaatgctaaagcccttccggctttccatgagggaagcagcggaagggcttttgttatatctacttgtctaacagtgagcgtgcttatttatactcgttgcatggtaaattcgaattccagcttttgatcggctgcaatttggtattcttcatgtactggagctccccagctgtcatcgccgcctacacccatttgctttccagctacggtgacaacggtgtaatacacgttgggcagctcatacagatggtaggcactttccagctcaaacgctgtatacggcgaaatattgcattccaccggtgcggtagcaggtgcagtaatgcgtatacctcgctgagaatcgtcggtaatatcaacacggcgcacgcctgtacgattgccggattcctgcggcacgacatacccggatacgttatccgcagcttcgttgcggaatacgccaagccttgcgccgaaggcccggtcgatgtaattctcatccggtcccatcgcataccagtccagatggcgatagtccgccggaaccttgaacgaaagggcaaagatcggcaggttaggcaatcctgagacgccttcataagtcgactttacgttcaggctaccgtcggcgaagacggtgtaggctaccgttatctgtacgtctgcatggatgctcagcgtgtagcggaatgtaacggttacatggtctgtttgttcttccgtaacctcgatgcccacacatttacgtgtcagacttgcagcgaaccagccaccggcttcaaagcctagtgcggttccccgatcattgtctgtggtcgcccgccagaacaatggggcaggagggatggcgatcatctcacgtccggcgtagcgaagtgaagtcaggctacctgcccctttggagaacatcatactgaaatctgcaccgtgaacgccaatgttaacatcgccatgcaccactcgtaaggcgccacccgaagggattttcagtggatttggatcttccacgatgaaaatatgctgtccaaaggccacttcgtgtccagcctcagcccagagcgtcgcttccttcaaaaccagagcggtgtgaataacgtactcaccaggctttccatccgtattagggaacgttagtggaatataggcttcggtctgagccgctacatctacatgaatggcattacgtgcgatttcttggccttcatgcagcaggctatatactaactcatagtcgcctgttccctcgaataggttttcattgcgcagggttacaccgctgcgatccggggtgagcttcagattttgatacaggaatttgacctcctgcatcttcggcgaaaccttccggtctgcatagacaattccgtccgtacagaagccatagtctgtagcacggtcgtcaaagtcgccgccgatcgcgaggtactcgcgtccgtagcgatcttttttcataacagcctgatcaatataatcccaaataaaaccgccctgatacagctcatatttgttctccagctctgtatacttgtgcatgccgcctacggaattacccattgcatgcatgtattcgcaactgatatacggcttttgcggattgtcgttcagatattgctcgatatctgcgggtttggcgtacatccggctctccatatcgctggtatcatcgtacgtacggttgtgaaacacgccttcgtagtgcaccaaacggctcgggtcggtggctcggaaatagttggcgacattgcgcagcacttcacctgcatacgactcattgccgcaggaccagattagaatggatgcatggtttttgtcccgttccagcatggaaatggcgcgatctatgacgatatcctgccactcaggcagattggcgggaatattccacgatggctcgacggcgccgagtttttgccaggaaccgtgtgtttccaagttcatttcatcaattacatagactccgtactcatcgcatagctcataccacagagtctgatttggataatgagaggtgcgaacagcgttcatattgttctgcttgagcgtccggatatcccacagcatatcttcacgggaaatcgcacgtccggtgcgagcgttaaattcatggcggttcacacctttaaagacgatgcgtttgccgttcaaatgcatgaccttgttgatcagctcaaatttacggaagccaattttttgtggaatgacttccacgagtgatccactggcatcataaatttgaatgaacaacgtgtataaatagggtttctcggcactccaacgctgcacttgctccaaggttgctgacagcgaagctgtgccatcagtaaagtcagcttttaaagaagctacaacatggccggcagcatctttcacatcgacagttgcataggccgttgccggcttttccaaggtcaatttcagttccagaagaccctgtgtgtaggaagcatccagatccgccttggcatgcaggtcacgtacgtgaaccgtagggatggtatagagatatacgtctctgaaaataccggaaaaacgccaaaagtcttgatcctctagccacgctcccgtacttctttgatatacctctactgccagcttgttttcacctgcttgcaagaacggtgtcagttcgaaatcagacggtgtaaagctatcctcactgtaaccgacaaattgtccgttcaaccatacatagaaagccgactcgacgccttggaaggaaatgaacacaggctgcgcgtcggaagccatattttccggcaaaataaagcttttgatatagcttccgaccgggttgtgatcctcaggaatatggggtgggcgaacgtccgaatgtccgtcccacggatacatcgtattcacgtactgcatttggccaaagccttgcgtctgaatgtgacccggtacctgaatatcgctccagccgccatactcaaagccgggcgcatagaattctaccggacggctggctggatttgttgcatagttaaacttccagctcccattcaggctatgacgccaagccatatcagcttgctgctccgcttcctgaagcgtagcgtaatatttgtgatcggaataggcgggcagccgatgtacagcaaatttggttacgtcggtcagccagtccagactaggggtatggatggtcaaggcgaacactccttatttttaaaatgaaatgaagatcgtacacagaagtttgttatttaaccgaacccaccatgcccgctacaaagtgtttctgcatcaggaagaataccagtgcagtcggcagtgtggacaggacaatggcgatcatgatgacaccgtaatccggtgcatagctggagccgaggttcgagatcaacagcggaatcgtttgattctccggcgtttgcagcacaatcagaggccagaggtagttgttccagctggacatgaatgtgatgatcgcggcagcggcataggttgttttcatcgtaggcatatacacccggaagaacagacccagctcggataatccatccatacgacctgcttccagtagatcctttggaaacatcttggtgctttgacggaaaaagaagatcaggaacgccgtagttacggtcggaatgacgacagaagagagtgtatcaataccgatccacggtatgacattagaaatgctgccgaacatccggtagagcgggatcatgatcgccgcaaacggaatcatcatagacatcagcaggatattgaagacaacgtctttcgctttacttctgtaaatttcaaagccataaccggccagtgatgcgattagcatagccagcagcgtagttgagatagagacttttgcagagttacttagtgcggtaacgatgtctactttttcaagcaaattgtgcatgttatccatcagatgggagccaggcagaagcttgcctttggtcacatcgaccgacaggttcgtggagctggatatcatccagaggaacgggaaaatcgaaacgaacgacacaatgatcagaaaggcgtacgtaaatgctctttttgttttcatcattttttctcacctgccactttgaactggataatcgacaagataatgatcataatgacgatggaataagatacggtcgccgcataaccaaagtcggatgaatacttgaaggacagattgtaaatatattgcgaaattgaagatgtcgcgttccctggcccacctttggtaatattcataatttcatcgaagagttggagtgtaccaatcgttgatgtaatcgaagtgaacaggataatcggcttaagcagtggaaccgtaatgctgaaaaactgtcggatcggggaagctccgtcaatacgggccgcttcgtagatagaattgtcaatgttctgaagaccggacaggtaaaagatcatattataaccagtccagcgccatgtgatcgcgataataatcgtaaccttggcccagaaaggatctgtaatccattggatgggcgtgccaatcacgtgcagattcagcaataaggagtttaccagaccgtcggacgagaacaggtacttgaagacaaccgagtatgctacaagggatgtgatacacggcaagaagatagctgtgcggaaaaagcccttgaatttcaggtttttatcgttcaacaataccgaaatgaacagagccagaatgaccatcaaaggtacctggaaaattaaatagataaacgtattcttcacggcggttataaacattttatcggtgaacaatcgcttgtagttatcaatgccgttaaagctcagattagaccctgtacctgtcttaaaggacaagataagcgcctgaatcatcggatagaaataaaaagcggcaatcatgatcactgcgatggatatgaacaaccatcctgtcatacctgctttgagacgtgttgtagttattttgggcgcggctgtcttcataccatgtcaactccctgtgcagcaataaaaccttgaactcgcaagcccaaggttttaagtgcttatcgttttattgtttagccttggctagatggactgtcttatttaagctgtgcttccgcctgtccttgagcatctttcagaactgcgtctacatcttttccgttcagatagttttgaatttcaacggtcatgatatcctcaatggcatacgtgtgcaggccataattgacttttggaacttgtttagtccattctgcaaatttcttgtatactttgtccccaccgaagtacggatcttctacgtcataagctttaccactggaagctgcgttcaatgaaccaacaattccaattttgctcagcatatcttgatacagctctggatctgttccgaatgtctctttcaggaaatcagcagcggtatcttgaccgtccgagttaagaacataccaggagctgccaccgaggctggaagcattcacggattcaggtatatttttcagcttagggaaaggaacaacggcccatttacccgattgcgaagcttctgctttgatcgaaggtgtaatccagttacctgtaggtacggaagcaactgcaccgctgttgaatgcggccaggaactgactccagtcggcattcattttaacaatgttagcgtcgaacaaggatttgtacgtcaagagcgcttctttcagagctggattaccagccaggtttggtgttttaccgtcttctttcaggtaccatgaacctgcggcttggatcataccacggatcagaccgaggtcattcggatcttgagtcagcatttctttgcctgttttttgttttacggctttaccaatttcaataaatttgtcccaatcaatattggtcaggtctgctactttgtagccggcttgttccaaataatccgttcttacatacagtcccataacaccggagtcgaaaggaacaccgtattgcttgccgttgtagctagtcggtccgattttataatcagcgaagtcggatgctttgatcgtgctgctcatatcatggaaagaatcgggataggcctgcaggaagttctgtgcccgataatcctcgatcagaaccacgttcggcagtcctttggtagaaccagagttaagaccggcattcattttttgtacgatatcgttttgggcatattcaacaatgtttacggttacatctggatgtttggcaacgtagcgatcttttgccagcttcagggctgcgatattaaagttcgggtcccaagcccagacggtgatttcttttttgcctgaatctgtggtagtagctgctttctcggaattgctggagcacgcggatagcaagatcaagcttgcaatcagcagaaggaaagtcatttttttcattttgttcaacccctactcttttttatatgttgcttgctagttctaaacctctcaaatgaaagcggttaccttatttataaatctagtgtaccatccatactttgttggtgttaggaatatctttatacggattggtcttattattatgatttatcaaaaaaggtaccgcttacatttgcattttattttggtttaggtactttttttaggttgaactaaagttgttcacgaagcgccactgcgcggccggatggtgcttcccatcgctgttgtatccagatttctttattcaaattatataaggttgaaatctggatacaaaggcgaccgctacgcttgtacagcaccattccgcccactccgttcttgttccaccttctttgtttagttcagcctatattttttatggggtaggaggggcgggttttacgatcaatggcagggtcattctgactttggtgccctcgccttttttactggagatggtcacgccgtattcttctccatataaaagggtaatgcggttgtgcacattctggatgccgatgcctgtgaacagttggcgcttgctcttgggattcggcagtccgtcctgcgccgtatgcccgtccaattccataccgtctccatcatcgaccacctcacagatcaatgtatcctccgttttggacaccaatatatagatgtggcctgcatttttttcattaaacgcatggaaaaatgagttttcgataaaaggctgaatgatgagcttgggcacatggtactccagacaatcgggtgatacaaaataattcacttgtacccgctgcccgtagcgtacatggttaatgaacacataattttgcatgttggccatttcctgctcgatggtgatcgtttcacttacattgctgattgtattttgcagtaaggaaatgagtgcattgatcgtctcggcggctgtttccttgtttcctttgagcaccagcattttgatcgaagccagtgtattgtacagaaagtgcggattgatctgccgttgtagtgcagcaagctctgcgttccgttgacccttttgcgtctctaaaagcttacggatatagtcatttagttcatccagcatgtagttgtaagcatgacttaattgtctaacctcatagctgcccgttaccgggatataattatcgaaatttttctcgcgtatggtcgacatttgcttcaccagtcgagtcagcgaacgaatcagtcgacgggatatcagaaaaacgatcaccaaagcaatcagtacgatggcaatgcagatccatacaacggatttaacgtcaataatttgcccaatggcggcttgtctgtcaatcatgttcaccagataaaaatcaaatgaagggatatagttggaaaggaggatactctccttattcatcacatccgcattcatgtagttaagtccctgttcattgatttttgtggcatagcctagcaactcactggagcgttgtccgatcagatcctgacgattgctcgatacaatcagtcccgacttgtccaaaataagcacatcattgccattgctcgtgaaattgttatagaaacggcgaaattcaggctctcggatagcgatgtagatcatgccgtacagggtgccgctggtccgctccataaatggtttggaggcgatgatatagggtgttggcttttgcggggtactattcatttgttgctgcaacaattcagtatccaattgatacataagctgtgccggtcgtgctacacttcgggctgtaatagcactgctcttaagctcttccgcagttacaggccaataggacgagtcggagtaaaagctccgcccgttcagacctgttacagcgacaccgacatcataggcatcgacgttcgatttaatttgcttcatttgctgtgccattccgaagtaaatcctcgccgagttaatcgagtcagattgaccgccagtcagatagttcttgaccgttccattttccgaagcatgggttacggcattcacgatagaatcattgaaggattcaaagctggattgaatctggctgagtaccttggcatttgtaatactgaatgtctcagcaaaaagtcgttcagacatccgaatcgtcaccaaagaggtcagcaaggacaccgcagtgatgctgaccaccataacaataaagattttgaagaacagaccttgatatttgatcttatggatatatcttttcatatgcaatctcttttctactggcagatgtggcttactccctaatagagatgctcccggcggtactgactgggcgagcaacccttcacttttttgaacactttggtaaaatagctggggtccgaatagcctaccgtgctgctaatatccgaaatggacatcgtccccgaccgtagtaactctgcggctttttcaacccgaattttgttgagatactcgctaaagccttctgtatggtgtgccgtaaaataactggacaagtaggaagggttaaagtgaaaatattgcccaagtgtcgtcaaattgagtgtttcagcatgatgctcctcaatatactccagcagttttttcatgcttgcactacttccttgctgtgttttagccatgatctgtctgttcgcttcctccaaaaaagtctccagaaggcgcacggcttcatgtacatgaggggcatcattaattgttttgaaataggaatatttcgccgcatccagctccttcatatcatacccctgattcccgagcaaaatcgtaatgttgaacacgatatttccgagaagcgatttgaattcaaaagcggtagaggtatagttaccggacatggcggctacataggatctcaaatcctgaaaagctgtatcaaaatgctcacgcttcatctcttctgtaaattgttttaagttgaacgagctgttcacctgtacaggcggagggagttcgtcttctattagcagcgctgttcctggaaaataaaagcggtaactcatcagttttggcagttcatcctgatagacgtcactaatctgattgaagtcatcaaataaatggctaactgcccagcctgtctgtggatcgactcgctttgtctcctgagcaacttccctaaccgtagccatccaggcgttcacttcccgtggatcaagattggctaaaaacacagccgcatagacatcagatggcagttgtcgcagtacgatgtactcacaggcagaggatactcgatccgtaagcttggaaaataggtccgaggcagagatggagcgccctttatcctgctgtgccagctgttctatacctatgagcgcaaaacgggcataaggaaatgcttgcttcagcagctcggcgtcatagtccatgctataaccggagatcagcttttcgatcacgtgatctatcgtaatttgactattcccggcatctgcttgatattgaatggatggaattttgcgagcggttctctggagtacctggagcagctcatccgtgtccagcttgggctttaaaatatagtcagcaaccccttgctgaaaggtggatcgcacgtaattaaactcgccgtaactgctaagtacaatgacttcgatatctggatagttctgtctgactatgcgcgttagctcctcgccatccatgatcggcattacgatatctgtaatgactatatgagggcgcaaggtttcaattagctccaatgcttctttaccgttagaagcttcacctacaattcgaaatccatactgttcccacgacaagtggtgtttgatcccttgccgtaccaatatctcatcatccacaatcaaaatgttgcatagctcattcatggcagcactctccgtaattatacctattcgaggaatttgcaaaaatcctgattcaaaaaagacctccatcacatggacgtcatatcatctgaggcacatatttgacaacgcttccaatttgacttaacttaaatctaaagcatttaatctttatatgctaacataaactacacggggattccaaaaaaatttagtccaaatggcatataaaacaacaaaaaaggcagccgagaaaatctcgacagcctaaacaaccgggattaccttatacagtgccccatgttcgatctcccgccaaatatttctcagtcaaaatagacagcagttgaataccaacctcattgtgtcctccctcaggaaggatcaggtcagcgtatttcttggaaggctcaataaatgcctcatgcatcggcttaacggtagtcaaatagtgatcgtggatcgaatggatggtgcggccgcgttcctcaatatcgcgaagaacccgacggagaatgcgcacatcagggtcagtatccacaaatactttgatgtcaagcaagctgcggagcttttcgtctgacagtacgtgcagaccttccaacataacgatgtgatttggcagaagctctaccgtctcgtccgtggagcgtgcatgaaccgtaaagtcatacactggcgcttgtgtcgcttgtccttttttcagacattggagatgctcaataagcaattcgttgtcaaaggcaaacggatgatcataattgaccaaagcacgttcatcataactcagatgtgaatggtctttataatagttatcttgagatatgaaagtcactttattagatcccagacgcttaacgacggcgcgtgctaccgtcgatttaccggaacctgtaccgccggcaataccaataataagcatggcgtttcacttacccttccctaaatgtatcccgatacaactcaagtattgtagcacaatgcacactttttttcatcactgttgaactttgtatttcttccatttccgtatcttggctctgaatgttttaaacggtgccaccgagttgatatgaatccatcttgccatgggccatttcggattagtccctgtccagtcgtgaacgccctgagtaaagagctcttcatgactaagtgtgtcgatccaatccagccacttttgctcagccaacttgaacatatcgcgtaattcacgtaaagattggtgggagtaggtcttgtaaaatgattgatatagttcacctagtctattccacttataattgggggtgggcatgatcacggtttttccttcccgttcgtccctgtcccatgtcatgacaagatgaagccatccgagctggtaggcgatcatttctgcgggtgttttatctacttcagggatacgaatatccttttggctctcgtcgatctcctggaactcaccgtcaaatcgtaagtaggaggcatgaatggcttcctttaactctgatttggaggcgtattcgtaactggacatctcatcgctcctttaaatgatatggatgatactcacccctttatatgtaccattcccaatatgacaaccgtatgtcttattcaaaaataaaaaaatatcgttttttgtgattttatgaaacagcagttggtgtgttcacgaaaaaggatgcaaaattaatagagaaattaagacaaaagataagtaattagacatattttaatatttatttaagtgtctataattattggagtatagcgcttagggccctcattggtgttgggatattattcccttcatcagtacgttatataccgttgggcatgtcatgtccgataaacggtgcaacctttgctttagtattcatgaatctaatcgagaaggagactgttatatgaagtcgagttttttaaaaaaatgtgcaagtgtaatgttaagcagtacgttggtactgtctttatcattaccgttgctgggtcatgcacatgcggatgggaatttacagataagtgatgattttgaacaaggggaagctcaaggctggaccgcaggatcggggaactggtctgtggtcaaggatgggaatggatctacataccaacaatctagtcgaagcgaaagccattccgtcaaaggtaatgcctcatggacgaactatagcgtgcaagcagatgtatatgtaaatgattttaatggctccaatcgagtctacgttgcaggtagatacacagattccaacaacttctatgcagcttcgttgtacaacaaaaaagacggagctctcgagattcgaaaaaaagtcaaaggctctatgaagacactggctaccaataaaaaatacaaactggacacgaatacatggtacagagtcaagctggaactatccggttcggaaatcaaaatgtatgtcaatgatcaactggagctgtccgctacagacaccagcctcactgctggagccattggtttggtaacctccaaagcagctgcccaattcgataatgtgatggtatccggtgcttcttctgaggtagatccaggaacaccgcctgtgaatccaacaccagatacagaacaaccgactcctggggtgaaccctgatgtaaccttcaaaaataactataatttgactggattttcgtatgataacaccggtggtggcaatattgcggataccgatgccaactacaaaaaggtatacaatgctgtagatctcaacgaagcactgaagaaagacagcaaagtcaaagtgattgagattatgaacgatcttgatctcggttggaatgaaattcctagtgctgccaaagtaatgccttttagtgccaacaaccctgtacagacgcatcctgttctgaaaaagacaggtgtgagcaaagtctatatcgaaaatatgaatggggttacgattttctctgccaatggtgcgaaaatcaaacatgctggctttgtcatcaaaagaagctctaatttgattttccgtaacctcgaatttgatgagctttgggagtgggatgaagcaaccaaagggaactatgataagaatgactgggattatgttaccatcgaaggtacaagttccaaggtatggatcgaccactgtacatttaacaaagcctatgatggtttggtagatgtgaaaaaaggtagtaacggagttacgatttcctggtctttgttcaaaggagatgaccgcagctccaacagctgggtaacccaacaagtcaacgcgatggaagcagacaagtcttcctatcctatgtacgcgtatctgagaagcagtgcagtaggcatgagtaaagaagatatcattgatattgcagcaggacaaaagaaggctcatctaatcggtgctacggaaatggcttccgacaatgcagacctggaggtgacgctgcatcataattactatctggatattcaggatcgcatgcctcgtctgcgtggtggtaatgctcatgcatataacatcgttatggacgatgccggattggccagagccaaaaaaagaattacttctgatatggctaaagcaattgctgcaaaaggataccattttgatgtcgtgggtaatggtgcaatttcaacagaaaacggcgcggtgttgctagaaaaatcgtatttaattgatgtattttctccagtgcgtaataatcaaaaagatcctaacaaagcggattacacaggtaaaatcaaagccgaggacgttatcttttcgaacaacggtaccgtattcagaggaggcagtgacgatgcgaatagcccgttagccccttatcctgccaagaccaaggacttctcttggaatgggttcacaacgttgccatacagctatacagccgaagaccctgccaatctggttgctcaattgcaggccaaggatggagcgggtgcaggtaagctgaactggtcgagtgaaaactggctcaaaacggtgtacaatacgtccgttacgaaaaatgcaatagtggaagaagattccgaataggtaggccatataaaaaagcagccagtacagataagctctgttgctggctgctttttttgttaactacgtctaggctgcgttcggtacgaacttaaccaataacgacaaacgaggatacgccagcaggtacggatctaacgcggaataatactccatcatctctaaaagtacgcagaatataaggctggttcgtaggtgtgcgaacattgttaaatcgcgcagtaccaaaaccatcgaagcctgcagcttggacaaagcttccatctagacgccggagtatagcaaagaatccggttgtgttaaaaggaacaccgtttgtgttagcccagataactgtaaatcggcgtagagtttgtgtagggctcacattgcgatatctcgtaacaggaacctttctgcccgtagatttcaatgtttgtggaggacgaatggccactaaaaatcaactcctttgttgtgatgagatagtaaatgcacacaaaggagttttggactgtgttattaactacgacttcttataaataggtatatatcgaactcaaaatgacactccatgtacattatcgttcgattcgggacctcatcatgcccaatcgcgtcgtagtgtaaagaggtcttttaacgcgtctgtagacagctcagtaatccagccctcggtactggttatgatttggtcgctaagctgctgcttgctttccagcatttcatcaatgcgttcctccagcgtgcccaatgagataaatttgtgcacctgtacatccttcgtttgtcccatccggtaggctcggtctgtggcctgattttcaacggctggattccaccagcgatcaaagtgaaagacatggttggcagccgttagattcaggcctacccccccggctttgagagacaaaataaacacggacggctgctcggcaggggggagcgtgtgagattggaattgatcaatcattcggtcacgggccgttttggatgtgctgccgttcagatagagcacaggctcttgcagctcctgagcgagtacccgctggagcatctgccccataccaatatactgtgtaaaaataaggcagcgctcgccctcctcccgcagttccttgaccatagccagaatgcgctccagcttggatgaacggctaatgaccgcttcaagatcggactgactataaccggaatccgcagcattcgggagtgcctccttggttaagagggcaggatggtcacaaagctgcttcaactgggtaagggcggataaaatggctcctttccgttcaatcccttccagcttctgcatccgttccatcaactctttgacaatctggtcatagagcgcgccctgctcagaggtcagatgaatgtacgttttcatctcattcttgtcaggcaaatcaagctgtatagctgggtccttcttcttgcgtcgcagcatgaagggctgaaccagcttttgcaaatctaacgtgcgctgctcgttatgttccttctcaatagcattaatgaagcgattgctaaaggcgcgtaagctgcccagataacctgggttgataaaatcataaatggaccatagctcggacaaccgattttcaataggtgtcccggtcaacgcgatccgatgacgtgcaggaaagctgcgcacggctgtggattgcttggtttgcgcatttttaatgttttgcgcttcatccaggcagactgaatcccaagtcatgctttgtagcagctcttgatccagggttgccgtagcgaaggaggtcaggatgacatcggcctgcttgacttcttcgcggaacaagtctccctgctcccgcttgcttccatagtgcagcatcaccctcagcgaaggggcgaagcggctgagttccttctgccagttgcccagcaccgaagttgggcaaatcagcagcgaactggagcggatgcccgtctcggcggcaatatcctgtaggtgcagtaaataagtaataaactgcactgttttaccgagccccatgtcatcggcgagacaggcacccagtccaaaacgccgtaaaaaggcaagccatgcgtatccgtctcgctgatatgtccgcagttcggcttgcagcccgtctggcacgtccaatgcaggccatcccgactgtcgtccgagctggctgatcagcttcagcaaatgggcattcagctcgacttccagtcggaagcgtgccgcatcctctggctgctcgcccgaggcgtcgccttcaggctcgtcggcgttgccgagcagatgtagctgcaggatgtcctgaaaggacaatccctgagtgctgtcgatcccggccatggcccggcggatctgtgccagcagcgcggggtcgagcgcgatccattgcccgcggaagcgcaccaagcgctcgttgcgagcgaccagctcggcgaattccgactcgctcagatcggcgtcgccaatggcaacacgccaatcgaactggacaatcgagtccagtccgaacagcgagctgcctttcgtgcgctctcccgccccttcgcctgggcgtaccttggcccgcagcttcggcttcttgcgggtagctgcctcccaccaagccgggagcagcacctgccaaccgctttccagcagacgctggctgtcggtcgtcaggaattgccacgctgcttcgtcggagagcgggtgattcagcacgtcatagcggcttccggcacgctgcccggcaggcaaaatcgaggtcaagcgttctagccacccggctgagcgctcacggacatgtgctgtccaggcatcgggccatgagccggatgcgtacccatcatcggcgagctgtacagacaccagcaacgccgggtcttgcttgtcctgcaacacaagcttgagctgccaggacggctcgtcgtcctccagctctggctccagcagttgcagaagcggccgaaatggcgcggtatcggctttccagccgatggcgatgagccaggcccgcgcgtctagacccgccgcggccgggcggttgggagcgaagagaatcggatattctcttcgcaaatcggcggcttccgcttcggtgccgtaccagcgctgaaatacggcagccgagaacgccgctatcagcccatcctgctcgtccttctccaagctgcctagcaaagcaagctctgcaggttggatgttttccagtgcttccgcatcccacttccattgcagcttccctgcctggaatgccgtgaagctgggcacatatgctttcgcttcaatacagtgagcaagtaaagggatcagccgaagccacggggcatgggcctcgtcccagatccattcgatatgctttagaagctcgcgctctgccagaaaaggaatcacctgctccgaaggcagcaggataatatccgtatcttgaacatgttgaatctccagctcggtgccataaaacgaagcctcatgccaagcaaacaaacgctgcttcagaatttggccggaaatgctatagttcatggaggaatcgccatagatcagcgcgtctccataggtagttaattggatatgcacggtaatcgtttcggtatattgactcatgataacaatttccctttccgcaattcctcctgtagcgcccgcaggcggctatgacggctggtgaaggtcgtgaagaacagctcccagcgtgattcttgcttcattttcttgtacagcttgaacagtcgctttaacagcttgactgctgctttatagctggctctgtttttttctagcacataacgttctaccgcttgatggtaaaaggggagtagtaactcaggcgcgttcttttcaatgggctgtaacacgctcactcgaaaactcaatggttcactgcgtatgcttagctgatagtcgatccatgaccgccatttttcgtgggcaagcagcgcctcttcatacattcctccggcaaatggaagcatacccaccagcgtgtcccacatgtcctgctccgcttctggaaggtgctgcaaaaccacatcccaatcatgcatataatcctgtaaatggtcatcccgatgactgtgaagcaggggaccgatatgccgcagtccgtccttgagacgtgcccaattctcggctttgcgcaacgcctctaagaacaaaagcaattggttggaagagatttttagtggaaaagctcgttccgcttcctgaagaagtacccaggcttcattatcctgcgatcggtaaatatgcatccagctacgagccaacatccatggaagccgtgctaaagttgtgccgagatcctcctcagccgcctgtaaatgctgtaattcctccgtatatatgctggagtcctgtctttcggggtgcatccagttcagccaaaactgataatacgtgtctgaaaaataagtaccgttacgcgattctgtcagcatttttcggcgcaaataggctaaggtttctgcgatacggacttcttgcatcggttcatcggtcagctccagcgggctttcaaaatcacgctcgatagcttctttaagctcatcggcggcgatttgcgtgtaataccccatataggtatgagagggatagcccggcatgggagactgaggcaccagcttttccagcacacgcagatgagcatgcagtccgtatagctgttgcatgccgggtgaaagcggtggcttcacagcatagatcgaggctaaagcgctttggacatattgggaattttgtgtgttcacacggttaagggcgatacactgatcgaacagatcatgccactctgaaatgggcatgtctggtatcttgcttgctgttttactgagagcgtttcttgttgcttccttgtgatccggtgaaagattcgaccgggaaggaggtgtggtacgcgtgtcagcttttgccgccaatcgggtgaatcccgccgaatgagcgttcactaaagcatgtacagaacgttcctgttcattcgcgtaattcagtagtacggcgatcatatgcttgcagttggtgtggacagggcatgtacatctgctggcagcaaaagcactcaagtgaagatccacctcgtatagctcgcttccatccacgacagctgcgatatggtcggcatcaggcattgcgaattcttttacctttccctgcttaaaatattgaaagcctcgtttgatcgtcacgtcattaaaatggtcagccacgttttgaataagctgttgccactgtatatcatccataagataggttggtttcatatgattagtctcctaagagagaatagttgatcaggtagtagcttaactcttccattatatcagttcacgaatataaattgagtggagggagagttggaaatttcgaagatatccgctggataaagcaaaaagtccccttactctataacgtaaggggacttgagtcatcgggcaataatgggggctatcctttactgtttcccatccagattctccactcggcggaagaccatggagatgacaagaagtaccaaggggactgccgcgcatataataatgccaaagtaacctgttattttatcgaaattgcctatttcaataaaactttggggatacatgctcagggaaaataataaaattaacgggagataacagatgtacctgttccacttttgggtgagctggctgatcccggcaacaatatagaaataatagtttgaggcggtcatgaagattttgatcgtccacaaaatgataaataatatttcaaatcgttctaggaacgcgccagggaattcaatttgctgtgcaaaagaaacgaccggccattgcaatcgggaaacttcttcaactgacatacagccaacgaccatcgttaccatcaagagatacaaacccattgcaatcgagtagccgatccagccagccttccacgccttttgtggattggccataacatttgttaatatgagaaccgattcaaaacccattgccgaaaaaggtacaactttaagagattggaagatcgggccccatcctttatgaaaaacagggcgcaaattatcgatgtcaaaatgattgatattgaaaacgatcaacaataaaaaaacaataagggttaaaggaaaaaaaagctcgaccaatcgaaccatcgcatggagaccgccccaagtcaaataccctataagcagaagaaacggaaaaataatcatgcctattggcgttctctccaatgcaaggcctttgaggaattccgccatcattctgcatacaagcgagcagatcatcgtgcaatatacaataaatgcgatattgatgagttgaccgatgaatttacctgcgatcacaggattgaactcatagaacgtcttccctggaaatcgttgacacaatttaacatggataaaaatgacgcctatcccaagcagacttgccagcaaaagcccctgccacacgtcgggcgtttttgtctgctccgcaatggttcttggtaaactgacaatacccacagcatacacggtcgaagtgacggtaaataaggcttgcagagtagatattttttcctgtttcatggaaggtatattggacattacgctccctctccttttgtataagcacctgtccgttcgatctgtactttagcctgaacgtcgatcggtatttgactgaatgtatcttgccaattttcctttacccgatcccagtaagcgggatagttcacttttacttttgtgccaaaaccgactacatctgctctcatttctttctggagcgtatttaacgatagggatactgtttgtctgatttcatcttgcgccgcttctttagcagtttggatgaatgattccttcaggaagtctacagaattatccgagctttcgtttagtttgatatctgctttaatacgaactgtgaatgagagatcctgcccgttgaggtgggggataagttttgtatggacatcctcaacttcaaacaccatggattgttccgattttgggccttcagttctaataattgaacccttcgtttttcccagcatccagttgatcccggtgacttccttttcatctatccaattagcaaatttcttcgttttaccgcggaccaaagctgcgcctgagaagtggttgcctccattggtttctatgcattgaatgatgaagtcagcgtcttgtgaagtgtgtgtagagatttctcctaatgttatttcttggggaatctcggagttgagatcgctatttttggccaaagcctcaaggtcaatggtaggtatatcttgatgtttgcccatcttattaaacgcttctttcgcgctgccttttgtgatcatgacaagtgattttcgactcggtttataggagcgagtaaacgtatctaacaattggtcgattcttgttttttgtatagcttggtcactaattaaaatcaagcgaataaaactatataaaggagcatgggatacctgcttggcctgttccctggaggcagactgaatggaatccttgttaaaggtggttacgttgctgtacatactttttttggatttctgagctattaagtgctggtaggttagttccaacatatcctgatccatatcaattgcgacgccttgaatgatactcaatttatcgatctccttgctatcccaacaaccgatgaggagggcacatgcgatccatacggtgatgcatttttgcacccagagggttcgacgaaacagaaagatataggagcgcataggcttacttccttttccatttagaatgtgtctcatcctttgtctttagcatcaaaggacgctttttgagatatttaaaaggaacccgaacgaaagtatcctgttgatctcttagccgaattggggctagaggtgacatataaggaactccaaagcttttgatctggaccatgtgtacgcctaagcaaataaaggctaaaatcacgccatacagcccataaatccctgcaatcatcataatggggaaacgaagaagccgtattccaatactcccgctgtactgcgggcttgcaaaggacgcaatggccgtaagaccaacgacaataatcagaaaagcacttacgaccgccgcctcgaccgctgcttgtccaatcacaagaccgcctacaataccgatgacttgtcctatgcctttaggtagtcgcagacttgcctcgcgtaatatttccaatgataactccatgattagagcttccacaaaaacgggaaaaggaattccctcccttgaggcaacgatagagatcaccagctcaggcgggattaatccaggatgaaaagaaataagtgcaacgtacagcgaaggcaggaatgttgcaatgaatagagccattaaacgaagcatacgaaaaaatgttcctaaagggaaacgctcgtaataatcctctggggattgagccagcatccagaaggtcatgggagcaatcaggacaaaaggagtgccatcaagcataatgacaactcttccggacattaaagcatttatagctttatccgagcgttcagaggcttgaatctgtgggaacggagaccatgaatgttcctcaatccattgctcaataatcccggtatcggaagcatcgtccacatcaatcgtttcgactctttgtttaacttcctgaactagctctggatttgcgatatctgatatgtacaagatcgctaatttccgtgaagatctccttcctatggtcattttatctattttgaaacttagatctttgatatgccgccttaccattgccaagttgctttccaaatcttcaataaaaccttctctcggccctctcaccaaagtttcggtgctcggttcatcgacacttcgcgaaggaaactggcccgtagaagcaaaaaaaacttcatcggtcccttcgatcagcagacaagtatttcccgataacacttcaattacacatgtctcaaggtctgccccttctttcgtaccgatcgtaaatgccgtctgctgtatcagttcctcctttattttctctagattaacttgggagtggttttcacggattccagtcaaaatgagtggcttaacgatttgttcgttaattatgcccgtattcgcaataccggagagataaaccatcactacatgaattcccgtttgtcccacgtccatttttttgaagacgacatcaggaagatgacccagggtcttttttagatggtccaatttctcctcgagtgatctcgccatgactcgtcctccttcaaaagcttaaatcaacgatatacatgtaatatgtgtaaaatggtaatatatattcatgaaatggtaatttagcgtgttcgacgatcgaggagctgaagacgcgagagaagagggagttttttggagtatatataaacaaaaacgaacaccagtggtgtccgtcgttggtcatacatatgaggcgaggatactctatccccgagataacgccatataaactactccgagtggaggtcactttttgaactcgtagaaatgtgcctccaacatgctcagagaaagctcggcggtagtggctaccacgatatccgcaccttgcatttgcgaaggtgttcctacaccgaccgcgaacatcccggcgcctttgatcgcctgtatgccagcctgtgcgtcctctataccgatacagtcggcaggctgaacgcccagatttgcggctccggcgaggaaaatttccgggtcaggtttgccatgccgaatggcggtaacatccaccacactgtcaaaatagtacgctagctccagtcgctccaagataaatgctgcatttttgcttgcagaggccagcgcgatgccgattcgggcttcacgaagctctgtcagaagcgctttaatgcctggaagaatgtccgagggagttacagctgagatgagccgctgatactccgtatttttccgtgtggccagttcttgcttgccttcttctgaaaacgtatcggacaggttaccgcgcgccagtattttgtcgagcgattccgtacggctgattccttttaactgttcattaaattcccgatcaaaagggatgctaagcgctgccgccaagctgccccatgcctgaaaatgatattcggcggtatctgtaatgactccgtccagatcaaaaatgactgctttcatttggtttcccccctgtctgcccgatttatgaaacgctgttcgtcattaacgactgtccactggtaatgtgcgttggctctccatacagctccagcgtcagcggttctccgtccaacagggtaatgatcacttcattttcctgtacgagaatacttaacaagcgaccgcgatagttgattttaaacgtatatttgttccagccttgaggcaggaagggggagaagcttaaggtttcacgatacgttctcatcccggcaaatccctgtacaatcgccagccagcttcctgtcatggaagtgatatgaagtccgtcttcggtatcgttattgtagttatccagatccagacgggccgtccgcttatacatctcgactgccttttcctccattttgagttcggcagccagcacggcatgaatggacggggacagactggattcatgaacagtcattggctcgtaaaatgcaaaattgcgcgctttttcctccagcgtaaactggtctccaaagaaatacagcccttgcagcacatctgcctgcttaatgaagcaggaacgaaggattttatcccatgaccatttctgatttaatggaaggttgctgggatcaagggaggatacaggctgcaaatccttatccataaaggtatcgtgctgtacgaagacttcccgctcctcatcatagggataatacatgtgagtgatgatatcctgccaatgggcaagctcatcagccgtaaccgctagatgcatcgatttttctgctgaaatttgaggtaagaccgataaggtatatttcaaaacccatgcagccagcgtgttggtataccagttgttattgacgttattttcgtattcgttcggcccggtaaccccgtggatcatatactgctgctggcttttggaaaagtgaacccggtcggcccagaagcggctaatttcaaccagtacatctatgccgtactgatgaaggtaggaggagtcccccgtatagttggtgtaattgtaaatggcatacgcaatggccccgttacggtggatttcctcaaaggtaatctcccattcgttatggcactccacacctgtaaaagtgaccatagggtatagtgcaccccgtagcccttgctgggctgcgttatgcttggcaccctctagttgttggtgacggtacaacagcagatttcgggttacatccgggtctgcaagcgccaggtacataggcacggcatatgcttctgtatcccaataggtggcaccgccatatttttcacctgtaaagcccttgggaccaatgtttagacgggcatcttcgccgtagtacgtagagaacagctgaaaaatattaaagcgtattccctgctgggcctctgtatctccctcgatttctacatcggctttgtcccaacgtctggcccaagctgcgatatgctcctgcttgagcgaagtatagcctttgttcacagcttccacggcgagtcgttcagcttgtggaattaacgcgtccttttccatatcccgtgaggtggtaaccgccacaattttttgcagctggatactgtcgcccggagcgacgctgtattgatagtggcgtgcagcatacaaaaagctctcttccgtcgtctgcagatcctgtccctcggtcacaatacccatggtagcgtttacggtaaagcgcggaataccgaagggattatctatagttgttgtggacaggctgatgaattgttcttgaacctctcgggcctcctccaaccaaaaaacctcatcatagttcgtatcttcattcttcgtattgccgtccaaataagggacaagctctatagttagaggctgctcgcttatattcgttgcttggtaatcaatcaggcatagctcacgagtggtgatgctcagaaaacgctccgtagtgatacgaacctgatcgttcacggtgcaggtgcgtcgcaggatcccctgtttcatgtccaactcctgcataaaatcgctgatgtgtgccgtaaataagtctacttcctcttggtttacgatcagacggatgccgatgaagttcatggcattgatgaccttaccaaaatattcaggatagccgtttttccaccagccgacctttgttttgtcggggaaccatacaccggagatatacgttccctgatgatgatcacctgaataagcttcttcaaaattgccgcgcatgcccatataaccgttgcctatggacgttatgctttcctgtaatcgcatgtgtgtgctatgtagagtgtgtgttgtcagcttccagctatctacgtcaaataatcggttgtaaaccatgattgcgtacccctctcggaaaatgagatcgttgttttaacgaaaccagtatatgagcgagttcagtatatagtgcaaccgtttgccctgtcaacgcaaaaaaaactgattttatgggtttccacaaaatcagttcttgttcattccgctaagaatcatagtaattggctggatttgcgttccacgattcggtggggaacaatgatgtgcttggtcaattccttggggtcctcgattttttcaatcaggcttttggctgcctgataacctagagtgaagatatcaatatccacggaagtcagagggggattcatcagctcagctagcattagattattgaagctcaccatggataactgctctggcatggacacgcctagctgagaaagcattttctgtactgccatggctacaaggtcgtcgctaacgatcatcgcggtaggcggcggggtggcctgcaataatgtacgcatgtcctccagattaaatggctccctgaccacgtattccttgggtaaaggcaagcctgcctctcgcaacgcatcctggtagcctcggagtctttcaatattcacgatgtgttcatgatcaccgccaacataagcaatgtgctgatgattcagcccagtcaaataagtgaccacatccttggcagcctggtagttatcgttatctacatgggtagtttcactgacaaattgctgaggcttaccgattacggtgtaaggtattttttctttatgaaggtactccacaatgctatctttttgcttggagtacagaacaatatagccgtcaacacgcccggtccgggtcatcagcttcacgcgggatagcaattcatcgctcgtttttcctgtgacaatggacagtgtatagttgtgctcatttacccattcgctgatcccacgaaggctttccggaaagaacggattttgaaagattgccacatccgattcaggcataatgatgccaattgactgtgtgacacggttagccagactctgagctgaatagttgggttcatagccaagcgccttcatttctttacggacacgtgccttggtcgcttcgctgattttggggctgtcttgaatgacacgggatacggtggaagtagcaacattagcacgttttgcgacatctttgatggttactgccatcgtcttcgtctccttttgctatctcaagcaggaaatattatgttctatcatacgatattgctcgaaaatcaacaaattcgcggctttttcgagtatttctatgatcattagccaagatatttacaattagggtattgccaatagaaagcgatatcattataataattgtgcaaccgattgcataatgtttatagggtacaaacaacgctgtacatactataagggatggggattgaaggagcatgaaaaaacttctatcatttgatttttggcaaaagctcgggaaagcactgctagtggttgttgctgttatgccggcagccgggattatgatttcgcttggtaaagtagtggcgatgttggctggtgatatccatttctggttgaccgtcggcggggttatggagaatttgggttggggtattatcaataatttacacatactgtttgccgtggcgattggtggttcctgggctaaagaacgggcgggcggagcttttgcggccttaattgcctttatactcattaatatttcaacaggaacgattttgggtgtgtcctcgaaaatgctaacccaggagggtgccaccacccacactctttttggtgcatccattccggttagtggctattttacctctgtcttaggggcacctgcacttaatatgggtgtgtttgtcggtatcatctccggctttgtcggagccgtggtatttaacaagtactacaattaccgcaagctgccagacgctttagctttttttaacggcaaacgttttgttccttttgtcgtgattttatggtctgtcatcgtaagtttgatcatgtctgccatctggccatttgttcagggggggattaatcagttcggtatttggttagcgacctcaggggagtcggctccttttgtagcgccatttgtctatggtacactggaaagactattaattccttttggacttcaccatatgctgaccgttcctattaactatactcaacttggtggcgtttacacgacacttacgggttccggggcaggaagcgtcgttgccgggcaagacccgctgtggctggcttgggcaagtgacctaagtgcgcttcgtggtactgatccgacagcctacaatagcttgttggaaggcgtgacgcctgcccgcttcaaggtaggacaaatgatcggtggagcaggaatccttatgggactagcggtggctatgtatcgccgtgtagacaaagataaacgcagcaagtacaagtcgatgatcttttcggcagccgcagctgtctttttaacaggggtaacggagccactggaattcatgtttatgttcgtggcgcctgtgctgtatgtggtttatgctattcttaccggtattgcgttcggaatggccgacatcatacatttgcgtttacattcgtttggtatgattgaactgctgacccgaatgccattgtctataaatgcgggtttggtgcaggatattattaacttcgtgctgacttgtgtggtgtttgcggtagcaacctactttatcgcgtattttatgatcggtaaattcaaaatggctacgccgggaagactggggaactatacggatgaggagcctcaagggacttccgtggctgggaatacgaagacagagggtgtggcagctgtttccactcaaaatcaactggctacggatatcatcaagacgcttgggggtgagcagaacattgtcgaggtggacgcttgcatgacccgtctgcgtgtgacggtgaaggatacggatgccgttggggacgaaaagacgtggaaagcgctgggtgccttgggcttgataaaagtagacaatggggtgcaggcagtttacggaccgaaggccgatgtgcttaaatcagatatacaagacatactcaacaggtgattactttgaagttgttaaccttaaatgcacatgcttggatggaagaaaaccagcatgataagctaaagcagctggctgcttttattgatgaacagcagtttgatgtcattgctttgcaggaagtgaaccagtccatggaagagactcctttgtcgccggacgatttgggcgcttattatagcgcagatcctgaagttgtcattaagcgtgataactatgcttatgtgctgaacgggctattgtccgatgcttatcagtggacgtgggctcccgcacatgttggttttgccaaatacgacgagggtttggcgattctgtccaaaacaccgattacagctacggtgaacgaatatgtttcctcgctacaggattatgacaactaccgctcacgtaaaattgtcggcgttcaaactgtggtggacggagtgcaggcctggtttgtaagtggacattataactggtggaatgatgaagaatccttccttggactatgggatcgtacaacaaaagtgctaaattcttttgctccgactcctgtgtttatgatgggtgatttcaacaacgcggctgaagtacgtggagaaggatatgactatgtactgcaatccggctggtcggacacctatccgaatgcagcagtacgtgatgaaggccacacggtgattaaagctattgctggttgggaaagtaatgcggagccgctccgtattgactttatcttctccaataaggctgcacaggttcaatcctcaaccgttgtactgaacgggaaaacgggaccagttgtatcggatcattttggggttgcagttgagttggagctgtgagaaagaaaggaggccagttgcttatgcaattggcctttttcttatagatttcgacttgaatcgaatgacatattggataactatagcgatcaacaccaaaatcaaattgtagtaaaagggagtgttgatgctaaatcgttccatgagtgcccctgcgatgatcggagacacaatggcccccaattcggacaaagatacaacgttgccgataaatgagcttctattctcctcaggaataacatcccctagttgcgagtaaaaggaatccagatagctggctcctcctatacctccgatgaacatccctaagtatacgatccacggttctgtgaaccaaagaaataagatgatttccaccatgatcaacaatagaccgatgatacaaagcatcaagcgatccttaagtagatcagatagtttgccaataaagggggctgatatgaaggtcgatatgccgataatggtaaaagctaagctaatttctgcggggctccaatggagcttgtaggttgcatatatggagaagtacgttaaaaatatagcgaatgcactcatttcaaggaaatgaacggtggaatagagcagtagctgtttcgttagcatggtttttcttttcgactcatgaaggggtgcgtgctgttgctgaggtttggaagagagactggggaaggtcattctggagacggcaacgaaggatatacatgagaaaatagcaacgaaataaaacggaatggataaagaaaaataagaaacaatagctccactcataagaggccctaaaatcataccggcaccttcactgctgctgatatatccattgagcgtgcctcgattatctgcggtgctcatatggttgatcgtgactcttacaaagacggttagccctatggctaccaagccttggaggagtctcagtagggataggatgatgaagcttgttgcaatcggaaacagaagcatacaagcgatttcggcaatgagtaagctcaaccccaagcgttttgcgccaatcttttcataaattcgtcctgccaagcctccaccaagaaatctacctacataaaatagagaaaataaaatgctcatgccgagtacggatatcccgaattgctctacataaatagcaaagagtggaaggatcatacttccactcatgttagcaataaggctgatcacaatcatacaggcaatattacgatttaaatataagtgtctcaccataacctcgaaacctctctttggtcttgcatcatgggaaccgttattcggattgcacctgattacgggtaaacggcttcaggtcgagttagcgggttcccatatagggcacgcaagcgagttcctcgcggtgcctaaatcccattgcaatgatggaggtatgaagcagcggatgggggaatctggattagagcgtggtgttgcctttaggctggaaagccgcctcctggtggtggccaagctccataaatccggcgtagtagcacgatttcacccaaatgatatgaattgtgggaagcgatattccgcagtattcctgctttcgtttcacctggaaaatgagctagtgaatcatccagttgcgcggtttcggcaatctgcacagcctgatctacgccctgtaaaaattcgttaatgacagcctgccatgcctcttcgctttgcggtccagtctctttgggccagctttccatgacattgcccggaagctggggcttccgtccttccaaatgctccagcatgaactgctgccagtaaatcatatgcttcagcagttgataaatgctgtaaggcatttctgcatttttcttccctgccagctcgacgtcgatgtctggtaaagcccgagctactcgaatatgtccacgttccccgaccagtgatttaaccagtgcttgaccgaataattggtttgcatccgacatgtatcatcatcccttctatggagaacttgtttctaacttattctcattttacgattatacaattatatttttcgaaatgaaaatacccgcgtagtatgaagagaaagaaaaataatttttaaaaacagttgataatcattctcatttgtactaaaataaaattgtttcaaaagaaacaaagtatcaacaatagatatattttgtatatatacggaaatgttaaaggggagctttccgtatgcatatattgttttctatgaaacaaaaatgggctataatgaaaggaggagtatgccaaaggagtgaccattttttcgtatgaagaaagcgacatcagttcagcatgtttatgatttgctcattaagatgaatcaccagctggagcagcatcagcagagagagagcatgactattctcgaagaaatacacgagcattttgatggaattgcttcacttaatctgacggatgtgcacgtcattgactgtattgggaggcatgagccgattaatgttacgacattagcggatcgaattgagctgagcaagggtacagtttcgaaagtcagcaccaagctgctcaaggaaggctggattcgcagaacccagcttaacgacaacaagaaagaaatctattttcggttaaccccgttggggaaaagactctttcttgtgcatgaacgactgcatgttaaggcacagcagcagttatttcaatttttaaatcgttatagctcggaagaactgaatgtcttgaaacgtctgctgtccgatggtgtagatctcttggaagctatggagtggcaggacaagagtttggactaaagggatatcgaatcatcaacgatgggcacctgttaatctccaagtaatagatacatggggagatgcaggtgcttttcttttaatgtcagcattttgcataattcgattcccaacgctcgagggtacaatatatagacgggctaacccgttccgatctatatattgctgatttgtgaatactcttgggatttatgcaaaatgcttagtgtaatagccgttttgcttccatatagagcacctgtacgaattttttcgtattaatgcgggcttgggacagtgaaggctccacattgttttgcagctccagcatttttttgcggatttctgtaaaatcaaaaaatttggatgcataattttcaaatttaggatgggtatagtcagtcaatccgagcgatactatatggcttagcgtctggaaaatagcacggcggacacgttgctccgatgccttgatttccttactcagctctactgctgaggctgaagcccctaatcgtttggacgctacattagcaaatatatccttcaacggcgggaacagatagggagatagatttcctgtttcctcctcatactggtccagaaattccagcatgtccagtaaatccatactcccggcttcgccgatcatccccatttcggagagcagaaactgcccggaagttacgatgtttcgggtcggttcaattgttgccgttgggttgttcgttgtgaacatcgacaacccttgaagcgtgcgctgaatatccgtaatcgactgctgcatgcgcagacgctcagccaccttatgaataactgcaataatctccagtcgattcaaaggcttggccacataatattcaataccgagcgagtatgcctcgccgatcatgtttttggattcgatgcgagaaatcataatgattttgccgctgaattgatcgccaagtgcacgcacggtctgaatgccgtcacgaagcggcatcagcaggtcaatcagcaatacatcaatccggttcagctctaggaggccgctattcacgtaggtaccatcctctgcttccccgatgacttctcctagaccttcgtcttcaataatgtctgccagcatagaacgaattccctgatcgtcatccacaatataaaaacgcatccgggctatcttcctttctccgtcagtttccgtaaaggcaatgtaattctaaaagtggtctgtaatctatctgtattctcttcttcatcctgttgcagttcaatcgtccctccaaggctctccgcgacctcacgtacataaaacaatcccataccggtcgacggctgtccttcctcatcatacttggtcgtataccctggtgtgaagaccatttcccgttttcgttgaggaatccccggaccgttgtcggtaacaataaaggaagctatatcctcttttcccggtagacagcgaatggaaacgtcaatccttccgttgttcttcattgcttcaaccgcattggctgtcaggttattaataagtgtcaaaacggtataaacatgcagcttgggtaacaatggatcgacatctagggtaaaacggatggacttgtccagcgattgggcgtatttgctgttcgttcggataattagctccccaagctcttgagaagccatgtaatgcactccgctttcggcatcaatcagcttggacaaaccagcaaaaatccgctggctgtcttttttgatctcgtgaacctgtccggaaatacgaagtgcctgtctggcgtaatgttctctatccttcagagattcatcctgctgcaactcacggtacagctcgtagctttcacgagtgatttgttctgcatgtgacagcgttttgcctaactggaccgactcctcatacaagtccgatacaaggagtaaaattcgctccgtctgctgcctttgtgcctcttcatgctggaccgattgatttaaccgaatcatattataaaacccaagcacgaagaagctgcggatcatagccatgaaagctactttgctgatcttaatgatgtcccagaaatcgccgtccatgctccaccggatgctaagttccgatacacttgcggcaacctcaatccctacagagaggatgcccacgcggagtgcgcggtaaggctcagcattaatgttaaggacctggaagagcagaccgtagatcatgtaataaaaaaaggtagggccgtgcagtgtcagcaactcttcaaagggaaggccgggctgagtgtaatgattgagtaagatgcgaaaggcgactaccgctatccctgcaagcactcccgataatgcaggcggaatatgacgaatagataacagaaagaaaaaaaatacaggcgtaccaaagctgagacggaatgtattagcgaacgggtgaatattcagctcacctgcgagcggtacaaatacaagcatgagcaggaaaaggagcgtattcaacttcatctatattcacctcctgggtattcagtcagaaaggcaatgtgagctaaattcacaggctcgccgttaaagtttgtgaatttatagaaaaaaataaatgcagctgtagataattgtcgttttttatagatcagattgtagtataaataacatcatttgaatattaagaacagcatactgcaaaaatatacaaatcagccaggggggacacgaagtgaaaaagattaatttgacgatgcaaatctttatcggtctggctttaggtattattattggtgccttattttacggcaattcaggggtggaagtctacttaaagccaatcggcgatattttcatccgcttgatcaagatgattgtcgtgcctattgtgatctcaacactcattatcggcgttgccggcgtgggcgacatgaaaaaattgggtaaactcggcggaaagtctattctgtactttgagattgtaacgacaatcgccatccttttcggactgcttgttgccaatctggttcgacctggtgacggcgtagacatgtcccacctggccaagagtgatatccattcctatgtagagactgcagagaagtcaggccatagctttatagatacgattgtgcatattgttcctaccaatgttattcacgccctgggcgagggagatatgctggctattatattcttctctgtactgtttggattaggggtagcggcgattggtgacaaaggcaagcctgtgctgaatttctttgaaggcgtagccgacgccatgttctgggtaaccaatcaggtcatgcgcctggctccgttcggtgtatttgccctgattggaacgacagtggccaagtttggattggcctcgttatggcctttattgaagcttgttttgtcggtgtacggctccatgatactgttcattgtgattgtttttggaattatcgccaagctttgcggtacccgtctctggaccatggttaaaattttgaaaagtgagctgttgcttgcatattcgacggccagttcggaaagtgttttgcctaagatcatggagaagatggagaagttcggatgtcctaaaggaattacgtcctttgtcattccgattgggtattcttttaatctggacggttccaccctgtatcaggcactggctgcgatttttattgcccaaatgtacggaattgacctgccaatcacgacacaaatcacgctggtgctagttttgattatttcctccaaaggtattgcaggggtgccaggtgcttcctttgtcgttttactcgctacacttggagcagtgaacctccctctggaggggttggcttttattgctggtattgatcgcattctggatatggcgcgtacggtagtcaatgtattaggtaactcgcttgccgctgtggtcatgtccaaatgggaaggccaatatgataaagaaaagggcgaggaatacgttgcttcaattaaataagatgcaacgaactgaatagttgccagaaagagcacttttgcgaagtaatgcgaaggtgttcttttcatttccagacttattaaggcctttccttgttcgacatttttcgatgttttttgtatgaatatataggtatatggacataaaaatgattcttattacctatgcgattttagatttatttataatgattcttaataaaattccgatattaaactatatcgttttatatattggcttagaagggaagagcatatatgtttcttaaaaaaaatgagacccactcacttgctcctttagtagaagaaagccgcaaactttcacaaagaatacagcagaaggattattctgccgcaatacaagtttcatccaaatcttccgagattcaagaaatcgcaaacaatgtaaaccaagcgcttgaatccatgaaaaatgatgctcaacatgttgacatccgtctgaagcttgttaccaaggctatagagattggcttatgggacatggaggtggttgcgggtgatcccgtcaatccaaataatacgtttacatggtcagaagaatttcgtgctatgctggggtatcagagcgaaaaggacttccccaatgtattaaacagctgggcatcccggctgcaccccgaagatcatgacagagcattgaccgaattgtcggatcatttgctggattttacgggaaagacgccttatgacgtacagtatcgtttgaagctgaagcatggagaataccgctggttccgggctaccggaacgacgatccgcgatcagcagggagtgccgcttcggattgcgggcgctctattggatgtgcacgaccagaagattaagtctgaagagttggaggccatggttacaagatacgatctcattaaccttgtgctggtagaggctccttacgatgtaaacattattggaggaaatatagaaaatccggataatacattttggtggtcaccgcaattccgcgcaacgctaggctttaaggacgagcaagatttcccaagcaagcttagcagttgggcttcaatcctgtatcctgaggatgccgaaatggcgattaagattttgaatgatcatttaaatgattatacgggacgcacaccgtacgaaatggaatgccgtttagtgcgtaagaatggcgagcatcggtggtattattgcagtggaaaaagcatacgcgatagcaagggagtgcctattcgtattgcgggtaccattcgtgatattactgtcgaaaaggaaaagcaggctgtcgcggatgagctgacgctcaagatccagcatctctccgattccattacggaaatggtgaacggcgttaactcggttagtaaccaggcgcaggagctggctacggctcaggagcaatcgacagaggcagcgaatcaagccaaagtcagtgcagaagagacgcaaaacatttccaacttcattaaagagattgcgaatcaaacgaatctgctgggtctgaatgccgccattgaggcatcgcgtgcgggcgagcaggggcggggttttgcagtggtagcagatgaagtgagaaaactcgccatacacagtgctgatgcgaccggaaatatcgagactagtctggacgaaatgaagacactcatcgagcggattttgcacaatatcggtaatatgtctacgctgacacaaacacaagccgcgctaacgcaacaagtaaatgcatctacagacgagatcaacagcatgtccaaagctttgttggattttgcaagaacgatgtaaggcttcatgtagaaatgagaccgggccttaggctcggtctctttactgtttttggaagatgaactatacttttcggggatagatctaaaaatcacctcatagtaactttatgtggaaaagaggaatatacttgagcttacttagttcaatattggtcggaattgtagctctggagcatgtgtacattctaatattggaaatgtttctgtggacgactccgcgggcgatgcggacgttcggcacctcgaaggagctggcggaagcaagcaaatccttggctgcaaatcaggggctgtacaacggctttttggcagccggattggtgtggggcttgttctatccggatactgtgttcgggcggcaaatccaattattctttgtcatttgtgtggtagtggctgcgttgtatggtgcatttactgccaataagtctattttattaaagcaaggcctgcctgccattctggcactaatcagtttgtggatactctgaagacacccttaacgggtgtctttttctagattcgatcacataatgtctggaatgctaatgacaaggggaataaacagtttttgatcgattgtaaatccgactattccgatttataataaatttattacatactaagaggacacgggggctagagcgatgcgtcgtaatttgactggtgtattggtattaattgtattgatgttggttgtaagtgcatgctccagcgggaattctggatctacgtctgagacgaatgggaatacgcccggtacagctaccacaacagctgataacggacagcctaaagatggcggcagcctgatcattggcgtacaagctgatccggtggtgctgaatccgaattatgcgggtgatcgggtaagtctgacgatagatcaggcgatattcgcaccattgtttcaagtgaacaatggcaaaaagacattttatttggcagacagtctgactccttcagcagacaagctgacttatacactaaaactgaaaaaaaatctgacttggcatgatggcgagaagctgacagctgacgatgttgttttcaccattaacaaaattttggacgagaagcagcacagctttttgagaagtaattttatggttaatggcaaaccggttcaggcgagcaaggttgatgatacaacagtggatttcaagcttcctcagccagctcccgcttttgaggcagcactggtacaggtatccccgattccgaagcacattttcgagaatgaagcggatattgagaagagcacaaaaaacaactctccgattggatctggccctttcaaatttaaagagtacaaaaccggtgagtacgttacactcgaacggttcgataactatgttggcggaaagccgcatctggattcagtaacataccggattgttaaagattcaaatgctgcgaatttggcccttcaaaatggtgagatcaatgtaaactatctcgatccgcaaaatgtggagaccattaaagcaacagataagtttgacattttcccttacagcgaaggtcgcttggcttatctgatgtttaatgaaaacagtgatacgaagcagttgaacaaaaaagaagtgcggcaggcgctttcttatgcactgaatcaggatgagttgattcaagtctcctatggctccaaagattatgcagatactgcgaaatctgctctgacacaggatgtactgtatcacacgaatgacgttgcatttttcaataatgatgtgaacaaggcaaaagagctgctgaaatcggctggcgctgaaggactgaagctgcgcattatcattccgggcggcaacaaggtacaggaagcacaagcgctctatatccagcagaagttcaaagatattggcgttcagctggacgtgaacagcatggattcctcggcatggtcgcaaaaattcgtcgatacgaatgccaaggacttcgatctggcgatcagcggctatatcatggggtatgatcctgacgcgtatcgtattttgtatagcaccggatcatcctccaactattcgcattattcaaataaagaagtggataagctgctggaagagggcgcgggtgagtcggatacgacgaaacgtggagcaatttataaaaaggtacaagagctgctggctgaggatgctgtcatctacccgattgcttacaccaagactattgtagccttcgacaagcagtatggcggtattgatcaggctgtgttaaagccggtcgtgattttcgaggatttgtccaaaatttatcacaaataagacagggttttcaaaaataagctgggctaaccagcttatttttttcgaaaacagcaaggggaagggaaacgtatgagacaactcatcgccagaaggttgctgcaagttataccgatgctattttttgtgtccatcgtctgcttcggcttgatcaagctggctccaggtgatccggttctctcttttgttacaccgaatatgcatctggaagacattgaacgaatgaggcatagcttggggctggaccagcccgcttatgtgcagtacatattatggcttaaaaagagcctaacgggcgatctcggctactcgctaattaatcaccagcccgtgctggatcagattctcgatcgtctgccggctacagccgggttgatgggtgcatccatcatattggctgtgctgattgcaattccgctcggtttgacggctgcggctaatcggaatcgctggatcgacaagctcattaatctgatgtcgtacatcggaatttctgttccgctattttggctcggtattttacttatttatttatttgcgatttatctgcattggcttccgagtacaggaatgcgtaccatcggtacggactcggtgctagatgtaatcaagcatgggattttaccatgttttgtactggccttcggctttctgtctgtgtatgtgaggtacatccgttccagcacgattacgcagctcaaggaagagtatgtgcagattcaatacgcgttcggatctggaaaaagactggttttgtttcgacatgtgcttaagcatgtgctgttgcccatcattacgctgctcggaatgtcggttgcggacctggtggctggagccattgtgacggagacggtattttcctggccgggcattggctcgctgggcatgacggcggtaaaagggatggattatcccgtcatcatggggattactttattttccgctctgctgctgatcctgggtaatctgcttgcagatatcttgtatagcatcgcggacccgagaattaaatcaacgaggtgaattcatgaatcggagcaaatggcgcaacatggggatcgagctgatgacgagcaaaatgggcgccgtcgccctcatactattgatcgtattctcgctgggggcgattttcgcatttttatcgccacaggacccgaataagttgaacgtgctggagcgtctccaaccaccgggagcggcacactggtttgggacggatgattatgggcgggactattttacaagagcactgtacggcggacgtgtatcattgctggtaggcttcgcgtccatgattattgcgaccagtatcggtgcagtggtagggattgtgagcgggtattttggaggatggatcgacaatctgcttatgcgggttttggagctgatcatgtcaattccgtctttcttggttattttgctgctgagtgtgtttttgaagccgggcgtcggcaatatcattgtcattatcgcactgctcatgtggatgaacattgcccgtgtggttcgtgcagagacaatgacgttgcgcgaacgggagtatgtactatacgccaaagcttcgggacaaagcacgttgggtattattatgaagcatatcgtaccgaatctgattccggtaattattgtaggggcgacgaacaatatcgcttcagcgattatgatggaatcgtcactgagcttcctcggctttggtgttcagctgccgaacgctacgtggggcagtatgctgaataatgcccaaggatatattgcacaggccccatatatggcattattcccgggtctacttattttactgactgtgttgagctttaatgttttgggggatgtgctgcgtgtaggctttgaacccaaattagtaaaacgatgattcatagttttatagattcatagtacaggtccattacaaatggctccaggagcgacaggaaggagcgaaaacacaatgacagaacatctactgtccgtcgaacagctggaggtctcctttttcactcgtgaaggggaaaatcaggcagttcgaggggttagttttcatattgatgctggagaaacggtaggaatcgtaggagaatccgggagcggcaaaagtgttacagcgaaagcgatcatgtcgatgattgccccgccgggcaatcggctgaacggcgatatccgttaccggggacaaagcctgaccgctctgacggaaaagcaatggcgcaaaatacgcggaaaccagattgcaatggtttttcaggacccgatgacctcgctgaatccggtcaaaaaggttggctatcacctggtcgaggtgattcgcagacatcgaggactgagcaaggaagcggctacgcaagcagctatagaactgttgcggcaagtaggcattaccgagccggagcgccgaatgaaccaatacccgcatcaattcagcggcgggatgcgccagcgggtgatgattgccatggcgctctcgtgcagcccggagctgctgattgcagatgagccgactacagcgctggacgtaacgattcaggcgcaaatcttggagttgctcaagacgctaaagcagcaatccgacatgtcgattgctctgatcacccatgatctgggcgtcgtcgctcaggtgtgcagccgtgtcatcgtcatgtacggcggcatggtgatggaggagggacgcgtggatgatatcttttatcgtccgggccacccgtatacgcagggcctgctgcgttctgtgccccagcgcacgaacggctttcgcgagcggctggtgccgattgagggcacgccgccggacctgctgaacccgccatcaggctgtccgttcatggaacggtgcccacacgcgtttgcccgctgtgtagagcggccaccgatggtggagctgcgcccggatcagcgagcagcctgctggttgaacgagccggacgcagtgcctgctggagtctgcgagacgcccgaagcgggccacgcggaaggagggaatgacggtgagtgaaacaaacgatgtattgggtgagcaacagcccttggtggaggtacaccagcttaagaagcattttgtgaccgcaaaggatttgttagggcgtagctctgaggtgctcaaggcggtggatggcgtgagctttcaaatcaagcgtggcgagacgttcggactggtcggtgagtcaggtagtgggaaatcaacggttggacgctgtctgacgcgattatacgattatacagaaggtacggtacgctttgacggtcaggatatttccaagctgaacgataaacagctcaagccgctgcgtcggcgtattcagagcatttttcaggacccatattcctctcttaatccgggtatgaacgtgcttgacctgatcggtgagccgatggatattcacagactgcatcagggcagtgagcgtaaggatgctgtagtggctttgcttgagaaggtagggctgaagcgggagcatctgtatcgctactcgcacgagttcagcggcgggcagcgccagcggatttccatcgctcgtgctctgtccgtgaaccctgagttcatcgtctgtgacgagccgatttcagcactggatgtgtccattcaggcgcaggtcattaacacgctggaggatctccagcaggagttcgggctgacgtatctgttcatcgcccatgacttgtcgatggtgcgacatatttcagaccgaatcggtgtgatgtaccatgggcgactggtagaagtagccgatgcagatgaactgtatgagcagcccgctcacccctacacgcaggcgctgctatcctccatccctgtgcctgatccgagagcggtcggagagcaagggggactgggaggaggcttggcccaaccagacggttcattagtatgggacaaggataacaacagtgcaaccgagctgagagaaatcagtcccggccattatgtagcatacccggttaacctttagggttaagatcgtttgtatgatgtgcatgacccaaaggaggtaaaaaatgatgactgaatcgacgacgaaaagagtacgtatttcccaatgggacgcactcttgctggaatcattacgctctttaggctggtcccaagaggaattaatccgtcgggtgcagcaaaatgagctgccaacggacggaccatccgattttgattatacagagcttgtcaccgggctggcgtcccaagagccggaagtgtttgtcagcgcagtaacggatggatatcagatcaagtacaatacgatccggggcattcgttcgtggattgccgttgcgttcgggcgggagcctgagctgtcactggaggaaggaagcgaagccgttacatccgaactgacgaaggctgagtatgatcggctggagagagtgctgtcgttaggatggttcatccaggaagtacgtcccgcggcgggcgagacttcaggattataccgaattgtgcctgcttcacagacgaattaaatcatggggatggagtaacaccattcaccagaaatggaaacgagccgaccgtgaaggccagctcgttttttttaatgcaatccttcttcatcttttttattcagcataaccagactattgtgaataacccgtgtcatgcagtaaaagcaggccattctggcggtttgcattatagctcccaacaacatggacatcgattccatatcggaaaagtgtcggataagaatccgattaataattccttcaccaaaccagacaaaatatagcggaacaatcatcttttgaatataacgggctttgcgctccaattcggggtggagcgcaaagtacctgtaaatatgggtgaatgtattagagaatccccacaagttaataaaaggaatcatgcgagcaatggctcccacggtacgaatcggataatcggaatgcttttgccggatggctttatgtacttgaactagccagatcagataggttacaaaacacaagtagtacagcacaaagctaaaaactgtaaatttttgctccagctcgtatagatgatcataataaaaatcatttgcgtagatatacactaatgtaaaaataaggatgataaattcgcctatagtgcccactgctagtaaggcttgatgtacgctgccagctgtcttggatgggaatgctttggaatctggatcattcaagatgtacttcctcccaatctagttgcttcaaatacacgatagcatcctccagtgtttctacggggataatgcgtaacttgagttcatgctccttttgaactcgggcagcctctgcttcgttgccttcctcaccgtaccattcataatctgccggtacgaaaaatagatcaacctttgccgcctcggctcccagcagcttttgctccagtccaccgactgatccgacatctccgtattcttccattgtgccagagcctgcgattttgtgacgtccgccatctgaaaagtcgatattattggcttcctcatacagtccgatacctgtcatcagacccaaggaatttcccgaaagatcctgcaaatgagtcaatagctccgcatagcgagcatcctccaatttgttaagattcgagaaagtcgccgtagccccagctgtgtcgctgtctacgcttaattccgtcgctgcatgtacggcttgcatggcagaatattttagcgtgtccgtctctgtaaggtccttcaaataagagtccacttcatcaggggcaagaggttcaaatttaatcgctcccccagatacattttcactggaatatacattccaacgctccaggagattgttagcaatacccgtttgcacagacgcaaaaaacacgcttccctgaacgccaagatctttgaccggatgcatttctccctgcaaaatatactgcgcaggcataggccttgttccaataaaggcagcgatagcggggatcagcagcagcgcgaagatgagtatacgttctttgtttatgccaaatatctttttgaggagatatggattacggcttggcacctcattcacaacctttccaactgttctcatacggatatcatcggttgaaatgattagaaaggttacatttttcaccataaatgaccgataagagtatagtagtattcatattttttacgctctgccagatcatcagacgctcattttttatgctatattttatacataaggaaaatttgagagttgaggtgcagcatgacatcaatgaatattttcgaatcatccgtcaaaccaggattaatggcttttcaggcaagcactgaagatcaggagcaggttcaggagttaattttaaagacggccagatggctgcacagcaaaggctctacgcaatggggacgcttactaaaaggaaaagatgatcataacctaggcggcgctattgcacgcggagaagtggttattttccgagcatcagaggatcatagcctggcaggcgcagtgatcttgcagcagcaacccagtgcatgggaccgtaagttgtggaaactagacgaaacggattctgaaggaggaacctcagtatatctgcatcgtttggttgtggatcgcgatagcaccgggaaggggctaggccgtgaactgatgcaatggattgaacgaggcatccacttcacaggcaaggatcgaatccgtttagactgtattgcgggcaatgacaagcttagtgagttttacagacaatgcggttatacgtatataggcgaaacgaacggctataatatttttgaaaagatgctaataaattcatagaaaacggaatcatactgaaggaatacgaaagaaggaagcaggtgatctgcattcttctttttttgttgtgcagccctttactttcccttggtcgctgtcatatcagagcccccaaaagaaaaaaatttatataaaaatgaaaatggggatatcgcgcctccccctcctacatatgatgatagggaaagttttgtaagcgcttcaaaagaaggatgacatacaaccatgcgaagctacaggaggcggttaaggtggacaattacatgagctggataaagattggatttttcctcagcgttctgtttttacttgcagcggcatgcagtacctctcccaaaatagaggagacagaagggcaaaaagtgcgacttacaatgcaggcttggggtaatcctgcggaggtgaaggtgtatcagcgggcgctggatgcatttgaaaaggaaaacccaaatatcgaggttaagctggtgcctgtaccgggagaccaatatgagcaaaagctgttgacacagcttcagggaagtcgcggaccggatgtgttttattcgtatgaatcgacgattgcgcgtttgatcggggcgaagcaggtacagcctttgggtgagtttttaaaaagtgatgcgagtgatgtgaaggctgaggattttccggaaggattgtggggaccggcaaagcgtgatggggaaatttatggggtcactcccgactcaaacccaatggtcatgtattacaacaaaaaggtatttaaggaagcaggcgtgaagacgccgcaagaatactatgacgaaggcaagtggaattgggacgcctttgaagaggttacatccaagctgaaggcagccggaaagcagggttatattgcggaaaactggtgggctcactggtattcatgggtgtggtcgaatggcggtcagatctttgatgaacaaggcaaatatgtgctggaccacaatgaaaagggcaaggaagccttcggttttatgtacgatatggtgaaaaagggaaatgcggtatatctcggctcgcttcccaaagggcaaggggctgacgcgatgttcatgtccaatcaagtcggtatgctggcggcgggaagatggctggaacccttgtttagccaaaataaaagcctcgacttcgattatatctactggccatccaataccggtaagaatgagcccgttgccattccggttgcctatgtagctgtaaacaaaaatagtccgcatgtgcaagaggccatgaagttggcagcattctacgtctctgtgaaggggcaggaggcccggctggttgaaggtgggaatgccatgggtacgcttgctgccgcagatgagagcattatgaaaaaggcgacaattgagcattcaagctatttgaccgaaggacgtaacatagggcatgctcatggatctgcactggcctatgatgctcaggtgccagggctgaactcggatatcacggaaaccatcgacctgatgttcctgggcaagcaggatgctgcggcaaccattgaaaagttgaatcagatcatatccaaggcggtcaagtaggcacgggatgggccgtgaccggggaggaaggtgacaagatgcagagaaagcatcaagcgctgtggggctatctattcattggcccccagtttttgggtctgttatgtttttcgctgttgccgttgctatatgcgctttacttaagctttgtaaactgggatggatttggcgtacccttgtttgtcggcttggacaatttcaagggccaattatctgatcctgatttttggaaggcactcatcaatacgatgtactatatggtgttggtcatcccggcggggattatattggctctgctcgtagccatcgtgctcaacaaagtgaagggcaaggaaatttatcgcttgttctttttcatgcctgtcgtaaccagttcggtatcggttggtgtcatctggatgtggatactgaacggcgaatttggcattttaaatcatctgctgcgagcgattgggattacaggcccgatgtggcttaccgatacgcagtgggtgattccgtcgattgcgcttttgagcatatggctgggacttggatataatatggtcatttttctggcaggactccagggtatctccaaaagctattacgaggcagccgaaattgacggggccagcaagttccagcagctaaggtatattacattgccgctgttgtcaccaacgaccttttttgtgaccatcatgatggtcatcagttcttttcaggtgttcgatcaggcgtttgtcatgacgaatggagggccagccaaagcaagctatacgctggtgtaccacatttatgatcaggcgttcattgacttcacgatgggagaaagtgctgcggcagcaatgattttgttcgtgatcattctcgtatttacactgctgcaatttaaaatgcaaaagaggtgggtgcactatggagattagttccagaggtagggtattcctgcgccatgtgctgctcgctgtcggctctttagtcatgttttttccattcctgtggactgttctcagttccctgaaggatatttctcaaattttcgtcgtcccacctcaatggattcctgatccgttcgtatggagcaactatccagcctcgctggaagcgatgcccttcgtgcaggcgtatatgaacagcttttacattacggtgatcatcgtaactgcgacgctgattagcgcgtctatggcggcgtatgcttttgctaaaatccgatttccgggctcgaatatactgtttatcttgttcctcgcaacgatgatggtgcccaagcaggtgacgatgattccgctatatttggtgatggatcgcatcggttggctggatacgcattggtcgctgatcgtacctggagccttgtttaatgcattcgcagtgtttctgctccgccagttcgtcatgggtatcccacgcgatctggaggaagcggcagtaatggatggggcgggctacattcgtatttactggagcgtcatcctgccactcattcgtccggcattggcggcgatagggattttcacctttttgggtgcctggaacagctttcttgatccgcttatctatctcaatacaccggagaaattcacggttccgcttttacttaacaatttcaaagggttatataccgccgattggtcactgatgatggcgggtaccaccatttctgtcgtcccggtgttaatcgtctatatcattgcccaaaagcaaattattgaaggcatcaccttgacgggaattaaggggtaggggcatctctctactcctttttgtatttttttcggtactgtagcggggtgtgcccggtaaggtgcttgaatacacgaccaaagtgagcgatgctgtcaaaacccgttttttcagcaatggaagtcactttccagctcgtttctcttaaatacgcccgagcctgctggaccctcacatcctgaagatattctactaaggtaaaacctgttgtctgcttgaaaatacggcataaatacgtgctgctaatataaaaatgctcagccagctgatctagcgacaggctctcgtcataatgagcatgcaggtatgcgatgaccgagtacacgcgctgctgcttttcgctacgttccggtgcaatggtatcggcagtggccgattgtatgcgccggatgcggataaggagctggagtagcaagctctggagatatagctggcggtaggcatgttcttggtggtattcatctagcatttgccggaataggtgttccagctcgcattgttcttccgcggaggggcgaagcagaaagcttttctctggcagaagaagctggttctgatcgctggagggagagacggtcattgacgaggctgcaaattcttcatcaaagttaatcaaaatccgttcatggctaccgctacccttgttactcgtacggtgaaaatcatgtttgctgatccaaatcagatcgcccttctggagcgcatatacccgctgattaatgtagtagtagcgctctcctgccagcaaataatagatttcgtgcgcttggtggacatggtcggcggacatgctgaatggcactttccgcaacgcttgctcgatggcaaaacggggtgtagcgatcatatcgatagtctcctttagtgaaagaatacataaggataatatatgtatattttacgggaaaaatcataataaaagcgaagattttgctctttcttatactataaaataaaagcaattcatgtaaagggtgtgaaccaattggctaaaatcaaatatgcacttgtgggtaccggaggaagagccgaatttttttacggtgaagttgttaccgttttcaaagatacctcggagctgatcgcgttctgtgacgtcaatcagacgagaatggattatgccaatcggctgctgcaggagaaatacgagcatgagccgattccgacctataaagctcacgagtttgatcggatgatcgcggagacgcagccggatatcgtcattgtcacgaccattgaccgggtgcatcatcggtatattatccgggcgatggagctgggctgtgatgtcatttccgagaagccgatgacggtggatgaagataaatgccaagacattttggatgccatagaccgcacgggacggaagctacgcgtcacctttaactaccgctatgcgccgcataatacgaaaatccgtgagctgatcatggacggaacgctcggagaggtgctgtcagtcaatttcgaatggctgctgaatacacagcatggcgcggattatttccgtcggtggcaccgggacaagcgcaatagcggcggtctgctggtgcataaatcgacgcatcattttgatctgatgaacttctggcttggctcgaaaccggagacggtgtatgcgatgggggatctgaaattttacggacgagaaaatgcggagcagcgtggcgtgacggagttttatcaacgggcttacggcagcaaggcagcggaaaatgacccctttgcgctacacctggaccgtaacgagcatctaaaaagcatgtatctggacgctgagcatgaggatggatatgtgcgggatcaaagcgtatttggcgacaatatcagcattgaagatacgctgagtgtcatggtgaagtatcagaacaagacggtaatgaactattcgctgaatgcttacatgccttgggagggctttatcatcgtatttaacggcacgaaaggacggatggaggttcgggtatccgagcaatcctatgttaattccggtggcagcaaggcagatgagggtgcgctaaaagagaagaccatcaccatctatccccactttgcagcaccttatgaggtcgaagtggaggaaggccagggtggtcatggcggaggagatccagttatgctgcgtgatattttcgataagccggcagaggatcggttccatcgtgcggcctcacatattgacggtgcatggtccattttaacaggcattgccgccaaccgttctatgcgtacaggtcaaccggtgaaggtggaggaactggtgcgcttgtaatgagcagtaaatttaataccgaaaagccccctctaactagatgaatagagggggcttttggggtgtatttatatatagaatgcaccttacatcttacgtactttattttattatttatcggcagtcagttcccgggttcccagttgttgtacaggacgatggttatcgggaaaaatggcagaaaactggttgatttggtctgcggacatttcaataggctgctccagcactgtccaatttacatgttctgtgcatggcggggtagtcagcgatccattgtagcgaacggagtgcaggtcttttggcagcaacgcagcgagatctatttcttcatctagagccgccgcttcttgggaattatccttcggtagtttggaccaaatgcggttgaaagccttgttttctttgccactttggataaggactcctaagacagctgtacttccgttgtcgctttgatggacaaaatgaagctccatttcagcatttttaccatctatttggtgttcgctcgggtgatgaaaatgaaactgctttaaagtgaatttagtaccgtccagcatgatgctattgctggcatcagcaacattgatttgcacagtgtgcccattattcaaaatggatgctttcgtattagtgtaatgaacttgcagcggttgctgcgtttgcgatgcttccaaatgggtatgctctatattgacaggagattgttcgtggccgttaccacaagcaacaaaatctttttccagctctccccaatgctccggtccctgatctccttcataggaccagtgcgggcctttttgaacaaccgcatgagcgttggtagctgatgaggatgaagtgctggtggtactagaaatggcgggctgtgaattgcatcctgttaccgacacaaccaagataatggcaaatatgctgaacaggcaacctttccagttttttttcatgtttctttatccttcttccaaatagagtatgtgaaactttttacattgtaaattattgtacaaagttcctacaagggtccaaggacttagaaagaagcatttttcgattaaatagttttaagttagtaagttagatttatgtttgtccttttcgggcaaaagttactataataatggagtgtgcattacaaaataattccatatctatttaaaggagagatctacatgaaagcagcaattgttacaaaagacaagaaagtcagtgtagaagagaaacctttacgctccctgaagcatggggaagcgttagtccaagtcgagtattgcggagtttgccacacagatttacatgtgaaaaatgcggatttcggtgatgtcacaggcagagttctggggcatgaaggtattgggaaagttattgaattaggtgaaggagtaaccagtcttaagattggtgatcgcgtaagtattgcctggatgttccaaagctgcggtcactgcgaatattgcctaaccgggcgggaaacgctgtgtcgtgaagttaaaaatgccggatatacggtagacggtgcaatggcagagcaatgtattgtcacagctgactacgcggtcaaagtaccagatagtcttgatcctgccgctgcaagtagtgtaacttgcgcaggggttaccacatataaagcagttaaagtaagtgaagtcaaaccaggacaatggatcggtatcttcggcattggtggcttgggtaacctggctgtgcaatacgccaaaaatgtattcaatgctaaagttgtagcctttgacatcagtgatgaaaaactagaactggccaaacaaattggtgctgactatatcgttaacagcatgaaagaagatccggtcgctcgagctaaggagttaacaaacggtgctggtctggatgcaaccgtggttactgctgttgccaaaacacctttcaaccaggccatcgacgttgtgaaggccggcgcgcgtgtcgtagctgtaggtctcccaaccgataagatggatctggacattccacgtctggttctggacggcattcaagttattggctccttggtcggcacacgtgaagaccttaaagaagcgttccagttcgctgcagaaggtaaagttgtccctcttgtacaaaaacgtccgctcgaagacattaatgagatcttcgaggagatggagcagggcaaaatccaaggacgcatggtcattgatttcacaaattaaaatgatgtccaattcgtaacccttggaattcggagagagaaagcgcctgctgatgtattgtaggcgctctttttggctttacaacttattcagaatgttatcttccaaaaccgcagatttatccccgtattctttaataatatgtctttctccccaagcacaaagagaatctaaaatgcctttcagactacatccatattcactaagctcgtactccaccttgggtggaacctgattatagctaatccgattgacaatgccgtcttcctctaattcacgaagctgctgagtcagcattttttgggttatggaaggcatcatccgttttaattcgcttgtccgcatctttccatgtgtcaaatgacacagaatgacgcatttccatttccccccgatcacctctaacgtcgcctcaacagagatattgtattttttcttccccaatgccgatcccccccatgtatatcgcttctgttatacataccttaacagcctgttttaattaaaaagaactttatttagggtactttttagtacctatatcactaaaaagtacgtactgttcatatttgcttgaataactcataataacatctgctggtcgaagatttctatagataggagtgaaaaacatgtcgccagaatcaaaacgaagtatctggccattactggctctagccgtaagcgcctttgcgattgggacaactgagttcatcagcgtgggactgcttcccctgattgctgaagacttgcacatatctgtaacgatgtctgcactaactgtaacgctgtatgcattaggggtcaccatcggggcacctgtcttgatctcattaacatcaagtgttccccgtaaaacgttgctgctgtggatcatgattatatttattgcaggcaacagcctcgctgcggtctctagcggaattgccttgctgctgattgcacgtgtgatctcggcgttcgctcatggggtgttcatgtccatcggttccaccatcgcggccgatcttgtgccggatgatcggcgagcgagtgcgatttccattatgttctccgggttgaccgtagccacggttacaggcgtacctttgggtacctacattgggcagcaatggggttggcgggcagcatttatggcgattgtggtcgtcggtgtagtggcactcatcgccaatctgattctgctgccatctacgctgcgcaaagggaacaagactcctttccgcgagcaggtcaaactggttaccaatggtcgcttgctactcgcatttatcattacagctttggggtatggaggcacatttgtggtatttacttatttatctccattacttcacgacataaccggatttcagcaaagtacggtaacgtttatacttttgctgtatggaattgcgattgccatcgggaatgttattggcggaaaagcagcaaaccgcaagccgctttcagctttgttttacatgtttctgattcaagcagtgatcctgtttctcctgttgttcacggcaccttttaaaacggcaggactgattacgatcttctttatgggattgcttgcgtttatgaacgtgcccgggctacaggtatatgtcgtcatgttagccgaacggtttgcacccaaagctgtcgatgttgcctctgctgttaatattgcagctttcaacgcagggatagccatcggagcttatgtaggcgggattgtaacggattcactcggtctcattcatacggcctggctcgggagcattatggttttcgttgcggttttgctcacaggctggagtcgtatgctcgaaaaaagggatacaacccccattacaggttaaagcttttaaaaaatagagaggaagattcaaaatgacacaaaacttacaaagcacaacattgttaaacaacggagttcgcatgccttggtttgggatcggggtatttaaagtggaagaaggttcggagctggtcgatgctataaaggctgctgtaaagcatggctaccgcagtatagatacagctgcaatctatgcgaatgaaagcagtgtagggcaggctattcaggaagcccttcaggaaaataatctgtccagagaagaactgttcgtcacgtccaaagtgtggaatgcagatttaggctatgaagagacacgagcagcttatgaagccagtctggacaagttgggtctggactatctggatctatatctgattcattggccagttcaaggaaagtacaaagaagcttggagagcgttggaatccttgtataaagaaggacggattaaggcaattggagtcagcaacttccagattcatcatttggaagatctcatgaaggatgcggaaattaagcccatgatcaatcaggtggaattccatccacaattaacgcaagccgagctgttacaattctgtcaaaagaacgacattcaaatggaagcttggtctccgttaatgcaaggccaattgctcgatcatccggtactgcaagacatagcgaccaagtacggcaaatcggtggcgcaagtgattttgcgctgggatgtgcagcagggagttgtcactattcccaagtctaccaagccgcatcgtatcgtgggaaatgctgacatttttgacttcgaactgacgcgcgaggatatggatcgaatccaggcgttaaatgccgatcttcgggtaggtccagatccggataactttgatttttaaaattacgttcatcatgagacgccgtttccttcttcactgaagggacggcgttttgtttgtgcatgatgggtctggggctacagcaatccaatcccgccatatggtattatagggttatatgaaaagagacgttttggaagcttgtgaatacgaaaaatcaccgggggacttcatgaataagacgattgcagatatagcccaaatggctggcgtatccaagagcacggtatcccgttttttgaacggcgggtctgtcagcgtggatacgaaacgaaaaattgaaaaagtggttaaagccacgggctatgtgcccaatgcctttgcccagagtcttaaggcgaagcggaccaacatcatcggcaccgttgtgccgcgtctagattcttttgcgacatctcatacgctgatggggattgatgaggaactgcgttctcagcattatcagatgctgatctctaatacgagccaggatgtacagcgtgaaatcgaagccatttatgagctgggacgacaaaagatttcgggtatcattttgctggctgctcaaattacagacgaccatctgaccgcgattcgtgacattggtattccggtgttgctggtgggccagcagcacgagcagcttcatagcctgatccatgatgactatcgtgcaggatatgatatcggcacgtacgttttgtcacagggacatcgcgaaattgcctacgttggtgttactgaaaaggatgttgccgtcggtgtgcagcgcaaggagggctttaggcaggctgttcgcgatgcattgcctgctgagtctcatacggacggtgcgatgcgagcagcagggtatgatatcagatactatgagaccggatttaaaatgtccgatgcacggattgctgcatccgccattttggaccatttcaagccgtcgttaatggtgtgtgctacggataatatcgcgctgggcgtaatcaatgcggcttattccagagggattgtcatcccgtcgggtttgtcggtaactggctttgggggatacgatattacggaggtcattcaccctgccctgacaaccgttcaatatccgtatatggaggctggacgtgtagcagcgcaaaatattatgcggctggtagaacataaatcggtagaaaaagtgacggtcatgaattattctcttatcgaaagagaaagcgttgacaaacgctgaacaagtggattataatttctacgaaaccggttccatagcattcgagcacaaatggaatcggttgcaaatccatggatgagcatttttttcaatcgtatgggaaccggttccgatagaatgtttttttcattgagttggaaccggttcctgaagcgaaagttttaataaaaatgaggtacacctatgaaaatgacaagagaacaaaagtatcgaatgatcgagcaggcagaacccggtgaaatagccagcttggaggagaaagtggagcaatgtcactggcggcaggcatttcatatccaaccaccgacaggtttgctcaatgaccccaatggcttttcatattaccaaggtgaataccacttattttatcagtggtttccgctcggaacggatcacgggatgaaatattggtatcacctgaaatctaaagatttggtcacatggaatagtgcgggcattggcatcgcacctggggattattttgattcacatggggcttattcgggcagcgcactggagcatgagggcaagttatatatgctgtatacgggaaatgcacgagatgaagactggatcagacatccttatcaatgcatggctgttatggacgagaatggtcacattactaaatgggagcaccccgttatttccaatgtgccagaagggtatacagaccattttcgtgatcccaagctatggaaagacggcgatagcttttactgtgtgattggtgcccagagaacgaatttaacaggctgcgccgtcctctaccgatcaaccgaccttcgtacgtgggagtttgagggagaattgtgtacaggcctgaagtcgtttggctacatgtgggaatgtccagattattttgaactgaacgaagcgggagtcttgatcttttctcctcagggcttggagccttctggggatgaaaatcgcaatatttatcaatcgggctacgtaatcggcaagccgttggataccgaaacaagaacgctggagcacggtgcattccacgagctcgatagaggctttgacttctatgcgccacagacgatgattgacccacaggggcggcgtattatggtggcatggatgggcctgccggatatcgaatatcccacagatccgaacggatgggctcattgtctgacattaccaagggagcttacgcttcatgagggcaaactcttgcagcggccgatccctgagctgactacgctgcgtagaaatcgtgaggatcgggtagctgacacgttattttcagagagcaaaacctatgaaggatttacaggtacggcctatgagctgatctgtgaggtagatcttttgagcgctaaggtgtttggtattgaattccgtgcgagtgagactgagaagacggtgattaaatataatgccgtcagtcgcaaacttgtattggaccgttcgcaatcaggtgagcctgtagccacttcgtatggtgaggtacggcagtgttcatgggataaggatcatatcaaacttcatttgtttgtagatacgtcttcggttgagattttcgtcaatgatggggaagaggtgttcaccagtcgtatttttccgcatccagagagtgacgaaatacgcttttttgccgacaagggagaggctctcttccaggcggtgaaatgggattttacatgagtaggctaaaacatcaagtggatcgttaatcatcaaacataacggaatcaacgagaggatgaacatcatggcggagaacagagaaatagctaaagaagtgatccaggcaatcggtgggcaagaaaatattgcatcttttgctcattgcgcgacgcgcttgcggattatggtgcatgacaaggaaaaaattgatcagaaaaaagttgaggagatcgacaaggtcaagggtgctttcttcaattccgggcaatatcagattatttttggtacaggtacggtaaatcgaattttcgaagaggtcgaaaagcttggcgtgactggttcatctaaagaagaggtgaagagtcaggcgaaaaaggaagggaacgtcttccagcgctccatccgtacctttggtgatgtgtttgtaccgattattcctgtgctggtcgctacagggctgttcatggggctacgtggcttgctcactcagccgcaaattctcgctctacttggcatgacgccacaggacatttcacccaattttctattatacacacaagtattaacagatacggcctttgcttttctgccagcgttagtcgcatggtcagcctttagagtattcggcggtagtcccgtgctgggtatcgttctcggtctgatgctggtaaacccggccttgcccaacgcttatagtgttgcggacggctcagcccatccgttgacgatgttcgggttcattcctgtagtgggctatcaaggctcggtattgccagctttcttcgtgggcttgatcggagccaagctggagcgggcgctgcgcaaacgggtgcctgaagcgctagatctgattcttacaccgtttttaacactgttgatcatgatcactttgggattgtttgccatcggtccgattttccattcactcgaagaatgggtgctgcacggaacaacgtttgtgctggatttgcctttcggtattgcagggattgtcatcggtttcttgcatcagattatcgtcgttacaggtgtgcatcatatatttaatttcttggagattcaactgcttgaaaagaacggcgtaaatgcctttaacgccatcattacctgcgctatggctgctcaaggtgctgcctgtctggcggttggactgaaaacgaagaatagcaagctgaaagcgttggcacttccttcctcgttgtctgcttttctggggattacggagccggctattttcggggtcaacctgagatacatgaagccttttgttatgggtcttatcggtggggcggttggcggttttatcgcttctgtcttccatttggcggctacaggcatggcagttacggtcattccaggcacgttgctctacatgaatcatcagcttccgctttacattttggcgaacttggctgctatggttgtagcctttgtcttgacctggatgtttggctataacgataaaatgttggaagaggtcaaaacagcgggttcctccaattaacaccaaccaagtaatgcgaatacacgcagatttatacgcgtaattataaatatgatggtcgttctatatggaacgctcttggtccctaatcaaaaaggactactagagcagggttccaggtagaacgaccatttttattaactgaggattttgcaaaatcctgtaactatgaaattctgttctagaccatccaactaaacaatcgaagagcgttcatccagaaattcggacggcgagcagcctgtcaaccgtttgaagatccgatgaaaataggaaacatcactatatcccacatactccgaaatttcacgaatcgttagccgggactcggtcagcatgtagatggcggttttaatacgttgcgtatgtacatgctcactgatcgtttggcgtgttacctcacgcagcagcgtcgcggcataattgggggttttacggatggcgtcgccaagctcatccttggttaccttttcacggtagtggttctggatatactgtttcatatgttccacatgtcgctctcgatcgcaagaaatggcgcctttgtcccattcctgattcatatatatcattgcctcggtcagcagacagtcagccatcagggtgtagtagcttgggtgttcagtccattgatagtacatcgatttgatccgttcatgcagcatatcgtagcatccaggtttgatcaacaacggcttgtcagtattcagtatgggaagtgtgctgttcgtacatgttttgcggcaatgtatcacatacttggtatgaaaaagcgtaggaatgctcttgccatagtaatccagatgaccgggtaaaagcagtgtttcacccttaccgagaatgaatttgcaatcgttcacccaatatacacatttgccaaaggtgaccaaaatgaacagtaagtcatcgttgtcgctatttgcaccagccttttcataccagtccacaccgttgtcctgccgaatatccaccaatgtaatcacgaaactcactccccgatgtcttcaacattcattatactgtagtacattcatcatactatagttcatagtcttggtgcacgggtacaggtagaatagagctatataagtttaatgtagatagagaagcaaagtggaatagaaaaccatacagtaaagacattcaggaggatgacattactatgcttaaaacgaaaattatttgtactatgggacctgcctgtgactccattcatttgctaaaagaaatgatccaggctggtatgactgtagcccgcttgaatatggctcacggggagctagaagatcacgttaaacgtatcgaaaatgtgcgtcaggctgcgaaggaaatgaatacctttatacctgtcatgatggatattaaaggaccagaaatacggattggcaagctgagagaggcatcttgtctgctgaaaccaggaagccagctcattctgaccacagaagagatcctaggggacgagcatcgtatttcagtgaattacccggatatgccgaaggacatcaaaccaggcgaccgcattctcattgacgacggtttggttgatctgactgtaacctccatcgaaggtacggaaatgatttgtaatattgtaagcggcggtattttgaaaccgagaaaaggtgtaaacctgccagggattcatacgacccttccaggcgtgacggagcgagatgtgaggcacatccaatttggggtggagcagcgtgttgagcttattgcggcttcttttgtgcgtaaaggcgacgatatccgtgaaatccgtgagattttgaagggacatcatgctgagcatgtacaaatttattccaaaattgaaaatgctgaaggcatggaaaacctggatgatattatcgaagcttccgatggcattatggtagcccgtggcgatctgggtgtcgaagtgccgattcaagatgtgcctgtgatgcaaaaagaaatgatcgacaagtgtaatctggtcggcaagcccgttatcgtagctacccacatgctggaatccatgcaggtgaacccgcgtccgacgagagccgaagttagtgacgtgtttaatgccgttatgcaaggagccgatgttgttatgctgtcgggcgaatcagctgcgggtaaataccctgtcgagtctgtacggaccatggccgctgtagctgccagagcagaatcgcaattcgattatcaggagcagtttgataagcgccgagcacgtcaaagcaccaacattaccgaagtgattagtcagggtgcggtgagttcgtccctggagctggatgcgaaagcaattattacatcgactgccagcggattcacggcacgtatggtatccaaatatcgtccgaaggcacctattattgcggttactccgaataatacggtattcgctaaaatctgcctgttatccggcgtattcccgatcaagggggataaagtagcaacaacggatgaaatgttcgaatcctccatccgtaacgccctgaatgcaggatatatccataaaggcgatacagtagtcctgtcagcaggtgttcctgtcgctgaggcgggcaccactaacttgatccgagtatatcaagtgtaatttaaaacaaaatatagacaagccaaaaggcgctgacccccatgggttcagcgcctttttcacattctgtcatgtcactaacttacagcccgaacacacttttagcaacgacctgtgtcaattctgccttatgggcttggtattgctcaggcgtaatgctcttattggccagtcgttgatccaactgctccgttaactgagctacctgtaaatcaacaacagcctgtgcgtcctttttattggattgtgcaatatctgccaaggtttgaccgttatataacgcatcatacaattgctcattcgaggatacgcccagtgttttcaaaagttcatcatccttggaagcttcattatcctgtacctgaggggctctctctggagccagtgtagcagcattagcccgacttccccaagtagaagactgcccaatagataacgccagcaacagtgtacagatgaccagaattcgttttcgattcatgagtgtaaatctcctttgtgttcattcaatttctgacaaggtggagccttatatggatatccaacgggagtaatgtttatgcctttagccgatccggcttatgtagttaccagattctaatatacatcatacacacccaatcttagcgccagcttaatactcgtttaaaataaactaaaagaggaggatataaacaggtaaaaccaaaaaaaattcacggatgcgaataatggatgtgatttaccctttggattctgcccttttctttgaccacattgttcgtatcccatgaatacagagcatctgctcagacttactttcgctgtgctggattggcggctttttaactttgttaggggagaggcggatatgaaaaaaacctccttcacaaaagtgaaagaggttttagacatctacaactattacaatttagggttttttccatacttattgtcgttaggctgactgtcttggcagaagaatacaatcaaaataattgaccctacgagaggaatcagactgattagaatccaccatccgcttctacctgtgtcatgcagtctacgggccataacggccaaggatggcaacaggacagcaagagaataaatcaaagtcaataccggtgataagcctacaagactatcgatcaggctgactacaaagctagcgagtgcactaaatagtacaaacatccaatactctgtacgtcttgctctaccttgaaatcctacatagttttttaatgcatttaaataccattgcatatatttttcacctccttataaaatctaaatgtttctatacacgtaaaattgttcttttaggtatatcggcaggaaacatatagaattttagttgtaaaattataactttaaactagaaatttacgcaatacatttattaatgttaataattcgatgaataatttataaaaacataaaattacatattgaattttccatatccattgaataatatagaggtacggttaaccgccaggtttgaatcgtccttcttaacagaaggtgcttttatttttcaaatcaattgaaagcgctttaatgcgaaataggagggatgactaacattaaattcgagggtgaagaagttaatacaaacataatcctgaccgctttctcaatattgttttatgttatcagggatgttcaaaacgagaggagattgatttatgaagcaatcatttgttcgtaaagtaacggcagcttcactcgcaggtgcgctgttgttgcctgcttctttggtaggcgcggagccaacactcaattcagatacagatggaattcaaaatgtagggcaaacttcccttcaagctcaagacctagaaaacttttcaattcaaagtaaaaaggctgtctctttcaaggagacttccgtacatgatccatccattctgaaagtgaaagacacattttacatttttggctcacatctggcggctgccaagtccaaagacctcatgaattgggatacgattgctacaggagtggcgaatggtaatgcattgattcccaatgtcaaagaagaattaaaggaagcactggattgggcacagacggacacactgtgggcagctgatgtcattcaactggcagatggcaagttctatatgtattataacgcttgcaagggtgactccccgcgttcagcgatgggcctagcagttgctgataaaattgaagggccttataagaataaaggtatttttctaaaatccggcatgtggggccaaccgagtgaggatgggacgatctatgatgcaaccaagcatccaaatgccgtagacccggacaccttttatgataagaacggcaagctgtggatggtatatggctcctactcaggaggcatattcattatgcagatggatgaaaaaacagggaagccgctccctggtcaaggctacgggaaaaagctgacaggcggtaaccatgctcgtatggaagggccgtacatacaatacagtccgcaaacggactactattacttgttcctgtcctatggtggattgtcagcggatggcggatacaacttgcgggtggctcggtccaaaacaccggctggccctttctacgatgctgaaggcaatgatatgatcaaggtcaaggcaaatcctgataaaccactttttgatgacgcttccattgaaccatacggtgtcaaactgataggtaattacctgattccaagagaaattggtgatccgggtactggactgggtgcaggctatgtgtcgcccggacacaactcggcttattatgatcccaagacgaaaaagcattttgtcattttccattcccgtttcccggggagaggcgaacagtatgaagtgcgggtacatgaaatgttcatgaacgctgacggttggcctgtggttgctccttatcgttattcgggagatgaggattcactgaaaaagctgtcagaaaaggatgtcctcggtcaatattcgtatgtaaatcacgggaaggaaatttcggcaaatattaagcaagccgttaacgtcagtctggatagcggcggcaagctgtctggtggagtgaacggtacatggaagttgggggcaggcaatcagctggaaattacagcagagggtacgaagtacaaaggcgtattcctgcagcaccgtgatccagacacaggtgccaagacgcttgcttttaccgcgttgtcctccaagggtgttgcggtatggggttcgctaaagcctgacctgaaggccagcaagattgtagctgctgtgcagaaggatctgagcctgggcgatacgagcaatgttctttataatctgacgctacctactcaagcagcacaagataccactatttcatgggagtccacccacccggagaatatttctgtgacaggtgaagtataccgtccagatgccggttcccagcctgtagcagttacattgacggcgaccatcaaaaaggacaaagccacagctaagaaaagctttacagccattgttcccgggcaggcccaaggttctcagcttgcacgctattcgtggagtgaagatcaaggaacttcggtagtcgacagcacatacaatcatttcgatggtaagatctatggtggtgccgcatgggataaagacgggaagcttggcggtgctcttgtcctgaacggcaaggatggttacgtgcagctaccagcgacggtaacggatgcgaaggattttaccttttccgcttgggtgaactggaagggcggtgcagcttggcaacggatttttgactttggcaacggccaagcccggcatatgttcctcaccccttcccaaggaagtggtgtgctccagtttacaatccatgagggtacggatcaaagcttgctttccaaatcatcattacctctaaaccagtggacgcatgtagcggttacactggaagggaatacagggaagttgtatgtaaatggtgaggaagtagctgttaatgacagcattaccttcaatcccgatgagttgctgacgagcgaggcttatctcggcaaaagccgttttgccgccgatgcttacttcaatggcagcctggatgaagttcaattgtataacaaagcgctgacagcagaggaaattaaagcactggcagaattgtagttcaaaatgagcaaataaacgcaggagatgagcttttagtaagaagttcgtctcctgcacaatgttttgtatatttatttcttgattgctggtataataagaagcaactgcggatataatgttttaagtaggcgttaatgactcactcccttcgaatgaacacagctttgaagttcgcaatagagaacataagcactctgcataaattaaattcaccagtgcttgcgttttcaatacacttatggtaatatgagtatattgaaattgtgacctgagattcgcatattgtagagggctattgttttaggttgaaataaccttgtgcaatatgtgaatttttatttgtaaaaaataaaggtcatataaatacattttggaggtaattccatgcaaacaggtacagtaaaatggtttaacgcagaaaaaggttttggtttcatcgaggttgaaggtggaagcgacgtattcgtacacttctccgcaatccaaggcgacggcttcaaatctttggacgaaggccaacgcgtagaattcaacgtagttgaaggaaaccgtggaccacaagctgagaacgttgtaaaactgtaatttaaaattacagcctacttcagatgccccgaacatagcgtttggggcatttgtttttatctgttcacaagaccgtttttgaactgattacatcttatcgctttataaatcatgaagaaagagggatgtttatgtacaattcacggaaaaagccaatggatgagattcctgaggaaattacaactgtctggaattgcgccagcgatacatgtaacggctggatgcgggataacttcgctttttctgtcgagccgacatgccccatttgcggttctgccatggtgaagggcgagaaaaagctggcagttttaaataatacgagcttcaatcataccaaacaatcctaagcggataaatgtttgtagtgaaagatgccccatagccattaacggcgctgaggcgtctttttgttttttataaatataaattatacataagaatgaacaggctttcaattatggtgtgtaggatggggctagtatgctcagtaagatagaattaaattcaggtagcgcttcgtagaatacaccgtggccgctacgttcgaaaggaataagctttgatccggcgattcctttttgagtttggacagccagggggaaaggacagacccgatccagcttgccgtgtagaatccaagtaggcacgtgtatacatggcaaatcaggacgcaaatcagagtcacgtagtgaatacaaagtacaagccatgctatgaactgaagccgcaaagccctgatcacgtaaccagtcgcgtaagctctggctgacgggattggcaaacaacatttcgccaaaagaagttaccaattgtgggcgatctgtataggcttgtttgatgagtttatctacctctgtgacaggagtaccataagggaagtcgctggttggcgtgaaccggggtgtagctgctccgattaagatcaactgattgacgccaaatccccggtgcctgctcatgtagcgtgtgactacagctccccccatggaaaaaccgatcagccgtacctgatttaactgtagcgcctgcataacagccagcagatcgtccgccaatcgatcataattgtatccatgccatggtcgatcagacttgccgaaccccctaagatcaacctgaatacagcgatacccgtaagcaggcaacaaggcgacctggtattcgtacattcggtgatccagcggccagccgtgcaccatcagaacagggatgccttctccaatatcctcgacatacagcttcacgccgcgttccacctcaatataatatcccatcgtgttcacccctctagaaatcacgtcatttcattctctctcacatatatgtagccagggcttagctcattcgaaaaagggatgagtctgtcacgatataagcatataatatgtcaacaaatgtatgtcatcctgtatagggataggatataattatggaatgaaacagcatcgggagagtggaacaatgacaccatcaaaaacattaaaatggattacaggcggattggagctatttttagctattcccgttttgggcgggctgctcatcgtaaattccgcgtatactatattgttctttatgctgattttccacattgttacgttggtgctatcggtgacgaatagagagtcttattatggatctattttagggatcgtgacctcggttattggatggattccgattgtgggctggttgatgcatttgctctcaggcatatttttgatgattaccgcagctcagcagccgcgtgatcagtatcgcaatcgcaatccttatgatgattatcgctactaggggatgtgtggcgatgcaaagatgagagatcctgttgaacagggtctttttttatttatgaaatctccccatgatgatggtgttgtagtatttgccatctgaaagaaccttatcgttttttaataacccttcgatttcaaatccatgttttttataaagctcaatggctttatcattcgtttccaaaacttgtagagtcattttcttgatgccattggagtcagcccaggaaatagatttttttaaaagatttgtcccgatcccgtaaccccaaaaatcctttagtacacatacgccgaattcaactttatgagagaatctgctcagaacatggccctcacatcttgaaaatccgacgattttatcatgaactaccgcaactaaaaataggtttctgttattctctgtatctgactcaatgagctgttcaaaaccggatgtacttataaacgcttctcccttctctctatctaaattttcagtttctccatcaatcagcaagcggatttcagacaaattcttcgcatcttgaattatggctgatctgatcgtatagtgtattccttgcacatcaaattcctgttgatttattttcattacattctccttattatgaattagagtgaaaaatgactctggatcatgttagtctaccacatattatcttgtttacatgacaaataagcctgtctccttctgttgtatcgcagcaggggacaggtctattggtttctctatccgtacagggaggccggatggagatttattatacataggtggatgtgtcagattaataaatggtttttatgaatgcgacttatcgagctacagcttttggaaaacaggagctgtagctatttctgcttagcagaggctttagctgcattggttttagcagaagccttggctgcatctccctgagtaggagctttacctgcatccgctttaccgccatctactggtggtttggatggtttcacgccattcaccatatctgtcatcatttgcttcagattagagacacgttggttatattcggttgccgtaatcttgccgttttgtttttccgtagccagttttgctttcatatctgaaaccattacatcaataacggaatttacgctcacgccttgtgctttggcgatcgtagcaagggatttacctgctttcaactgtgtatccaactgactggaggacaatttcaataatttcaggagagctttgttctcagcatagttacctcctgcgattttagggccattagcatcgccgggattccccttaggtgcctgtgctttgtctgcgatgggagccttctcaggtgtagttgaagcagcatgggctgcgcttgtggagtacagtgccccgcctcctaaaaatgccaaggccatcgttccagccaaaattgctttcttggtgctcttcatcttcattttccacctttcggttatggtttgcttggtacgtgatacatcataagggatcaacttgaatgctatctgagcgcaagctgagcatttactgaatgaaatttgggtggcatgactaaaatttcagctaaagtaaacttgtattatgtgtattaagtgatataatacactacaggcacgatagatgcagccgattagggggaaacacccatggaagagcaacgggttggctcgttccgatttttaattgactttagccagccattatatgaacaaatattaaatcaagtacgaagctccattgctaaaggggagatcgaaatgggaagcaaaatgccatctgttcgtgatttagcgcaggaattacgcatgaatccgaataccgtgatgcgggcatatcaagagctggagcgggacggattgactgagaagcggcgcgggttaggtacttatgttacttcgtccagtgaacggattgccagctttcgggaacaattggctataacgtatatagatcagtttctcggacagatgagcagtctggggttatcgtgggaagatgtacagcagtatatacgaagcaaacaggacggaaatgacaaggaaggaggcgataaggcatgacggagtctgttgtggttgcgaatcatctggtgaagcaatacggcagtaaaaaagcactggatcaattagatgtcatcattccggcaggacgtattgtaggcgtgcttgggcccaatggctgtgggaagtccagcttctttcgagcaatcaccggattgattcagccagatgggggcgagcttcaggtgctgggccgacagcctagttgggaaaccaaccgggatatatcctatcttcctgaccgggcacgctggtaccccaatcatacagttcagcagacgctggaatgggggaagtcttttttgcctggcttcaatataaaagacgcgtataaacttgctgatcatatggacgtcgagctggaacttaaaatgactgggctgagtcgcggacaggaggcacgtgtgctactgattttatgtctggcacgtgaggttccactcatgatcctggatgagccgtttgcgggtattgatgttctctctagagaggcgattgtagccggaattattgattatttggaggggcggcagcagtcgatactcattagcacgcatgatattcaggaagtagaaggcttgtttgactacacggtcatgatggaccgtggacggatcatatggtctggtgattcggatgatctgcgtgcagagcatggctcgctgaatcaggtgttccgcaatttgtacaaaaaggagtggaaggcgtgaattcatcagggctgttcaaagatttgatacgccatgaatttcaaaataaaggaagctggagaaagcagggccgcagtcgactaccgagatcgtggagactcgtgtatttctcattatttctaattgcggcgttcgctatttccttgtacttcgcacttcacaaccagctcgaattaacaaggctgtggtatgtcaccctgggcctgccgtacatgatcatttttatgggtgtgggaagcttgagaagagaatgggaaaatgatacctacggatggtggctgacccttccctatccgcgcatatggctgattagcgccaaatgtattgcggctattttacaaaccatggtcgtaatattgcttctgtttgtggtgggttctctgtacgcgttgttcatctcatcaaccatacagccttatacgtttgcggatgcagcgtcttttattatggccggattgaactggtttgtgatgattatcgccttcacgccgttggttattgcgctgggtctattgacggccagtaccaaatacagcaccttgcggccgcttaacccgatactgtggattcttttgatgggtggcgggagtgtcttttattggtcgggcgatcaggggctttatgagcagtttgaccatgctcaaacaggacaatggtttccatttacctggcatttcccgattgcggtgttgatgagttggattgttgcgtatgtattaatccgcttgagcgcgtatctgctggagaaaaaactgtcgatttaggctagcgtatctacaggatctatgaggaaggagttactacaccatgacgacgatatttatatatgtattgatggctgttctggtggggctgatgatctggttaaggaccaagagacgaaggggaccggtaaaaggaaatggaatccggattctgctccccttgtttatcgctttcccgcttatgatgatgtctgtgtaccaattaatgcatattcccggtcaaacgtacgagctccccgccttttgggaactgctggttgccgggctactaggggctctgttcggctatgttattttgctgcatacggcgtatgaaagacgggatgacggtcttatttatcccaagccgaaccaatattttaaatatattattatcgctattatcttgattcgcgtcgttttgacccagtatctcagtagtttgggtacgaccgaaattagcatgctggcgattacgatggcgctggtgtatatctcaatctggcgaatcgggagctttatcaagtttcggaggacgttatccgtataacaatagcaatggggttaacacagcagcttactattcaaaaagcgttcattcgcttggcgataggagccgcttttttttgagttttggcattagcaagttatcacacattgttattgctccccatatcctttattctaaggcttgtggcttgcattgtagcagtacaattataaatttttgaaaggagggttattgaggtttcaaaagatttaaatggggtttaaagttagataggcggggaaaagttgtttcttgcgattaggtgtaactatattagttacataaaaggaaattgttttccacattttattttacatgttgagaggggttcacatccatgaaaaaacatacggttactgctgcactcgctggtctgcttgttctgtcttctgctgtaccggctttagcagccgaggtaaaacctactacgggtattcaggtttgggtagatggcaagaaggaggcttacaaaattgcgcctatcgtgagaaataagcaggtcttaattcccttgagacaattggcctccagtttgggaattccgatggatgccaagcatattacgttcaatacggcgcgacaaagcacgaccatccgatatgatcaggcgacggttgtactggtgtctggcagtccggaagcgcaaatcaacgggattaaggtaccgctatccacctcgaccctattgaccaagcagggagtaacctatgtaccggttgatgtcgtcaaagaagcatggggcaagcaagtgatttgggacccggccagccaaacggtacaaatcggggtgagtaataaggataaggtcattgaaatcgtgaaaagctttgaaaccggagacacgaaagtggccgagacttggatcagcaaggatcagtacattcagcacaacctgagctttgctagcggaagagatgcgttgctgcaagggattagccaggcgaagggagccaatgtacaggttgaaatccaacgtgtaattcaggatggtaatgatgtagcagttcattataaagagtccattgcagggaaaacgagcattgtttttgatattttccgcttcgatagcaatggtaaaattgttgagcattgggacaacatgcaggactcggctccagccaatccaagcggacacaccatgattaatggaacaacacagatcacggatctcaaccaaactgagacgaacaaaacactgatccgcaagtttgtggatgatgtcctggttggcaaaaatcgtgctgcattggaaagctattataacggtgaccattacattcagcataatcctctttttggtgacggtgtatccaatttgaaacaagcattttccgcagcaggaagccaaggagcttcttttggatatgatcaggttcacatggtcattggagaaggcaactttgtgctggttgtgagtgaattgacatcgtctaagggaacttcagccgctgtctatgatctgttccgggtagagaacggcaaggtagcggaacattgggacgtagttcaggaggttccagctaaaacagagtggaaaaatacaaacggcaagttttaagaaagtgcatttgtggtatggcgtgatcggcatgctttcctaatcgtcctgttcctgttaaaatgatgcaaacttataacaggaggttggacgatggaaggcttgaagcaacgtgtgggctgcctgcatgcacatcactcgaacatagcctatgtggaacgagcttttgcttcttatgaggtggagctgatacattttgtggaccctgggcttatgcgccggatctcgtcagacccgcatttttctgcggacgatgctagtcgcaaggtagaagagcaactgagatggattgctcaaagcgatatagatgttattttgataacgtgcacgaattatatcgttttggcagaaaaagctcaattgaccctgtctacaccagtaattgcgctggatgagcccttttttcatgagatatgcgatgatttgctgccacggaccttggtattcacgaatccggctactgtagagggaacgatgaagcgtctttatcatacggctgctctgttaggcaaaccagatatctcttcttggatagaggttaaggtggtggaggacgcttttgaactgattatgcagggacgtgaagacgagtataaggaattgctggttcgttcgctgtatgagctaagggaggctgatccaagcagagggctggctgtagcacagttgtctatggttgatgctgcgttacaggtggagctggagacggggcaaacgattggtaatcccttacggtcgttgtcgaattcaattgaggatttgttaggttgaataagtataaccaaaagaacttccaccccgtgttttgggcctgtggaagttctttttttggaggaggctggcgagcaggttacttctgcgttgttcatcacagattctgttgatcttgggtgatgaatgctgcgcctgccgattctctttggacaagcgtaacgtataaacgttcatgctccacgtcttccccagcaatgattttgagaacttgttcggcagctacagcgccccatttacgcttggaatagtcaatcgttgtcagacggggctgaatatattgcgccagctcgatattatcaaaaccgacgatatgaatatccttgccaatcgtcagctctgactgagccattcgattgtacaagcccactgccatttcatcattgagacaaaatacggctacaggttccgaatccgggctaacgtgttgctgcaaaatgatctcagccgcctgttcaccgcccgatttctcaaaatcgccgtcaatttcgatcatttcagccacgccgctacgctcaatggtctgcttgaccgcctgcatccgttgccatgaatcgtaagaaccttctggtccggtaaccacatatagcttacggtgtcccaattccaataaatgttcgattgcgagagcggcgcccgctttgttatccagcagcacctggttaatgttaggatgattcagttcacggtccaacacgacaattttatgtcctcgctcggcgtagttcagtagctcctgactatcaaacgtctgatccagcacaatggcgccgtcgatcatgcgttccggcagcattcggtgagactgcttaccgctgcatacgatgagatcatagcccttgcggttcaaaatttccttgatgccatacagtaaatctccataaacgtctccacggaaatcagttaggaaaacgccaataattttggtctgccttttcttgagattacgtgcggcggcattgggcacatagttaagctctttggcaatggctaaaatacgtgcgcaagtttcttctgttaccttatcgctaccattcaaggcatatgaaacggtagatatggaaacgcccgcctgtttggcgatatctttaatgctgaccacatcgtcacctccttgtcgtccatcttataattgctattgtatattcattattaaccacatatctattccaaatgtcgtagtcctacacataagcagcaaagggcgatcccgcaagatcgccatccctttgttgcctataccagatttagcattaaaaacgctttataaaataatctccagacggtgtacaccgtcatgttctgccaaggcttgctcgaaaatctcgcgtttgatgcgcaaggcaccggagcggtagcgattatcatcggctggcacgctttccagtggtgttccgttcaatactgtacggccctgctcaccgccagtatgctcttgcagcatgcggtagacgaaggtaattggttttcctgcaaaggaaaattcaaattccaatccgtcgagatgatccggcagcacggggtctaggatcagatcttcgcccgactgacgaacaccaaggacgttcgatatgagctgattcatatagattcctggaccactggaatagattctccagccgcccttgacgggtacggctccttcacgcagttcaccaaaccgttcctgtgcttcatagcgggtattaaatttaccatccgagctgctgaaataggcgttactttggcgccattcggcattcggtacggacgcacggatgccgaccggattgatgagcttcaagctgtgccaagcgtcatccttgcgtcccaatttggccatcgcttccgcaaagcggatatgggcatgcacatattgcagcccgacctcacgtccgaagttggccgcttgctctgcacgtttgaagtgcgagctcacaccgccatcatactgtgcagggcggttcatcagacgcacgccatccgggcagaggaactgctcacggatgagttgctcatgagttaatgcttgctcaggcgtgagcagctggctgatcatgctgcgtgtcatcggcagcaaccgataatggattcctgtctcggtgtcagacggatggagcatcagcttaggttggccgggctcttccatatacacgaagcccggaataattccgctctccagcatgtagcggttaaagtctttacggatgccattggccatctgatgtagatcttgtgcgatcttgtcggcttcacttactacacccgcgggggcctgctccaaagcagcagcaaagttactaataacttggtaggtgagtgcaaccgtccagctgctcgccatgtattgcttcagctgagcattggctggttggagggtatcatcccaatcgccgtcgccataggccgacaaatacgtatcatggaggaaattctcgcgaatatattcgatttccttcagggcatgttccatgagagtcgcggtctgcttggtataatcgaaagtatgccgatgggtgtaaggcacattttctcccagaatactgtaatcacgggtagcggtcaaataatcgcccagtaccttgagcggccagacgataatatctccatggctttcttcttgctgcacgtgagtatagttgtcaaacataaaccattgcggccagtttccgctgtcctcgtactgatggctgaaaacagtcagcaaaatggaacggacctcatcgaacttttgcatagctgagaaatattccacaggcccctgacacacatcacgtgttccccaggctgcaccgccgtattgttccagaccgtgaggcacagagtagtgaacgagcatattgtgggtgtaccaccaagccactgcgttcacacggaatagctcgctcgtttcgtgttgacccagcgacagatggaaaccgttcataagctcggcaaaatatgcccgatagcgctcgcactcatcttcaaaggaagcgtgacgctctttgtgcgctgattcttgcccagctgaaagcccattcagccaaccctgcacggtgcaggtccattcgctgctgtcacccagctccagcacaaccagagacgcatcaggagaagctttcccctgtagcagtgcgtgagcgtcgctcacatgctgtaatggagcgccctctatgtgcattcggtacagcaggtctggataggcttcggcactcagggaagcagagtctgcccggaagagtagggcgtcaccttcacgttccatatgaaacgggagctcatattcgttcacatgcatagacatttgctgagtgatgaggaacggataggttttgccactcgccgcacgcatgtgaagccgcacttctgggctatcgacattcgtatggtttgtaataatgaatgtatcgtcagccgttttgtaataccagcgcacataattgaagccaatctcgaacagggaaggcatcgtgagcaggcggtatttcccttggattccgacataaatacgttgaccggatgtcttgggaatattgagcgcattacgcgcgttggtaatcattttgttgaaatttgtattgccgattacgagttgggaattgaacaccccgtacatataggaggtggttgtaatggtttcttccttacctcctgagtaatgcccacccattaaaatgtgcccatggggacgctctacacgaagctctttggatttgagtacgacatgctcatagctgtccgtgaaaaaggaaagtagttcatcgccatcccgttcttcttcctgccgtttggggaaaagttgatccacttcggcatcggtcaagtccaatgtacgcagcggctcaccgatggtttgagctggagccacacgccctgcctgaagatcacttgccgcgcgtaccggtatgttggtctcggaagcgtctactagaatggcagctacttcgtcacgtgcttttgtcaccagttcctgatactccagctttgtcactgcggctggatgattgggctggaacagaccgtaaaaagtaaagcgagcttccccagccagtttcacccgctcagattgcaacgcggtataggcgaattcgtattggtacacttcattggcgagcgaatcgcgacggagtgcttccggctcattcgtttctttgtacgaaagtccaaagaactgaaatccgtcagtcgagtaaccaacagtgcgggttaacgagccttgttgaatgtatgggaatgcctgactttgaggctggttttgacgtgagcaaacggtatagcctctttgttcatcatgatacacggtgtggtcaatatattgagataaataagcttcattactgcgcacagcagcggtatcggcaatgccgatatcctgaccgtacacgacatctgcttccacgtcatcgccctgtagggttacatcccagaaccatactcccaggcggcttagcgtgaaggtcacctgatagcctacaccagcggtgaaaccttcccaaataatctgctgatccgtttgtcggattactcccggtgagcgaaccccaagcaggggagtgatacttacaccggacggacggtacaatctcaagtacagattgttcaaggaaccgtcgactgaattggtcaacagttggttgatcatcgttgagccgtgggcgatcttatacacatcaccactgctcaagaaggtaaaagacaggtcgccggcccgcagcaaaatattttgatccagacttgtattcatcatagggaacgcctcactttcctgtttcttttactaaccgaaaacggccttctgtagtatctcggctgttaggtcctgtaaagacggcaaattcaccgctgtcactgtcaaagctcaaatctgcatgatgataacgcagctgaggctcggtcaatacaaatttcacttcccggctttcgcctggggtaagcaggactttgcagaaatctttcagttctttcattgggcgaaccgtatcaccgctgatatcacgaatatagaactggacggtttcctcgactggacgcgttcctgtgttcgttacctgcactttaacggtcagttcctgaccgggagtaagagtgtcgccggaaagctgtacgctgtcataggctacattggtgtagctcagtccatagccgaacgggaataaaggttcgttcggtacgtctaggtattgggacacgtagcgttcttttgtattcggatctaactgcgggcgtcctgtattaaaatgattgtaatacacgggcacctgcccgaccgattgtgggaatgacatggtcagacgacccgtaggttcggcatcaccgtataacaaatcggcaattgctgcgccgccttcgccaccagggaaccaggcttccagtacagcgtctgcttcttcaatgacgccgtgcagatccaatggacgaccattaaacagtacggctaccataggcttgttcagcgtcttcagcgtcttcaggcgcttcaccagttccaactgggcttgtggcaagcgaatattggaacggctgcctgcttcaccactcatatccgagcgctctccaagcgccaacacgataacctctgcttggctggcagcttgcagagcttctgtatattgctcctcagtcatatcgtcgatagagcaacctgccgcaaccgtgagcaacgaggaggatattttcgattggaacccgtcaacaacacgaatggcttcctcttgtgaaccgctccacgaccaagaacctaggatatcaccgctctctgcaaaaggtccgatcaatgcaatacgttgattgcgattcaatggaagaacggaatcatttttgagcagtacgcatgatttaatagctaattctttggcaactgtgcgatgagcgtcgcagaacacaacttcacgttcacgctcagggtctgcgccgcgtagtgggttttcgaacaagcccagcttttgcttgagcttcaatatacgcatcactgcttcatcaatgagcgcttcatccagctgtccgctgcgaaccagctcaggcagatgcccgttatagcaggaggtcatcatttcaatatctacgcctgccagtaatgctttctttgctgcctcccgctcatcttcggcaatgccgtgaggaataagctctttgatcgcggcccaatccgaaatgagtacaccatcaaagccccattcatcacgaagcaaatcacgcatcaggcgcttattgcccgttgcggctacgccttctacggtattgaaggatgtcatcaccatttcacagccttcatctaaagcagctttgtaggaggggagataatactctcgcagctgccatgcggacacatcaacagtattgtaatcccgtccgccttcgccagctccatatgcggcaaaatgcttcacgcatgcggccacccggtcggtatcgttcgtcagatctttaccctgaaacccccgcacaaacgcacgagcaaattcgctgttgaggtaagggtcttcccctgtagattccatcacacggccccagcgcgggtcacgcaccagatcgaccataggggcgaatgtgacatgaacaccggatacagccgcttctcgagcggcaatggtagcgctctcttctgccagctgcatatcccatgagcaaccaatagccagcggtatagggaaaatcgttttgaagccatgtacaatatctgccataattaaaagcggaatacccagacggtttttactcaaatgagcctgctgaacacgaattgcttccttagcccctgcgaggccaagcacggaaccgacgttgtggacatttttctctgtaatgccgagagaagccatagggccggtaatttgactatccgttcccgcttcttcaaagaaggcacctacaagctgtagcagttgatcgactttttcttcaagcgtcatgttttctaaataggaattcaggtgttgttccatcataatcctccataagctgtattgttggtggacagctctctttttcagattcatgagattttttggataaagatgattcaaaaaaatgctgaacaggctaatagctagtatagaagcataatattctgtcgtattattaatcgaaacgtttctattattgaactcagttggattatatacgctttcaaatggagagtcaaatccaattcagcgggtttttataggctaaatagcgtaataaagatgataaaaacgaaaaaaagtcaggattccgagcaaacaaaaaataatattgctattgaatacggtttcaatttgttttataatgactatcgaaacgtttctattgacgggtatggtccttgtgctttgaacataagtgttatagcggtatgctttaatcgctatgtatttacatgcatcaggattttgcaaaattcgattacaatcaattattgtattttgcaaaatcctcgtatttgaatccgttatcatattgcatgatcggtaaaccgatcatctcgggaggaattcgtatgatgaaaagaacgttggggatcattttggcaagtaccttattactggggggcgcgctggcaggctgctcgtccaaggatgattcgtctggcaaagatgcgaacggcaagacgaccatcaccatgtggggcatgggggcagaaggaaaactgctgcctgaaattgtaaaagattttgagaaagaaaatccagatattcacgttgatgtacaggcgttgccttgggataacgctcacgataagctgctgacagcagttgcttcaaaatccggtccggacgtggttcagttaggtacatcatgggttcccgaacttgcgtcagcgggtgcattgacggatattagcccttatatcagcaagtatcctgaactggaatcgaagaatttcttcgagggtgctgtaggtacgacaaaatttgaagggaaaccagtcggtgtgccttggtacactgaaacgagagttttgttctatcgttctgacctactgaaacaagtcggatataatgaagcgcctaaaacgtgggaagagctttccgatgctgctcaaaagctggcggctcggggcaaaggcaaatatggcatctcctttagtgcaaaggagcagtctatgggctttatgtttgctctccaaaacggttccaagctggttgacgagcagggcaatccgctgttcaatcaaccaccgtttgtggatgctgtgaagtatgtgaatacctttttccaaaatggctctaacgcagtggatattggaattgattccgttcaaggtttgcaaggcgagggtatcgttccaatgtttatcagcggtcctttcatgattaaagaaatcaagagcaaggcaccagaattggaaggtaagtggaatatagcggagcttcctggcaaagtaaacaacctgtccgttttgggtggagccaacctttcaattatgaaattcagcaagcacccagaggagtcggccaaattcctggcttacatgagcaaaccagaaacacagctgaaatggatggatctgtccagtaacttgcctgcaactactaaatcgtgggaagatgccaaactgaagagtgatccgatgcttcggacgattcgcaaacagttggatcattccgcagcattgccgcaactggccgcatgggaagaagtttctcaacaattcatcaagagcttcgaacgtatttaccgcggtcatgccgatgtacagaaggaaatggatgactttaatcagcaggctgcaagtataatgaaaaaataatgatccatatccgtcattgtcaaagggagtgaaggcatgaaaggaagctcgcagaagcttgcgccatacttgtttatcggtccctccatcatcctgttaacgctgttttcgttgttgccgatactactggcgctcgtgatcagcttcacggatatggatctgtccggactcgttaattatgaaagtattcgctttataggattggaaaattacacgaacgtgcttttggacccttcctttataaagtcccttggtaataccctgttcttcgtcatcatcggtgttccgttggtgctgatattttcgcttagcatcgcgattctgattaacatggggaaatcacgtgctttcaaagtattccgcgtcgtgttctatctgccgtccgtaacgaatgtggttgcggtcgcagtggtttggagttatctgtataatccgacgcttggattattcaactacgtacttggtctgatgaatttaggtcccgtcccatggctgaccgatccaacagtagcgaaaatttcgctgattgtgttagcggtttggcggggcatcggcttaaacatgattatttttattgcggctattaaagggattccgggctcttattatgaagcggcacagcttgacggggccaatacatggcagcaaattcgttatattacgcttccgcagcttcgttacgctattttcttcgtgtccatcacgacgatgatcggctggctgcaatttttcgaggaaccttttgtcatgaccaaagggaaaccgctcgacggcacgctgacggcatccttgttcatttacaataacggtttccaatttagtaaattcgggtatgccgcggcgggatcgttcattctgttcttcgcgatcatcgcggtaacgctgattcagttccgtttgcaaaataaagcggagtcctgatagagagaggtgatgaacgtgaaaacagctgttcagcaagcccgcgccaatacgcgcagtggtgaaaaaacatttcaatggttcgtggcgattctcctgaccgtaggaggtctgttgatggtgctgccttttgcgtggatgattctatcctcctttaagacagagggggaggtaaccaaaattcctccgaccatctggccgcagcattttacactggataattttaaattactattcgatagcatggcttttggaacctatctgacgaatacgctgatcattgttttagcttccttctttggattgttcctgaatgccatggcgggttatggctttgccaaattccaatttaaaggcaaagggtttctgttctatctggtactggcaacgatgatgattccaggccaagtgacgatgattcccgtctatttgattctgaaccagatggggttgaccaattccatgctagggattgtcctgcctggattggtaggtgcgttcgcgatcttcctgttccggcagttcatgtccgatatcccggaagaacttctagaggcgacacgcctcgatggagcaggggagttccgtacttttctgcaaatcgtattgcctatctcgacgccaattctggcagtacaggccattttaacctttatcggcggatggaacagctttctgtggccgctcattattgcgaatgatgagaagctgtacaccttgtccgttggactgtcactgctcaaggggcagaacgaaagtcaatttgccctacaaatggcaggctcgacctttatggtcgttccgatcatgattatcttcattgttttccaaaagtatattatcgagaactatacgatttcggggattaagtaatagtgtagtgacgaactataggctgaacatagtaacggcgtagtttcttggttctaaaccaacgagattacgccgtttactctaatggaaatatgaacagcaggacaactattactatttagcaaagggctattcactcaataagtttgtttataaaacgaaacacttagaaatacgtaaccaattgcttatcgtttatcttgaacgttaataaatacattaagtatttaataataatattgactataataaatatggtgtgttatattaaaaccgtaaataaaacggcttcttagtcttggtggtacaacggattttattttcgcattcagagaggatggtttaggtggcagcagctgtaaaagcaaagatgatcgtagacaaatcttttcgtattgctgaagtcgataaacgcatttatggctcttttgtagagcatctcgggcgtgccgtatatggcggtatttacgagcctactcatttaactagtgatgaaagcggtttccgaaatgatgttaaagagttggtaaaacagcttgatgttcctattatacgctatccgggaggcaattttgtatccggttacaattgggaggacggtgttggccctgtcgcgtccagacctagacagttggagctggcgtggagaacggtcgagccgaatgaagtgggtacgaatgaatttttcaagtgggccaaggatgtaggttccgaagtcatgatggcggttaatctgggtacgcgcggaattgatgctgcgcgtaatctggtggaatattgcaatcacacaggcggctcctactggagtgatctacgtcgtagtcacggtgtagagcaaccacataagattaaaacctggtgtcttggtaacgagatggatggcccatggcagattggtcacaagacagcagaagaatatggccgtctggctgttgaatctgcaaaagccatgaagctgattgatcctgacattgagcttgtatcctgtggcagctccagttccacaatgccgacgttcccggaatgggaagcaaccacactggatcatacctatgaggtagcggactatatttccttgcaccaatactacggcaatcatgataatgatacggctaattacctggcacgctctatggatatggatcattttattcatacggtcatttcgacttgtgactatatcaaagcaaagaaacgcagcaagaaaaaaatgatgctcagctttgacgaatggaacgtatggtaccactccaatgatgcggacaaaaaaattgatccgtggtctgtggcaccgccgcagcttgaggatatctataactttgaggatgcattgttggtaggcagtatgttgattacgttcctgcgccacgcggatcgtgtgaaaatggcttgcctcgcccaactggttaacgttattgcgccgatcatgaccgagaataacggaaaggcgtggaaacaaacgattttctatccgtatttgcatgcctcccgttatggtcgtggcatatcgctgatgcctgttgtggattcggaaaaatacgattccaaggacttcacagacattccttatctggacagcgctgtagtttatgatgaagagggagacgcactgactgtctttgcagtgaaccgtcatttgtctgaatcgctggagctgacagtagatgtacgcagttttgaaggctaccgcattgtcgagcatactgtattggagcatgatgatcttaaagcgaccaacagtccagccggtgaaaaagttacgcctcacaacggcggcaatgctaagcttgaagacggaattgtaaaagctcatttgggcaaagcatcgtggaacgttatccgtctcgctaagtctcattaattctcttctgtaaaaggtacagcttcgactgtatctaaataagctcgcatcctctcttgtaagagtattacaagagcggcaatgcgagctttttgcgtaaaatgagccatttgtccctccatagatataggtttctaagagaagggtggattttaaataaatattatgtttattactaaatttaactagacaaagatgatccttattcactaagtgctcgtactccgtacatttttatgaagttaattagacccagtgccatacttcccaggtgaaaaaagaccctattatatcgttgtcaacgtactgatatctgaaatgcagggtgtgcaatccgacttaaatccacgttatactttaaaagacagtctatttaaatccaaatggtggttgtagtatttcgagaaaggaatgatctgtatgagtcaaacagacgaatatcgttttcaagtgaacttgggcggtatgattgatattttggccaatcatttatatagcagtccgcgagtgtttatacgtgaggttctgcaaaatgcaacagatgcgatcacggctcgcaaggagctgcggaaggttgctgctgaaagtaatgtattacaagaagacaaggcccttgaagatacagcttctgagagtaacgactatgaaggtaaagtcatcgtggagttatctggttccggggagcatcaggtattgatgattcaggataacggcattggattgtcagaagaagacattcaccgttttttgtcgatcatcggtcagtcttccaagaagggagccgatttgctggcttctgagacttcgtttatcggacgctttgggattgggttgctatcctgctttatggtgagcgatgaaattgtagtgctgacccgctcggtgaaggaaggcatctccatggaatggagagggaagccggatgggacgtatacgattcgtcgattggaaaccgagctgcctgtagggacgcaaatttatttgcgctgcaagccgggaagtgagttttattatgagccagcgaatgtagaggagtctttattctattatggggcgttgctgccgtatccggtcatgctgtctgtagatggggagaccaagcgcgtcaatcttccgtcgacgagctggatgcaggacccagagcaattacggagtcgccgtagtgaggtactggatttaggctatcgcttgatgggcgagcgcttcagtgattttataccgttgcggacggcatcgggcagaacaggcgggattgcattcattttgcctcgcagtgttaatctgaacagcaagcggctgcatcgggtgtacctgaagcatatgctggtgtccgacaaggcggaaaatgttttgccggaatgggcattcttcattaaaagtctgatttggacagatgaattgcaaccaacggcatcacgtgagtatttttatgaaaatgagcagcttgacgatgttcgttctgaactggggacctgtattcgggaagaactgctacgcatggcgcagtatgagccagaccgcttgcagcactggattcgtttgcatgagctgtccatgaaggcgctcgccgtggaggatgatgaatttttgcggataatgtaccgttggttttccttcgaaagtacatttgggcggcgtgagctgaaagaactgatccgagaggcggacggacttccactgcattacacatcgacagtagatgagtatcgtcagattacgcatgtggcggcggcgcaatccatgttggtgatcaatggcggctatatttatgattcagacattttggaaaggctgcattggattgaccctaacctgcaaacagagcgtcttagccctgaggaagtatctctttcatttaccgggctaacgcaggaagagcgcgagagttattacggtgtgctacgtgtcatggatgcagctttgcagccgatgcgttgccgcgctgagttgaagcgttttgagcctgcgagtttgccagtgttgtataccatttctcaggatgccctgaccttgcgctctatggaaaacacggttgaggagacaacctcacttttttccaatgtgcttgatagtctgaaagcaggagtccagcaaaattcgggctattccaccttatactttaatctgaacaacccggtggtggcacggattcttgaagctaccgatacgcagatggtcacggcagctacagaaatgatgtatgtgaatgcgcttatgatggggcactacccgatgaaccgaagtgagttgggactgatgaatcggagtgtactgcattttatcaattggggattagggaacggacaaaatgcgtaattgcgtaattatagggggagccaaatggaagatacgatatatgaattgatggaacaggcgcaggatctgcccgggggtgcagcaaagctggcgattctggaagaagctgtccgcttggcagacacatccgggttgaaggaacttgcttatgaaatccggggagagattgtagactgcgctatttttaacggatatccgttgaagtcgctgattgctttttcgtggcagctgggccaatttgatcaaaatccagaggaatacgacgcagatgagctgttgtggaattacaaatggatactcgggaaggtgtgcagcttttccaatatatcgaagactcaaatagaagatctggccgaagatatgcgcagacgttatgccgaatatgggtataatgagcgtccatattactattataagttccgcatcgcgatggacatgggtgaactggatgaagcacggcgatatctggataccttccgctcggtcgagcgggacagtatgagtgattgtgaggcctgcgagcaaagccagatggtgcgtttctactacttgaccggagaagacgagcaggcgcttgccgtggcaaaaccgattttgtcgggacggatgaaatgtgcagaagtaccgcatgtgacgctttctcaggtactgttgccgctttatcgtcaaggcgaggttgatgaggcaaaggagaatcatcgcaaaggctatcgcctaattcgggatgaacgcgacttcctgaaaacgatagcggagcatatcgaatatttggcgattgccgatccaattcaaggaatcgaagtggtagagcgtcatctacatatggcactggactatgagagcgggctggagcagatgtatttttacgcgacgatggtgagtctactgcaaaagttggatacttcgggagaaaaacggttgatccggttgccggcttccttggaatgggctagagaggatcgcacattgacagaaatcattgcgtattttaggccactggcagaatcagcggcggctgattttgatcgacggaacgggaatacgttttattccgattggatcgggaaaattgttcaaacggcatagaagaagtggtagctgtgacgaatattttatacagcccaaacaatgagcaggtataatgttcctgtgaaatgacaggaggggttatgttgtgactgtaaccgaaaaggtgattaatttcgcacaccgcggagcttcaggtgtatgtcccgagaatacgatggcggcattccgccacgccttggaactgggagcaacaggtatagaaacggatgtgcagcgcacccaagatgggcatctggtgctaattcacgatgagtcgctgaagcgtacgacaggttgctcactggatgtaaaggatattacgctagaagaattaaataaactggatgcgggcagctggtttgatgagaaattccgaggtgagcgggtcccgatgctggatgagctactggaactaacccagtccttgaatacaattattaatttagagttgaaaaatagcatttacctctatccgggaatggaggaagaggtcattgctgccgtgaagcgttttgggttggaacagcgggtaatcatatccagcttcaatcacgaatcgctggcgctctgtgcgcagcttgctcctgagatcaagacgggggcgctgtatatcgaaattatggttcgtccatcggagtatgccacccaattcggggttacagcacttcatgcctacaaacaagttgttacaccagaagctgtatcagaggctttggcattaggcgtcgtctaccacccatggacggtgaatgaaccggaagaaatgaagcgtctgctggaggccggggtgaacggcatcatcacggactatcctgatcggttggcgcatttgttggctgttcgctcttcctaagtcgaagacacatcggaactgtgactaaggtctgcaaggatatgactgtggctatttattgaagcaaaaaaactctcctgtacgcactcgtttttacgaggcgagggagagtcttttttgccttaagccgaagaggtatcatccacgatgaccttgattcctttctacttgatgccgagccgcatccgatagctgaacaggatgtctagtgttctgccctgaaaatgattctctaccagcttcacgaagcgggctatatcgtcgtcaagcgctcgattgccaagtttgaaaagactttgaatacccccttggctgagagcgagccctgtatagcgagctgcgtcacactgctcacggttatggaagacaatctcccgggtatatcggaattgtccgctgcggtgcagattagctaaatgctgatccttgctccatttatgagcttgctgctctactggggcttcctgttccaaaagggtatccgccttggtgataatctctgtataagcttgctctatctgccattgcagcaccggaggccagtcacagtcaaaggctgcgaacacgccgccccgagccaagaccctgcccgcttcccgaagcgtgctctcggggtccatccagtgaaaggattgagagcaggtgatgacgtctacagttccgtcctcaaagggcaggttgttggagaatccgcttttgaaggaaatggtttctgccattgtcgttcctgctgtttccagcttgtgctgtgcttttcctctcatgtccgggttaggctcaataccgacgatttgccgagctgcgttttcccatatgaaagttgaaagtcctgtaccgcagccgatatcggcaactagctctacatttcgctccagatagcggctgatgatttccacgacgagtgacggtgcttccgggcggtgctgatcgtagttgtcggcaaaaccgttgaaacgatccacattactttgcagatttccctcagggatcataggtccttttcctccttagtttcgactgggcggccgtgtagattcaaatgctgctgtactcctatattgtacaagtttacatgttcatccatctactctcgtgatttcacagcacccgtcggatttcggagggaggaaattcccctattttatcattgaagcaagcgcccactcgcgcatcatggagtcaagcatcggacgcaaatcttcgcgttgcatacccatgtggagcacggcttccagatatccagctttatctccaatatcataacgtgtgccttccagctctaatgcgagcagttggttctgcaatgctacttgatgaagggcatctgtcaattggtattcaccgcccgctccagtggacaggttttccaatatagagaaaatggaaggctccaacacataccgaccaatgactgcctgccgcgagggggcctctgccggagatggtttttcaacaagtccaccgacttcatgaatgagaccgttctggtgagtggagtcaataatgccgtatttacttacatcctgttcttccactgtgcgcacgccgaccacttgcttgccagtcgcttcgtaaacatccatcatttgacgaatcgccggggtggaggaattcataatatcatcgcccagcaacacggcgaaggcctcatcgccaatgaactgacgagcgcagctgaccgcatgtcccaggccgaggggttctttttgacggatatagtgaatgactgctttacccccgatgctttgaacttcacgtaggagatcatatttacctttgctctccagtacctgctccaactccacagacttgtcaaaatgatcctcgatggcttttttattacgccccgttacgataatgatgctctcaattccggacttgatggcttcttctacgatatattgaatagccggcttgtctacgattggaagcatctctttcggtaaagctttcgtagctggtagaaaacgggttcctaatccggcggctggaataacagcttttgtaatttttctcatagaaactcactttcctttcgtgatggggaaccgaatacccagtatcggctcccgatataattgatgatcattccggctgcggtcgcgatcagcttgcttaaagcaagtggcagctcggttccagtgtgaagcacttgcagtaataaggaggttatccccaaaacgatcaggttgatgacgataaatttaggtaattgacgcttattagtgttgtttgatagttgtttgttgaatgtccatttgctgttcaaaatataactgttggctgtgccgcagctgtacgaaatgatctgcgccacaataaccggtaccccgacccaagccagcagcataaaaatgatataatctacacccgtattcaccaggccgacgataccaaatcggatcataggaagcagctgggccatgcgacttttcatggtttaggctccatgaccggatttgggtccggtatataccgcactgttgccgcgcactgtgcgtcctgccgaaatcaggctatcacgggctccttgcatgtacagggattcacggggttcaggggctttcatagcatgtgtcggaccgttttcgtattgtccacccagatgctcacggacaatgtaaagcggacgtgctttggtttcgtcataaatccgtccaacatattcacccataataccgagaatgatcaggatcaccccgtcgaagatcaggctgatgctaatcatagacgaccagcccttcatcacataggaatcggtgaaaaagttgagaaacaatacgtacatcagatacaggaagccggacatggatagaagtgcgccgatataccctgccagcttaagcggtttaatcgaaaaggatgtgatcccgtccagactgagcttgatcattcgtttcaacggatacttggtttcgcctgcgagccgctcgtcgcgctcatattctacagcagtttgtttgaacccgatccagctgaccagtccacgaacgaatcggttattttccggtagccgtttcaattcttctatgaccttgcgatccattaggcggaagtccccggtgtcgactgggatattaatatccgttgatgctttgagtacacgatagaagaggctggcagaccatttcttgaagcgagtttcgccattgcgtttgagccgtttggcgtagaccacttcatagccttctttccacttgttagccatctcaacaatcagttccggcgggtcctggaggtcggcgtcaatgacgacgaccgcctctcccaccgcataatccatcccggcggtaatcgctagctgatgaccaaaattgcgagagaaatcaatcaatacaatggtgtcatctctgagactgaattccttgatcaattggacgctgcagtccgaacttccatcatttacgaagatcaactcgtagggctcacccattgagcccatgacttgtttcagcctccggtaggtttccgtaataacggcttcctcgttgtacatcggaataactatggaataacggatgggttcactcattcgtagttcctcctcatttataatgtgatttcgtataaagtaccgcttccgccacgttcgtctccgccagggccaccttgaccattctgggcgtttacattgctgtttgtggtgtcgcttccgctctcggttgctttaacgtctgtacttgtttcgcctgttgttgttttccattcatctgtagggatcactttgccgtgttctttgatccatgcagtgacttcagagttaccgccgtccggtccgccgcctccaccagaaatcatgaagtacttcacttggccgctttcgaccagcgccttgattttatcgacggtatagactggatcggaagatacaaaaccgttcataataattactttttgtccggcctcgaccaggtaaggagcagccgttgaataattacttgctgcgaaaaggtaggtttcacctgtgttgtttttttgcaaatagctcaacgttttttgatctaaactttggctaccgttgggtccccccattcctctggaacgggtagaagatttttgttccgtgtctgtacttatttgtgtgcttgaagtatttccatcaggactggaattctctacattattggtctggttattcgtttgagtcccttcggcttgttgtccattagcgctctggcctctagtgcgatcattgccacccggcattccgccaccaccgccgccaaattgagtcggtccggcttgtggaatcatgctgttccccccgtagacgatcggtgtcaatgcccagtatgcaggaccgataaacatagcgagtacacttgcaatgatggcgaatcttgtgaacttctcagatttcattcgtgctactaccaatagcgccgtgccgatgatccctaggatcaataccgcgatggaccagccgctgccaatggtatcgttgtaattttgcaaaacaaaccagctaaataccgaggttgccaatactgcggcgggtaacagccaggagagccagttggaacgctcacgatactgcttccacaattctacgaatcctgctccaaagagcgctgcaattggtggtgcgagcataatcaggtaataatgatgaaagaatcctgctacgctgaaaaatgcagctacgggaatcaaccaggccagccagaagatgacctctttgtgcttttgtgtgatattacgatgtcgaatgcttgcaagcagaccgatggaagcaatcaatgcgaatggaagcagccagctggcttgacctgacaaggaagattggaacaaccgcaaaggtcctttttcgccagtgccgaacatgccaccaccggaatttcctcccggtccaccgccaggaccactctggccaccttgcccgttgccgccaaatccacccggtggcatttgaccacctgcaccgaatccgcctgctgccatgttgttggcaccagagtcacccgtagtggtagtactgtccgatgatgtagtcgtctgagcctgatccgtgctcgtattgccgctattcgttgtagcgttattgttccgatccatgcgttcaccgccacgattgccacctgtaccctgatctcctgtcagacgggacaggccgttataactaaaggccaaattcagcacagaattggtaccgctactccccatataagggcgttcatctgccggagtggagtccactacgactgcccaggagagcgatacgatcaggaggacaactgctgaccctaccagtgttactgcttttcgcttccagttaaacttggaagccagcagatagaacaaacccagtgcgggaacgatcatataggcttgcaacattttttcgttaaaggcgatgcctacgactgcgaaagcagcaaggatcagcccggttttgctatttctaatgcctctgaacaatagccatgttgcgagcaacagtgtgaagaccaacatagcgtcgatgttattcgtgcggctaaccgctacggctatcggtgtcgttgccatggcgaaggcggccaatcgtgcggccatcgtaccgaagctcggtttgacgagcaagtaaacgagcaagaccgatccgacttgagccagcgcctgtggcaagataacgctccatccgtgaagcccgaatatataggcactcagtgtctgaatccagaacaccacaggcggtttgtctaccgttaccgatccggcagaatcaagtgaggcgaaaaagaagttgtgaaagctctgtagcatgcttgctacggccgtcgtatagtaggtgtttacatatttgtcttgccaggtgttgtatccgttcaaaaatgcggatatcagcataatgatgatcagggggatgtccgccctggtcttaaaccatttcttaatcatgttcattccactccctgtgaaaattctttgtatttattccgttgttctagccgctatcttcaggactgcggaatgaccagtcgcttctgatcttggcccggtgaactaccggcttgctattatcatgccagacctaccttaattggttctgagcgctccctgaacgttagctgaaagctgagcagaggtgctttttttgcgacaggattcaggtatattagatacaggtaaaaaatgaaccgacttttttatgagaaaaatgcggcaacatgaaagggaagattaaataatgaatccaatacacggagttaaaattatgctggcagatgatgagcctcatattttgcaatttttagagcttggactgattaatgaaggatacgaagtcagaaccgccgagaacgggagtgaagcgctcgatttggcaagagagtttcgtccgcatgtagcggtgctggatgtgatgatgccggaaatgaacggttttgaggtgtgccaaagtctcaaggagacggaggataacatcgcggttattatgctgaccgccaaggatgatgtagacgatcgggtaaagggtttgaaaatcggcgcggatgattatgtcgtgaagcccttcagttttaatgagttgctggctcgcattgaagcgcgcttgcgcaatcagtttcccgatctgctgggcgaagtggttcacggaccctttcgagtggatgatcgacggaaggaaattcgttatcagagtcaggtgctggagctgtcgcctaccgaatatgaactattgaagtttctggtgctaaaccacgggattgtgctgagtaaaagtcgtatactggaccgggtatgggggtacgattttgggggcgaggataatattgttgaagtgtacatccgctccttacgtgaaaaactcaaagacaaggagcaccgggtcattcgtacgctgcgcggtgtgggataccgggtggatctgctatgaaggcgggagggaaaagtcggaggaaatatgcgctccgttctctccgatcccagcttttagccagaacgttactcattttggctttactgctcgtattaattggttttctacaatattttctgatgaaagattttctgtatcgcagtcgggcagaagctatggatacgcagctgaattcaattcctgctgatttattgattaaggattcacaggagcagagtggggtaaccgctccccaagaacaaaccaatcggaggaataatcgaccggggccgtttttgttctggccggatatgtcgctcgcttctatagatatagatggcaccttccagagcttgtccaacgaaaacgggcttaagccgccacgtctcaccattgagcaatatcatgcgatgcagcagagcaaacgtatgcatcacggctatcaattaatcacggatgctcaggggaaagagcaactggttgtattccgtccgctcggtccacctgaccgttcgtccggtttacttcaaatgggcgtatccacgaattctatgcaagagcagttgattaaccagctccgcacctttattttattgtcactgattgcgcttgcgattgggttggcgcttatgctccctgtgctgcgacgcacattggtgcccctttccagaatggtcgaggcagtcaaacgtattgatgccggcaatctggccgagcgctttgacgcagagcaggggcagtatgaggtggatcgtttggcagtttcatttaacgggatgctggaacggttggagcattcgtttgctgccgaacgggaattgcagatgcagatgagacgatttattgcggatgcttcccatgaactgcgcaccccgctcacatctattcacggtttcttggaagtgctgcttcgtggagcagcatctaatccgaagcagcttcaatcggcactagaaagtatgtacggtgaatccaagcggatgaataaattggtctctgatttactattgttggctaagctggaccgaacaccggagttgaaactggaagacataccactagacgcgttgctgttggaaatgaaaccgcagctccttatgctggcaggtacacgtagggtagtttttgatatgacggcaggtatacgggtgttggcagagggggataaaatcaagcaagtagtgctcaacctgtttcacaatgctgttcagcatactgatatggaaagaggtgtgatccaggtaaacctatctgcaggtaagaaattggtggatatccaaattcgtgataacggaccaggcatgagtaaagaacagctggagcggatatttgaacgtttttatcgtggagatgaatcgcgtacacgtagctcaggcggggcgggccttggtctggccattacacagtctatcgtggaagcacatggcgggaacattacggctgaaagcacaccgggaacgggaagtgtattcaaagtaacgctacctttagcgggaacagtatagtttttaagattatggcgtaacataaaaatagccccccgaaccgcagctttggttgtaacacggctcgggaggcttttctattgttagttaatcagcgaagctttttgtaaaagcacgtgcagcaccttggcggatgcctcacgggttgtaggtgcattcggctggaagtaggaggagcctttaatcgctgctccgttgataatacctgctgcacttactttttcaatactgtccttggcatagcctgcaaaggatgaagcatcatggtacggtgtgcgtgcagggccatcggctgtagctttgatttgaagcagatctacagctttacccagcacgacagcaatttcttgacgactgatattagcgttcggatcaaacttgtcgctgctgcgacccgtaatcaaaccagcttcataagcggctgctacatcgccggagtaccagctacctgccgggatatcactgaatggtgcagcagtacccggtgtcaggccgagtgctcgggttaccagggctgaaaattctgcacgtgtcacgttctttttcggtgagaaagttgtgtcagtcgtgccgttaatcagcaacttgttcgctagcgattgaatttccgattgggcatacgacgatgaaatatcttcaaagctaacgggacgtgtcgccgctgcatacgtcgagaagcccggacggcttaccttgacgacggtagatccatcagcctgcttggtgaagacggatggaacgggatagacatttccgtttgccgtataaagtacaccggctgtattggaatcaacttgaccaggtaaggtaaaggatctgctaataaactgtcctggagcaactttgagtgattgactcttgccaccagtgacaacattagcttcaaaccctaccggggtgccgatcacattggagcctttcagcttacttgtaaaagtgctgctcgcctctgtctggctgctgattaccacttcaatgcctgcaccagcaggaacatttttcagagcggatactggcaaagccatagaagagcctgtattgcttacaatcaagctgcttcctgctgaagccttgcccaacgttaccagttgtgtggaagtgagcgatgccttcgtcgtttggcctgcttggctagtagccgacagtacaatagctgtcgggctggaacctgctgctgtcacggcagcctgcaaatctgcatcggttactgtcagcgactgtacattattgttcaatgcaacggctgtagtgatagttttaacagcctgtccttgtttcacaacgctttgaagtgaaggtgcagatgtagggacaggagtggatgtgttcgttgtagcagaaggtgtagtattgcttctgccgccacctccaccacctccgcctccaccactaccgctagatgcggcgctattatccacgcgaatagctttagtggcggtgaagagtttaggacctttagtagtactctcgacttcgccttttgcattcagctccggagcgctgacttccagcttgtatacgccgtccttcaaatgctgaatcacgggctgaccattagcatccagaatgggttttcccttgtcatctaattcgacgtaacttccgtcaatatccttgaaggaatatgcgccttgtttgaggcgagcgttggctccttgttctttggaagtcgtaatgccgtcaataagaccaattaatttatcatctacgccgtatacataaagcgcgatctggttggttttatctgtggtcaggcggaatgccaaatctgttgaacgttgagcacctgtacgactcggataaataatcgggttggtgacactcaagtcctgcaagccgaagccagttgtaggattttctttgcccacatgaacgacgaacggcagatgaagtgttggcagtccggcgcttttcagaataacttccccttcatatacacctgtggctgcacccgaatttggttgtacagacaggaagaacggttgcgatttacccggttctgccgagattgctccattcgcgccgacaccttgcaactgaacggcaatgttgctcacgtcaggtgtagcaatcggttgagttggatcagaagttacattatcatgtaaaacggtgctggcttcatattgcacagtgttagctgacaagtttttgagttgaagctgaatctgcttcgcatcactaccaggtcgtaacaccccgaagctggcagaaggattataattcacaacctcctgccgattaaagtttttgtcgagaatcgtaatcttttcgacggtttccagcagggctggcgtctgaatcgcattagcgatgtttacaaggcctgcaccttgggaatacacatcatattggattttatcctcatcaaagagtgtaaccgaagtgtttgccagagcagcgcggatatcaaacggtgtccagtttggatgctgttgcttcagcagcacagcaagtccagccacatgtggagacgccatacttgtaccgttgctacgtttgtaagcctgctcatacgatgcatctggatagaacttggcgaaagcagggtaggttgataaaatgccaacacctggtgcgctcacgtccggtttgatactgagcagttcatctccgttcggtccgcgggagctgaaatcggccatggtattacctgcattatctgtgcgaatatagtctgctccaaaggaaactgagaacttttctccagcgttgtctacgatttgtttagccagtgaacggccttccttacctttcatgtcaagggttggaataaagtcaaagctgtcacccaaattggaattaacatagtcatcgcgacctgaaatactttcccctaaatcagctttggtgatgtcgcccgctttcgtattcccattaaaaacgataacagccttcgcaccgttctttttcgcatttgtgattttatccacgaatgccaagttgccgcgtgaaacgaggacgatttttcctgctacgtctttcccttcaaaatcatcaggttgtcccagattcgcatatacgagctcataaggggcagttcccaaaatggaggcaaagtcttctctgcctgtctcccagcccatcaaattaaaatcataatgtgcataagcatcattagttacggtctttttcaattcaccgttagcctcccaataggtgtcacgggtgaccgaagctgtacccgagaagcttttgctcggcgaagtagctgcaccgacggaaatcgccagctgtgatgttgcgggagaacccatggaataaaaataggggccatcctgtgccgcattaccattcgctatgaccgcgactacgccggaaagtacagcattattaatagcaatggaatccggggagttagggtccttttcggaatccgagcccagcgacaggttaatgacgttcataccatctttgacagcgtgttcaatgccatcaatgacctgtgcggaggaaccggaggaacgacccgtcttggtattgcgtccaagcactttatacacgtataagtccgatttataggcaatacccttttgtacaatatctgaggatttatttgcggctttaccggcaatcgtgccggagacgtgagtaccatgtgtcgttccgctaaaacctgtgccatatgggtcattctctttttcaaggaacggttcctcgtaagggtcgttgtcctgttcaaaagagtcatatccgcctttataggcttctttcaaatccggatgctcataatcgataccggtatcaataaccccgaccttgattccctcgccattcaatcctttggcccaggcttcaggaacaccaatctggtccagcggtgcgttatcataagtggcttcactggctgtaagtgttggcgggtcctgtacggggatggaataatacgttttgttttcatgaatggattttacgcctggcagtttagccagtgctggaatcttattggccggcaatgtgacctccaagccgttaagcaccgtgttgtactggtaattcacctggagagaaataccatgctcagcggcttggtccacgaacgtagtttgctcggtggcaatcgcggattccgctttttgctcagattgagctgtgaaagcttggacgcctgaacgtgccgcatatttgtccacggctaagggctcaccatcaagttgtacgatgactctgacctggcgggaagagtctgtgcttagctctggcgaaatgaaggccggagccgcctcaatagtcaatgcttgctgagcttccaaaaatgagttgagttgtagatctgcggtagcagcagaactgacagacggcagagacaagcttaccgtcaaggcaagagcgagtgatacgacaggtatttttttcaaaatgatcggctttttcaaagatttccctcttttcaatcaaaatatgatatgtctacatactaggatttgaagccactgccgttgttctcacgcctcccttaatatctaaaataatagaattgaccactggtgactaacttgccagttttgaggcatatcttaccatattggtgggatatattactatatgttttttatatttttagaaaaaataagggtaacattacatgtagattccatggaaatgttatgaatttactagattatttttgaaaacaatcaaaggggaatgggagaatgcgagatttaatgatataatctgcattggaattgttgaggtttcacaatcatgtaaaatgcctaaggcaaaggagtcgattatgttggcaaaaacgttgattttcgggcataaaaatccggatacggataccatttgctcagctattgcttatgcagacttaaaaaccaaactaggcgcggacgtagagccggttcgtctgggcgaggtgaacggggaaacgcagtatgcactggattatttcaaagtgagcgcgccacgtctggttgagcaggttgctgctgaaacggacaacgtcattctggtcgatcataatgaacgccagcaaagcgccgctgatattgacaaggtacgtgtaactgaagtcatcgaccatcaccggatcgctaactttgaaacaagccagccgttatacttccgcgctgaaccggtgggttgcacagccaccattttgaacaagctctacaaggaaaatggtatagcgattccgaaagaaatcgcaggtctaatgttgtccgcgattatttccgattccctgttgtttaaatccccaacctgcacggatcaagacgtagctgctgctcgtgaactggctgaaattgctggtgtagatgcagatcgttacggttttgacttgcttaaagcgggagctgatttgagtggtcataccattgaacagttagtaagtctggatgccaaagaatttcagatgaatggtcgcaaagtggaaattgctcaagtgaacgcagtagacgtcaacgatgtgctatcgcgtcaagctgacctagaagctgcattatcccaaaccattgaggccaaaaatctcgatctgttcctgttcgttgtaacagacatcgtgaacagtgattccattggtattgccctgggaagccaagcacaagcggttgagaaagcctataatgttcagttggacgacaataaggctgttctaaaaggcgttgtatcgcgcaagtcgcaaattgtgcctgtattgactgacgcttttaacagtttgtaatgataaataataagcctcctgagcccgactgcataatggcagtggaagcaggaggcttatttttatttcttcagttctgccaggacatctccgatgcggaattcaaatgccaatttcaactgatcgctcatcaggtgccaggcgttttcagctacagcgagatcgccgctatgagtaaaggcatgtgcggcacccatgtattttttatacttcacggggacatctgcttcaatcagccgtttggcatacaactcggcttcgtcagccaaggagtccaactccgcggttatgatcagagcaggagggagattatgtagtgattctgcaaaaatgggggaaaccaacggatttcgcgcctcatctggtgagttcagataactttcattaaagatttttgctactcgtggcggaatccccttctcaaattggggcttcaatttgggatctgtagcaatatccagtggtgggtaatccagtacctgatatacaatcggaaattccttgcgctcccgggccataagacacagcgccgccgctagattgccacccgcactgtgccccccgaccgcaatgcgttgaggatctacgttaagcacatcaggatgcttgtacaaccattgggtcacctcatagctttcctgtagcgggatagggaatttatattctggggccaagcgataatcgacattaacgacgacgcaattggcacgttcagcaatgaccgggcaccagggatcatccatctcggcgctacccattacaaaaccgctgccatggaaattaacgaatacagggagtggatcagcagaccggtgagaaggttcatatacaatcaccctagagtcaccaatagaggtggggatgatcctttctttccgatgtactttgggagaatgcgaaggtttgaaatcggacgcagctaccattctgccagccgatatgcgggcaagtttgacgaacagtttttgtctcagtcttcgcaccatttttctctctcctctctggagtcggttagacgcgaacctttaacatcttcaaacgcagaacgtacgcgtgacaaataggtttggaactgacagatttccgactcactaaagtctgacatcagacgtgaagccagccctaggaaaaagggatccatctgttgaattttacttcttcctttatcgttcagggacacgaacactccccgcttgtcattgggatcgtcatatttattaatgaatccctcttgttcgagagaaataaccatagaactgattgctgcccggcttacacccatcttatcagccaaagcagaaggagatgacatttcatctctttgcgctgaaagtacacaaagcgcgatatattgcccgtaggagagaccaaattcacgtgaacgtttttccatatttttgcgtatttcatacgttatggaaaataaatctaccaaaacaccaatcggtttattgccacctggaaagagattataggccagttgacgaatttcggagtccaaaaaaaagaacatgcgatccacctcgatgtagttaattagttaactgtaatttaattaaccactggttgcaatgatttatacaaactttgttctgcattttttaaaaaatatatctgcaaaacgtcatatccaggggccgatacactgatcgaggccctgattcacaaaggcttgtatggagggctggcgcagggtacgtccttcttgccatcgccactcactatattgaaccttggcggtaaacataggttgcacccaaaatgcgtcttgatgccgatccggtctattgctaaaaggtcgctccgatatggtatgtggcagcaggcgctcggtaagctgacgccaatcttcccgagtcagcttacccgtacccacatgcccgatatagcgcagcattccttgtttatcatattggcccagcaacacagcgttgataatgcctccgtttagggtatagccaccgataacggcaatgatatcgccataatttttgaccttgacccatcgtccgtcttttccgcccaatgtgtacggactatccagctttttacacacaatgccttccattccttggctgcacatgacctgaaatagagcttgtccatcaggatgagcgggagccagttgaatccgttcattcggtatgatgatctgatgcaggagctcaagcctttcctgtaacggtttaagatgaacccactccccgttcagataaacaatatcaaacaacatgtaagtagcgggtacagcttcataggctgactgaattcgatccgttcgacgaatcagatcccttcgcataatttcatggaacgatggcttaccgtcggcaccgagtgcgatcatttccccgtccaatatgaccgaatcagctttacagtaggaggggaagagagcaagctccgggtataaaagcgttcgttcgtgctgtttgcggttgaacagacgcgtgctgccctggtcgtgatacgtcaaaattctcgtaccgtcccattttatttcgtaacgccaaaggcctgttgcatctacaggtactttttcgctcagttccggttcaaacgggatgacaggttttaattccgtacgcaacgcagcacctcccttgcctttattggaataaatatagtgtcgacgatagatcttattttatgtatgtgatgtttcgctgattcctaaataggggaatgataaggatatcttgcgtcggcatgaagtgattgcagtaattcgttagcatggaattgtaaaggatgttcttcagtcagaaaggagattggtttcatgagacaaattcgcgaggaggaccatgcagtagtcatggtggatgatgggcaggtagttgcagaagtaggctataaatccatagatgaccactcattggtcattgaccatacatttgtatccgagcagttacggggtcaaaaaatcggcaaggagcttattgaccgagtggttgatatggcaaggaatgagcataaaaaggttattcctgcttgctcgtacgcgcttgctctattcaagcgccatcaggaatacagtgacgtatggcagcaatgaatatggatcatcaaggctgcttaattgcataatcgatacaacaccggagcgggtaatcagaccttcccggtgttttttgtgtgcataaagcttgtaaaatcaatgcattctaccgttgatatagggaagtaaagggctattctcaaatgttaaatcatattttccgacagatggctatgaaattgttcatactgttgtcacttcacaggctgtccatgagttctatataatatattatggttatgactacaacagtaacgaaaacctgaatttaacgaaggagacgctcatgatgaataaagcgagtgaggacaagcagtacgttccaacgagcaatcgtaattttacagccttgattatcaccgtttccataatagccaacgtgattattttgctgctgttcttttcgccgatcggataccagggtagtgtgagttttgatctcactattttcccaaggctgaatgcgatttttaacagcttcacatttatttttctggtggctgcactggttgctattttcaaaaagaacattaagcttcataaaacctttgttttgctggccttcgccagtaccgttttatttttattttcctatctgacctttcactacatttcgccggaaactgcaaaatatggtggggtgggtatccttcggccgatttactttacgctgttgatttcgcatagcatactggctgcgattattgtaccgctggccctgttcacagttgtatggggatggacgatgcaggtagcaaaacatcgtaagattgcacgctggacgatgccgatttggctatatgtgagcttgactggtgtactggtgtacgttttcatggccccatactattaatagattaaaccctttgcgggttgatttagggaaatggcgtctctgctgaagagacgtcttttttgtatccaataaaagaaaaattattccttctaaatttattttattgaaaaaacgttccttctttagcggcatttctgctataatttgccttaatcaactaagaacaagggggtcaccatgtgacaaagaaagcgaaaggcaggttacgcttgcttgtatctatgctagcgctggttgtactgctgagcagctgcggtggtggaggatcaaagtcggaaaaggttgacggagggaaagtaacactgcaattttggaccattgcactacaacctacatttaccccgtatttcaatcgggtgattgccgattatgagcagaagaaccccaatgtcaaaattgactggaaggattacccttatgacgcagtaaccaacaagctgttgacaagtatcgctagcaacagcagtccagatgtagtcaatctcaatacagaatttgctagccaaatgggcaccaagggtgctgttgttgatatgaatgagcatttgtcgcctgaggaaaaggctgcttatttcgagggtatttataattctacagttattaacggtaaagcttatgcgctaccctggtataccggtacagaagtgctttacatgaatacaaagctggtcaaagctgccggattggaccctgcccatccgcccaaaacccgggaggaattgtctgaatggggccgtcagatcaatagaaaaattggcaaggcaggctatgctcagcagcttgtatccaagcttttcgctgtggacggcattcctatcctaaataaagaaaagacagcagcggcgttcaacacaccagaaacagtcactatgattgataatctaaaaaaacagatggaagatggcattgtactcaaggaagacgctgaattctcacaacaagtgaaatattatgccggcgagcaggttgctttcgagctggcaggcccgacgttcatcaattttatcaaaacggcagcgccggatgtttataagaacacaattgctgtccctatcccaaccggcaaagccgatgtgcggctctccaactccatggacctggtcgtacctgctaagtctgcacatgtggacgaagcggtgaaatttgctgttttcttgacaaacgcagagagtcaaacagctttttctaaagcggcgaatacactaccttccacgaaagactccattaaagatccatattttactcagtctgacaaatcattagaagcacaagccaaggtagtatccgcgcaaagcttggataaggcgacagattatatggtcggtgtgcctaatgccaaagatgtgaacagtgccatcgcgcgagctttacaaaatatggtattgaatggcgcggatacgaagcagacgcttactgccttggagcaggaagtgaacgatattttaaagcaataggtttgacaggggagtaagtgaatactcccctgttcatttatcaaaatcaggtggtgatgcagcatgatcaaatggttgaggtcggagtcctttacggcctgggcctttatgacgccgggactgttattgcttgccgtctttgtattttggcctattatttacagcattccgctggcattgacggactactctgtcatatcagacacccattttgtcggcttggataattttgaagcggcgtttaaggaccgtaactttcttatttcgatttggaactcattgttgtacgtgctcattgtcccctttcttcaaattttctccatcctgatggctgtgcttgtgaatagccgtatcccgggaattaaaatatttcgtacgacctactacatccctgttgtgacttcgatggtagcggtagccttaatttggagctggctgttgggcaaaagcagcatagtgaactacttgctcatgcaggtcggcttgattagcaaagacatacactggttatcggacagcaacttggctttgtatgtactaatgttcatcacaatgtggaagggactcgggtattatatgatgctctatctggctggattacaaaatattccccaagatctgtacgaagccgctagagtcgacggagcaagccgatggcgtctgattgtccatattactcttccgctgctgagaccctacgttctgttctgtacccttatatcgctcatgtcagctattcgcgtatttgatgaagtatatgtactaaccaagggtgggccgggaacggccacgttgacatccagcttgtatatttttcaaaagggcatggagcagtttaattttggatatgcttccgcgcttggcttaattgtcggtgcaatgattgccgtacttagtattatcgtattccgattcaataggaaaggcggtgtcaatccctattgatgaatctaaaggatgacaaaatgctacgctcatctcttcctaaaaaggaaagcagccgcatcatgcgcagtcttgctcgaatgctgagaatgacggtcatctacgtgcttctagtgctactcgccctctttttaatgggaccgttcctatggctgctcagcgtatccctcatgccaggccgcaacattttttcaacgccacccgctatttttccgacctttattgatttcgacaactacgttcaagtgtggcagttcatgaattttccaaagtatatgctgaatacggtcatcattacggtgttgggcgttgtgctcaatgtggtgctcgccagtctgacaggatatcccttggctgtatttcgttttaagggtaaaaatctggtgtttacgctgctgattgccacgatgattattccttcctacaccgcatttattgtgcattatctgaccattcaagggcttcatctaggcaatacctatttaggtgtggtgttgcctggggcagtctccgttttcaacatttttctaatgcgacagacgtttatccatattcctaccgatgtgcgtgattccggtaaaatggacggcgcttcggagttccgaatttggtggcagctggtgcttccgctggtcaagccagcgctggctgtaatctctctattggaggcgatgtcgttctggaatagctttctgtggcctatcgttattttgaacgatacggagctatatccgctggcagctgcgctcacgtatctcaacggtcaatttgcctataacttcggctggattgctgcaggcacaatgatttcggtactgccgatcattatattgttcctgtttacacagcgctactatatggaaggtctggcgggagcggtaaaaggataagccagtagttacggctacgaagagcctgtgaagggaaggagacgattgcgatgaaattgtccaaaggaatggggcctcattcaggtgtagggctatcacggcaggagatacaatattattttcgtgatgtgtatgacagcggggaaaggctggttatctccgaaccgcgactgatctgtgaactgtcctctcgctttgcaatgaatcaggagtatgaaggtgtgctggaccctgagggaccgatcaagctcattgcacctccaggaccgggtgtaccgactgaaacacggggaagcgtacagttggcgctcgaatatgacggaacgcttgctgcagacggatatcggttggacattcagaaggacgggcggattgaaatccacgcttccaataaaagagggctcaaatacggcatggatgccctgcatctcctgcttcaggtggaacaggagcgatgtactctgccggtgatgtctattcgggatgagccttcatttccggtccgaggaattattgaaggcttctatgggataccgtggagtttcgcggatcggctggatgccgtccgttttatggctacgcaccggatgaacacgttcatgtatgcccccaaggatgatccatatcatcgtgagctatggagagaaccgtaccctgaggatacgtttgaccagatccgcgaattaaaggaagcttgcgaacggcatgaggttgattttcattattgtatcagcccagggaacgacctgagctttggcagcgatgaagatttcctcaaattgacggaaaagctggcggccgtgattaagattggcgtacgtcatttttctgtattaatggatgacattgactatgtactcaaaggggaaaatcgacatttgctgggccgctcgggtcacgctcatgtctttttgacgaacaaggtgcatgcatggttggctgaacgactgcctgaatttacgctgacggtctgtccttcggaatattggtcatattgggataccgaatacaaaaaggatttccgtgagcggctgcatccggagattaaggtgttctggacggggtactttgtttttgctccacagattagtcgcgagcacgccgctgataatcatgcatactttgggcatgagctgtggctgtgggataacatcccggtgaatgattgtgaccatgatcggttattccttgatccgctacgcggacgatactccagactaccggactgcggacataccggtatggtggccaacccgatgaatcagtgggaatgctccaaagtgacgctcatcacgatgtcccactacatgtggaacagtgaacggtatatgcctgagctatcttgggaatgggctgcgcgggagttagcgggagagcgtgcggatgaactgatgtttttctgtcgtcaaaataggaacagccgactaggcggcaacacgtatgaggacgtggaccttgctttgaaaatgcgcgatatccctgcgctggatatgtactttgagcggctgcttcaggcggtgagcgtcctacggaacgtgcctgccgatgatctagccgcagggttcgtgtcccaggccgcgccgtggctggaacgtgccgagctggacgcgggcctgtggcaggtgctgcgtcaagctacgctcagcagcgagcgacaggacgatgcacagtcggaggagagcagcacgccgagcgaagaaattgacgggccagagccgtcgcctctgacggacgaaatcgcaggagaactgcgacgcggtatcactgcttgcttagaagcggaggctcggctgggtagcaatccggcgatccgagctgccgcgcagtggggttatgtcgatcaggatgaacaaggcaaatatcggctgatcttgtaagtgtctgcgatggattaagaaaccaaggcagcatagctgccctgaaaataatcatttgccgttaggataacggtaattttcaggagaggtggaatgtacggtgaagtcaaacacccgattactttttataccgctggatgagcggccctgtaattatcaatttccttatttactggcacaaggcacagacttggaaatggagcggcccccattggaatggatgggacaaaagaaaacccctggcgatatgaccagactatgggcatggctcgaagaacgagcagcgactgctgatggagccattgttgcgatggatacgttgctgtacggaggaatcgtaccttctcgactacacggtatgtcgagcgagcaggtcagagatagagtgaatcggcttcgcaagctaaagcagctatatccgcaactgactctgtatgcatttcaactgattatgcgttgtccgcaatactctttggctgatgaagaaccggattactatgccgattggggtcgtgagatattcagaaagggcttcattgagcatcgtcaggagctggggatcgctaccgcagaagagttgcttgaattagttgatattaacgagcgtttgccaatggaaatactggatgattacttggggcgtcgccatgtgaatttggaggccaatgaagttgcattggatctcgtagcagaaggtatcattaattttatgatcatcccacaggatgattcggctccctacggctataccgccaaggatcagcagcggctaagaagtcgtatttctgagcttgggctggatttgaatgtatacatgtacccgggggcagatgaagtgggttgtacgctgctggctcgttgggttaacaagatgaataatgtagtcccactggtgtatcctcggttgtctgctttgcagggggcattcgtagttccgctttttgaagatcgctatttttacgaaaccttaaaatatcatattatggcggcaggtgggctaatagcttcctcagcaatggaggctgatttgattttgttggctaacacacccggtgacacgatggcagaagcttcatcccagcagcgtgcaatgaccggatatgatgtacatcggaatgtagtagagctggttgagtacggttcttatatgctgcaatatgtaggtcaaaatgttgcagttgctgatgtgggctacgccaacggcgcagatctcaagctaattagactattaaagcaaaaaggactgctttttaagctggcgggttatgcaggctggaataccagttctaacacgctgggcaccgtcattgcccagtccatgctgtatacccactatggctctacggaggaacatttggattttctgtcgctgcgctacaccgaggatgcctgttattgcgctgtgatacgtacggctatgaataacgggattgtggagcagatgggttttaccaagtttatgctcgatggaccgagaggctcggttgctgcggttattcgcagacggctggagcaggcgctcaatgaatatgtgaacgggccggaaggccgcgtggaaattacagattgctacatgccgtggaaccgcacctttgaagtcggattaaccgtacggcatcatgccgagaagagagggtgattcctatgggaatggaaggtgtgttatccaaagttcagcacggactgatcgtatcctgtcaggcgctgccaggcgaaccgttgcatggagcagattctatggtcaaaatggcgcttgccgcacagcagggtggagctgtagcgattcgcgccaatggcgcatcggatgtacgtgcgattaaactggcgatttctctaccagtcattggcttgattaagcgggattatgatgattctgatatttacattacgcctacccttcgtgaaatggaggaactggtagaggcaggcgcggatatcattgcgctggatgccacattacgaccgcgcccagcgggatgcaagctgaagaggctcatagattatgcccatgagcagggggttacttccatggcagacatttcgacactggaggaggcgcttcatgcggcctctcttggcgcagactgcgtatccaccacgttatccgggtatacaccgtactctactcggattgagggtcctgatctggagctggttcggagagcgtcagaactggttcctgttcctttaattgcagagggtaaaatctatgatccggcgcaggttgaggaagcattccgaatgggagcacatgcagtggttgtaggctcggcgattaccagaccccaattgattacgcagcggtttgccgatgccgcaaggaaggcagtgaaatgcatctatggagatgaacgaccgaattaacacatattatccttcattaacgaaatcggagcagaaagtcgccttgtgcgtactggagcatcccgcagacatcatatatttctccgtgacagagctggcggattttgcaggtacaggcgaaacgaccgtcatgcgcttttgccggaagattggtttcaaaggttatcaggatttccgactgtccctggcgcaaaaccagacttatcgtaaaacagatatgggcgaggagaacatcgacccagatgacgaacaagatattacgcgtacggtgtatcacaacatgctcgatattttgcactccagtatggggctgctggaccattcagagcttggtcgtgcgattgcgtgtctcgatcaagcgggctatgttcaatttttcggtgtaggcgcttcgggaatttctgcgcaggatgctaaaaatcgtttcttacggatcgggcgtcgcgccgaggctgtggcagacggacatattcagtcgatgatggcggtgtccatgaacccgggtgatgtggctatcggcattagtgtatcaggaagtacgctggatacaaacgatatgctgcataaagccaagcaaaacggtgcaactgttatcgcaattacgaattatgccaaatcacccattacctccatagcggatatcgtgttgctgaccgcaggcaaggaagctccaatagaaggtggttcaatcggcgctaaaatctcacaactattcgtgattgacctcatctgcgaagggcttgctcgcaagcatacgaatcacaccaaacagatgaaggaaaaaacagcgagggccgttattgaacgaagctattgagatttttcagttgtgaattgaaaacttgtgctccgacagttcaatgacttgtgtttgtggtgcttatgaatggctatttcaagtattgctattaatagaaggtttgtacaaaaagctagtaagcttttatgtggggcaacaaggaggttggtgtggtggtagctgctgtgaacagagtcattggaatcgacattgggggcacatcggtgaaggccgccatagtggcacgggacggatcggtgcttgatgaaatccggctggatacggacgcttcccgtggacgtgaatgggtgttgtcgcaggtgtcagaatctgtgctcggactgttgcgttcttttggggataccagcatcggtgcctatatagatataggcgctctaggcattgctactgctggcagagtaaatgtggagagcggcgtagttgtgtatgccacagataacctacctggttggcaaggtacatccttagtaacgtgggctaaagaaaaactggctttacgagcggttgctgataatgacgcgaacgccgctttacttggagaagcgtggcagggagcggggaagggcaagcgacgtttggtgatgctcacgttgggaacaggtgtcggaggtgcatatatggaaaatggccacttgtgcagaggggctcattggagcggcggtgattgggggcacagtattctattccccggaggacacccctgtaattgcggaaaaaaagggtgcgccgagcaatatgtatcggggagcgccctgttacgtcgaggtagggaacacgtcggtaaattgtaccgctcgggaaacgagatagtgaaagaggccgttcacggtaaccaggaggcaatccaggtactggatgattacaccgcagatttagctgtacttctagctaacatctcggtgactcttgatcctgaggggatcattgtaggcggaggagtagcggacacgggagaggtctggtggcctatgctggaaaagcatctgcaccaatttggagttcaaacggaagtaagtcgggcattgttgggcaatcgcgctggaatcatcggcgctgcacggcttgccttcgaaatgaccgagtcctagtacaagaatgaaaggggaacgaaccatgacgcaaaaacggcttgataccgacattgttgtgattggcggaggtctgggggggacatcggcagctcttgcggcggcgaaggctggcatgagagtcatcgtgacagaggagacggactggttaggggggcagttaacttcacaggcggttcctccagatgagcatcgatggatcgaacaatttggttgcacagcaacataccgtgagttccgtaatcgtgtacgtgactattaccgtcagaactatccgttaaccgaagaagctcgaaataatcccattctcaatcctgggaacggttgggtaagccgtctggcccatgaaccacgggtagctctgcgggtgcttgaagatatgctcgctccttatttgaatacagggcgcgttcatgtatactatcacaccgtgcctattgccgttcagacggatggggactgtattacttctgtaactgtccgtacctcgaatagcgctgatcataagtgtggatttagagtgctgcacggaacgttttatctggatgcgacagagtgtggtgatctccttccgatggcgggcgtggagcatacgagtggagcggagtcgcgggctgctacgggtgaacctcacgcactggagtgtgctaaccctttggatatgcaatctatcacacatgtggctgccgtagactatattccccaggaaagcttcattatagagcggccgcaacaatatgatttctggagaaattatattccgtccttttcccgttttccgattttgagctggtttgctactgacgcggatgataccagtaaactaaaacagttcacattgtttcctaacgatcagggcattgtatccttatgggattatcgtcgtattgtagatccctcgatatggagcaaaccgctaaatgatggtgaggtaactcttttaaactgggcgcaaaatgattattacctagggccattgatcggtgttaccgctcaggagcaggcaaaacatcgagaaggagcgcgtgagttgactcgttcattaatatattggcttcaaaccgaagcgccccggttagatggagggttcggctatccgggaattcgaccacggggtgatattctcggcacttctgacggtctggctaaaacggcttatattcgcgagtcacgtcgaattcaggccaattatatgatatctgagtttgatgtaagtcgtgagcttcggggagaagagggtcctaagcgatatacagacagtgtaggtgtaggtagctatcatttggatcttcatccaactacggtatctcagcgaacattctacatccctaactatccctatgaaattccattgggctcacttattccggtgagggtgcgcaatttacttcctgcctgcaaaaatatagggatgacccaaatagccaatggctgctatcgattgcatcctacagaatggaatataggagaatcagcgggaagcctagcggcttactgtgtctccaacgaagtatatcccattgaagtgagccgatcagcagagcatcttggatgttttcaaaatgttcttcttcgccaaggtgtggaactgcactggcctgcagaggtatttgagccagaggaagtcatcagctaatgaaggggcaactagcccctcgactgattttaaatgagctgaaagatgagtggatttatgatgaaataaaaaaaaaaaaaaaagtgcttgctaagttgcttgggtttatgatatattatttgagctgacaacaaaacagcagtttcaaaagcgaaaagcttgggtgaaatgatcttcaaaaaaagaaaaaaataacccttgcatttttgaaacgaacatgatatgatcttatagctgctgaaaaacgcggcggaagagaaatgtttgatctttgaaaactga

SEQ ID NO: 42 - DNA, 54382 bp, Unknown
  Kingdom: Bacteria, Phylum: Firmicutes, Class: Bacilli, Order: Bacillales, Family: Paenibacillaceae, Genus: Paenibacillus
acttgtgtttatggtggagtttttttattcctaatttttaaatttaaaatctgaaaggagcctgaaccgtgactgatagtacgatcaaaattacattaaacggacaggaactgaaaacgaagaacagcgcaacgatccttgaagtgattaacgaaaacaacatcgctcatccccagctgtgttacgttcccgaagtcgatccgatccgcacctgtgacacatgtatcgtggaagtggacggaaaacttatgcgttcctgctcaacactggcttcggatggaatgaatattcatttacactcggatcgcgcgaaagcagctcaaaccgaggctatggaccgattgctagaaaatcatctcctctactgcacagtgtgcgataacaacaacggtaattgtactttgcataatacagcagagcttatggagattgaacatcaaaaatatccgtatcaaccgaaagttgacccgacagaagtagatatgtctcatcccttctatcgatatgaccccaatcaatgtattgcatgcggccaatgcgtagaggtatgccaaaaccttcaggtcaatgaaacgctgtccctcgactgggaagctgaacgccctcgcgtcatatgggatgacagggttgcgattaacgattcctcctgcgtcagctgcggtcagtgtgtaaccgtctgcccatgcaatgccttgatggagaaatccatgctgggagaagcaggcttcatgagtggcatgaaaaaggatttattaaatccgatggtggatttaataaaggaagtggagccgggctatagtgggatttttgctatttccgaagtcgaagcagcaatgcgtgaaacccgtacgaaaaaaacgaaaaccgtctgtacgttttgcggtgtaggttgcagctttgaggtttggaccaaaggccgcaaaattttgaaggtacaacctacctctgagggacccgttaacggtatctcaacatgcgtaaaagggaaatttggctgggatttcgtgaacagcgatcagcgtttgacctcccctttaattcgtcaaggtgacgaatttgtggaagctacctgggaagaagccttgagcctgatggccagcaaaatgggagctattcaagaaacttacggcggtgaggcactcggctttatttcttcgtccaaatttaccaatgaagaaaactatttgatgcaaaagttggctcgtcaggtcttccaaacgaataacgtcgataattgctcacggtattgccaatctcctgcgtcatgggggctgcaatacaccggaggcatcggtggggacagcggtacgattaaagacattgccaaagcaggtttggtcatgctggtcggttgcgcgccgggagaaggacatccagtgctggctactcgtatcaaacgtgcgcataagctgcacggtcaaaagttgatctcggtcgacctgcgcaagcatgaaatggcagaacgcgcagatctgttcattcgtccgaagcaaggtacggattatgtatggttatccgctgtagccaaatacatcattgagcaaaactggcatgatgcaaaattcattgaagagcatgtaaacttctatcctgaatatttgaagttgctagatcgtttcaccctggaatttgccgaacaggaaactggtatttccaaagagacactgattcaggtagcgactatgattcacgaagccgacggcactgccatttgctggggcatgggtgtgacgcaaaacatcgcaggctcttacacttcgattgcaattgccaacctactgctggtgactggaaactttatgcgtccgggtgcaggcgcatatccgcttcgcggacataacaatgttcagggtgctgccgatatgggtacaatgccggatattttcccgggctatcagcccgtgacgaacgatgtcgttcgtgccaagttcgaagcggcctacggcgtacaaattccaggtcaacgcggactagacaacattcagatgctggaagccattgaaacaggtaagctcaaagcgatgtatatcgctggagaagagatggcatgggtggatgccgactccaaccatacccaagaaatgctggcgaacttggatttccttgtcgttcaggatgtatttctgagcaaaacagctgaattcgctgacgttattttgccagccgtaccttcacttgaaaaagacggaacctttacgaacaccgaacgtcgtgtccagcgtttatatgaagcactccgccctatgggagacagtaaaccggattggtggattttcagccaatttgccaagcacatgggatttgattgggattacagccatccaagtgaaatttttgaggaaatggcgtcgctcactccatttttctcccaatgtaattatgacgtattggaaggctggaacagcttccactggggatcgccggatggtagcaatacaccgctactgcacaccaacggctttaactttccagataaaaaagcgcgtttgggacttttcgaatatgtgccaccgaaagagtaccccgttgaattcgatctgaccttaaataatggtcgactgctcgaacagtttcatgaaggaaatatgacgaccaaatcggcaggcattcagctcaaacttccaaaagtatttgtagaagtgtcccctgaattggctgaagagcgcggaatccataatggatcgctggttcgattggaatccccttatggtgcggtcaagctacgcgttctggttacagaccgggtgcagggaactgaaatttatgtgccgatgcactctaccagccatgatggtgcggtcaatctgttaactggtggagcgttcgatgtggtcacccgtacaccggcctataaacaagtcaaagtacggatgcaaattttggaggtagacggtcaaaatccactaccacgtatcaatccgcgttacaaaaagcgtcatccgcaaaatggggttgaagtggaccgtaaatggaatcgtcccggttacgtcgatttagtggatcaaaaataaggaggtcaagccatggctaagcctatttcaattgtgagaaaacgcattttgacagaagaagaacggcaaaaacaatcgctggatcagcttactgctgatctggcggacaatggggcggcattgcagaagacacttgaaatcgtacgtgaactgcacgatagtggtcttctcgaagcagctcagtctatgctaaaggctaaagaaagcatcgccaaaatcgctgtaggacaagcaacgcgtaagcctgtgacgaacatcatcaataatctcatgggagcagcagggatgctgtctgaggtagaccccgagctgatgaaaaagctggcaaacagtgttactaatggcctgaacgaagccgataaacatctaaagcagaataaaaagactcgtctgcgcgatcttatgaaggcgatgaatgatccagatgtaaaccgggcaatgggatttggcattcattttctcaaaggagtgggaaaaagtttgtctgataaatagctcatagagcgtgaagatggaagactagtaacacagacaataaaaagagctggctccgaaaacggggacagctctttttatttattttttatccacctgcaatagcgtcaccgttttaagagaaacggcatcttttatttgctcctctgcgatgaccttgagcttaagcaaactggcaatcttcgacgtatccggcttggaaaacaagcgccatagctgcggatcaggcagtgaatcatacagctttgtatgatcgtattccttgcggtgctgctgtataatcttgactcggtagttgccaatttcccaatctgatacttcctgctgtgcacaatgtgcggtaatgtcattacgcaaatcagtcagttcaccttcaatttctttttgcttttgctttaactggtagtagcgacgcaccttgttttccaatcccatcacgctcctctgcttacatatgtatgtttgcagaagcattttaggacaagttttgtgatgttaggattgaaggtatagctgtaaaagcatttcccgggtaatggaaaggtccataagttgagccatcatcatccaaactttatttaggtacattcgcccctggatttacaggccctgttccttgggatttccccttacgtttcatataattggcccagtatgccgtcagaataggtactaaaatcgaggtcacaatgaccgaagcagcaactaaggccgttgcagattgcgctacaggcagaaactcaggcttgatgttggccacaatgactggattggctacggctgcacctgctgtactggaggctgcaatccctgctgtaccgttgccaccaccgatatatttgtccgccaaaatcagcggaatacctgtaacgataatgacaaaaatacctaataaaataccaagcatacctgtctggacaatgacactcaggtcaatggaacaaccaagtgcaaaaccgaaaaatggaatcaaagcttgcgttgcgttcccaaaatattttcggaaatcatgatccagattgcccaacataaatccgaccaaaaatggtaataccgcccccacaaaggtctgcggttcaaaaacggccagcccggtgctacccaaaataatcatggtcaccaacggacccgattccagtgacatcagtacaaatgctcctgcctcttccttggagccatactgctgcataatagaggcgtataacccgccgttcgtcatatccatagccgagatcaacgccagcaccgacaaacctgcaaatagcccactttctataccaccaacaggcagcaatctggatgcaatgatcgccactacccacgcgaccgcgattttagtcaatacgagcgttcctgatttacgcaatacagtacccgtcgctcgcacatctatagaagcacccatacaaaaaaaccacactgccaagatgggtaccgtacctgtcatcagccccttggtaaaagatccaaaatagtcgcctgcccatggagtaaatgtatgaaaaagcgcgccaataaacagcggcaccagcataatgccccctggaattttatcaatgttttgtttgattttcataacttcgttcaaccctttcgtttttgccaatgcaaaaacaaggccgtgttacttgcggctcaagccgagctcgggaatcagtctcgcaaaggtatcgtgactctccttcagttgccgcgcgaatgcctctgcatcctgtacacgcaatcccaacccatgcttacgcatttcctccctgaattcctcgtctttcgtccccttgatcagtgcatccgtgagcgtttgagcaacttcatccggtgtatccttgggtacagccagccctctccaagtgccgataaaatgtacacgcagcccagtggcttgctgtagtgtcggcacttttggaaacgcttccgaaatagtgtctgcctggatcgccagtatgcgaagtttcccttcgtccacgtatttcttcacttctgcgggacttacgggtacagcatccacaaatccgctcattaaagcggagacggctggacctgctccctcataagggatatgggtaaagcgaactccgcttttctgctccagcatcgcggcagcaaggtgccatatgctcccggtgcctgcattccccattttgagcttaccgggatgggccccagcatcctccagaaatgcctccgctgtcttccatggtgcatccgcccggaccgtaatggcggaagggtccatattggtttgaagcagcggcttaaatcgctcataggtgagcggtagcagtcccaaatgaggcaacgtagtcagctcggcgaccagatacgttacggtataaccgtccgcctgcgcctcagccccttccattagcccgacagaaccgcctcctcccgttcgattaacgacgatgatcggctgaccgagatgcttttcggcggctttcgccaacgctctcgcggtaatatctgtaccgccgccggctgcgtaaggaacgacgagtgttattggcttcgtaggaaatatacggctgtgatcctgcagggtgcggtgatccacacattcactgatactcaaggcagaaagcatagctactcccgccgcaaccagcacatatttttgccatggctttttcttcattacgtttcctcttctccaaaaatgaactgggcccgtcatgcgcccgttttcacctccaacgtttttggtcttgttgtttgcgtttacatgaagtcaatgtaccgcaacgtggagggctacatctatcgcttaatcttcgtatttatcttctatttcgccaaagtatcgaccttttgaccgatctgcatattcattggaagatttgctgatttgtctgaatttccctggggtcacttgtttgtgcttgcggaatacccggataaagctgttctcatttcggtatccgacctgttctgcaatttcaccgattttcaaatgggtttcacatagtaatgtgcatgccttttttacgcgtagtccagtcaaataatcgtaaacggtgctccccgtttcttccttgaacatgctgctcactgaggacacgctcatgtgaacatgatccgcaatttcctgaagcccgatgttcaaatgtaaatgatgttccatatactcgatcatctcttgtacacgcacaaaatctttggactggatgcgtccattccatttttcttcaatatcagtcaacataatgaccagcaatacctccatgtcttgaaggtctagcgtcagaatctgattccagtggtaatcagcaagctgatccggcggtgtcacactctgagtggcacaccattttagcaaatcttccagcaattcatgaacaaacaagtagacctgagctggagatgttctgtggagtcgaagttcttctacccagtggctgattagctttacacttgcaccaggttcctgtgactccagggcacgaatcatttccacacgccgattgtccagcaatgttgaatcctgaatctgctcctttgactgttcatctaccgtattatcctttttcacacttatactgctgtctatattcgtatatgaacgtccatatccctcatacaaacgcaaattaagggcctcttttccttttataaaagacgcccgtgcctctcgaatatccgtgaccatatgaccaatccctatagaaatagtcaaaggaagatactcaccgacaacctgaatcagcctatccacgcttttgtgaagcaaaatgctctcttggaggtcagtctctgtaccaacttcattcgaactctcgctgaactgtaacagcacaataaaaccactttcctcctccggcgagcatactgctttacagtgaggttcgagcatctctagcaaaatattgttcagcgcatacttgagcagcattttatcttcttctggaaagcttgcggcccacgcagaataccggtcgatggatacgatcatgacaaacaaagaatgaccgtcccaatcagaaaaatactgttcccatttcatacgcatttcctgtatgcccattctacgctggataacatcttccatatatttggaacgtagctccggtaggcttcgctctaccaccaatgatttgcggtgaaactctccaaccagtttgctaatcacaggttccaggtcatacaatcctccttggcgcgttcctttattgcccgaattcaataggctattaatttttttcatgggacgaaaagctacataattataatagtaaactgctgagcacccagccagtatggagataaaggccagccacagcatcatattgcgcgccagctttacatttttcagcagcttgtccatcggaacgagcgatactagacgccagcccgttacatcagaaaaggtttggttcgccatatattccatgtcccctatctccacataagcatagggactcacatccagttctttcaaaatcctgcccatatcatttaagggtaaggacgatctcagcttgggatagatcaactcgccctccagatcatacacgtattgcgagttggataagtgaatatagagtttggagaaaaaacggtcataatccagattgattagcaccgcacccatgacctgaccatcctctactatgggcctggccagcgaaagcagctctaccgccccctgctcacgatcggtgccgtaccatcgccgcttaatcaacaacggctttttttgaatgtcctgaatccagggaacccatgtggtatccggtgcctgcttccaatctggcctgtaaccataattgctggatacgagagcatgattgtccaaagaaataacttcaaccgagtaaatttcttcgtgcgaagaaagggttttcaagtatttgtgaagccgatctatgacggaggccttgtcttccagcgattccccatccgtttggacacgtacaaaggcctctacatctggatgatatgctgcgtccagcgccttgttatcagactcacgaaaagcccgattggtcacatccagattgatttgcagcaattctatattgggtgtgttcagctcggtatccaaaccttcacggtatcgtgaatacgatagcaagccgatcacgctaattacaagcgacacgcacagagtgagcagtagaatcaatcttgtctgtttatttttcagtatcaatcgaagcttaagtcgcaacattcccgtaacttcatccttccggacttcgttgtccatcttcctcttgccagtatacgtggtgacatattctccctaaatctatttgacgtaagagttggaattccctgcctatgtatatcaaacttaatataaggattcatataaaaaagaagaagcctccctgtactgtacaaggtagaactccttctttggcactgcttgtatcattattcagcaaaaacagatactcgctgtacaggttttagcttgtctattccacctgaaaacgatctagctcccgttgcatctcttcgcgaatctgacgaagctcttttaccttctcagccgattcctcaaatgaacgcttctgctccaccgtggaagccgtaatctcttcactgcctgcggcggactgctgagtgattgcgctgatattttcaatagcttgctgcacctgtacgctcagttctcgcgatacattcatgtccgttgatagcttgctgacttggctggcgatttgctgcactttgccactaatctctgtaaacgattctccagtcgaggaggttgccttctcctgctcacggaacagctcctgactttgcgccacagaagtcttcaccttatccatagcctgcgtgatactgtcaacagcagtataaattttctttacagcagactctgattgattcgccagctttttcacttcattggcaacaacagcaaaaccttttcctgcttcacctgcacgtgcagcctcaatagaagcattcaaggacaacagcgatgtttggctggcaatttcggatacgtatccagtcatggttgtaatctcggctgcattcgcctccagctccttgaccgtctgctccacttcggacatggctgaacgattttctgcaacaatacgcagttgatcgctcatgacccgcgtaccctgctcaatgacacgcaaagcatcctcactatacgcggtcgattgtgtggtctccagtagattcgattcaaacttctgctgcatctcgtccacaacgccaactgtcgacgacagatcctcagcaattttctgactgcctattgccagttcctctgttgacgtgctgacttgtgtcacaatttccttcatggcctcattatgctgatcaatatcccgagccatcagatcgacacgattacccgcctgatcaatggagagtacaatgctgcgcaggttcccgatcatcacccggaaagattcattgagctcgtccagctcatcgcgtcccttggtttgggcaagctgcactgtcagatttccctcagcaatttgctttgcggcatccgttaatttgcgtgttctaagggcaagctgcctggatgtatatgtattatatagcccaaccgccaccagaagtataactgcacctgccaaggccaattgccatgtaaaacgaatgctcttggtcaaatcttctgtgtattggtcataacgtgccttggtcagcagatccagcataaatacatcgttctgaatcccttgggcacgcatggcctcccgcttggactccgggctgttttgggtactcatggctttctccgttgctactttcaattggctgaattttgttttaatcgtattcagtcgcttttgctgcgcttcggtttgcatcatgccctgtgaaagcaaagcaatcgtcttttcagactgagtcagttgattttgcacatcggctttgttgctctccgtcatggaagctgaataattttgcagtgcctgccctgactgaatcaaataggcattgagctgctgtacattcaacatagccggaaccagattactactttgcgagttaatacgaattaattcaaaaatgatataagccactaaagctaggcaagcaatcaaggaaatcatcgcgttcagcaccagtttaccttgcagtttcatcagctttcatcctccgtttgcgaaaatttattgggtgggaacagtcagtgtgccggatttgattttttcctttaaatcatccaacaacttttgctgatccggactcagtgtcacgacacgaataggcgccaaacctacaccatcttccgcaagaccaaacaccatatccttctccgtaaattttctttgatgatctgcaaatcctttgactgctgtataaattgcaatgtctacatttttaaacatcgaggtcactaccgctttttccgcaataaaaaactggtcgctatcgaccccgatggcgaatttatgctgcttttgcgcttcctgcagcgcacctacgcccgtaagacctgcggctgcaaagatgacatcaatctgatcctgattaatcatgtcatctgcaatttccgtacccagttccggctttccaaaatctcctgcatacgttgcagtaactttggcattaggcttgactgattgcactcctgcgcgatacccaatttcaaattttttcaacagaggagattccgcacctccgagaaaacccacctgttcggtgcgactcgtcaaacccgcaacgactccagccataaaactgccctcttctgctttgaagctaatagaggccacattcggtaaatctgatttctcatccacgattaaaaatttacggtctggatactttttagcaatggattccaaactgtccttcaccatgtaacccagcccaatgattaaatcagccttttcttgagcaagctgttcaaaagccgcatcatacgtcttggtctccgttatttctcggtattcaaaaacaattttcccctcatcccgtgctttgaccaaacctcggaaagcagcgtcgctgtatgattggtcacccagaccaatatctgacagtacgattcccaccttaatgggctgagccttggtttgtgctgccgattgcccacatgcacttagcaataatgcaaagattgtgacaatgggaatccacctaaaatttaataatacagctcgcttcttcatgacatatcacctcagcataatttggaaatccccaacatctttatatcggttataaaagcatattttttcataataatttctgtaaactcagttcttctattttattatgaaaaaatagaagggactgaccaccaggcttgaataacatcgcctaacaatcagtccccaatcttatttacttttactccatttggaagcaatcacttcggttttactttctatgagatccatgacttcctcgcggcgtttcgtcttgaataaatcaatcatgtccatcaagtcgttgcggtctaatagtttaaccccgttgacagcagcaagtgttttacaggattccgtataacggccggaggtgatgacgacagacttgtcggccgcataataacgcatggaggtataaatttcctgcaccgcgcccaaacctaccggatgttgtaccccataacgtttggcctgtatgacaactctaacgccttcacggtctgtaaaaaccagatccgctccaaaatcccggctactggttgttttatagatatccttatagccaagcgcggataatagccgctgcaaataaagctcaaattccgacccatcctccatacgatctatatcctgaattccaattttgcgcgggtccagatcacgtaaaatccgatttctgcgaccacgtatcaatcctctgatgatgagcgcaaacaacactaaaagtacaatgagtcctattcctaattccttgtatgccaataatttctctagcaacatccaactctcccttttctaccataagcgtagccgtatcatccttaacagggaacttttctatgcacgctggctcccgtattacatctctctttatcacataacaatagccccgccagattcgacggggctatcttcgtcttgcctcaaagctgtctaaactccatactccgcatcattattcgcgattcagcaaagattctccggcaataccaggctgagtcatttggtacgggtccaatataatgtccagctcctcctcggtcagtacattgtacagcaagcacagctcgcgcaccgatttcccagtcgtaattgcttcgcgagcaatgcgtgataccacctcatatccaagatgcggattaagcgctgtaataatgcctacactgttctccacatattcacgacaccgctccacattcgcttcaattccttctacacaatgaatgcggaagacgtggaagccctgcttcataatttccagcgattgcagtagattgtagaccagtacaggctccattacattcagctcgagctgaccagcctctgaagccaagcagattgtatgatcattaccaatgacctggaaagcaatttggttaataacctcacacatcaccggatttaccttgcccggcataatggatgaccctggctggcgggcaggcagactcagttcccccagacccgcacgtggtccggaagccatcaaacggatgtcatttgccaccttagacatattcatcatacaaattttcaaggcggcagacacttcagtataagcatccgtattttgtgtagcatctacaagattttcatcagcttccacagggaagccactgacgtctgccagtacctctgcaacacgctgaatataacgacggtctgcgttcaggccagtacccaccgcagttgcacccatattaatcgttagcaggtgctgcttggtcgcacggacgcgtccgatatcacgacccagcacacgcgcataagcctgaaactcctgtcctaatcggatcggcactgcatcctgcaagtgagtcctgcccattttaatcacactatcaaactcatttgccttgcgggaaaatgcttcctgaagctcactcatggtagctaacagcttatcaatcatacttaatacagccaagtgtacggctgtaggaaaagcatcgttcgtcgattgcgccatattaacatgattattaggactgatctcctgataatctccgcgttgcttgccaatcagctccagcgcgcggttcgcaatcacttcatttgtattcatattaatggacgtgcctgcgccgccttgaatcggatcgacgatgaaatgatcatgcaactgtccttgtataatctcatcagcagcctgaataatggcctctgctttggggcggtgtaaacgggttagttccatatttaccgtcgctgctcccttttttacaatcgccatggctttaatcaactcagggtgcagtttttggcctgtaattggaaaattttcttttgccctcaacgtttgtacaccataataggcatctgatggcacttccttggtacctaaaaaatcatgctccaacctcatattctctgattcctccgctgtgtttgctacgttcttcaattcagtacagccaaattgacataaaaagaccttctctgatccccctttttcattatacgtttctattcccgtgcttttccagttgaataaacgcggaaaaagctatgtaatcctatgacaagttatgattacccgtatataccacacttattcggtaaatgctcagctatgacttgaatacggatttaatggcttataataatatcgcgtgtcatgaagctgaccatcggctgattgagcataccctggaataacaccagcttctacgaacccgatcgactcgtatagtccattggagggatcacccacccgcgtatctagcaccagtaacgttctatcctgacttagtgccacttcttccgctgctttcattaactgtcgtgcgatccccagtctgcgaccggacggatgtaccataagctttgcaatttccgcacgatgaatagcgttagctttttgagccaaatgaagctggaccgtccctacaggtactccgtccttctcggcaatccacagaactacgccgtcctcaagtacattgttccaataagttgctgcttcctgataacctaatgggggtaagaaccctatagatgcaccgtctgcaaccacgtcgattaacagtcgacttagcgaatctaccagggcttcatccagagcttgaacagggtagactctcatttcgttagacattgtgattcctcccgatgagttcgataatatacaataaagaaagcaaactatctttttaggatagtttactttccataatacttcgcttacttcatcattctcatttccattactgctctgccatataaaagaactcccacagatgaccatccaaatcctgaaagctccatccatacataaaaccatgatcttgaggttcgtttgagggcttgccgcccgcttccaaagccttgtggacgatctcgtctaccttttctcgactctccaccgataaggcaacaattgcttctgtgctttttgtggcatctgaaatttcctttgtcgtgaacgttttaaaacgttcttcaaccaataacatgacaaaaatatgctcactaacaaccatacaggttgcatgttcatcagtgaactgagcactgaattcaaatccgatggtagtgaaaaaatcaatggactgttgcagatttttaactggcaaattcacgaaaatttgtttagcttttactcccacgacatttcacctcttcattcgtcattcattctactttatcatactacctctccacaaaagataacttaactatcgtataaagtcaatcaatctgacatttgtatagggaaatctcctattcccaatgtagcttatccaatgcgcgagataatacagccgcagcttctgccctcgtcacggatgtagccgggccaaaacggccttctcgtctcccctcagaatacctagtccagacaaagtcttcacagccagagctgcccatgtagaaatctcctgcgcatccgacaatgatacagatatactttcactcacttctcttgtattttcttctgtgttcccaacgaagcgcaaggctctctctatgatcacagccagttcctccctcgataccggggtatcaggacggaagcttccgtcagtatagccgttgatcagcccagctgctgctgcggtacgtacggaatccgcataccacgattcgggttgaacgtcgtcaaagctcgtcagcgtgcgatcaatacgctccagtccaagcacacgaaccagcatcgctgccagttcagagcgtcgtacctggccttcaggctcaaaatgcacgttcgctaagtccctttcacgagtcgcactagctgtagacgctgttgaatgggtccccgtcacaagcaggagagttgccagccgtgtaatgtcctgctgcgcccaatggccggatatatccatgaacgatctgacttcaccagaagacccgccatcaagcacagcgtaagtccctcccgaacgtccatacacggttatttcctcactcgaagtgtgaaaaggaacgggttgataggacaggtgtccgacttggttggtcgatgataccttcactacagcaagctggtctgtatcgaccattgcaggaacacgtaacagataacgttcataccctctaccagagtctccgttacctgccaaaagctgtttccgtccatcctcgcttctcagctcagcggcgatatccaaagcctgtaacactttgcgccctgttggaacatccaagcgtttagccagctcttcgttcaaagcgatggaaaaattcaaggaaatttgttttacaggcacctgccaggtatcagccagtttctgaaaagacaaacgacttgttgctacttcatatccaccctgtggcgtttccactcgaagggtacgaatacggtcgttcaagacggctcccaaagcttccccgtttaaatgaacctcgtacgtccccgcttctacttgctcccctgcacgaatcacaagcgtacccttcacaccattttgaatggccttttgtatttcagcagtcgttacttgagcgactgtctttttcaagccattttgctccactccggtcactacagacctgacttgcaccacatttgtaccagacaggctgcttccattgggttcaccactggcggtctgaccctgcccttttaccgttccattcgcgttaccgctactgccatttccagcgttggcgtttccctcgttatcctgctgatcctcctcatcatcgtcatttcggccactcccactatctgttggtggttcttccgctttgcgcggcacatctatttgtgcaaccaacggatcatgatcgctgacccgcccgtccgccgcactaaagtctgcattcatatgaacgatatccagcacggatgttttgctcagtgacgggctgaccagcatatgatccaatgtttgcgagttaccttcataaatataggagtaccgttccttttcatccaaatggtcaatcagattggtcaattcctgcccccgtagcaaagccagcgtttccgaaaattgaaaatcattcaggtcaccgagcaccaccatattggccttagggtttacttgcagtaccgactttacaaagccattcacaatcgttgcaatcttcgcacgctgtatttcgctgcttcgcacaggtggctgaattccaccaaatggcgcttgatcgccccctttggaattaaaatggttagcgaccacaatcacctgctgaccttcaaactcaaattcagcggccaacggcttgcgcgagccttcaaaggatgcattcaggggatcaatccgacccgggttgagggaaagtccctgcactccataagtgacagacgtaactgaatcccccttgggcttgtcggtcagcgtaacacgttgcggattgtacaagaagccaacacggatgttgcccccggtggcaccgccatccttattattttcagggccaatatctgtaaaattgtattccgggcctccatgagcacgaatcgcctctatgagcactcggaagctttcggaagcgtctgtggtgccatcatccttctcaccgttattatcctgcacttccagcaatcctatgatatccggatgattcaaatttacagcgatagcctgccccagctgatctatccgttttccatcaccgggatcgaagttttccacattaaaagaagctactgtcagcttacggtcatcccctatcaaacgcgtattggctggctggaggccgccaggtacaacatccggcatacgctctggcagcagcttataattgctaaagctatagctcaccacacctgtgatagaacccgcaaaacgatcgcctgttttcaacggtgtcgaaggcttcgcatcaatcagaatccgttgcgggttcagacttctttctgtcagcatgagtccgcctgcctccgttacaacctcacctgtattgggaccgttatcaattcggactggaatttcatagccataaggaccaattacagtggcatccttcaactctacacgcatgccttccaggctttcgaaaaagtccaagccatcctcctgtggatcaaacaccgtcattccgtcatgatccacaacagatgtcggcatcacacggccctgttcacctagcaaaattggagttggcaatggacggtcattggcaattaccttaaccgaagaagccacaatttctgtggttgtcaggtcgattggcttgctcgcatatgttctttccgtgtattccttcaccgaaccgctaacctttacctcatcccctacctgtgcaccgtgactaggcttgtacactaaaatggcctcggatgttttttcatcctgatccacttgagcatccaactcttggatatagaaactactccccttcaccatcgtgacaacgccttcaatatccgctactttttgtccttcatatggagaacggtgtgctgccccctgtacatcatggatgcgaagctttttaggaaaatagacatctgcgtatacacttgcccctacagttacgggtgaaggttgcacctcttttcctgcaaaagatgcaggctctgccgaagcttttccactggacaaccctgccggccctccagctgaaagcagcagtatggcactgagccatgtgatcccgaacctttttaatttcgtaggtaatattttttctatgtattcttgtttcatcaaaagatactcccctccccatttttactatgattacgcttacaaatatattcatcttttaagataccataaattagtcaatttagtaccttaattatgtaaaatgaattcttcttgccgtagcatattcagatcaaattattgtaaacttgttctaatacagaaaaaggtggcacatacactatggagcatttgcttaacgatcaggttaaaaacattcaaatcagcggcatccgcaaaatcgccaacaaagttgccgcattacccggaaccctgtcattaacgatcggacaaccggatttccctacccctgcgcatattatggaagctgcccatcgggcgattaacgaaggacgcacctcctatacacctaatccgggactgccggaattacgagaagccgcagcggcgtttgtagctcgtaaatacggcctgaattaccgtggacaggatgaggtgatcgtaacgaacggagccagtgaagcgctggatattaccttacgcacgattttgtcacccggcgatgaagtcattctgccagtgccgatctacccagggtacgagccattgatccgcttgtcaggcggcattccagtgtttgctgacacccgcaacagcggcttcaagctcacggccgaggtgctggagccttatctgaccgaacggacaaaagcagtcattctcggatatccttcgaatccaaccggacgagtaatgagtcgcgaagaactggaagcggtcgcggatttactgaaggagcgcgatctgtttatcatttcggatgaaatatacagtgaactgatttacgaaacaccccacgtgtccattgcagctttaccaggtatgcgggagcgcaccatcgtcattaacggtctgtccaaatcacattccatgacgggatggcgcattggctttacacttgcacccgctgaaattacacagcacatggtcaaagtccatcagtacaacgtaacctgtgctagctcgattagccaatatgctgccctggaagccttgactgttggtgtcgatgatgcactcccgatgcgtgaggaataccgcaagcgtcgtgattatgtacatggtaggctgacagacatgggtatcccgctggagaaacccgaaggagccttttaccttttcccttctatcgcccattttggattaagctcgatggattttaccgtgaagctgctggaagagcatggagtggctgtcgtacctggagatgccttttcttcttatggcgaaggatacattcgcttgtcctatgcttacggacaggatgtactggagcaagggttggataaaatagagaggtttgttaggggaattgtgaggagttaaggtgggagagacgctacgcagtccatttgatcttccgatcgctgttgcttctccagattcaaatggcccgcttcgctcactgcccaccttaaagtcccacgattctctaacgtgtgtgaagtatggggaaaagaagtacaatactcactgctttacacggtgaataaacaaaacaggcccttgaaccacctacacgggtggttcaagggcctgttcgttcttcctctactccctcacctgggtgtgggattcatgggtgcgtacctttaagcacggtgcagcggagggggcggaatggtgctggacaagcgaagcggtcgcctttaaattccgattttaacctttaaatattcaatcataaaaatcggaatttaacagcgatggtaagcaccatccgccaccgcagcgacctttaaagcaccaactcctaatcccaacgccactcccctactttaaatgcattttgaattgcaggaacaattcattgtaatgagcgagcatgcgcttgcctagattgttgtatacttccagcttgtctgtaatttcggacggagggtaaaaacgctcgtcaccagagatatcttcaggcaacaacttctttccatcctcgttgggtgtggagtatcctacaaattcggcattttgagcggctacatcgggctgcatcatgaaattgatgaacttatgagccgcatccacatgggtagcggtttttggaataaccatattatcaaaccacaagttggagccttcatctggcacgatgtaatcgagcttctcgttctcatccatgatttcagacgcatcaccggaccatactaccccggcagcggcttcctcgtttgccagcagcattttaatctcgtcaccgacaaccgctttgacattaggcgctaatttctccaacttcgtcaaagcctgctgcaaatgtgcctcattcgtatcgttcaaggaatagtgaaggctgttcagtgacatccctacgacttccctcgcaccgtcaaccaacagtagattattacgtagctttggattccacagaccgttccagctatgaaaatcaatgcctttcgtcagctccgggttaaacacaatcccgactgtaccccaaaaatacggcaccgagtattcattattcgggtcgaacgaaaggtttagaaaatgagaatccacatgcttcaaattcggcagcttgctgtggtccaacgggagcaacaagtgctcctgcttcattttagccaaagcatattccgagggaaccgctacatcaaacgaagttcctccctgctcgattttcgtcagcatcgcctcattggagtcaaaggtctgataaatgacagtaatccccgtctccttctgaaaccgttccagcagctcagggtcaatgtagtctccccagttgtacaccgtcagtgtgttaccaccggagtagccttgactggaattcaaccatgcggccacccccatcagcccaaacgagatgatgaaaatcaacagaaacacgcgcacaagtgacttcatctaggcacccccatttctgccgcaggctcttttttaccattacgattcgccttgcgcataataaagtagtaacccaccaccagcagcacagtaaacaggaaaatgagcgtggatagcgcattgatggacaatgaaaccccttgacgggcacgtgagtatatttccaccgataaggtcgaatagccactgcctgtcacaaaaaaggtcaccgcaaaatcatccagcgagtacgttaacgccataaagaagcccgcataaatccctggcttgataaagggtagaatcaccttggtcagcacatccattcggctggcacccaaatcacgcgcggcatcgaccagagatggactcatttcctgcaaccgcggcaagatcataatgaccgcaatcggcacactaaatgcaatatgggataataaaacggagtagaaacccagcttaatcccgaccatcgtgaacaaaatgaggaaggaagcgccaataatgacgtccgggttcacgatcaatacattattgagcgatagcagcgtatttttgactcgacggttctgcatctgatgaatagccagcgcccccatgatgccaataatcgtagccaacgcagacgacaacaaagcaatcaccaaggtgttaatgacaataatgatcaagcgagtgtctgcaaacacctctttgtaatattgaagtgtaaaaccttcaaactcatgcatcgtcccgccactgttgaaggaatagtacatcaaatacaaaataggtgcgtacaacacgagaaaaacaatcaccaaataaatattcccgaatcggtttttatttaccatgccgcaccctccgtttcgttcccgaggtgagcagcataatgatccccatcgccaaaatcaggaacacggcaactgtagagcccatcccccaatcctgagtaaccagaaaatgctgctctatcgccgtccccagtgtaatcacacggttacctgcaatcaggcgggtaatcataaacagcgacaacgctggaataaacacagccatgcaaccggatcgcacacccgcaagcgttaacgggaaaataaccctgcgaaacgcggtccacttggaggctcccaaatcacgggcagcgtccagcaatgaagggtttaacccttccagcgcgttatagatgggcaaaatcataaaaggcacaaaaatataaaccgatacaaacacaaagctggagctggtaaacaataattgctgacctcccaacccaaccatacctaataccgcattcaccgggccataggtaccaaatatcccgataaaagcatacgttttgagcagcaagttaatccaggtcggcaaaataatgagcaacagccacagctgcttatgcttggtatgtgtaagcaaatatgctgccgggtaagcaactaatagtgaaaatacagtgatcagaaatgcataccaaaacgagctgagcgtcatgctcaaataaacaggtgtcagaaactgagcatagttgttgaatgtgagatgaccatccacatcaaataacgaatagtaaaacacaagaacaactggagccgccacgaacagcacaatccataaatagtaaggcagcagatacgctgctcttgtattaccggacatgctgatccacctcttcataggcttccagacgccgatcaaattcttcttctgtttccccaaaccgcatcacatggatcgcttccgggtcaaatcgcagaccgatttcactgcccagctccgcctttttggtagaatgcacgagccactcctgacccgaatcatcatagcagcttatttcatagtgaacaccacggaacaattgggtatctaccttcacacgcagcttgccttcagcaacattcgtaatctccaagtcctctggccggatcacaatttcaatgggttcgttcggacgtaatcctccgtcgacacattcaaactgtcgaccgttaaattccacttgataatcagcaatcatccgtcctgggacaatgttggattcgccgatgaaatcagcaacaaaccgattgatcggctcatcataaatatcattaggcgtaccactctgctcaatcttacctttgttcataacaaaaatttcgtccgacatggccagtgcttcctcctgatcatgcgtaacgaaaataaaagtaattccaaggcgctgctgcatttcgcgcaaaatgtactgcatttctgtacgcagctttaaatccagtgcagacaatggttcatccaacaagagaacatcaggttcattgacgatagcccgtgcgatggctacacgctgacgctgtccaccggacatctcagaaatttcccgctcaccgtagccttccagattgacaaaagacaacgcctgtgtcaccttctcctgaatgtcctttttgttcatctttttgattcgcaggccgaaagctacattttcaaacacattcagatgcggaaatagcgcataatcctgaaaaaccgtattgacctgccgctcattggctggcacacgattaatgagttttccatttaaataaatagagccttctgtcggctctgcaaaacctgcaatcatacgcagaatcgtcgttttaccacagccggaaggccccagcagtgtataaaatttaccacgctcaatctcaaagctgacgtccgccagcactgggggatcgttgtcatattgcttggtcacccgttcaaatcggatgatggtttgctctcccataacaccctccttcaaaaaattcgacttcattccatttcattcttttcattaaacctatttattcagggcgtatcatttacccttgagacttccatgtaaaatagtctgtcagcacacgaatggctacaccaatcgcttcctccgcaggctccagcttggcatgatgcaaaccataaggcgtatcaacaccaagccagaacatcagaccgggaattcgctccagaaaatacccgaagtcttctccggtcatcgcttctccgcattcaataagctgcacatcctgccgattacggacccagttcatgaattcctcggtcacctgagcttcattgtacacttgcaaataattggagccataatgaatctcggcatgacattcaaatccagcctccacaccgcgcactagtgcttcaatccgtgatttaaccagcttcatcgtatcggctgacaacgttcggatcgtaccctccaaacgggcggtttccgcgataatattttgcttcgtgcctccgctaaccttacccacggtaatgaccgctgcatcgagtggattcacattacgggctacaaccgtctgtaattgtcccaccagctgacaagcagccactaccatatcattcgccttgtgtggatacgcagcatgcccacccatacccttcaggtcgatgaaaagctccgacgtattggcaaataaaatgcccgggcgagtcgcaattgtgccaacaggatattcgggcgcaacatgcagtgcgacaatttcatcgggtatccagtctgccagctccgtgctgtcccgcataggcaaggctccgcccggcccttcctcagccggttgaaacagcacaaccaggtcatccttaatcggatggcttgcaaagtgagtaacaattcccaatccaatcgtcatatgtaaatcgtgtccacaagcatgcatatagccgggatgggtcgaacggaaatcgtaccctgtctcttcttcaatcggcaaaccgtccatatcacaacgatatccatagcggcgttcaggagctgttccatgaatgaacactaacacgcccgtacgccatgtacgaatgtccaaccgctcctgagggagcgtttccaaataatccagcaaatattgttgtgttttgtattcctcaaaacccggttcgggaatttggtgtaaatcccttcgtatttggacaaaagaacgatagtcgaccgtactcattgctgctacgcctcctctttatagctcatcagctcttatcgggcaaaagaacaaaaggacaaaagcccggcgcagccgccgagccttgtccgttgtgcttcgtccctaagttatgctgtcagtgcatcatgcttctgacaaggaatcgttcacctttggtacattaaaaaaattttgccttcttacagaatgcgcagttctttcaaaatctcagttttagatttggtcttatcgtcaacctgtttgatcacacgtgcaggtgtacccgccactacggagtattcaggcacatcttcagttacgacagatccggctgcaacaactgcacctttaccaattcgtacgccttccaatacgactgagtttgcaccgatcaatacatcgtcttctactacaactggttgtgcagatggtggttcaatgacacccgccaggacaacgcctgcaccgatgtgacacatgttacctactttaacacgaccgcccagcacagcattcatatcaatcatcgtgccttcaccaatggtgacaccgatgttaatcactgcacccatcatgatgactgcgttgttaccgatgccaaccatatcacgaatatatgcgccgggctcaatacgagcattgatgcctttcagatcgagcataggaacagcagagttacggcggtcattttccaccacatagtcttcttctttcgcgtttgcgctatccagtacaggcttgatatcagcccaatccccaaatacaacaccactgtctccagaaataaaagcttgaacattctcgccaaaagatgcggaagccaaagctccttttacatatactttaacaggcgtctttttcttgctgtttttaatcacgttgatgacttcttgtgtattcatttcgatggacatagtaaatctaacaactccttcatcgcttcatacgacttcgtaagccggaatgatcttattctctcatcctttatagcacaaaagtgcaggtctcgcaattatagattagacccttatagctctaacctatcccttaaaataacaatttccagcggcgtaactgccttaaattcataattgtaagccgccgaccatcccgcagcaaagtagggttatttattagcttgcaggctctccagcgatgtataaatgaaggattcgaatccttcagcaggttcaccttgtggaatgttcactttcacgatgaaaccacctgttttattttctacaacaatatattgctgtgtcatcttcgaaccgctcgcttgtaagaacagacggctactggacagcgcttgaggtacggctgctttgtccagcttctgcaccttgccgatggaagctaggtccttttcgccttctttttgaagctcatccagattaaagtcggagggcagcttcgtaatttcagcataatagttatcatctacagccaaggcaacacggttttgatcgggaaacagggacatcggatcaaacacatacagtgaatatccctctccttttgccaatgttgctgtctgcttttcctttttcccttcaagggtaagctcaaaagtttgagttttcgagcgttctccgcctactgcttgaccagaacttccgttttgattgccatctgttgcagcttctgttttttgtattttcgttaaagtcagttgcttcgccgtcgcgtcgccctctactgctttttcgttgtattcaaacgctactgtatcgccttccttaagccctgctattaccgtgtccagtccgtctcccagttggaaggattgggcttcgccattggtttcaatctctaccgtatgtgggtcagcagctccattgtatacacctgtgccttttttaacttccggctcagcgattggctccggtttaacttgcggctgctgttgcgtttgcggttggtctgacccttgaggtgcggtgttattggtttgcggtttcgttccacaggctgacagagccagcactgccactacagtcagtagtatgattgaaaatgtgttttgttttttcataaaatccacctccactatgatagacgagcttgtgcaacaaaagttctacgcagcatctcacttaaaatcctaactcctgctcccgtttattatattctcaggattttgcaaaatcctaataccacgggaatgtcaggtacggtataatgggctgtattaaacccaattttcgagataccgcttggaaggaacataaacgtatttattttcctccatacggatggagctgccacatgaatcaagcacacaaaccgtcgttttcctttgaattattgtacatcataggtattatcgctatttcgttctcctcgatcttcgtaagatggtctgaagccgaggtgtccgtcatcgctatgtaccgtttgtacctaaccaatctgatcatgctgcctttggtctggaaataccgcaccgagctgtttagcctgacccgcaagcagtggatgctgatcctctggtccggtatagcgctggggctgcatttcttgctctggatgggctcactgcgactgaccaccgttgcaagctctaccgttattatgacattggagccgatccttgtcatgctcggttcttttttgtttttccggacgggcacgaatcgcgctatgctcatcggaatgggtatggcttttatcggctcactggccatcggagctggagactttcatgtctcgggacaagccctgctcggggacgcactgtccttcttgggtatggtagccgtgtccatccatatgctgatgggtaagcatctacgcgagcatttgagcgcgtttgtctataatttttgggttttcgccatcgcagccacatcacttgcgctgtataatatggtcaatgccattccttttaccggatacgctccacgggaatggggactgttcctgctgcttgccattgtgcctacgctgttcggacattacctgtttaactggctgctcaaatacattaacgccactgcggtgtcgatggcggtactcggcgaacctgttatttcttccctgctagcttgggtgctgctcggtgaaaggctgtctgccttacaatttggtgcaggcttttttatcctattcggggtatggatttttatccgatacggagcggattttaaaaagaaagtcatccatcaaagtgagttgcccgacactgagcaccccctgaaggccagctcttaacttatttaccccattttcataaaccatactcaatggattaaatttactgttaaataaaggaaggcggaatcctctatgaaatccatcgtatccaaacgctggctgctggcccgattgtatgagccggacatgatcattgccgactgccgttccctgctcggacaagccggggctggacggactcaatttaatgaagaccatattccaggggcggttcacttcgatttggaagaagaccttactgctcctcttggtgagcatggtggtcgccatccattacctgatgtggatacacttgccgcacgtctgagtcgtgtcggaatcaacgcatcttcacgcatcgtcgcttatgatgaccaaggcggtatgatggcttcccgcttctggtggctcctgcgctatctcgggcatgagcaggtatatgtgctggaagaaggctacagcgcttggaaagaagcgaagttccccgttacgtcagaccagccgattcgcattccaagtacattcacaccgaatgtacaaccgcaaatgctcacaagtatgcaagaggtgcaaagtgtatccaaagattcgcttcctgatgcctcttacatattgattgattcgagagagcggcctcgctacctggggctggaggagcccatagatcaagcagcggggcatatcccaggtgcggtgaatttcttttggaaagaagtattggacgaacaaggcagctttaaaaatgcggaacaattgcagcagcactttgccgaccttgatccaaacgcagaaattatcgtgtattgcggttccggcgtatccgcctgtcccaatgtactggccttgaatgaagctggatttagtaaggtccgtttatatccgggaagctggagcgactggatcagttatgaggagaatccggtggcgaccggagaggaataaaaagttttcaacggatatacagggttaaagacaaatacactgtcctagcgattaggcttacggcagtgtatttgctttgttcaaaaaaacaacttgagctgagtgaagcaataaaacgatgtagttgaagttgcttgcttttttgaatagctatccaatcttttgaacaaatatatatcttaattcatattttttctgttgtttttctgcatatatcagagtttctcttatggaacccgtttctaatatattcaaatcattaaaatgttcttttaaatcttcttcagtaaagaagtgagcatatttccctttcttgtaacatatgttccttcttcaatttccctacccacaccattattaaaatcacaatcagaaaaacatgtgaaatacattactcccaattccttcaaatgcttcacgcaattctgtatcagtttttttcgatcttctaacaaaaataaatgcaataaatcataacaatatattccatcatacctttggcatgtactaaactctaataccgattcttgaataaaattcgtttttaagtcccattcttttgctagatttatagctgaactagatatctcaattccatcaacctgaaaataagaagagaacgccttcgtatttcttccatatccagcaccaggaaccaaaatatcatgtacatgattctgtttaaacaaatctatagcttgggttacagtttgacttggttcacaaccccaaatcatcccttcttcagtaaatcttttgttccaataatcccccatatgattcacccgcctatatactcacatagctcttcttttaagctcatcaatctgtctgatatgatgttgatcatgccagataaaatctcttaaatatgatattacagtaaagttcccgtcagcatattctttagtaaacttatcgtcttcaaaactctctatactctccaatatcatgttacggtactgaatagtcattttaattaattcttctttcgtttttgtttttccatattcaatagcatcctgattaaattgttcaaaatccatatgtgttaatgtcaaaggtgtattgtttaatatgggacttattgctgcttcaaaaaagtatttatcccacagcagtatatgacttacgatatcctgaactgaccatttaccttcagcaatcgttatttgccaatccatttcacgaatctcagaaacaaaacgaatccattccttgaactcctctagtaaccgcgacttctcattcatggtttcacgctccttttttcaaatttcatttatctaggacaacgtttctgactcatggaccccaaaggggttgtctgctgaaaatcccttttcgagactccttctcgcagacctaggctccgtcaggaggcgcagttgaatattaagtatctatattcatgcccccgaaaggattaaggtgcttcagcaccgagtcgaatacttagccttgcaaggttgatcgcccgatccccttcccagctcatacctccggacgacccaagggcgataggctcgcagcgtgaatactgtgatatctacttacgtcgcttttttgaataactaattcctaatagctaaaatctaaatacttacaaaatgtatttctttaaaatatctagttcgtctttcaaattagtttctattttttcaatccaatcatttggatttctaattttagttggaaagctgctcttattctcaagataatatttcaattgaagataactactaatcggaaaatcttgagcataccattgttttctatatcctaaaattccatgatcctttagtaatacttccattgattgtacaacctctgatatgaattcattaaagttacattcttcactgaactctaatttccctgggtgtgtctttatcccatcttcatagacagttatattaacttgcaccttttcttgtgatttctttacaattttccagttatgtatagctggttccgaatcccaatcaaagtgaacaatacttttaacttcatccgcaggtgtacattcaggcaacaacacttcaattgctcttactaagtcaattaatggctcagagagatagcttggagaaatataaatttccgaattttcaattcgaagatgtacatctgcccaaccaatattacttagtgtataagtaaatttcatgtatattctccttttcaatattaccgttatttcggctaacgtttgtgtattcacgaacatgcgaaccttaaggctcttgtagaagctatccgctacgtggttaagttctcagacggtccactgaattcgcttcttgggtcgcatctagtggattaaggaagcgaaagcggccacagtgtgaattacgatgttaggtggaatgcactgaaatactcacataattaattcaattttccctttagggctctactcgaactaatacctcttccatagtcatttctggagttataattatcgttttgtttaggttccgacttaaatcttttaggaagttcatgagtacatctatttttttctctgagtctatctgtattggtgaaatatcaaattcaataacgctcccttcataaaaatgcccacaaatatcaatttcactatattcaatagttatcccaatacttgcttctttttttattcttaacaattcagcaatatccctaattctagttattagcccatctatagtcactcgataattaattctattactttccaaatgatcaaaaattagagcccatacttggatgtctgtatccaatatataaatatcccttagacttccatctttaaagaatacttcattcattagtacataataattcatgcaaacctcctaacactccgtatttcacctaacgttcttatatctacaagccctcactatctattagcttctaatcttcattcattctatctgctcgtatccagctcatttcctcaatgtttaataattctttaaactcttctactaactgatgctcagattccagttgtgtatagtaattattattcaaaatatcatctaattgttttattcgctcattatctagttcaaaaaatctaaatgtttttagattgcaatttgtaaactgttttgctattttctcattgtattcattagatctcagaacttcttcaattaattcagttctgattttgtcccctctagggtcgacatataaaaattcaatgtgatcttcctctggatatctttcttctgcaagcttaataattgaagtatctaataacacgtatgatatatgaagacttgctatctcttgtgaattgtaaactacacggtatccccaacagtgatcttcaaaattataaaaatataacactgggattttttctgaaatttgaaatagactttctggaatttcttcactttcttctgtatctttggttacgaaaacaaaccatttgtcatttaaatcctccgcgtatataggatcatgctcaagaattgcttctttatatttcaatagtgataagcatcctgaagtcaattcactcattgttttgcccctttttgtttctttagtcatatttcagctaacgttcttttattcatgaacccctaaggggttgtctgctgaaattcctctccgaaatccacctcgcagacccagactccgtaaggagccgctgcttgaatatgatgttagacgatacccttgatctcttttgagttccttaaaataatccctattactactgtattttaacttctcaaatcgacaaccatcgtaattgatgaatcaactttcccaacttctttaaatccgaatctctcgtagagcttcattgccgctgcattgctcggatcaacactgagggataatttttttatattccttttcctagcttctttaaataattcatccattaaggccattccgatttttcttcccctgtattcttttaacaaagccattcctagttcgggtacatcattatcaataaatccaaatcccttattatcctcgttaaaatatcgaactgttattgatccgacgggttcaccctcatggttcattgctataaatccaaaatccccatctcttccccaaccttcaatatactttgatatataagggtcttttattatcgctttatcgaatggctcttgaccttctgggacaaataatgattcatataacatctcccataaaaaaaacacatcatcttttattattggtcggattctgtattgcatcattgaagttacctcatttctagattctcaaaggtttcacataacgtttctatattttccataagagccgtagcttgaatattatgttatgcaattcctccatcctctccaaatcaacattccaaagcttggcttgcttctgttaattcatcatttgcctctaaatattttaatgttttttcaatatcgtcgtggtccattgttttcgttataataagatgtttaatattaaatcctggtggttccatttcttttttaaagtgatttactaatttttgaggggttgtcaccaaactccatcgttcacttccatccgaaaaagtaagggtcacctccaccaaatcaaactcctttggatcatcatcaaacttccatctttctaaaaaaggcacttctatatttccttcaataaaatgagcttttgatatccaaactgcttttccatggtttccaataattctatacttgtccccatcttctttttttacgatgtatttattgccccttgtaagtgcatgagcataaacgcctatacttatacaagttatgattggtccctccatcaattcacttccataccgtatttaatgtccttcgcaatttctcataacctttccgcattcatgaaccccaaaggggttgtctgctgaaacacctccccaaaatcctcctcgtagaccaaggctgtagcggagccgctgtttgaatatgatgttatatgacggtactttggactactttcaaaatacattatttctttaagtattttcccatgttctttttcgactgatttttataatccttgtttgtcatctatgaagcatctccttgagagttattcatcatactgtcatataacgtcatgtattcacgagccttcctgcctcaaccaaccgaaaggagcggctgcgacgcagttaggcagtaaagggttatccggctgaatatactctcctgctaatgaatctacttcttcgaaaccgctactttaaacttcggtccggaccaagaagtcatagccacacagcgttgaatatgttgttataggatagggacgcctactgatatacttactaatattcttcaaatttatattttattaatttatttatttcaattacttgttctttattaaaatagcccattaggcaaccttgatctaaaattgaaatatacaatttcatggattgttcagtctttattagttcgttaaatttcttgaatatctccatatccaaccaatcatcatctactttcatttcccatctgataagttcattcatatattcaaaagagacccatgcagtaccattctgaatatctacgtaatccgttatattatttaaattaagttttgtcatattctctaatcgtattattattcttgcatagtctccatggtcctcaatacattcagtatctaaataccaaatttcctcagatacatttataaattcaccattcacttcaacttctccacctaaagtaagtagtagcaagttgtagggatcttcttcatattcatttctcgaaaattcttccaaaagtaattctttctttgattctgcactcatgaagatgcccaattcagaaagtttgtttagttgatcttcaaatattattttcttcttcttaaataaaccaaacaacttaaacaccttctttttatggtttgcgtcccttttctataacgcttgtattcatgagctccgtcaggggttgtctgcaaaaaccctcttcgaaatccaaccagacctaggctccattggagacgcagcttgaatattatgttgtcagatgtcagtacctgccttgatttactcaacgtcaatttttgtttaaatcctttgtcagtattatttccagaggttcattctcaagcattaaacatccagcatctctatatccaagctttctataaaaatgttgggctccttcatttgaaagtgttgaggtcatgaccatttcaaatcctttttgtttcattaattcttcccaatagtggacaacttttttaccaatacctgttcctctatactcctcatctatccatatcatattcataaatggtgtgttgtcccaaaaaaatccatatctcatccaacctatttcttgattggattctctaattattagaatttcattttcttttatttttggtcttatcagtgtcttatgtatgtgcttgtctcttaacgagatatactcataatctgattcaatcgcaaaatcaatcttcattgtaaatcctcccttcactcttctcattaaatatcttcttggtaacacttagcactgatgtctcataacgtttgtacattacataagtttataaagtctttttaaaaatgtataagtcaccttcttctctaactttagtaaacccacactttgaatagaagtgatgattcttcacactccagctaggagtatccagccaccattcagtgctgtctggaaatttactttcaattttctccatcaccttcgttccgattccttgatttttaaaatttggatcaataaagattcttcctagattatgcacttgattacattctacgaatatcattgctcccccgattatttttccattaaagagtaccttgaaatattcgcaattttgcatcatctcttcttgccaacttatggagtcatatcctattggcccaacgatttcgttgttattaaaatgctttgattcatcctcaaaactggccttttgtatttcagcaagtttttgtgcatcattttctctagctttttctagtgtcagcacccaacatacctccattgtctttttattttttctggggttgtctgctgaaatccctcctccaactccatcccaacaggccaaagctccgtgaggattcttatgcttgaatattatgttatcagaagttaccgaacttcttcactatgcattcaaaatcaatctgcaaatttttttatcagcgaattttctaatatggtcttttttcattttgtagtttaattattagttcatatgcatctctttcacttttctgagcttttaatgactcttcttctgttatttctatttctatcatttgaaccactattccaccagcatcaaaataatgaatattctcccatctcttcgaattatattaatccaataattggcaaagagtatatccataaaatgacctccagatctttcgcgttctttatactatagtttttagtacttttgagatctaattattatgtttttagtaattcaagaatttctgataacgtttgtgtataaagcctctaaattagaggctcctatggacgatgttcgttcgtgtccctcgacaccacagttcagcaaattccaaaattgttcaaccatgaccgatgccggatatggcatcgaacgggtaatccaccattccaatacccccactgccgctgaaattaaaaattgcaccgtaatgtccctgttcatttcctgatcgaggttgatcgaatccagatgctcgctcagactttgccgaaacatggtctccatttggttccgaaaaaccgtacttcccttgtttgttagcattctagagtagaatgaagcatgctgctccaaatattcaaacgtgcgcagtagtgcggttttggaagggagatgaaagaaattatcttcagacatacaattgcgcagtaactcgttaatttgagcttccatgcattgatcgcgtagatcgtacttgtcagcgaaatgcaaataaaccgttccgcgattgacattcgcttcctccgcaacttgattgatcgtgattctctcgaattccttttctgacatcagcctcataaaagcatcaataatggcttgcctcgatttttgaatacgcctgtccatatccttctcccctttgtaccatccgaaaaaatgaacacttcgaagtcctctgttgaagaatcaacaaccacgcttgttttaaccattgaaccccatataccgctctgatacattcactttataaaatttatgttgatgattcaacatatgttcaattttagaggagccatactcatgaaagctattgttttacaatgtttggataatttaatttacattgaattaggagggtttaaaaattgaaacttacaggaaacacgatttttattacaggcggcggttcgggaattggacgtgcgttagcagaagctctccacaatcttggaaacaaagttattatctccggtcgacgtaaagagcgtctggaggagacgatcaaagcgaatcccggcatgtccgcagtggaattgaatgtacaagatcctgccagcataaaggcggtcgccaagcagttaatcgaagaatacccggatgttaatgtcttggttaacaacgccggcatcatacagtccgatgacgcggcgggcgtgatcgatgaggatgttttgatttcgactgtcactacaaacttgctaggtcccattcggttgacttctgcattcatcgagtatttgaagtccaaagaggaagcggttgtcatcaacacgacttcaatacttggatttgcaccattagcgacaactgctgtatactccgcgacgaaagcagcacttcatacctatacgctgtctcaaaggtacatgcttaaagacacatcggtaaaagtaatagaaattgtgcccccatgggttcaaagcaacaacgatgaaccgcgtgcgatgccacttgattcattcattgatgcaacaataaagatacttggcacggatacagacgaagttctggtggaagaagcgaaaatgtttcgaaataaccctggcccgaacgaaggtgtttttgtgacccagcttaacgataggatgaattctgaacctccaaagatccattgatccatctgtaattcagtttttaaaatttaagcgaacatgaagtagacactcagctccgtctacttcatgttcattttattgcaacttgcacgtggagtaagaaaaagtgccaagcggtcacacccatgtttacctcttaaataatttcgttgatttcacataacgttgggcattcctgaagttcaagcagtttaaggtgaccattgggaatactcgtcagacttaacaggtcgaatgtgtccggtgaatccgctcctccgaaacgcctcttccgggccaagggttgggcttgtcccgaccgctgcgttgaatgcgatgttagatgatgtgtcacccacttcttagagttgcattgaaagtaattattattcttgtttccatttatgtgtttcgagtagttttccagtttcataataatactttattacttcaagcataggaattaattctatacaaatgttatcgcaataattgcctaactgaccaccagcaaccagaagaatttctctgttcccctgtttatcgttcataagagtatatatattaccatcaattgtaatagacactatgaaatattccggtccgcctccaactaatgctgaatctgtgtctgatacctcaaaaaagactaatgtaaatttatctccatcgagttttcttaaaaatcttaaagtgtctccccatgtaggattcataactatttcttcattgaatgtggtcccattccattcatcaacactaatagattttatcattttttctttgcatcctttttagatggttttatttatttgggtgctttcatctaacgttcctgtatctatgacgtgacctgaccctagatagcttactttaggtcaggtcgtgtgttatctgaatatgattctgtgcttgacacctaataacttactagtacttcattcaaagtgtcaaatccctagatgtaatattattaagtcgtcattatcttcaactagattacataaggtaattagttcagagagaatttttaataaattagcttttcttacttcaattttttcatattcacctttatcgatttggtctctccaaaaataattccctgttaactttatttcatttggagcatttttaaatatctcataccaacctgtaataattttttttagtacactcgctccatttggataaatatctgttaacccatagtaattcaacccgaatctatttccagtttcatttggtatccactttaatgtatctgaaaaatactgaaagaattcatcatctaattcaactaaataatcgatacctgatttacttttattaattctcccattgttattcctaacaatttgatttaattcaaagccaattttaggagctataagaaactcatgaattaatggcattctattcacctgttttcttaaatgctagtctttcagaaaacgtttccgtattcatgaagcccgaaagggttgtctgctaaaatccctcttcgaaaatccttctcgcagacaaggctccaaaggagccgctgcttgaatattatattatgcgatggaattgcttcttcgattaaccaacgtgcattcttgattctaatctgttactgtcctgctatatgttccaataaatctcctggctgacaccctaaagccgcacataatttgtcaatcacttctaatgatacatattcgttcgtattgagcttcgccattgtagcagacgaaatacctgtcattttcaataaatcctgcttcttaatctccctgtcgatcaataatttttgaaatggtttataactaatcatctgatattcctttcacacatcaagtgaatttttctttaattatatgaaagtatattttctttatcaaaaacatcttcaacatgtattgacttaattatttgatatgataaaattatgtttaataagttgaacttttattcataaaatcaaatacattggaaggtgtttaaaatgcataattctttagaagtcttacttgattcactgatttatactcgaattgaatctttatatggcgagcttatcaaaaacaactccagctacaaccaattttcatccgaacggaatctctacttcaagcagttacatgaaggagtaccggagaatatacagaagaccctattcctttacgacgatgctgagctttctgtacaagctattttagaacgtgaaatttatttgcaaggttttaaggacgctcttcatctgcataacgaattacatatatctttagaatgagagccttctggctctttttcattttgattcagtcgtataacgtatgtacattcctgacgttggtttcccttagatagctctttcttagggaaatcaacgtcagctggatcctctccttgaaatgcctccggcgaccaaggggcgaatgccccgcagtaggaatatgatgttaggcaatgcagacagttatacccgaaaaattcctgacttcagtcttacgatctcatagttattagatcttatatattcccataccggttctctaaattctttataagaacttattactttactcttcggatctatagtacatattcgttgatttcccatatcacagacgtaaagaagttcatcgtaaaagtatatactttcaggtaagttaaataaggttccttcaatgtctcctatagaatacaattctttgtatgttttaaggttataacactttattgtattccttgttgggtaaacaacccaaatcagatcctcagaaacagcaaaaccatagactgtatcaaacatatcttgatggataaattctagatttccgttactatcaaacttatgaatgtctgattgttggaagtttgatacatagacggagccatctaatgacctgcatgaatcagttatattgtcctgaaagtaattcataatttcaacatagtatggaccgtacttatgacaaaagtattcttgtttagaaatagtatcaacctgtgaattggaccacttagcataaccaagctcttcacctttttcatccattaggtgaaaataaacctcttcttcatcctcgaatattccccagcctcttctatgtattaactgcattatgttccttcttccttaagctcagtttcgcctaacgttcctgtattcatgaaccccgaagggggtgtctgctgaaattcctctccgaatccatcccacagacccaggctccaaaggagccgcagcttgaatattatgttatgcgttgttactgccatctttgaactccttacaattatcctctctcttatatgtctttccattcctctcttcttattaggttttcgatttgggatgcatggtgtttgttgtgccaaataaatctttgtatagctgtctctaatgtaattattcctaatacttcagtttgtatagtccgtttatagtcttctatactaagttcattcagcaacaccaaaaagcgatgatgcaatacttcaataagtgatagcgaattctctacgggcaacttcttgtaatcaattaattctccccacagatcttctctatatgtatttgctaatggattattttcagttaatcctcttttaaatctcaggtacgcattcatatcattatcagctaagtgatgtatgacctgccttactgtccaaccattcggccgatacggagtctccaattggtattgttcaagaccaatcagcaatgtatttaatcgcttagttagttcaggaatttgtttaataagatttattattcatcatttgaaagattgtttttgggttgaaattgaccaatcggatatttgatttgatccattgtatttctcctttctgctttagaattgcaataattacgcataacgtttctgtattcatgagccccaatagggttgtctgctgaaatgcctcttcgaaatccatcccgcagaccaaggctccaacggagccgcagcttgaatattatgttatacgacggaatcgcttctcgactctgccctcactattgattttctccaggtacatattcaatcagatcatataatttgcagttaaatgtaccccataactttatttataagctattttcatggtctatatccaattctagcccaatgatgccttagatatttaatatttattggtattttagaatctttaatagcttgaccattagattctattatctgatttattggactatgataataagatagtctttcaatatctatagaaacagataagttatcatctaaagtaaataagccaatttcaaatgctttatcatgaaataagcaaaggcacaatccattggatgtatctcctcttgattctgaattatcagaccatctagcaatatgagctccaatcagaaaactgctatcagcaacttcacaatttggaaaacaacaaatatgattaaaattatcgcgaacatttttagaaaaattactttgccctattctaataggcagagtttttttactttcatatgtattggactgatcaattaccaacctttctctaacagtagtattaatactactgttactaaataaaatgttgtataattctgaatccacttcagatagatatgccccattttgtctacgtaaatttccgttttgaattacataaaataaaagtttcttttcgtctgaactcttagctttatttacattgaaataatacatcaattgattttctttttgagtaaaaagtgtacttaattcgattgtctgatcaaatggttcaaatttttttaaatttactctataaaaagtatcagcgtaactccaatttggtccaggatcaggtggtcttagtgttgtgataaagccatctgtttcagcaattgaatgtccgatgaatttagaatttgagtctcctcttaaatgtaagataatgtccccttcttttacacgcattaaactatcccaatatgcccatatacgtctggtatcacctactattttatatgctggtgaccaaaggcattttgtaaatccccattctcctcccccatgtacttcgtcctttgacatctctatccaaatcatatccctagctcctttatgaaatattctcaggttgtaattcatgcgccctcgctagctttaggtgaaaaaattaacgtaatacatgcagtcaacaaaccgtacatctgctttgctctgcttctccaaaccagagcactcaaaactttgatgtacaataaaattactcggttctttcggataacgtttctgcattcatgtacccaatggagttgtctactgaaatacctctcaaaatcctaattcgcagaccaaggctccaaaggagccgcagcttgaatattatgttatacgatggaatcacttctcgaatctgccttcacctattggttttctttgggtacatactcaattaaatctgataatttgcagttaaatgtatcgcatagcttaaggtttctagctttgttgtttctatattcgttctcctatacaacttgttgattgaattccgacttaagcccgatttcgccatcaattctgttatatcatctattcgatgttctgccatgagttctcgtatattgcacttgattacgttcatcttttcccctccataattctatcttatcttccatattagcaatcatcaacgaaaagcgaagttttaactctataaagtcaaatattcaccttgcaattatctttataaggttatataatgactctatagagttaatcagaggaggaataacatatgattaatacattagaatcattaacagagccgcttataagaatacgtttagaattactctatactgagcttctggagtgtcataaggagtacactcagatttcttcggagacagatcaatattttaaaacgcttcatgatgctttgcccgatcaacttcaacatacggtttttctttacgaagacgcccaaatttctcagccgccaggctccgatgcgtgaatatgatgttataggatgtcagcgtctcctttgaaatactcagattatactaatgtgaaatcatcaattatttcaacaacttcaatttttccattaatcagaagctcaggaagttcgttttttacattccccttccaatattctctagcctgttcgattttttttaaaaatgatgctccgtctacctttggtaataggttcccatcaccttcaaaataactccctgttactcgtagcttaacaatctgcaaaacctttcgattaaaagaatcaaatatctccttccatttcaaagcatcctcataacttctcgcagcatataagcaagacaatctagaaggataatccggatattcttgtaatctcaccatttctactattacttctctaacagatctgatcgtttgtcctgcatacttcatcgttgctgcagcgttctctttatccagcttcaatccttcatttgaataatgatcatgtaaaatcttaaaaatatcttcaccgttattatttgtatatgtcttctcaaaaaagaaatgatacaggttgttcttctggtttttgtcaaaattgataatctgtccaggactcatttctttcctagtcacaatatgataaacaagcatttcgttctcattcatagtctacctccgtttgaccattaacgtaaaaaaacaattcaataagtaactaacaatattgattttgatatttaatttttacgctgatttcctataacgtttttccctattcacgaactccgccaggagttgtctccaacggcagaccaaggaatgtagtgacgctacgtgaataggatgttataaggagtcgacggcttcattgaaatactttcattttagatgacctttgaatcatcatgttgtcttgaaaaccatcgtattacttgatcagcaactatttttaaacaagttgagaattgtttcatttcatcttttggacactcgtatcccttatttttgtaattagtttttgcatgagcgatcatatttcttgtatctgaaattgcatttgataactctagtaatgattgcttcttttcttctcttgtgctttgtatattcattttgttgatatttttcaaatatcttggtgcatgctcttttagttctaccacatcacaacatacttcaattgtgattctaatagcttctttgtctttcctataattccccagatcatcaaacaacttctctaattcgagcacataatttgcatcaggactcaatgtttttgggctatatagtttcgtcattactgattctaataattctcttctaaccaccgtttgagaaacatactctataacttttgtatacataagaaccaaaatttctggatcttcaatactggcgcatgcattataaatttgataaagttccttatttccctttccagcaactaaaggacggagcctaacattctcttcgccttcttgtaattcatactccaattcataatatacaggtcttggagaaacaaataatttaatattcaatgacgaactcaactcaaacatatacgcttgaattaagtcatcaattaatgcttcattaatttgtatttctgatgttacctcaatgaaaagatcttcgtaaagtactggtgggaaatatttatcgtagttattcataacggtaactacaactgcaaagtttgtttgttcatcaatcaaattaaaataaaaggtttgattattaatgataagagaggtactaaacactccatctactttttcttcaagagcaactatcttttctctatttagtgagtccacccttagcaaaattcgcttgggactcatatagatatagtcattatcaatccttgacattcttacttctttaattgtctcaaatacctcacccaaagtttttactggataatcgtcacagtagggtaatccaaaattgatctctgagtccaaatcaataacaacatcttcgtcgtaatcttcagaactttctatatcaaaaaagtcaaagtcaatacgaaatttcttgaaataagataataattcatgggtctttgtttttgtttcatcgtcaataaaacgtaacatcctgtcctcctaatgtgttattttataattattcatgccgatttcttataacgttcctgtattcacgacctcagcgaatgctgaggtgtccggctcctgccggacccagggcgtatgcccgcagcgtgaatattatgttacatgaagtatctacatcactgaaatactcgagttattctaaaatctttactaatctttcaaagctttctttaataatgccaaaatgttcttcaacatttctttgataaaccttttctcttttttccttaatatcatcagtaaaatgaatttcaatattacatttatgctcctcaaagtaatcactggtattaacaacaggaagaggtataaatagatccccttttttatcaaatatcactcctttcactttaaacaaactcaatagctgtcttaaattaaaatcattagttaaaaaaaacggaatgaaaaaacgaccttctccccctcgcttaagaaaatactccataatacgtgggactgaaaaatcccaggctatattttcgatctggcgaaataatttttcagtcttcatacctttattaaatttattgagcatattaacgttttttgaattcataaaatacttgtgtgctacaataaattctctttcataataaattcccagctcatcattgataaacttaaataaattgtctattttttttggaacacctgctttattttcgaatttattaatcaagataccaatgagtaataggatcatgcactgatgaagattcttaaatatactcatcattccttcaatgctactggcattaaatgttccattaaaaatttgatcggcaagaagaaaagcctctgtttcagtaattgtataagagatgatgcctttctctatatacttttgttgatcaatacttttaaaaagctctagactaaccaaattcctatacaactttgctcttttatcttttctgatagattcatcttctaccccttctaatttgaaggagtttttataattttcaatcatataaaataaatagtcgtaattgtaccctccccggataagtacatctataacttgaaatacctcgttattcattgttgaccattcattatttctgacaaaattatcaatgtaactggcatagttagtatctaacattattgaataatctactttgaatgttgtatcagcactcccattcataatcatttccctgtttaattcattctctatgaagtacaatttatcagttgaaaaataaggaatgaaatggctattctcagattcaataagtttttttatgccatttggataaccacttctgtgataattatctagcgaaacgatagcacttgtatcattagaattccccataattgcccaagcttcaaacagctctttcggctcggtcgcttgagaaagtacatacaaaccttctttaaaatttttactagtcctaaccataaaggttccctccaaactaaaataggtgcctaaatattctttatagatatttcatgtaacgttcttgtattcacgaatccgaggggtttaagggcgtttgcgcccgggtcgtagacttagcctcgcaggattgtctatctgagttcacttccttgtattagctactggcagaccaagggccgtatggcccgctgcttaaatacggtgttatacgccgtgtttctattcgtcgatatacccttcaattgtctctttagatcttctaacttttccacttgttctatcgaattgaatagagataatatcgtctttaactatatcatctatcatttcaacaataattccattccataatctatatgataaagatgtttatctttatcaaaatcagaatttataaatactccactatactccattccattttcttcatcaaacgttggaaagaaaataaaactatgtataaatgaattgcacatttgtttaattgtaagtgaactgtttaaacaattcattaaatcgtagaattcaccgtaatcaataagatttagcaaatctatttttttctcattttgtattctttgatattttccacacttgtaatttttagaaagtaattcatcacttaactttccattttcaacaagttttctaataataaaactgcaaagaaaatgaaacttctcaagccccattacaaagtgttcagtatcatattttgagaattttatttgtttgagatattttttgaaatttctcaattccttaattaattccgctttccaaatgtgggagttccaaatcatctcacaatctcctttattaattctttagaaacatggcgtataacgtttctgtattcatgaaccccgaaggggttgtctgctgaaattcctccccgaaatccatccgcagaccaaggctccgaaggagcccgctgcttgaatattatgttatacgacggattcagtgccctcactattgattatctccaggtagatattcaatcaaatcagataatttacagttaaatgtatcgcaaagcttgaataaagtctccagctttgttgtttctatattcgtttccctatatagcttattaattgaattccgactcaatcccgatttcgccatcaattctgttatatcatctattcgatgttctgccatgagttcccttatattacacttgattacggtcatcttttcccctccataattctatcttatctcccatatcaataatcatcaacgaaaagcaaagatttaactctacaaagtcaaatattcaccttgaaattaaccctataaggttatataataactttatggagttaattaaaggaggaagaacatatgattaatacattagaatcattgacagagccacttataagaatacgtttagaattactctttgctgagcttctggagtatcatacggagtacaatcagctttcttcggaaacagatcgatactttagaacacttcgtgaagcgttacccgatcaacttcaacatacggtttttctgtacgaagatgctcaaatatctctccaatccatcttagaaagaagcatctacatacaaggtttcaaagacgctctacaactctttagtgaattgaaaaattctaacatttagaggatcatatgatcctctttcctattgtttttgattctgtcgtataacgttcctgtattcacgacccagcatatgctgggtgtccggcgtatgccggacccaggacgaatgtctaaagcgtgaatatattgttataagaattcactattataatcaaatatattataaagactttaatattattaaatcacggagttgtatttcaaaagcttcatcaagttatctcccataagtgtgtgtattgtccaatttagatttgcagttgcacgtttgatcgcattgtaaaatggttctgttccttcgcaaggagaaacaaacactaccacagctttattaccaaaattagcaaatggtctatacacttgatatgttacatcctcagttactttctttttaatctcttgtccagatttaaaaggcatacaaagataattaactttattggtcccaacttttttaataggcaattccatatctgatatctcgtacacaccatgaggcttaactttttctctatctacaattgatttatctatatttataattatttgagcaactgcttctcgaagttcttcgtcgttataatttaaaattttttgtttatcctcttcagtcaattcggttgcattatgtttaccatagtccttgaaataattatccatagtaaaccattcgttaatctcgtattcttcgacaacaggaattcttaggttcgttaattcaacattattttcgtgtttgagaatagcactacaatttctaaggactataactttttcaataaacttaaaatcactatatttatctataagaacattccagaagtcatctgggaatttatccttgaagtactcgaagtcaacgtttataagactaaagtatccccatatttttttaacaatagattttatatcttctaaattgttcacctcttttcgaataaagtttatttcttttttactataatcttcgcaatactttattgttgatattaagaacaagttcaactgagggttgctatctaattgaactgccattccttctttttctacaaaccttttaacaatattcaagcatttgaccgctaagtcagttgctttatctctatataatttcggctctgttttaagatattccaccatagcttgcaaataattaagaaccgtatagaaagcaggtacaagtatatccatttcattgttatgatcaagtaagttattcattccacgtactaatccagagtctcctcttgtaaaaaaatactcatcttctgagcttccatgtaccataccttccctcatctgaagtctcattatattaatatcaatatttacgttataggttgcacgtccaactgaatctgatgttgctttataaaactcttgtggcaatttataaagactataaaaataaaatattttatcaagaatataaacttgattagctattttttttaaaaatcttgttaataaaacttgattttctgcacttaaagtaaagttttcttgtatatcttctaataaaaatgcaagttcacaaagttcttttatctgagccttatttggctccatttttaatgatttttcacataaaaatagctgatcatttaaactcgtttctaaaaattctttcataaagacacctctttcaattcatttagtgaatcatctgttgaaattttaaaaatataagaatattccttttgagaaagacaaatagcatcaacttttatttctacattctctcctaagctcttaagtaagattctttttcttgtaacaatatctaaatcaataaaatcatctgatactactaaaatatcaaaatcagaatattgattttgtagattaaatgcataagaacctctaataaaaagtttctcacaattaaaataagtatggctactcagttttctaattattgactcttcaatactcatatttatttcactccataaaactactattatttatttttttgatttcacagtaatttcttataacgttcccgtattcacgacgcctggcggctgccaggtgtgtccggccgcttttgcttccctgaagtcatactgccggaccgagggcgtatgccctaagcgtgaatataatgttaagcgatggtaatgtcttctaaggataccttaaaatcaaaaaataattggtcttagacaaacgattcctgcaattttcttcaacaaatcgtctttatcgttattcacaaaccatttataagctttctcattagaaactagtagtaccgcctctgatatatcaaattgaaaatcacctttgatcctccattctctctcgtgagtccagtcaataatatttgatctatcacttaagttaaaattaacaattctccaatgttcatccttaggtaacattttctttgctatttctgtttgttcatatatagcagggcgagcacctttttcatatgcatagatttttctaaatgctatacctgccggcaagtaacgaacttttattttttccttaggcataccgctttctacttgtttttctctatagccttgctcatgtagtatattttgtactagagaaactggaggggtatcctgaaaacaaactgcggggttatctcctacaataaatcctggggaaccgggtttactcccaataatttttccctcctttaatattttcattaagacttgacctgtcttcaattcaccttttgctctagttaaatgagtaatataagtagtgaggtctgttctcccgctaatcctgttattccattgatctattgtataaggcattcaatcacgtctttctttatagtgttttcacattactttcgcgtaacgttcctgtattcatgaaatccaaaggggttgtctgctgaaatactctgaattccttcccgcagaccaaggctccatcggagccacagcatgaatattatgttatgcgtagttactgtcttcttcaaatttgataacacaattattcttcacaccttttattgggctcaatcttaaaattagtggttgacagtgaaatagatcggttttctaaattaccacactgtagtgatgggctttccagaaacgatcaaagatcagatcgtagtcaaccactagttttggttttgagccttttattattaactaaatcaaaattcgttactctgttcattctccttacatctaaatctgctatcaaaatttcaatttactatgaaaagatcttatgttatccatgtcacctaacaatttaaatatttcaccttgtctctgaggggatactcgtgggacacaaagtgcaaatggagattgacacgcagctaaaaatgggattatcaaatcatatagctcgggcaaaatatttttatcttttaaacattttgttaaagatccggcaaaaacatcagcagcttgaactaaagtattcattttagagtcttcaaaatatagatcgctttcaatatatttatcagaaattataagcttagatccatcattaaaattcatttcgaaatcttcagaatttcttgcaaacatctcaaaaacgtttaagtaacctgtcgagaattctttactttgatcatgaacaaattctgaaatgatcatgtcattatcttcacataagttttgagctgtttgtaaaagaataactagcataggcaaattaaaagttgctaaaactccatttggccaggacttgtctgtgtctttttgatcttcacaattttctaataattcaggtatgtctacacttagatactttcttatcagattcacatattttttcgagttgccttcttcttgtataaagcgctcttttaacaatttatcgattttgacgaaatcaaaagcttcatattttattatattttttagactttcatgaatacttaacgcatcataagatctataagctttaaaaaaagcatccaacaattcatctggaatctcatataaaataattgaaaatatttgttttctcacgatatcatcctcaaattcatcaggcacgaaactgttataaactggggaaaatacgaactcaattattctcattactatagcgaacctaaattcaagtatagatattacaggtaaattacctatttcgatcatatttttaatcaagtcatatgccatcttttggccttttttattcttcattaaatgagtactttttagttcagtagcagaacgcttgcttagaatttgatttattatttttacactttcattcttcttgctttcttgaataagccatcctgttactacatagaacggttcttgtttattcaatgcatttgggccacagttcccggattcatcacataccattaaatactttttcatattgaacacctcttatctttttgagtttcgcttgatattgttatgtttataatgcacagtgattctttaattcttctatcttcttttattttatagtaattacgcataacgttcctgtattcacgacccagcgtatgctgggtgtctggcgactgccgggcccagggcgtatgcccgcagcgtgaatat

SEQ ID NO: 43 - DNA, 169371 bp, Unknown
  Kingdom: Bacteria, Phylum: Firmicutes, Class: Bacilli, Order: Bacillales, Family: Paenibacillaceae, Genus: Paenibacillus
acggcagcaacggctgcgcctagcgtgacggcaaagggcgagatgcccgtcacgcgcttgccgggcgtcccgccgataccggcggtgccggctgctccagcgcgcagcgtgccggtggcagcagagccggacgtgcgcgtgtacgtcacgtctaccggtcgcacggagacgttaccgctggagcaatacattgtcggcgtagtagccgccgaaatgccgcccagcttcgagggcgaggcactaaaagcacaggctattgccgcgcgtacctttattgcccgacgtttgctggctgatgacactagcggtgcgccggcgggagcagatgtgacggatactgttaaacatcaggcttatatctccaaagccaaacttactagagaatgggggcgttctggtaaatccgcagagctggctaaaattcagcaggctgtacgagacaccaaggatacgatcatggtatatgaggggaagcccattaccgcttcttttttttctactagcaacggctataccgaaaattcagaggatgtatgggcgaagccagtaccctatttacgaagtgtgtcaagtccatgggacaagcagttggccccgcgttatacagataccgtcacactgagccgtcagagtgtgttcgatagattgggactgagtcgtactgcgattgctgcttctactggaggagggggtatgccagagattcgtatactctccaagacagaagggcatcgcatcaagaagattgaggttggtggttcagtctttacagggccggaaatccgtaacaaattggggctgcgttcggctgagtttacatggaaggctgaaggggatcggattgctataacaacctatggttatggccatggcgttggtatgagtcagtggggagccaatggaatggccaaggaaggccatactgccactcaaattctccttcactattatactggcatttcttttgcgcaagcctctcgtattctaagttagtaaatatttcgaaactttgaagtataaaagagttgcacccggtaacactggttactgaggtgatgagcaaatgaatgaacaaaataaaaaccagaaccaaaaccatgaagaaacacccaaaacctttcagggtggaagagcttcacggccgtcttcgtggaaaaagctgttgtccaaaaggtgggcatacccggcagcctacattgccgcagcagccattatactaaccttagtgtgggtctatcaggatgccagccagaagtctttcaaacctgacccagctagtccatcggtacaaagcacaagtacaatgagtaccgatgttaacggacaacagccagaaagcgtggaagtagttgcccagtcggaaaatatcgcatggccagtggcagatgctggcgcagtacaggtcgtaaagccgttctttgatgagaacgcaacggctgatgagcaggcggcagctatggtagagtacgataaaacatttaccgctaacactggaattgatctttcccgggccgacgatcaggcgtttgaagtgagagccgcccttagtgggaaagtatctcgtgtagaacaacatccgctggtaggtaatgtcgtagaaatcacgcatgataataatctcaaaacggtataccaaagcttgagtgatctgaaagtaaaagaaggcgatccagtgaaacaaaacgatgtgattgcttcagcgggtcgtaacgagcttgaaaaggatttgaaaacacatctgcattttgaagtgtatcaggatgacaagccggtaaatccagcaggtctgcttcctaaaaaataaatttggtcatggctttgcatacaaagcggggaatccatattccctgcttttttcttgtgtagtttttgtgcataaggtaaacataagctgcttttgccaaataaataggccttccgaagcatgtcttcccgccaaaccgcgaatatataggcacgctcctcatataatgtaccaaactatccacagtagggaggcgggagcgtgcacgattacatcaaggaacggaccatcaaaatcggtcgctgtatcgtggaaacaaggaatacggtccgtacgattgccaaggaatttggtgtctccaagagcacggtgcataaagatctgaccgaacggctgcctgaaatcaacccggatcttgccgatcaggtgaagcacattctcgaataccataaatccatccgccatctgaggggaggagaagcgacgaaaattaagtacaaaaaaacgagtggcaaacgaagggaaatcctcgtttccggcaagtcctaaaaatatatagtgaattggctggcaaagccattgaatcaaccccctgaagtatgatatgttaaaagatggtacaagacgaaaaatgacatgtaaccgtaggtttatacatatatttgccgcttcttgtcgaatcttagcttttaaaatatcactttgggggcctttttaatatgttcagtaatgatatcggtatcgacctcggtacggccaacgtgcttatccacgtcaaagggaagggggttgttcttgacgaaccttccgttgtcgcgatagaaagcgatacaaaaagagttctggctgtcggagaggaagcgcgccgtatggtgggacgtactcctggtaatatcatagccatccgtccattacgtgatggtgtcatcgccgattttgaagtaacagaagcgatgttaaaatattttatcaatcgggtagggggaaaaagctggtacagccaccctcgtattctaatttgtgcgccgacgaacattacctcagtggagcaaaaagcgattcgtgaagcggcggagcgtagcggggccaaggaagtatttttggaggaagaaccaaaagcggctgccatcggggcaggaatggatatttttgagcctagtggcaacatggtagtggatattggtggcggaacgactgacgttgcagtcctctctatgggggatgtcgtaacagcttcttccattaaaatggcaggggacaaatttgatacagccatcatgaaatatgtaaaaacgaagtacaagcttttgatcggggaacgtacggctgaggatatcaagattgctatcggaaccgtgcatccgagcggacggcgtgcagaaatggacatccgtggacgggatatggtatccggattgcccaaaacgttaagtatttctgcggatgaagtgcaggatgcgcttagagatcctgtgtcggcgattgttgctgcggccaagtttgtattggagcagaccccaccggaactgtcagctgatattattgaccgtggtgttattttgactggtggcggtgccttgcttagcggattggacgagctgcttgctgaagagttgcgtgttccggtactggtcgccgaagatccgatgcattgtgttgttaaaggtacaggaattatgctggataatttggatcatgtggttaagaaaaagttctaatctgccgatagtgactataagagactcgtgtgcggtcagacaggttgcctgcctccgcgcgagcatatgattttagcagagtataggattggggtgcaccatacatgttgagaggtttatatactgcggccgccggattgatgacacaacaacgacgccatgacaccgtgacgcaaaatattgctaatatgaatacgacgggatacaaacaggagaacagtgttcagcgttctttccccgagatgcttatttccatgacgggtggtaaccctgataacccggaccgtacggtcggcaagctcaatactggcgtttttgctgaggaaagcctctctccttacattcagggagcattaaaggacagtggacaagcgacggatttcgcgatacagtccaatattaatgtgaacgacccagctactggtcaacctatggcttttgatcaggcagggaaattcatcaatgctaacggtgaagtcacctaccgtccagaagcgttttttacggtgcgggacagtaatggtaatgttcgttatacacgtgatggacattttcaagtaaatggagcaggagcattgctttcatcgactggctcagcggtgctggatacgaatggaaagccaattcaattgacgggggctgtctcagcgcttaaagtaaatgagcggggcgaattggtagatagccagtccaaccagacgttagggacgacgctcggtattagtgtcattgatcgtccgtaccagctcgttcgtgagggcaatggaaatttccgcctgaatgatactgacggtgctacagctagaatgataaccgctaatgatgctgtatccgttcgtcaaggttatctggaggtatctaatgtagatgcttcacagtcgatggtggatatgatggctgcgttaagagcgtatgaggcgaatcagaaggtaattcaattttacgataaaagcttggacaaggccgttaatgaagtaggccgtgtataacagggggtaagtgatgaacaactccatgattggcgcaatggtatctatggccagtgtgcagcagcgtttggatttaattgccgataatattgctaatatcaatacagttggttataagagtaaacagggttcctttgaagatgtactggccaatgtgcagcaacagccttcaacgtatctccaaaatggacgagccatgccgctcggctataatttgggctacggagttaaaacggccgcaatcatgaaaaatatggagcaaggtccgctcaaagagacgggacttcctaccgatctggcgattcaaggtaatgccatgtttgaagtccaggggaatgggcaaaaagcttggacccgtgacggtagctttcattttgttcctgatccgaatgatagtgcgacgatgatgttgaccactgctgaaggttactccgtgctggataacaatgatgttcctgtgactgctccagcgggttccaaggtggctattaactcggatggcgaattgctgattcgtgctaatggaattggggatccgacagttggtcagagaatcaagctaatggatgtacagcgtccagaaggactggaacagcgggatgataacctattcgtgttgttgaatggtgtaacagaggcaaatgtattcggagcagcaggtgtggcaggtgctgttccagcggacgtatctgtgcgttccggttatcttgaggaatctaatgtggatttagcgggcgaaatgacggatatgatgcaagttcagcggatgtatcaaatggcggcacgggcactaacttctagcgatacgatgatgaacctggccaacaatctgagggcttaaggatttggtgatgaaagaagaacaatctgattcccgtccggtgcctgaaaagacgaagtcccgctggcgtactgctcgttatttcatagttccgttgctgctcctgttatcgctgttaggcggcttaattgcaggatatgtaattgtaggtaagcaagggctgtcaggcgtgttcgagtggaaaacctggcagcatgtcattgatcttatatttgcgccttaattttaatttaaaagagtggggtggcgggaaaagaccgctccgcgtgcagattgttcttccgattgctgttatccccagattccttttgattataaaacattggaggtttgaatccggggataaaggcaaacgctgcgcttcttcagaacaattctgcccgctccgctggctacccgccatcagggccactttttttaaaataaaccacccgcaatttgtgtgggtagtatataacaaaaccctgtgccagtggcgcagggttttgttatgcttttaagggaggggcctccagcgtagcacgcatggattgtggccaatgaaggccatcacagaggccttcggttttctctgcccttcacggcaagcgagtattattgaagcgaggcttccttttgagccaaaagtaactcggcggagggatttatttgaatctggagaagcgatagcgttcgcctttgcccctaaattttaaccttgcaggttttataaaatgagaaaatttaggggcaacagcgatcggaagatcaaataaatcgtgcagcccctccccctttgctcaattgaatttccgcttcaccccataatcggagcacccaatatggtacttccgcgtaattttctttttgcatctgataactgtataatgatggggaagtttataacactgcggggtaaaaccaagcacgggcaaaagggcttcttcgcgcctcaggttgcataaccggcggaaaaagccccttatctcaacctccacttctgcagtaggtgaaggatatctaacattgttgccgttatgagctgtttttatgcagcgtaagcggggtaatattatgcttgcagtaactcatgactgatacagagtcaaacctgcaagcgggaggagttattaaggtaaatggacaaattgcaattggatgttaatcaaattcaggagattatcccacatcgagcgccatttttattggtggatcgtattattgagctggaggaagggaaaagagcagtaggcattaaaaatgtaacgatgaatgagcctcatttcgttggacattttccggggtatcctgttatgcctggtgtgttgatcaccgaagcactggctcaagttggggctgtcgcattactgcacctagagagcaatcgtggcaaaatcgggttcttggcagggttggatggtttccgtttccgtgggcaggtggttcctggggatacactgacgcttgaagtggaaatcactcgttccaaaggcgcatttggcaaagggaaagctacggctaaagtaggcgatacggtagtagctgagggcgaaattatgtttgctttatctgaccctccccaataattaaagctctgcctacataagcacgacgtctgaaccgagtgcatgtgtacatagaaatcctgttttgacaacccaaaaatggagaggggaaattccgtatgacgcagttgagtaaaaaagcactagaaggcattgagagctggctgcaagacccttatattgatgaagagaccaaacaggagttgcgcgcattggaaggcaacgagcaggaactggaggatcgcttttacaaagagctggaatttggtacaggcggtctgcgtggagtgatcggggcaggaagtaaccggatgaaccgttacgtcattggacgtgcgactcaagggctggctcgctatattttagaacagcatgctggtaaagaaggcaagccttcggttgtcattgcacatgattcgcgtcatttttcaccagaatttgctctggatgcagctttggtgctggcgggcaatggtatcgtagctaagttgttcccttccttgcgtccaacgccacagctttcgtttagtgtacgtcatttgggagccagtggagggattgttgtgacagcgagtcacaatcctcctgagtataatggatacaaggtatacaacgatgaagggggtcagcttgttccagatcaggctgaacaggtaattggttatatccgcgaggttccttcgtttgccgacattcgcagtctgacacgtgaggaagcagaggcacagggattgttggtttggcttggagaagaggaagatgaagcgtttgtagatacggtagccagtgtgagtgtgaaccgtgagctgattgcagccggaccaggcaaaaacttcaaagttgtgtttacacctctccatggaactggaaatgtaccggttcgccgtgtgctagagaaaatcggttttgaacaggtgcatattgtgcctgagcaagagttgccagatgctgaattttcgactgtcaagtcgccaaacccagaagaacgtgatgcgtttaagctggcgattgcgctgggtgagaaaattggtgcagatctgttgatcggaacagaccctgatgctgaccgtatgggtgcagttgtgaaaaaccgtgatggcgaatatgtggtattgtccggtaatcagtctggcgcgatcatggtttactacttgttgaatcaactgaaagaaacaggcaagcttccgaataatggggctgttatcaaaaccatcgtaaccagcgaaatgggtgcagtcattgccgaacattttggagcaaccgtgtttaacacgctaactggcttcaagtatattggcgagaaaatgaaccaatttgaccaaactggcgagtacacctacctgtttggctatgaagagagctatggttatttggcagggaattatgctcgcgataaggatgctgtcttggcggctatgctgatcgctgaagctgctgcttattacagcacccaaggtaagacgctctatgatgttttacaagagctgtacgagcagtttggttacttccttgagaagctggagtctcgtacccttaagggtaaggatggagtggcacaaattcagggcaaaatgaccgattggcgtaacaacgcgcctcaagagattgcaggcgtgaaggtagacaaggtactggactactcacaaggtctggacggacttccacaggaaaatgtactcaaattcttactggaggacggttcgtggttttgcctgcgcccttcgggcacagagccgaaaatcaaagtatactttgcggtacgcggttcctcgctggcagacgcggagcaaagaatcagccatctggtcgatgctgttatggctcgcgtagacgcttgagaaaaatccctttataatagaataggttaaggtaattggataagatatagtaatcggtgacctctcacggcaaagggcagtacgccgtggaggtcatttctgtattgcagaataacctggaagaggctttgggaaaataggcttattccggcaacggaggattttgcaaaattcaatgagtgacctaccaaaaggctgagtatggcgaggtgggcagcattgaattttgcaaaatcccgaatattaaggaggttctttggtgtatcagaaatggcagtattggaatacggcttctcgaaaatggttatggattttggtggctgtcggcttgctggcttccattccagtcatcgccgatcgtgtgaagacagaatcctcgagtaaaaaagtagagattgtattcgattatcgggatttgacagaggcagcctcgtatcaggctcacccgcaggactatctgaatgagcaacttgaccgcttacagcaagcgggtgtgaacagcatggccatgtatgaaagtacgttggatgatttccgtaaagcgggtcgcgtcgtaacctatacaactcagaacgttgccgatatggaaaaacggctttcacctgcaaatgagaattttacgtatattgttttcgctgataaagaaaatgccgaggcattaaagccgttaattttacgtacgtttacaagcctggacatcaatgtaaaaccttggacttatcagggacaggaagggttagttgtggaaacatctccagaggatgcgtatctcaagcccatgcagcctgacccgattgcgatgaagcagcttcggagcaaaggattttttattgttccacggatgagcgacagtcttccttacaaccaggagttgacggaagagatgcttgcttcctttcagcaaaatggtgtaaaacgcattttgtttgaaggtgattcagtcaaaggcttcaccgataacgagaaagagcatagcttagcggcatttgctaaattgctgaacaaatacgatattggcctagctgctatcgaaaacttaaaaaaaccgcaagcaggcttcaataagctcgcttacgatatccactataacgttgtgcgtttatactcattgagcgataaagattcaacgctcgatgttgaaacgttggccgatcgttttgcattggccaccaaggaccgtaatattcgcatgttgtatctgaataccgcgcctagccgtagtattgctgaagccaaggtgaaggattcggtagataacctaatccacagcttggacaagccgggtaacgctgtacaacggatggagaaaaaggggtttgaactcggacaggctgaaccgttccaagtcgtggattcgtccattcagcgctatctgaaaatgattgtcttactaggtgcactggcattcttctccattatggtgtcctatttcgtcccggcattgactttgctggcatttgcacttggcttggtaggttcagcaggactttatgttttgaactctagcttgatggagcaaggcctggccctactcgcagcgattagcggacctacggttgcaatgatcatcgctgtgcgtacgattagaattaaacgtgaacagggtgctgaactttctgtaggtcagcgtttgattcaaacgtttatactgtacgtgcagacggcgattttgtcgctggctgcggtgcctttcgttattgcgctgttgaacagtattgcctacagccttgtgctgaatcaatttagaggtgtaagcttgcttcacattctgccgatcttcttggcagcgatatatattttcttttatcgtggcgtttctatacgggaggaaatttccaagctgctacgtacgccgattactgtattgtgggttatcgcactggctgttatcgcagccgcaggttattactatttgactcgtaccggaaatgcgggtacggtgtcgaacacggagttggtcttccggaacttccttgaaaatgcgtttggtgtacgtccgcgcaataaggaatttttgatggctcacccactgtttattgcaggggcattcctggctgtgaaatatcgcaaagcaatctatttgttgattatagctgctattggtcaagcctctatggtggatacctttgctcacattcactctccagcggcattgtcgcttagtcgcgggctgttaggattgggcttgggcctggtgctgggaatcatcgcaattgtcgtgtggcaagtgctggaagggtgttggaagaaatggtcaccacagctcaaacgatagtcatctcgggttattacggctttaacaatagtggagatgaggcggtgcttaagtcgattttgacagctttagaggaggagagtcgtcaggcggggattacaatcaagcctgttgttctgtcttctgaccccgcttggacacagaaaatgtacggagtagaagctgtaccacggatgagtctgggggaagttcgtagagcgattaaaaacagcgatgggctaataagtggcggcggtagtttgctccaggatgcaacaagccctaaaagtattccgtattatctggcgattctgaaactggcccaatgggctggaaaaccgacgtttgtatatgctcagggcattggtccggtacaacggaagatattttatcctatgatccgttctgtgtttcagcgttgtgaatatgtttctgtaagagatgagcagtctgccgcactactgggtactatgaaactaaaaaacccggttgtcgaagttgttcctgatccggtaatggggcttccattgccctcgggttccgagcaacataaagcagcaactgagacggataaggataaacttccgatcgttggtgtatctgtacgttactgggataaggagcgtcgcgatttaacggctattgcggacggcttgaaaaaattagctgctgagcgccgtgtacacttacgctttttacctttccatctgcctgatgacgagcaggcttcaaggatggtaatggatttgttgggggatattagggggacgggaagccttgtcagcatgtgcgatcaagtcaccgatcctcaacagatgcttttggaagtcagtcgttgcagtttgatgatcgggatgcgattacacagcttgatctatgcagcatcccaccaagtgcctccattggggatatcctacgatcccaaaattgatcatttcctcagccgtgtcggtagccagcctgtaggcactacagaggcactggatggacaaaagctggctaatgagtctatgcggttgctggatcagcgaagtcaatggatcgagagccagggagcggccattgctttgttaaaaagtgaggctcgcttaccggcacagcatatcgttaattacttgtgtcgcaaaggatgatggatacagtgacagttgataaggttacgaatgtgcctaccgtcccgattttcggtgttccggtatcaaggcttaatatgaaagatacattaaaggtattaattcaagcagtggagtctcgccagccgcatcaagtgatcactgccaatccgattatggtaatggctgcattggaagatccagtgtacatgaatgtgatgaaaaaggcagagttgattgttccagatgggactggcgtggtctgggctgcaaactatgtaggacatcctgtgcctgagcgggtagcgggctttgacttgttacatgaattacttgcagctggagaaaactatcattggaaggtttatttactgggatcaacatctgaggtgattcaagcgaccgcaaagcgggtacatgagctttatccccagattacggtttgtggcaagcgtgatggcttttttggacctaaagaggatgaagcggtgattgcagccattcgtgaagcaaatcccgatttgttgtttgtagcacgtggagcggacacacaggagccctggattggtaaatataaggaacaattgggtgtaccggtgatgatgggggttggcggtagcttcgatgttatatcaggcagaaccaaacgcgcacctaaattgttccaaaagctacgggctgaatggttatatagactcctcaaagagccaagccgatacaaaagaatgcttgcgctgccgaaattcgccgcgaaagtgatgcgcgaaaaagaaaacgtcacaaaagtgtgataaatagcttgaatctgccttcaaaacccgctaatttgccagaatatgaagcttggtatttatttttgatcagagtataattcaatgcggttacatctgaaaagggattgctttaaaattgggggtcgaatgatcaaatgttattgatctatattattgggttcatcatggcactgggacttgcgctgttactgacaccgctcgtcaagaaattcgctgtgaaggttggagccgtcgatgtaccgaatgcccgaaaagtacatacccgaattatgccgcgtcttggcggactggggattttcttggcatttctgttgtccttattggcggtgttaccttttgtgcctgacggaatgctgtcctctcgggatattaactttatcgcagcctttctgattggcggcacgctgattacactgattggtgctctcgatgatcgttttgatctcaatgcaaaattgaaatttttggctcaaattgccgttgcgtgtatggtcgtgtttgcttttgatattcgtgtagattttgtaaatgtaccttttcaggatgcatactcatctttggaaagctggatttccattccgcttacgattttctggatcgtaggtgtaacgaatgccatcaatttgattgacggtctggatggactggctgcaggtgtctcaggaattgcgattgggactatctttgtgatgtcggtattgatgggcaattacatggtagctatgctttgtcttgtactgctgggcagtattatcggatttttatttttcaactttcatcctgcgaaaatatttatgggtgatacagggtcattatttttaggtttctgtctggccatgctatccatgcttggtttcaagcaaattgctatcgtatcttttattacgccattgattattatcggtgtacctttgtcagatacattctttgctatcattcgtcgcaagttgcagaaaaaaccgattttctctccggataaaggtcatttgcatcactgcttacgcgaactaggtttcagtcacagacagacggtgttgattatctacggtattgcggcatttttcggtgtattggccgtgattcaatcgtctgctgcgcttaatgaagcgaactgggtcacctttgtcgtgatttgtattatgatgttcttcctacagattggtgcagaggttattggtcttgttggcaaaaccaaacgcccagttataaacacactgattcgcttgctggctaagccagattcccaaacgcgttcgaaattataattttaatttaaaagtaagccttcaagcttggcggtataccgcgggtttgaaggcttttttgatgtttgctgtaaaaaaaatccctccttttttgagaatttactaattttttgtatgtttactaccgataaaaaaagtattgaatgattacgtaccccaaggtgcgacagaatcaaaggaggacaatgatttgaaacgattgctatccatgttgctgacggttggtctcatcattggcttggtgccggcggccctggtaggtacggctcatgctgcgacgggaacttattttatttttccaagtgaaaaatatgatgtggattcggctagaatggtaaacactgaccgagttacagttaacggtacgattaacggagtgaacggaagtactatatcttatagtgtattccaactctctaaaaatggaacaaaccttaacgtggttaataagaacgagagtcaaaaaggcggaattacagtcagtggctctacgcttaaagttacagacattaaactgtttcctggtttgaaccggattacatttcaaagtagccaaaattcggctgatatgaaggactccatttacattgagtatcaggatgggcctaagctttatgatctatctgctacgttgaatggtgaaaccgagcagttgcttgagaatcagacagcggtgctgacagacgcacgcaatagcggtacggatgatgtgaaagtagtcattcaaggtactgctcctaatgctgacagtgtaacgctcacgtctgcaaaaagcagtaatacgtatacagttaactcttacactggctataaactaacgggtagtgttgtactgagtccgggtaaaaatatagtgaccattaaagtgaataacggaactcaggctcttacagttacacgtgaaattacgatttatacgggtaaaccggaattttctgatttgaccctgaataaggatgggaatgtttctgccgatttgaccacttcgcctgactttaccgtatcgtctacaagtggtgtggttttaaaaggtaatgttttggtgccaggcggtgcaaccgatccaggagtggccacaatcaatgcacgttttaccgatgtgagtaacaatggtagtgctgtgggtagtgcgactggggttgatgccacaattgatactgcaaatgtagttacttcaaatggttataaagtatatccatttcaggtgactgtaccttcggaagctgtacttgatcatttgaccagagcatccctgggcataacttatacggatagcagtacaccaccggctccatcggctgtccaatttacattgcgcagcagcactcagccgtatattgatgatgttaactatcttcctgattttaatactcaattgttgaacagaactaatggaagcgggtctgatcaggcagctgccctagatgaagctatgaaattaacaggtagctctatgaagaacaagactacagatgctgcatctgtacctgtaggtatggagtttatcgttgttaatggcgcaccttcttcaattagtgagctttctggagtatcggttcatattgtaggatcgcctcaagatgtgattcgtacaatcaatggtaagtcaacgcaagtgaagaaaattgttgcttatgtagacactttgcctaaagaaggacaaaatgtactgaatttttatctgaatggtgactcgaccaagttaattaaagcaacggtgaatctgttgcagggtccgttcatgaaatacgatacgatttatgatgggcaacaaattccgttgaatacatccagctcaaacttgaatacctataaattgactcaactgggctactttaaaggtaaattgcttgatgtgagcaatgcagcagatattcattacactggaagtaaccgaaatgtcttcctgtatattaataatgtattggttgatttggatggttcaggtgcggacttcaagcttgctgcttcctcggagacagccgcagccaatgccttggcgaacgggaataatgaaatcaagtttgtatacaagccaggtattgagtacagcaatacggtaaaagtaaactttacacagacgaatattccagtaattcctgttcccaacacacaaggaatcatcccttttacaccagttagcggcttgagcaatacgccgaaatatagcgaaattgctccgaaatcaaaagatgctaatttcaccaaagtggatgacaccaactacaatacatctctgaaaaatatcaatgtatttggtactttcagtattgctgatttgggtaaagcagatcaggtaaatggttcgttaagtgatattgctaataaagatcaatatattttggagattaagggatcggatgatagtgaagtcaactggacactgagtaacgagtttttctcagcagaagatgctaagacaacatacaattccggttctactacagataaatttacaaataaagatttaaaagacctgcttgtgtactaccatccagacaaaaagtatttcagctttgtgttgaaaaaccaaactatttcgcaagatggaacaccagtagcttataatattaccttgtacaatagcggtaagagcggaccatttgctactttccgactgcaagtatccggtcaatccacatcttttgatattttgcgtccactccctgaaaagagaatcgtgaatcaaaactttgtgcaagttgttgtaaatgcaggtaatgcagatagtgttacggtaggtaaagaaacagcagttcaagagggtttcgactctgattatgatggcaccattgattatccatcaacttacaaagccatcgttacaggtctaaaagccaacaaagataataaaattgatgtagtggttactgtaggcaaagaaaaactgaaacagaccattactgttaaatatgtgcctactaatatccctggcgagcagtacatggaagcgatgaaaacatcgcacaaagtgttcgatggtaatcttacacttgcttttgcaaagggaacgagtctgattcgtcgggactacgatcaaccgcaacagttcaaaaaccaggttttctctggtcacaatttgtactttgcaatagcaaatagcgaagatggtgtggttgaccgtcatgaatttgaaactgaaaaagcattgtccgatatgcggagcttgattgcagatggaagtaaatatttcaaccgggattttccaagtcgctttaccaaatccagtccggtattctggattgatccaggtacagcagatgatattaaaacggatgcttacgatccggtgacatatggtgctgatccatatcaattggctaacaaatcgcaaaatgacagcagcaagatcaaaaacttctactggcgtgacccatctaacgagttagtaccttccaagcgtgctacattgacgctgacgtatgatagcagtattgctcaggatgcagggaaacaaatgtcggtgttctattttgattctgatcttaaagactggcagaacattggtggtgtggtggatccgaagaaacacaccattaaagtaccgtttgatcgttttggttactatgtagttgctaaagttggagaaacgtatagtgatgtcattaagcacaaatacgctagagattacatcgaagctatcttggccaaaggtgtcatgaacccaatggatccaattaatagctttggacctgacagctacattaaaagaggcgaattcacgtctatgattgtcaaaggtttgcaaattccgcttaatttcagtggagcgaagcatttcgacgacgtgtctattccaaatacgatatcagcagatgcgctctatgattatcgttatattgaaacagctgcacgcgctggtattgtcaaaggttcgcaaccaagaatctttatgccggaagatgtaatcacacgccaagatgcagcagtcattatcgctaaggcattgaatttgaagcttgaaacagatcatgacaagatcatgaagaatctgtctaagacctttaaagatgcggacaaaattgattactatgcacaggcatctgtgttggctattgccaagaaaggctttattacgggttcacctgttgatgcaagcgatctgaaaaaaggatatatgtttaatcctacttctctgaccttgcgtggagatgcagccattattgtagctaaagttatggctgataaaaagctgcttcctaaaatctaattaacaaaacacctgaaattattaaacatccctccatgcgaaatggaaattccctttcatatacatgagagggatgttttttataaatcagctatttgactggaattaagggcctatgccataatatcaatgaggtaagaactttggattagccttacaacgttttttattttggatttagcttaaacgtctgtaattaatttcttttttttaagcttttatctcaaaatgtgtttattatttttttatatgtttttttgcgcatttatctgaaactttacgcttatttcatcgtagtagtggatgtgtgtgcttaaatattacatagagaagtgagtggggagtgatgagatgtctcagttttcaatacgccgtcctgtaacagtatttatgttaattattgctttgctaatcgggggcggtattttttcgttaaggcttcctgtcgagcagatgccggatatgaagttgcctatcgctgtggtagcgaccagtattccgaactcgacaccaacggaagttgaggaattggtgaccaaacctattgaaaagagtctggcttctattgagaatgtagatacgatccagtccgaatcttcagaaggatcatctatggtcatcattcaatttaattggggagtagatataaatcaagcaaccctcgacatgcgagataaaattgatggagttcgaggatctcttccaaaggcggcaaattcgccgcgcgtacttaaattggatcttaatgcaacgccggttattacactctcctttacaggggaccaggatgttaacaagctgaagcctattgctaaggatattattcagccgcgacttgaaagaattgcgggagtagcttcagtcagcatgtcaggcgggcaagaacggcttgtgaagattactgtagatcaagccaagcttcaaagctatggtattacgctggatcaaatcagccaagcgctatcgtctaataacgtagctggttctgctggttcagtataccgaggcaatacagaaatccaacttcgggttcagggtgaatataaagctgtttcagaaatgggtgaaacgccaattccagtagggaaggggagcgttaagctaaaggacattgcgacagttgaagattccttggatgatgttacaaccatttctacttttaatggaaagccaagtgtcaatatttctgttactaaagccacaggggggaataccctctcaatcgccaattctgtaaaggatagtttagattcgatacggaaggaattgcctcagggaactcaattagagatggtaacagatgcttcgaaaccgattagcgactccgtacactcactagtagagcatgctatattggggcttattatcgcagccattgtattacttttatttttgaacagtatacgttctaccattattgctgctatcgttattccaatttccttcgtagctacgtttatgatgatgtatttcaccggacaaaccattaatgttatttcattgagcggtttgcttctggggttaggatcgtttgtcgactttgctgttgttattattgagaatatttttagacaacgacatgaagggaaaagcatgctacaaggggctattgatggctccaagcaggtgggtaatgccgttatggcatctgcacttgcgcagatcgtagtatttttaccagttgtttttgttgatggaatagcgggagttctatttaaaccgttggcgttaacagttattttctctcacattgcagccttggtcgtatcccttctgattgtgccgatgctcggttcacgttggctacctaccataccagatgaatccatatactcttcaggtacttataagggtgttaaccctattgtgtggtttaatattggcttcgagaaatttaagggtgggtatcgccgtatactgaagtggggaatcaaccatagaaaatctgtgttaatcattactttattaatgtttgtggcagctggggctctagttcctttcgttaaggctgaatttatcccagcatccgatactggggaattcacagttaatgtgaaacttcctaatggaacggtcttggaagaaacggaaaaggttgttcaagatatagaaaaagaaatattgaaagttcctgatttggataaaatgacagtgacagttgggtctggtggcaattcggccttttcaggtgcaactccaaccaactcggcagatttaagtgttacgctcaaggatgggcatcagccaacagatgttgtagttgagggccttcgtaagaaatttgatagtattccggatgcagagattacactgacgtccacaacaggcctttcaagcggtgcggctgttaacattaatctaaaaggcgacgatattgacgtcctgagagaactctcggacaatctcgttgcggacgtgaaaaaaataccgggtacggtcaatgtgaaaagtagcttgagtgccgttcgcgaagaatatgagattaccgttaatcgggagcttgcgagtcgatatggcttatcagcaactcaaatcttatctgcagtgaatacttcttttaatggatcagtcgccacaagctatcgtacaggtgaagatcagattgatgtgaagatatcattgccagagcaaaatcgccacgatttgtcaaatctacaagccttgcggattaccactccacaaggtattgatgtacctttgtcttccgtagtaagtattgataaacggactgtacccgatactgttactcgtgaagaccagacacgtcaagtacagatttctgctgatattgatggatcaggggacattctaaccgtcaaacagaaaatagatgctcttttgaagagtactcacttccctgaaggctacagtgcagatacgggtggcgggcaaactgaacaaatgatggagtcttttataaacttagggatagctattctgctatctgtagttctgatttatatggttatggcaggacagtttgaatctctgctcacaccgtttgttattatgttttccgttccacctacggtaattggtgtgcttatcggtttagctgtaaccggggcgagcctcagcgtttcagctttgacgggttacatcatgctcgtcggtttggtcgtcaacaatgccatagttatgattgactttataattcagctccgaaaagacggccaagatcgggatgaagctattattcatggagcgtctgagcggttgcgtccgattttgatgaccacgctggctactgtactagctttgctcccaatggcattcgccacaggagagggtaacgaaacacaagcaccgatggcagttgttgttgtattcgggttatccttcgcagctgttattacattgattcttattccggtagtctacgtcatcatggataatatgatacaaaaacgtaagaatcggaaattaaaaagacaagcgaagagagaattgaaaaaagaagcgaaactacaaaaaagtgttcatatataaggtgaggtggagaaacataatgaataaaaaaagtgctctgattgctacaactttgcttttatcagttgcattagcgggttgcggtgggggagaggcccctgccgcatcgactacggcgcaacaagccattccagttcaagtagcaaaagtggctaaaggtagtattaacgattcaacaggtattattggaagctttgctcccaaagagacagctcaggtgtctccgaaaattagtggtaaaattcaaagtattaaccttacagtggggcaaaaagtaaataagggcgacacattgtttactatagaccaaaaggacttgcgggactccattaagcaatctcaagagtcgtaccaggttgccctggccaatttaaagcaggcagagtcaggtgcagcgcaatcggtgcagcaggcagaatccagcgtggatcaagccaaaagtgcgcttgtccagcaagacaacacgatcactcaagctcagaccagtctggtagatgctcagagttccgtgcgtgatgctcaaaatacgctcaatcgcaaccaacagctgtttagtgcgggtgctctttctcaatccgagttagagcagtctcaaatagcgcatagaagggctgtaactgcggtggagaatgcacagatcacactccataatgcacaaacgtctaaggaaagtgcgcaaacaacatataataatgctcaaaaatcattacgtcttgcacaacagaaaacgggcattgacgtagctcgtgcttctgtcaatcaggctaagtccagtttagacacagctcgtagtcaattggtggatgctgtagttaaagctccaatctctggcacaatatcagtagtaacaggaacccaggggcaaatggttagtgcacaatccgcggttgctacaattgcgaataccaatcctattattgctaaagttaacgtttctgaagctgagcttcttaagttgcaggtgggttcatctgtaactgtaggcgtggactcgttaaataagcggattgaggccagagtatcggctgtcaatccggtaatggataatgatcttaaggcatatcctgtcgagatttcagtccctaatggttctggtgaattaaaatcagggatggttgtaactgtatacatgaaatcagaagctcctaaaaacattttggtatcgcaggatgccattacggagcaggcagggaagaagtatgcttatgtagtggagggaactgttgctaagcgggtagaagtgcagacaggccaggaaagtgccaaacaggttgaggtaaccaaggggcttgctgaaggacaaaatgttgtcgttaagggtgttagtctgcttacggatggcgcgaagattaatgtagtgaagtaatttgtctcggttatatttactgtaaatcattgttactccgtcattcctactacttaaagtgtattagagtattagatttcaagagaatctatagactatatgtgctttatatattctatggataattcttaacgaatatactccattaaagaccgacttaaatgtacgaaaataatccttgtacatttaaggttgagaaggtaaaagttgtaggatgacggaggaacaggttcaatagtataattatgactgtggaaagcggaatacataatcaaaaaaaataaaaattttttttgaaacggacgcaactttttgaacccatgctacgtctaattgggtgagtatgaaacaaaggggtacaaaagcgtaaagacaaaattcgctaaaaaaaatctttactgcattgttatcacattgtataatactggagtacgtcataaatggacgctttctttcaactagattccaagcttctgtgatattgtcacagatatcattttataagggttctcataaagctcggaaaggaggtgtaacgactgatgagtgacaagatccgacaaaaagacaaaaataatatttctggttatattcaaggaggagaaaaaaaggttatgacaaagtttaataaaaaaatgattaacgtgctggcaacagcaacattggttgctggtgtagcagctccaatcgcagcattgactgcaccaactgcaatccatgcatcttccagctatacttccagtaatacacctagtattggttcaggccaaactacaaattctactctgggtagagttaaagttgacgtgagccaagcttccgttggtaaaggtgattctttcactgtttcattgcctaaaggctttgaattcggtaaagatcctggaattgttacttctgcttctgatgctacttatggcttgggtgtttacattgatccaggtgataacgacgaaaatgctgctgctcgtgctgaaactggatatgtacctggtgaaggtgtgtctgtagaaaagctgactaataactctgcaagagtgactttcaacttcactaactctaaagatagcgttaatctgtacatgaactttggtaaaatcaatgtaaacggacctagcaatggacctgtgaaagttactatttctgcaccttctgcaagtggttttactagcggtgaagcaacaattgcaaacgtagtatcttccggtcagatagctttgtcggcacttgatactgtttctagcgaagaaaactttactgcaacattgaaagttaaagaacaaacagctggttctttgggtaataacaacattaagttgaaattgcctagtggtttcaaatgggattccgctcctaaaagcccagccactattttgtttacttctaagacagacaaagcaattaagccatcagatgtgaattattctgttgatggcgatacacttactttatctttgaaaacagtaagtgatgccgaaacttctttccaattgcctgtaggattctatgttgacgatgaaaacagtgcaaaagaaggcgacgttactgttagcatctctggtaacgcaacgactgacgttagctcccttgtagttggtagctatggtcaaatcggtggtggcgtttccgttgctactccatcaacaattcttgctggtcacgacgagcaaaaagttggcgatatcgtaattaaagaaactgttgctggttctttcgtaaaaggacgtactgtaactttgcgtctgcctgaaggtgctcgttggcagtcaacttttgaaagtaataacccaggaagcaacttctccggttctatggagaacactaatggtttgggtggagcagaggtttcctatactgactctgacaaacgtactttgaaattgactttcaacaacgctaacagcacaactgatgctggtagtttgaaattgaaaaacgttgaagttgctacgcaaccaggtttctccggcgatctgaacgttgatgttgctggtagccaaggtctgagcggtactgttaaggttgctactgtgaaacaagcagttactctggctgctgcttccaaaccaaccctgacaatcggtctgggcgatcaacaagttggcgatatcacaatcactgaagctgctaaagaagctttcgttaagaaagacggtagccgtgaagtaatcttggaattgccaacaggcgtacgttttgcttctactccagaagtaaaagttacagctggtgacgttaaagtgaagagcgtatctactgatacttacggagaaagcaacaaaggccgtctgagcttctacatcgacagcgaatctgctactccaagtacaatcacaatctcggctcctaagctgactgttgaccgtactgtagctcaaggcgacatcgttgctaagctgaaaggtagcgcagtttcttacactgcatacaaaggcgcaactgacaacactcaaaactggaaagacaacaacactgcagctgctgaagtagcaatcgcaactgttggaactccagctccaggtgctactaaaactaaagctgtcttcacactgggaagcacttcctacactgtgaacggcgaaagtaaaacttctgatgtagctgcttatgctgaaaacggacgcacttacttgccagtacgttatgcagctgaagctttgggtgtatccccacaaaacatcctgtttgacaaagcaacttccacagttaccctgattaaaggtgaccgcgttgctcaaatcaaactgaacacaaacctgttgactattaacggttctgtggttcgtatggacgttaaagctgtaactaacaaaaaccgtactgtactgcctatcttctgggtgagcagagcgctggatgcatccatcaactatgatgcaactgctaaaacagtaactgttgaaaacaacaactaatttaagagcaactcttttgagttaactgaattagattagaagagggttccttttggagcccttttcttttattagtcttattgacaaaggagagaaattatgaaacgttttggagtggcagtactgtccacattggttctttcttctgcgttcgccagtcttgcaggagctcaagcaggtgatataaaggttattattaacggtgtaacacagcaatatacccagtccccagttgttagtcaaaatacaaccttggtgcctctccgtggtgtttttgaaagcttgggtgcgaaagtcgattgggacagcaaagctaaaaaagtaactgcttctaaaaatgaagatacattggccttgaatgttggttccaagcttgcttataaaaatagtaatcctgtacaactcgatgcagcaactcaaattcaaaagggtcaagtactcgttcctttacgttttgtgagccaatcattaggcgccaaagtaaattgggatcaggctacacgaacagtgaccatttccaatcaagctaatggtagtactactgacgaccaaaccaatagtttgtctagtaagcctctagcaactcctgtgacccaagttacttatgatacctactataatgattctttgacctataatgatgccgttaaattggctgtagctgatagtacttcagtaaaaacagcggcaacgaatatcgatcaggctggaaaaatcatgaaagaagcaggcaagaatattgactttgttccagcagaagcaggtgatgaaggtcaagataaggcttttaaaggttatgctcaaacgaaccttaattatgaggctgctaaaaagaacttggatatgaccaaagaaggcattgagtacaatgtgaaggatctttacaataagcttcttcaaaagcagaatgccgttaaactggctgcattgaatattgaagatgctgagcgcaagctgaaagttgcacaaattaaaagagataaccaaatgtcaagtgattatgaggttacacaggcaactaatcagttgactcaaaatcaagctgctttagagaaggcaaaaaaagatctagatagtgcatatgtatctttgaaccaagtgattggctacaaaccggagcaacgttatgaattaaaggataaacctgtatattcggagtttaaagataatgtggaaactaaagtaagccaagtacttaccagcagcacggctatttggctgagtgagcaaaaagtggatttggctgaattaagcttgaagctctacaattttagtacgccaggtaatacaccttacgaagccgaacagcttaatgttgagaaagctcagtatgcaacagagggtacaaagagacaactcgaagaagcagtaagaacaatctataacaacatcaaagcattggaaagccaatattcacagattcaagctggcttggtgagtgctagaagtgcggcagatatggctaagaagcaatttgatgttgggttggctacagagcttcaggtttatgaagctaatttgaaagtcactactgctgagcaacaggccgaagatatagtttcaaatattgatactttgaagttggcttttgataagccttgggctatgcagggttcttctggagctagcgcacaataattaaaacttaactatacttgctataacctgctgtaggaggacttcatgaaatcacgctataaagtatcgttggctgctgttttacttggaggaggaattgttactggttccttaatgaacaattcagttaatggtgcctccagttctggacaacctggcacagctgatgatccagtcgtaaccaaaagctatgttgatcaaaaaattgctcaggccatcaaaggtgggggaactgcaagcagtactagtagtaaagcaactagctcgactactccagcaacaaacgctacttctaacccatcggcgtcaggaacttctggtgcaggaaaaacttccacaccagagcagacagaggctttaaaggtagttgatgtaaagcctggtcaaaaactgattgccaaagcaggctcggaacttattttacgtaatggttatgctgttgtgtatagtatggatgccagtggtgctattgatattacttctggaacggaaattgtccataatcagactgtcgaaaaaaatcatttattatcctttcctagagaaggaagaggtattcaagtaaaagaaggtcagaagtttggtctggtcgttatggtacgaggcggttacactgttcagtaaactgtttttgtatataagctgcttccggtggccctttttcttaaatactgcttgggatagcaaattgttcttggctaaattgaacctaatcgctgcacactaactccatgaaagacaatatgtttagtggagggtgtatacgatggcgtcaagaggtcaaagacgattaattcccgaaagccgtgccaggttagatgatttgaagtatgagatcgctgctgagtttgggctaccagtttataatcctcaatatactcatatacatcccaatgctgacagtgaatttgctgcagaattgggggagtttgcgggaggccaaaatgtagcatggcgtgatttgacttcaagacagaacggttcagttggtggtgaaattactaagcgactgatacaatctgctgaacgtagcttatctgaatttggtacattgtaaatagcaataatttctacagtttttgatcatatagtagcgtataaactggggttatttacatgtgaatcgaaaatgatttgcatgtaaacttacctcaatttcgaaggttgtaattaggctgcatgaattgacaccttgttttaaataggatatcatggcatttgaggcttgtacgcaaccttttcctaccggaaaaggttcattttttattaataaggtaacaagatatctcccgccatttgttggcttgaaggtatctgaataatgccattgccatgtcaggattttttaataaatcctcatgtattttaattgtgggaggttgaaattcatgtctgtaaaaggccgccatttgttcacgtccgagtctgtaacagaaggccatccggataaaatctgtgatcagatatccgatgctgtattggacgcctttctggctaatgaccctaatgcacgggtagcatgtgaagtatcggtagctactggtctcgttctcgtcattggtgaaatcagctctaaatcggaatacgtggatattccatccattgtacgtaatacgattaaggaaattggctatacacgtgcgaaatacggtttcgattataatacttgcgctgtattgacttctttgaatgaacagtcgccggacattgctcaaggggttaatgctgccttggaaagccgtgatcctgctgaagtagataaagaaacggaaaacattggggctggggatcaaggtttgatgtttggttttgctacgaacgagacacctgagttgatgcctttgcctatcgctatgtctcaccgtattgcacgacgcttgtctgaagtgcgtaaggatggaacactgaattaccttcgtccagacggtaaaactcaagtaacggtagagtatgaaaatggtaaacctgttcgtattgatgctattgtggtttctacgcagcatgcggaagatactactttggagcaaattcaagcagacatcaaagaaaaagttattttgccagttgttcctgccgaattactggatgagcaaaccaaatattacattaatccgacaggacgctttgttatcggtggtcctcaaggagatgcaggtctgacaggccgtaaaattattgtggatacgtatggtggttatgcgcgtcacggcgggggagcattctccggtaaagatccgaccaaggtggaccgttccgctgcttacgctgctcgttatgtagcgaaaaacctcgtggcagctggattggcagacaaagtggaaattcagcttgcttatgccattggtgtagctacgcctgtttcgattaacgtcgatacatacggtacgggtaaagtaagcgatgagaagctagttgaattgatccgaaataactttgatctgcgcccaacaggcatcattcgcatgttggatctgcgtcgtccaatttataagcaaaccgctgcctacggtcactttggccgtacagatttggatgtaccatgggagagcgtagataaagcagaaattctaaaagaacaagcggggctgtaattcctcgtatattatcaaaataaaagcaataacccaaaaagactgtttcatgctttgcatgaacagtctttttttgatgtgtttcgctgttaagttgaatttgcacctaagtaccgaatactgagtgactactcggatatcggagcatggtccaataaatttttaagtaaacgacaaaccttttgcagttccttgtactgctccaaatacgcaaaaagggctttcaggaggcctttttgcgggttcgatttcagagcctcttcctttaaatgagtgtagatttgctgacactcctgtttctcctctgaactccacgaagacagcagtatactgtcttccaaggagtggagaaggctgttaatttgacggccttggtcaaagggattacttagagcactttcaggtaaccagccttgcttgctccagaataaatgtggagctgaatcagcattgttcaggctggttgccaaggaactggataagaagataataaactgtgttagatgttcaatcgtttcatcatccatccgatcggcaaagaagcgaatatattcaaacacaatgcttttaagtacaaaggtcatatcccatgcatgatcttcaatgctcggtccaaaaatatcaatcaggcagtcgcgaacccatctgtacaatttgtattcatgattctcgaatgcgtaattgagttgttcattctgaaaaataagcatggaaggctcaggaagatccatcatgagatacactttgttttcaacgagatttttcaagtaaagtacaataaaaccgtgcagtttatcgtgcttagaaagattaggtttgctgtagagagcccggatgtcttgttcaatgttattttccagaatgatacacatttctagagggagttcttcttttccttgaaaatatttatagaaggatgctttcgccatcccactttctttggctatttcttcaacagatgttgaataatagccttttctggagaacagccgaatggccgcctgtaaaatatcattttttttactttccatacatacttccccctagggaccggccaactcgacagcatcgaattcacttcatacatcacaaaggttggtcacgtgtgataactgtgtgctgctgttttttgagttgacggcgcatcttgtacttggccatgatcatatacaaggacggcacgacaaacaaggttaacaaggtcgagaataacaaaccgaaaatgacggtaaacgccagtggcttaaagagcaggcttcccaatagtgctaatggaatcatacctacaatagctgccaaagatgtcaataaaatcggtctgaagcgagcagcagccgcctgtattacggcttcctttaattccattccttcatgtcgtgcatcctcgataaattcaattaacacaatcccattccgcacaacaatgcccgcgagtgcaataattcccatgatgctcataaaaccaataggcataccggtcaagaaaataccaataatcccgccggctgctgccaggtacacggtcgtcataataataataggaatggagagagaataaaattgcatagtaatcaagagtaaaatgagcaagactacaacgatcgccagctgtcctaagtccttgaatatggtcgattggtcagaggtttccccaccaacctcccatttgtagccttctgggaacttcatttgtgccagcttactttcaacatcaatcatcgcttcgcttgcagttcgtccgttcaaatcggcttccaccgtaatcgtccgctccatattgtaatgcttgatttgctgaatagcaaatgacggcttaatctggacaagctggtttaatggaatttgcttaccagctgcattaactacacttaattgttggaaaagcttacttggctcctcgtcgctgtgattcaaatacattttaatatctaccagactgtttccagtatcaaattggctgacttgggctccttcttttaatagaagcagggtgcgagtcaaatctgtgtagcttaccaggtactgatccatcgcttgtttgttgacctcaagctccaatgcatatcgttcaattcctatatcatccacgatgcctgttgtgccttctactgtcgcgatctgctcctttgccttctgggcaagggtttgcagttcattcagatcctgacctgagatacgaatagaaacgggcttacccactggaatcccgagacgaggaacatacatcgtaactgtaactccagggtaggatttcttaacatgttgttcccaagcatcaactgtcgtattgagatcgaatacgttttctttgccgacgacagcaatctgccccaccgtttcgttataactaatatttccacccgaactattaatgtcactaaaaagttgtggggcagtccctccagcgctgtagacgaccttggaagtttcaggttgctttttcacccagcctgcaaggtctttaacgacctggtcggtttccgcaattgaagtgcctacaggcatttttacatttagtgcaacatgaggatcttccgactcaggaaaaagttcaactgaggtaaagggaactaatccataggcggctgttccaagcatgagtccgaccatggctgtcaacaagggacgctgaatgaccttaggcatcagtttttgtgaatagagcttgtttaaagaatgaatctgctggccgagcaagcctgctggtttagacttaccctgagggtgacgagcctgtctgcgcttctcataccattctcgaaaaatagggatgatggtgagcgacatgatcatagaggcaagcatggtcagggagacaatagcaggaataggtttaataaaggcacctacatttccaggaagaaacaacaatggcgcgaaagctgagatggtagccagagttgcaaccaaaatagaaagcatgacctctttggtaccttttacagctgcgactgagggtgattctcctaattccgtaagtctacgctcaatattatcatttacaactacggcatcatccacgagtatgccgagtacgatgatcagaccgacaacggaaatctgatttagagtgatgccgaacataggcaaaaagataatggcaatcgaaaccgaaataggaatggccagtgcaacaaatgcagaggtgagcaaattcagccccaacatacaaacgagaataacggccgcaatcgcaagaatcgtttcacgctttaagtcgtcaaagatatggcttacctgatccttttgtgcaaaaagagtttgaaagtgaacacctgcgggaagtgttttctccagttctttgagcttggtattgaccttttcgctcatagaagggatgtctgtgcctgtttctgctccaatacttagcgtaatggccggtttaccctctacataggcaaagtattctgtattaggatgtgccagctccgttgtgccgacatccctcaaatatacaggattaccttctttggtgcgtgtcaaaaggacctgattcaattcatcagctttttcggtctcgcgaacaataagttgataggtacgtctgttgtattcaatattaccagtaggaacccgatcaatttgagactggatcgcttgagctacttgtccccatgacagctggtattgctgaagcttctggttgtcaatatgaacacgtacttcttgatcagggagaccattgaatttgacgctagatacgccagaaatggtgttgagctgatctttccaagttgttgttaaatcatttagtttatacagtggtgcagaagagtcagctattagggcataggagccgataaaagagctggttagcttgtcatttacaacaggcacttcagcgccttgaggaagatcagcttgtgcatcctgcacttttttacgcatattatcccaaaccgtttgaggatcaactccgtttttggattcgattaaaatagaggagaatccgttaccagaagtcgaactaatcgttttaacaccttcaacttccttaatgcgtttctccagctctttagttacggtttgttctactttttgtggtgaagcaccagggtagactgttgttaccgtggcattttgtatggtgacatccggcatttcctgctgtggtaactggaaaaagccgaagattccgaccaaaatcagcatgacaaaaaacagcaatgtaatttttcgtttttttacgatgtactcaatcatgggcgtccgccttcctccgactgaatcgcatttccatcaaacaggttttctgcccctttaacgataatacgttcgccttcacgaagtcccgatacgatttgcaactgattatctacaacctgattaccaagctccacaggggttttaacagcttttccttgaatgtctttgaaaataaaaggcttgcttcccgtgttaatgactgcttcggcaggaacgagaatcccatttttgtcggtcacctgttgagcagctttaatgacctgaccgggtaaccagtctcgctgtggattgtttataacaatctctacgttaacccttcccgtgtcggtgctggttgaaggagagacgttagacaccgtaccttgacgagtctcttcatagagcgccacttctacttgttgaccctttttccaatccttaatttcactgtctggtacaggaagcagtactttgaggcggtcgatggagcctatgcgatagacggcttgccctgacgcgaccaaatcacctgtattcacgattttgtctaagattacaccgttcacaggagagattagacgtgtgcgtgaaagtgcaagttctgcctgccccttggcaacaagggctttttcgtagttggcatgggcttgtttttgggaagctgcagcctgttcactggccgcaagggctttgcttttacctgcaagcgcatcttgaaaggaagcttgggcggattgatgatcttcggctgtggctccttccagcaaaagggacagggattccttggcttgttccagatctttcagggctgcggtagcattcaggcgagcattttcattatctgatgcggtagcagcgcctgcctcaaataacttctgtgtacgctcgctatccgtcttggccttgttataagcgctttgtgccttatctacagtagcttgcgcttgttgtttctcttgagcacgtgcgcctttattgaccttgttaacattcgcgcgagctcctgtaatgccggcatcggcggattgaatcgcggaggtagcagcctgtaaattagcctgtgcgttatcaataccagcctgtgcctccaagatggaggctgtcgcctgtgccacctgaagcttgtagtcagcgtcatccagactagcaataacggcgcccttctgtacagcagtaccgacagtgagatatgcactggctacagtgcctccattttggaaagccagtgtgttctcctcataagcctgaagagtgcctgacaagttataggccgtatgaagtggcgtggatttgacgattgcggtgcgcacaacggttggctgtgcagatgaacctagagcggcatcttttttttctgtagaacatccggtcattgcgatgctcagggataaagtgaatatgatgatggcccgttgtttattcatgattatcaatccttccgatagggtcataattggagttgtgaactaatcagtattatttgaactattaagttcaaatgtattatagtgcgccgatattgcattcgtcaattcatcgttttagattttatgaattagttgacgggattttcgtaacttttgcctatataataagtctattaacataagaggatttttttgtttattgatagagtacacgtgcggaataaaaccgtttgaatacactggagatgggagctattatccaaatgtttttaagtaataagaaacagagtgaagtgaaagtaaatggcagaggaattgctaaaagatgggccgtgttaacactggcaggggtattatgggtcggtccggttgctggaactggcgctctaatccccttgaatggttggatgtctgctccaatcgcaagtgcagcctctggttcaactgtaaaattgggcgaagagatcattacttcgggtgcaacattattgaaatatcgttttaaagggtccaaaggaacagcgctggctgatatcattcgagtggacttacaaaatccgtacgtcaagctggatgtaatgacggggaagaatggacagtttacgacccgtcagagtacaggtggcatggcaaaagagaccggggcggttgctggtgtaaacggagattattttaatacctccagcgagggagcgccgatcggtggacaagtatccaagggtgtgttgatgtctactccgtctgatttaacgggtatgtatgcctttgctgtaaccaaggatggttctcccatggtggagcagtttacttttgaaggtacagtaaaagctggagatgggtcgtccttctctttggcggggatgaacaaggcttcgtattcgcctgagacgagtgggggcggctatagccactctaatgctatgtatatttatacatctgcttggaaagcaattgagcggcccaaaaacagttcgacaacgcccaccgagatattggtacaaaatggtgtggttacacaagtctccgacaatgctacgttgaatatgaccgttccgcaggatggctatattttacgtactcatggtaaagctgctgattatgccaaagcgcatctggccgtgggacagacggtagaaacaagttatcaccttcgtgttaaatcgacagggagcgaagtagatccttctaaccttcaaatgatgattggtggacataccatattagtaaatgacggtcagaaaacctctttttctcggagcacaacaagcataggcgggacgcgtgcgcgtacagctctgggatattctcgtgacaagcgttacgcttatgtcattgctgttgaaaaaaatgggaacagcgttggtgtatccctgagcgagttgcaaacgctgatgaaagatattggcgtctggaagggtatgaaccttgacgggggcggctctaccactatggtgactcgtgatttgggagatacgacagcggggcttacgttcaatacagaatatggcacagagcaacgtagtattgtaaatggagtgggagtatataccaatgctcctaaaggaacgctcaaaggcttcaccatcaagggcaataaaacgttgctgattggtcagaccggaagctattccttcaaaggttatgacaattactacaatccattcgatacctcgaaagtacaagtgacgtggaaatccagcaatccggctgttatttcagtgagcggcggcgctgtaaagggagccaaaccgggaactgctactttaacggcatccagtggctcagccagcgctacaaccaaggttacggtgcttggagcagatgaaatttcatcacttaccgctggtactggaagtggctcgcttaccgctggagctaaaatcgctgtaccggtaacggcaaagacaaaagatggacagagtgtcagcattacgtcagatgcgctcaaatgggagttcatcggctttaagggaagtgtcaaggacaatcagcttacggtaaatacggtggatgcaggcgtaaaaacgggctatgccatcggtcgctatgatggtttcagcgctgtcgtcttcctgtctgctggcggagcaagtacaaacaactgggagaactttgaaaatgtctcgtatccggttgattttacttcgaatgtggaaggtgttactggcacagcggctgttgtacaaggagatggcgaccatgccagttccaaagtgctagagctgaactacgatatgacgaacggcagtggtaaaatgtatgcttacgctcaattgaacggcacatccgggaaaacacttgaacaggcggctacttccatctcgattgatgtcagaggggataagagtctgaactggctgcgtgcggagctagaggatgcccaaggcaaaacagcatatattgatctcgctaaagtgatcgactggaacggttggaaaaccattaacgcagatatgagcggtttgaatatttcgtatccggcgaagctgaagcgtctttatgtggtcaatgtagcagagggtcaggacgagcgtgctaaaacagggaatgttgcttttgataatatttcttttaatacaccgggaacggtcggtacagaaggactcaaaaaaggaacagctcaaatgacgattggacaaaaatcaatgacggtgaacggaacgccgaccacgattgatgccgctccgatgactcgcgatggttcaacgtatgttccgatcaagtatgtactggacgcatttggcggacaagccaaatggaatgcgggcgatcagcggatcaccattatgcgcggcggtgtgctgatggatttgaccgtagggaaaaaagaagttgttctgaacgggaagcgtcaaagcactgatgttgcacccattgtgctaggaggcaggactttagtcccattaagactcgtttctgagcagttaggaatgactgtaaaatgggaacaagaaacgaagaccatcaccctccagtcatgatatggtatgatatatacttgaaatgctaggattggagtagaacatttgtggactttcaagccgatatcatagaccgagtcattaaaaatgccatccaggtgatggagaacagcaaatatcagatgttcgaaatattggacacggcccggaccgagctggtcacgttaaatcaggagctccagagcgtcttgaaggaaacagcagaaacgatcgaaaaggtggaccagctggaaatgaactatcggcggtcccgcattcggttgactgaggtcagccgcgacttcgttcgctattcggaagaggatatcaagcaggcttatgagaaggcaacacagcttcaactcgatgtgatgattttccgcgagaaggaaatgtatctcaaagccagaagagatgatcttcaaaagcgggccaaaagtgtcgaggcttctgtcgagcgcgctgaaaccatcggttcgcagatgggggtcgtgctggaatatttgtcgggtgaattgggacaagtgacgcggatcatcgaatcggccaaaaaccggcagtttattggtctgaaaattattttggctcaggaagaggagcgcaaacgtatatcccgtgaaattcacgatggacctgcgcagctccttgcgcatctagtgcttaggacggaaattgtggaaagaatgatcgccaagcaggaatttaagatggttcaggacgaaatagtagacttgaagaaacaggttcgctccagtcttgaggaaatgcgaaaggtcattttcaatttgcgtcctatggccctggatgacctgggacttattccgacgctccggaaatatgtgcaggattttgaagaaaaaacgaaaattagatcgctttttgaaacaaggggcaaggaacaccgtctctcttccgcgatggaagcagccatttaccgtctgatccaggaagctttgaccaacgctgccaagcatgcttatcctacctatgtgcttgtggagattacctatcaggcgcagcttgtaaaaatcgtggtgcaggataatggtttgggctttaagccagagctttttcagcaaaaaagcaaagatcatgggcattttggtctgattggtatgcgggaaagggttgaactgctcgaggggagaatggagatcgaatcagctgagaatcaaggcaccaagatagtgattcatatcccaaccaacgtggaaaagggaaaggagtaacaaaatggaaaatcaggaaattagcaatgcacccattaaagttctcttagcggacgatcatcagttgttccgtgaaggacttaaacgtattttgaatatggaggacgacattgaggtcatcggagaatgtggcgatggtattcaagtgttggaattctgtaacgtagagaaaccagatattgttctgatggacattaatatgccaattgaaaatggtgtagaggcaaccgaaaaactgcgtgagatgttcccggatgtcaaagttatcatattatccattcatgatgatgaaagctatgtattcgagacgttgcgcaagggagccaatggttatctgttaaaagatatggaggccgagtccctcattaatgcaattcgttcggttcatgaaggatatgcgtttatccatccgaaggtaacgggtaagctcattcagcagcttcgccggatgacctacctgaatgaaacgggggctatggctgaaggtcatacgaaggaagccggcgtgaagtttgtcgcaggtgaaaataatccattgacccgtcgtgaagctgaagtgctgcgtctgatggctgaaggtaagagcaacaagatgatcggtgaatatttattcattagtgagaaaacggtcaaaaaccatgtcagcagcattctgcaaaaaatggaagttgatgaccgtacacaagcagttattaactcaattaaatatggatgggttacgctgtaaagtgtagtctttccatgcattagacgatgcagctgctaatagatatgaatgctgtaccgcctttctttgggagcgatatgtccgctcatacggaaacccagtacataaccgtgacacctcttcctgttatacggcatatattgtcgctataggaggaggtggaaccctcgtgacggctcacttggtttggatattgcttatatacggtgtgggagccgcagtcgttcatcttatgtatatacgacaggcggttcaggcttatcacaatggtgaagattcacgcacaatatctccaggtcatcgcgcgactcgctatattgtgattacgtccaatgacggagatcgtgtggaatgggtgatgcgttcgctgaacatacttgcctggctacaccggaggccgctacatgtgacggtactggatgatgaatctatggacgatacgctaccgattctgacacggctactacgctatagtcatatggaggtttcagtcatttcaagtcgtttttcaccggggaacccggtcttaccgaagtcaggcggtgaaaagcaggttgttattgatcttagaacggtcaagtcgttggcggacgccccatttgttccttagcgataggggattgtggacatcgtggttaaaatcggatataaatgttttaaaacagttgcataggcaagacgacagggatttcgttgagatctacttgatgtgaagcacacttcaggctattagccataggagtgtgcttttttgctgttctctggggtaacaaaaaccgcaaaaatggatgaatgggaggagcaggggaaggtgaagattgcagtatatgcagtgaggtataaagggaattggactctccgattatctgcggatattcgagtagatatgacatggtggatgaatcaagatgaggggcaagagaatgttgtcgaaagatgggtgcttttaggagatgagcttcccttgtcctgggggacaaagttgtgcgaaacatttaaggaattagcaaatatggagcgatggggaaaatggcagtggtgggcttatattctcgcacagctaaaaagtgaactggctattgagccttttgatggagaacgaattttgtctggaggagtagaaaatatatgcatttgggatcatgtacaagggtggacttcctgcacaaaaggtggggatgagggacgggaaacagacggaattttacgttctattcaaaaaaggagtctcatcacgggaattgatggattggatagggagtgtttaacacgacaagcgaatgagctggcaaatttgttgtcaggacgccagttactcgttccggaagtcgaagcgctgctggcagaggcagcgccaggtttggagcatacttggcgatccgctgcacaacttgcatatctgcaaggccgactcagctttgctgctggcctcgctccagcaccacgtacgcgctggtctgccgcgcgtacgcatgaacttcgctgcaatcgttgtggcagcgggatagtgcaccgcacgagctgcgcatcgtgcggacgtaaggcgtgcgcttactgcgagatatgtctcgcactggggcgcagccgtgaatgctcgctgctgcttcgtggcgcagcgaaacccgtcctgccgtgcacagcaggcagggccccggcgacggaactcgaccgctgggggctgagccctgcacaacgtgccgccgccgaagcggcgctgcgctttttggccgcaccgcacggcgaagtgcggggacgttttcgcccggaaggccgtgggctccgggcgttgttccggcgcgatagggttgcgcgccggggatcagatgctgccgcttcgcagggcagcaaccttgcccgcagcaagcagtctttgccaaaacctggcgaaggtgcgaggcataacgctgatcggcaggtacctgataccacggtagagcgttttctgctctgggccgtaactggtgcaggcaagacggaaatgatgtttccgcttttgcaatatgtgttggaccacggaggaacggcacttgtggcaaccccgcgccgtgatgtggtactggagttagcgcctcgtttggccattgcttttcccgatgtgagcatggtgacgctctacgggggaagcgcagaacggtggcaaaggggacagcttacactggcaacgacacatcagctattgcgttatcgtcaagcttttgatttggttgtgattgatgagatagatgcgttcccttatcacaatgatcctatgcttgcctttgctgcacgagcagtatgtaagccgaagggcaagtttatctatttgtctgctacaccaccgcaaaccttgcagaaagaggctgcacgcggtctactgccacacgccaaggttcccgttcgttttcatcgttaccctctacctgtcccatttcgtctggggactgcttcagtgcaacattggctgcaaaaaggtcggcttcccgcatcctttattcagcgcctacgcgtatccatacaacgtggggcacaggttttcctgtttgtgacacgaatctcacatattcagggacttgtgaagctgctgattaaacaattacctgatgtacctattgcaggcacctcctcacaggatgaagaaagaaccgctaaagtgcgcttatttcgagctactgaaatacgtgtgctggttacaacgactattttggagcgaggggtaactgtttcacggagtgatgtgtacgtattagacgcggacagcagtctttttgatgaagcctctcttgtccaaatggcgggtcgcgcaggaaggtccaaggatgacccatgtggaggtgttatttttacatccccccaatggactcgaggtcaaaagagagcaattagacagattaaacgtatgaatgcactggctcggaaaagaggatacctgaaggaggcgaagcactaaatgcattaaataaaaaaagtttttttgaaaatgtgaaacctgaaacaaagtcggtacgtaaactaccaagaaaggtgcattctggtatggggatgattccaacaacccgtctatttttgaattggttattccatcgccagtctcaaatatgtatggcttgcggcactctcacagggcgtttttccgaatttcccggaatttgtacttcttgttcgcttcaaattccttgggtttacaatattcgttgtgtttattgtggacgtccgacgtcttgcccggattgcgtaaggcttgaccgattagtacgttactatgtgtgcaatcggagtgcaaccagctatacaccgatgatgagagaatggattgggcagttcaaatatcgtggaaatgaaaagtatggttccttgctgggcgagatcatgaatcgagcctatcaggcgatgaggtatgagtttgcaagtcttaaacattctcgtttcaagcaatctttgtggagtgtggatgtagtgacctgtgtcccggtaagtgagaagaggctgacagagcgaggcttcaatcaggctcagatcttggcagaagagattgctaggaggaataagctccccttcctatctttacttgctcgtccacaagatacaggcaaacaaagctttaaaaccaaaaaggaacgcatgaacaccatgaataacgcgttttctgtccaccccaatatggaaaatttgctgaagtcgtttattttaaaagctgaatctcatcgtgctacggagaacaagccttctgttaccgttttgcttgtagatgatatttatacaacgggaagcaccttgcaggcgtgtgcacgtgttttgagagaaaaggcattagagcaaggaatacatttgactattttttgcctgaccttagcaagatcataagtctaaatatctagtattttccatgaaattttgcttgaaactatgaaaaagaggttataactctcttgtaagaaggattaaatgatagagcaaaagtcttttaagccgtacaatcagcaggatttgacaacgagctagagagaggtatataataaaaatatagagacaaacaaaaagtaaggaagtgagggatgaaaacagaatatttcaatttagaggttgatttttttggaaaagaggagtacaatttctatctgttgatagctaacatgattggtaataagtgattagctaatgactaaagagcggacattgggagtgtctcgctcagtagtaaagcagttaattaaaatttaaagctaaaaagaggagagaaaaaatcatgaaaaacgtaatgaaaaaagtagcagtatctagcatgctggcagttagtttaggtgcagtatctttgttgagtccacttgcaacaggtcaagtaatggcaaaatcgaactctgaccaaaataaggatcgttatgaagatcaactgatcattcaacaacaagaagcagcacaaaaagcatttgaagaaaaagtttttggaactgtaactactaaagatgcagcaactacaacaccagctcaaccagctactgagaacaacaatcaagcaacaactacaaaaccagcaacgactacaactgaaacaccagcaactgtaaatacaatcactgtaagtgttcaagagggcgacacattggcttctattgctgaaaaatacggtgtgactgttgaagaactggttaaaatcaataacctggttaaagtaggccaagaactgcaagtgccgcaaacaaacacaaataaataattatcattataaatgtataatgaagtgtgttttttaaaccaagcgtttgactatagtatacgggaaggcctctattaaaacaatgcttttttgaataattaattgtgaaatagcttgtttttttgggctacaaatttccactgatgcatctagcttgatttcggatagattataagttgagatgatgttaggtccatgagatttatgaatacccacactccatgtgcggagcattcgtatgggcgccgttcccccggatttacaggatttccttgatgtcattcggggcacaggtgaacatgaattcttctgaggattgtttcgcccggtttttccctcatcttgataattaatttctacatttctcatattcatatatagctattttaattgtataatgaagcgctattcccgaaaataactggaatggcgcttattttattttctatctaaagtacggtgtaatgtttgacgataaatagatacatgcactaggctgagctattagctttcatgggctttctttattttttatgacattgattattgatgcatataaatatagagaaacttttgctgatggatcattctctaatatgataacttataagatgtgcaattgtgtaaaatccgaaaatctttttttgaaatatttgctagacgaggctcttcattataagttaatgtaaggataaaagtaattaaagatcggaaattggaaaggggcgctacagaggatgaatttggataactgtcctcgctgtggaaagctgtttattaagaacgtcaggggaatctgtcagaactgtattaaagaaattgaaattgaatacgaacgctgtgtcaaacatatacgtgaaaacaagggcattcatatgcatgagctttcagaggctactgaggtatctgtaaagcaaatcacgacatttatacgtgagggacgtatttccattgctaatgcgcccaatatgacgtatccttgcgaggtatgcgggataccgattcgtgaagggcatatgtgcgattcttgtcgaacacgtctgactaaagacctgcatcaggctgtacgcgaaagtagtaatcaggatcaaagtaataatatgggctcaggtacctacagcgcgattgataaacttcgtggaaagtagtacaggggaattaaaaacgcattcagctattcaaaaagttccaaataccgccgataatctttatagagcttatcggtttttttatttttagcaacatgcacaaaataaagaagtgaggcataatacgaaccatgttcgacgctatgtcgtctgatacattctgaccatatcaaataactaaggaaggtggaagttatgaaaattaacgagaccaaccgcatcggagctattaatccatatcagcgaaatattgaaacaggacgtcaagaggagcttaagaagtcccgccgcaaggatgaggtttcgatttctccggaagcaatggaaatgctgaaccgcagcagtgatgcagaccgtgttaagaaaattcaggagcttaagcagcaagtagcttctggtacctatcgtgtggatgccgataaaattgcagagaagctgttaccttacttcaagcagtcttctgaaagctaggtgagggaatatgcctttagagcgattgattgatgtgctggagcagctagaccaaaagcatcttatcttgctagaactagcaaaaagtaaaaaaaagattgttatggaaaatgatatggatagcctggttcagcatttgaaccaggaatccaggctccttaaacaggtggaacagctggaggaagctcgtatggaggtttcgtatgagcttcttcgtgaacgtggtattaagtctcagcttaatttgactataactgagctggcacgtcttgtatttgatcctgaagataagaacaaactcctcagtgtccagagccgcttatcccacactctctcagaattaaaggaaattaatgcaatcaatcaaaagctcatcgagcaatcgttggtgtttattgactactcgttagatctacttgtaggtcgtcctaatcaggagatgacttatatgcatccggatcagaaaagtaatcaactcgcacgacctggattgttcgacactaaggcttgagccgaggaggaaaatagagtgccatccacatttcattccatagaaacagccaaaagaagcctttatacacaaacggcagctttaaatacaacaggacataacatagctaatgccaacacagaaggctatacacggcaaacagttaagatgagagcttctatacccatggaggcttatggtattaatcgttctaatgtacctggtcagttgggaacaggtgttgaatttgatgctattgaacgcattcgtgagaagttcttggacagtcagtatcgtggagaaaatactgagctgggcagttggacgattcggagtaacacacttgataagctacaacagattatgaatgagccgtccgatacagggattcggaaggttttggataacttttataaatcttggtctgatttaagcaaagacccagaaagtgtaactgcacgaactattgtaaaggaaaacgcacttgctttgactgatgcaatgaatcatatgagtaaacagttaagcaatctatctgcggatttaacctcaaatgtggaggctaagtctagcgagctacaaagttatgtgaattccatagcggacctgaaccaatcaattactaaaattgaaggcttgggagataacgctaatgatcttcgtgaccagcgtgatttgatcgtcgataaaatttcgaaaatcgttaacgtaacggtaactgatactgatcaaggctacaacgttaatatgggtggtcaagcattagtaactgggtttgcaccgactactggagttaacggcgcttttttacaagccgcttttgcctccaatgatttacaaggtggagaagtacatggaatgatcatctccagagatcaatttgtagcagattatactgcacaaatggataacctcgccaacacattggcaaacggtgatatttctgtaacgctacctaaaggctcagtattgccagaaggcactgtactgaatggagtgacttatactgggaccagccgaacacttcaatcggatttaacagttacagttaaaggtcttaatggtttgcatcaactgggttatacccaagaagataaagatgctaacggtaatatggttgcgggtaaacctttttttgtaacttcaaataatggtgggacaataacagcaggtaatatcacgttaaacactgctatagtagataatcctaacgccattgcagcatcccttcgggtaacaggcactgctcctactgaggaattggttaagggtaataacacattggcatccttgatgtccaatttgaaattaagcaatttcacttcagtttctacggggaatacggctactattgatagctttttcagttctatggttggtcagttgggtatagaggctcaagaggcaacaagacagacacaaaactcgacagccctcgtatctcaggtggaaactatgcgccagtctgtgagtggtgtttcactggatgaagaaatgtccaatatgatcaagtttcagcatgcctatagcgccgctgctcggtttatgaccacattcgatcaattattggataaattaattaactccacaggtgtagtgggaagataagaatggggattaaatatcttgtgttttatacaagggtatttaattacggagggatataattatgcgagttactaacaatatgctaagctcacagcttttgctgaatttgaatcgaaattctgagcgtatgaataatacgcagaaccagatgtcgactggtcgtaagctgaacaagccctctgatgatcctgtaggcattacgtattccttaaggtaccgatctgaattgtcttcaaatgaacaataccaacggaatgtggacagcgcagtgtcttggcttgattttaatgatacggtcatggatcaggcaggccaaattatgcaaagagtacgtgaacttacagtacaggcctctacgggaactaatccacaatctgcgctggacagtatcaacaaagaaattggtcagcttaaggaacaaatgattgatgttgtgaacagccaattgaacggaaaatatatattcaatggtcagacctacgacaagaagccttatgacttccctttgaatgctgataatacgcatgatacgtctggagcagcattaattgctacggatacaggcaatgttaattttatagtaggtgaaaatgtagctttgcccattaatgttactggtaatgaagtcgttggaacaagcgtggataccgataatttatttactatttttaatcagctatctgcggctttggcaagtggtgatattaaagcaagtggggatcaactggccaatattgatacgcgtatggacaaaatgctgaaggtccggtcggaaatgggggctaaatccaaccgcgttgagctaatgcaaaaccgtttaagcgatctgaaagtaaacttaacggatttgcaatcaaaaacggaagatgcagattacgctgagcttttaatgaattccaagatccaagagaatatttacaatgcttctttgtcagctggagctaaaataatatccgcatcattggttgatttcttaagatagtctaaggagggggaaagatgtccatcattccgatgcttcagatccggcaaactccggctatcctgcacattgatgcagatccagggcagtattcgattcgacagccctcggcagatatggaattaacgacacgacgtgctcaactggaaattcaccagtataagcctcagctgaccatagatcaaagtgcagccttctctgcctataacggtgggaattaccttgagatgaataatcgaatttattcaggggtgccacagatttttttacaagctcttgcgcataaagtggagcaaggcaaccgaatggcggatattcacattcctgggaatactgtagccattgtttatggagaggatacagaaacgcatgtgcttcctgaatttagggatccagcatctatggataatgtcgatattcgtgttgaaacgcgcgcacctgatattacatatacacctgctgtatcggaaatgcatgttaccgttaatcgtccagagattgagtatacccgagggaaactggagatttatatgcagcagtatccatcagtggcctatattccacctgaaattgatgtcgcgatgtaaaataagttaaggttatagaggttattcaagccgactatagccttttttttataataaaatgtatatatctgattaaatattggaggaatattagtgattatatccacatctatttggggtgacattgaagttaatgaaaaagaagtatatcgatttgaaaaaggaattccgggatttgaggagacgactgagtttgtgttgcttgatcatgatgaggcacccttttactatctccagtcccttcagcagaaagaactatcttttgtcttagtagacccttttattttttatcctaactatgagttcgaattacctgatagtgaaactgaagaactggagattgaatctaatttagtcgtacgcagcatattaacattacatgagcaggtagagaactcgacgattaatctattggcacctttggtattcaatcctgataataggcaagccaagcaggttgttttgcaccagtctccgtattcgaccaagcattcactacagcctactaaggaagacgaaaccatccgttcaaaggaaggtgaataatcatgctggtactttcgcgtaagaaaggcgagtctattatcatccaggatcacattgaggtgacggtgctcggagtagagggagatacagtgcgtataggaatttcagctcccaaacagatggacatctttcgcaaagaaatctatttatccattcaagagtccaatcgtgaatctgctgcccatacgcagtcgaatttggatgctttgcgcaagatgataaataaaaataacgaaaaataaaaaaaaacctaaaatgctattaaaagatcgacgagaatgtcgatatatatagtacaagctattgcggaggggcggccgacttcaacggatagctgtaacaacaataaaccacatggatgtgggacatttaccttcagggaggaaatttaaaatgattatcaatcacaatatcgctgcaatgaacactcaccgtcaattgaacgcgaacactactaacacaaacaaagcaatcgaaaagctgtcttccggtcttcgtattaaccgtgccggtgacgatgctgctggtttggcaatttctgaaaaaatgcgtggtcaaatccgcggtttggacatggcttccaaaaatgctcaagatggcatctctttgatccaaacagctgaaggtgcattgaacgaaacacacagcattctgcaacgtgttcgtgaactggctgtacaatctgcgaatgatacaaatactgatgctgaccgtcaggaacttcaaaaagaagtagcagaattgacaacagaagtaacacgtatctccacagatactgaattcaatactaaaaaattgctggacggcgctggtgtcagtggtgcagttttccacattggtgctaacatcgaccaaaatattaaattgtctattggaaatatgagtgctgcatcattgggtatttccgctgtttctatctccactcaaacaggtgctaacgcagctatttcaactctggatgctgctattaaatcggtatcttccgagcgtgctaaactgggtgcaaaccaaaaccgtttggagcacacaatcaacaacttgggaactacttccgagaacctgtctgctgctgaatcccgtgttcgtgacgtagatatggctaaagaaatgatgaaccaaacgaaaaacaatattcttgctcaagcttcccaagctatgttggcacaagcgaaccaacaaccgcaagctgttcttcaattgcttcgttaatcgtttttttaatggaactgctgagattattctcagcagttttttttgtgtttatattttacatataaggaattattgttaccatcatattttataagtcgaatctaacttataattatcaattaaccgatatatatactaactgattcgtaaatgcgaaatgagaggaatacatgatgaaaacaattgcgttatgtatgattgtaaaaaacgagcaagagcatcttagaaggtgtcttgatagcgtaaagaacaaagtagatcagattgtaattgtagacacaggttcaacagatgaaactgttaatatcgctaaggaatatactaatgatgtacatcatatggagtgggataacaactttgcagctgccagaaatgaatctattaaatatgccactacagactatattttagtgttagacgcagacgagtatctagaaggatctgctgatttacaaaaggaaatcacctcaggtgcagactactatttcacaaaaatacacaatattatgtcatttgaacgtgctttaaaccatttggcaatccgaattttttcaaatagtaaagacctatattatcagaaccgtcttcatgaacatttgaatattatggacgaaaaacgtaatttgataagtggacaagccgggcttgttattatgcatactggctatacagatgaaatgatggagggaagggaaaaggccaaacgaaatctccctcttatgttgaaggaagttaaagaaaacccaacggtgtataacctatttaatatgggaagaacctatatgtgggttgggaaatatgaaaaagcaataacctttctaaagagagcttacccaatgagtaagaacttaacgatcgcttcagatttaattataactttatgtcgaagcttaggggaaacgaaacggtacaatgaggcactacaaattttacaagaagcagtagttgttcatcctaaagaggtagacttacttcatctacaagcactttactttatggaaataggatactatagagatgcaatagcgacgatgacaaagtgtcttgatatcggtgatcaaggcattaccgttacggaaggtcatgggagttatatagcacactttagattagcagaatggtatgaactacgaaatgatttggcgaagagttataaacatattttagaagcttttaagctgaaaaatgactttgcgccgattatggggaaatattttaaaattatagagaaagcaaatgttccattagaagaagtattcgtaagtacaaaccagttgtatccgatatcaaatagtggtcagctggaaaaaatgttagaagtgatgtatcaattgagacaccccctcttgcaaagatatctgacagagtataacgtgactgttcaagataatgtaatggctactgcacggcaatatgccagggactatgatggagcacaagccttgtggttgggaatggacggtgttgatgagcaaaacggagaggatcttttattaatatctatgattctcaaagataaaactctatttggaagggccaaaacactacttaatctaagtcaaaaggaacaaaaaaaactatacaaaatcataatggatgaatcttcaggagatgctaagttaacactacatttagagaatatattagaaagagtactgatgcatttaatacgattacaagagttcgattcatttgaaaagttattgagttatttgtggcagggtagtgttgatgtgaaggttaaagtctgtgagtaccttgtgagctatggttttaacgagatagccattgatctattagttaaactgtttgaacaacatccaaggaatataagtattattaagatgttgggtgatgtctgccttagttctgaatattatcaagatgcacagcttttttatacaaaattacttgaagttagtgatgattatgtggcgtatgagagggcttacgaattatatgaaagagtagatgatcaaattgcgaagaattctgttctaagtcaaataattcggaaattcccattatgtgcatggtctaaacagaatctcaatagataatataatattcaaaacaaggagtttattatgagaaatttcacaacaaacaataaacctcgtctggtagccctgtggccagaatgtttaaatgttcatctcactaaggatctcgggatgataccgtttattcttcataaatatcataattatgattctgcaatagcatgttatggcattgaggattttccttatatagacgcagaagtaaagggcttgaaaatcgattctgttgaaaatagaggagacgtcttaaaagatggtaatgattaccttacaaaacgagcagaagagattgatatattattcttaatgggaatttatccatttacgttaagctggatggagaaatacaaaagtaaaaatccgaaggggaaaatctatttaaagctggacgccaatatatattggatgaatagtattgatttaacggataatctacttgagacgcttaaaaaatgcgatgtaatcagcgttgaaagcaagagactataccattatttaaacaaaaagtggcccttaaaaatagagtatgttccaaatggattttataattttcattcaagtccaagcgtgaattttaatgaaaaggaaaacgttattctaacagtcgggagaattggaactcaccaaaaagctaatgaaactatgttagaagcgtttaaattagttgcttcagaaattcctgactggaagcttaaacttgtaggaaatgttgaggaacatttcatccaatatgttcatgagtttttcactgaaaatcctgagcttagagacaggattgaattggtcggcccaatagaaaatagaaaaattatagaaaatgaatacagaaaagctaaaattttttgtttgacttcgagatatgaagggttcccgttagttttcacggaagctgctaataacgggtgctttatcgtttctaccgagattgacccggcttttgatattaccaatgaaagcacacttggaactctttttcctatagatgatccttatagattatctgaaatattaatggaggtttgtaatgacaatataagattggagcatacatgttgtgaaattcaaaatttcgcagaaactaattttaattggattaatatatgcgataagcttgatcttttattacatctaaattaatgggggaattccagtgatcgaaataacatttcaaaatgatgaagtgaagttaataaatacacaaaataatgtttcggaaactgttctacatttcggtgggattcacaataaccttacaacgataagctcgccaaagctgttacaagaatatattcacatgctggaaaactactcaactatacaaaagtatacttacggcgaaactacgatgattgatatcgtggcacttacaagtcttatatacaacgaattaatggcggggaaacatactgagatcagggctctagaggtaggaagttggttcggatgttcaagttatttctttgcaaatagtctcaaaacgttctcagatagtaatatcttattctgtatggatacgtggcagggtagcccggatacaacaagccataatattgcaaattatgaaaatgcgtttgaacattttaagagcgtaatgagatatgccggtgtttacgataatataaagcctattgtgtgcgattcaacggtgggcatggacattctacaggataattattttgatattatttttgtggacgctaaccatacgtatgactatgtttatcaggatataatcaaaggaataagaaaaattaaagtcggcggactattaatggggcatgattgtgagtgttatgcagatgaacttcctcctcatcttttgcatggtgacaacaagcatttagacggtatagagggttatcacacaggagtaattaaagccttggatgatatttttggcagatcctataatcggtttaatcaaagtcttgtctggtataaaagaattactcaagaagacaaagatatgttattaaaaatggactcggtagatcaagaggatactttacaattggttgatactatgaaggaagctattcaatttatatacaaaaacattacagatggacaatcagatatgctccaaattcttactgcggatacgatacaggcagcaaatcagctggagaaagaaatgatcccgcattgtgagaaactttataataaagacttgaaaattaaaacaaatgagttaaagagttccttattagattttcaaattacgtataataatgattttccgcgagctctctttgtgctggaatcgagagttattgagagtttcaatacgtggttggaatgtttccttgaaagtagtaaaaaatattaagttggtgtgtttggcttggtgaggtacacagggtgaaatctaagcaaggatgtgagtagagatgaaagttgttattttagcgggaggccgggggacgcgaattagcgaagaatcccatttgaggcctaaacccatgattgaaataggtgatgccccaatactttggcatatcatgaagacttattcttattatggctataatgagttcattatctgcttgggctataaaggttatattattaaagagtattttgcaaattattatcgccacatgtcagaagcaattacctacgacttcacctctggcaacactgtagaagttcaccaaaattcagtcgagccatggaaagtcactttggtcgagacgggtttaaatacaatgactggtagccgtataaaacgtattgaaccttatgtagggaataatccatttatgctcacttatggcgatggtttggcagatattaatattacaaaactggtgaagtgtcacaaggaaagtggtaaattggctacgattaccggcgtacagccagatggaagatttggtcgacttgaattggaaggtgagtctgttacaggatttactgaaaaagtaaaaggagatggcggttggattaatggagggtttatggtttgccagcctcaagttttcaagtatattcaagacacggaaaaaacaattttggagcaggagccactgcaaaacttagcgcgcgatggggaactgaacgttttcagacaccatagcttttggcaacctatggatactatacgtgaaaaaattatcctcgatgagctttgggagaagcagaaggctccctggaaagtatggctggattcataaaacaaaacaagttctatggagtggagtagcatgtttaaactaactttaacgacggatgatctgcagaattatgttcgtcatcagttgaataatttttatcctgataatgacttattatgtaaagatatattatttgaaaattcgtttaatcatgcgcttgaacgtacggagtactgttttcagcatatagccttacaagcctatcatcgccaagggagtacatttttctcacatctgcattcagatcaatacacgttgtttttatggtttttgtctaattcagtatggaatatatttgaagattctgagttggcgtctaagcttttttatttaaataaggctttaaatggggtagtatgcatgtacgatgcaaatatgcctaacatttttctcatcgtacacggtggtgttgtattgggcaaagcatcctacagtgatttttttgtgtgttatcaaggatgcacggtaggtgccattgatggaaactatcctaagctgggaaaaggagttatcttggctcctcagtcatcgattatcggaaattgcattgtgggggatctagttacaattggaaatcaagccttgcttagaaataggaatctggacagcaggtcgctgtattatcgccatatcgatacagggcagcatgctgttcaaaaggctaagactccttgggcccagtcgtttttcaatgtcccaatcataccagatggagatgatctttgagagtgaagacagtcttaatcagcggtgcaaatggttatatagggcttcacatggcacagttgctgaaaaataataattataaagttatcacggccacacgagactcgtatggggatattatgatggatttttcggttccatcgaaggtgccacttttaaattatcctggtattgatgcgatgatacacacggtttcaccaaatgaagatctttacagacatgacccctatcgcgctttatcagaaaatgcagctggaatacatgcagcaatcgatttttgtaagaataataatattcgtgattttatatatatatctagttttcatgtttttggtaaacaaggtggactattaagagaggactcttacgtcacgccaagtaatgactacggacttgcgcattatacagctgaacaaactgttagaatgtttgatcgtaacaaagagatcaatgcatggataatccgtccgtctaatctttttggagtcccggcagatatagaaagattcaaaagatggaatttgataccttttctgttttgcaaggaagcagtagagcagcagaaaataactcttctaacctctggaagtcaacttcgtaattttgtaggcatttctgatgtgtgtaaaaaagtactatggatattgaataaaaggccggttgatcgtgttttacatgcttttggaaaagaaactataagcgttttgcattatgcacaccttgtccaaaaggttgcattggaaaacttcgatcttcctgtgcaaatcattcgcccagatggaaatgaacaggtcgttcaatttaagtttacaagtttatataacgatccagaaattttaccaacagatgatatagaaatgtttgtggatgaaatgcttaaagtgcttctatcgagttgatagaagggaattgtcaattatgatttgctggataatgagtttaattgtttactaatatcagtgtttatgacgttattattgatcactattgtcaaaaatacgtttgaaaagtggtatagtttaatactatctgttgatgaaattcatactccctctcatgtctggggttcgttggaatgatcaggagtttgggatagaatggccttaggttggacatgaaggaaccatgggattactaaatattttatcaaataaaaattatagtaaaaggaaggtattcatggaatcattaaataagctaaatcaagctcttctattaattggacaaaatgacgaattaagaagtaaaacactgacttggtttaaggaaatagaagaactattgcattacccgcaaggtagtattagggatgaaataacaggtcctattttagatgctatttataatgaaaataatatatttagaaagaaactctccaatgggttggtgtttgatttttattacagaactaaaattgcaagggactttttaatgtcaactcctgaagtacctgatcatgtttgggaacctcaaacaacgaaattattattgttgctgtctaaaaatttaaaacaagtcctaattggcggcgcttatttcggtgatcaggctataatgctagctaacgaaattaaaaacaacaatggagttgtacatgcattcgaaccgaatttggatcagttcaatatgctgaatcataatgctaaaattaatggtttaaataatttaaaagcatggagaatggggctttggaaagagagtgacagttcctttcgtcttgtaggagaagattcgtttgctcatgctgaatctgttgtgaacgaaactatgcaggtggataaagatattttttctacggtatcgattggtgactatttggagagagaacaaataagaaaactcgatctcatcatgcttgatatcgaggggttagaatattttgttttacagggagctcaaaatcaattgaatcttccagcttcggaggcaccaaccattgtttttgaagtacaccggagctatgttgattggagtaatggtcttcataacagtgagatagttcaatatctgatgggatttggatactcagttttcgcaattagagattacaattcgaatgttgatatgacagatttaccgattgaaattattcctccagatagagtgtttcttgaaggacctcctcatgggtttaatatgctggctgttaaagatacttcaatacttaactctacttcttttaaaaaatgttatgatgttagtcctaaattgttaaaacataaaaattcctatttacatgaaccaactaaatgaagagttacagagctagttgattaaaatgcacaataaaagatcaatcaaatcttattagcaaggaaagtgagtagtagccttaggtgagtcgcttttttcagataatcgattgtctcctgaggaaaaacggtttagccagtcttttcatcaagcactaaaccgttcggggtattgtggggcattttgagtttactagcgtatacgaaaatcccagcctcacgcctagcgacaagttggagactgttattgagtaaatgctcaaagttcctctcaccagatatgagatcaactcatgaagcttggattcattagaacactgctgatattttggggagttgatgttggactaatcatgccaatttctaaagattatctacaagcttctcggaatatttttaagccataaggagagtaaatatgttagttcagccagcacccttgcatcaggcagcggtgattgaaatggagcctatccaggacagccgcggttattttgccagaagcttttgcaaaaaaactttttctgagcatggaatttattttgatatggttcaatccaatatggcattcaatcgatatcctaatacgctaagggggatgcattttcagctacctccctactgcgaggacaagatcgtctcttgctttcatggagccatctacgacgttattatagaccttaaccgtaaaagccctaccttcggaaaatggtttggactaactttgtctgaggaaaaccgtttgtctttatatgtcccgaagggttttgctcatggttaccagacgctgacggaaaacacgagcattcattacatggtcagtgagtactatactccttctcatgagtctggagttcgttggaatgataaagcctttggaatagaatggcctttggaggacgggcttattatttcctcgaaggatgagcagtggaaagactttaatataagtaccgatggaatgattttgtgtgagggagtcggacatgaataattatacagcaacacagatccttgaaactttacagtctggacatgaggccatttgttatttggaagattgtatccatcgtggagagctaaacctatccgacatcataatattagataatatggttgagttgctgtatgcgctcgaaaatgccacgtcgaatgtgtctgtgcctaaccgtgtaaaagagattaaagctaatattatgttctatattgaacatcttaaacagaatgcaatcaatgaaaatgtagagcgatttttatatgattttcgctttcatgttagatctctgttccggattttggagtttgaaattgcttatatcgtggaggatttcgttgacaagaaggactatccgcgtctttatccagaagtaggaatcgttaatcatggtgatattgcggcactaggggaaaaagccaactgtaaagttagtgtcgttttggtcgcgtataataatcttaattatacacgcgattgtgtggagagcattttaacgaacacagacgatgtggagttcgaattgattttggtggataacggctcaacagatgggacaaaagagtattttgattccattcctggtgcaaaggtgatccatttgaagtataacttgcatgttgtgaaaggcttcaatataggcctaatggcggcagaaggtaaatattctgctgcggtatgcaacgattttatttttgcgccaaactggttaaagaatttaatgatttgtattgaatcagatcctgaaattggttatgtgtctccaggggcgactttcatatccaatatgcagcaaattccaatccccttctcctccaaagaggattttcaagaaaaggctagagaatacaatgtaagtgaccctacaaaatgggaagagcgtgtggtgctattgcccaatgttttgtgttgtcccacagctcttttggatcggattggttattatgacactcgctttttccgtggtgaattttcagacgatgacatcagtttcaaaatcagacgcgccggatacaagctcgtttattgtgcggacacagtgacgcaccactatgggagcttaaccaccgccagtgatcatcagacgaattccttagaagaaggaagacaaacttttatagataaatatggtttggacgcttggttggatgcacgtatgagtgcggcttatatgaggtttgattttagtcagctttctaatgtgaaatctattcttggagttgatgtaaaatgcggagccaccttgctccaaattaaaaatcatatatggtcaacttatggtattaaaccacaactatctatatgtacaacagaacagaagtacgaagtagatgcaaattccatttcagaaaatgtattcttactcgataatttacgttatataccagaagagcttaatggtaagatcgacttagtctatattgaaaagcctcttgattgttattctgacgatttggataccattttccataatctctccaaggttatgaatactaacggaaagctaatttttatggttaacaatagcataagcatagaggcactatatgaaatgctcaattcttcgaattccatgcacaatcgcaggatttatatgcgggatatgctttatttgcaggcaaggatccatggttttgaaccaacctctttcattaatattgctccggaacgcagctctgagagtaatcaagtcgtagaagatctggctaagtttctaactggcggaagagaattagaatcgaaatatttggagtcattattacactctactttcggaatctatcaaatgaactatcaggctactttacaatagccttgatcaaaaagaacttttataaaagtcaggagcacctatgatgaaatcagacatggtggatcgtagtttttgggccggaaaaaatgtgttccttacaggacatacaggatttaaagggagctggcttagtctgtggcttcgtagcatgggcgcaaaggtgacaggttactctttacctgctcccactagcccatctttatttaagctaggtaatgtagagaatgttctggtggaatcgactatcggtgatgtggctgatttagagatgctaagacggtctttgcataaggtaaacccagagatcatcattcacatggcagcgcaacctttggtccgaaagtcatatgaagatccggttcagacttatagaacgaatgtgatgggaacggtaaatgtaatggaggcagctcgtacctgtagttcagtacgggtgattttaaatgtaacaacagataaatgttatgaaaaccaagagtggcattggggataccgtgagaatgaacctttaggtggatatgatccttattcgagcagtaaagcgtgctcagaactgattacgtcagcatatcggcgatccttttttcaatcatccgatatcagagtagctacagcacgagcaggaaatgtgatcggaggaggcgattgggctgaagatcgattgatccctgacttgatcagagcgttgacggatggagaacaaattttaatccgaaatcctgaggctatccgcccttggcaacatgtgcttgagcccttatcgggatatctactgctttgccaaaacttatacctagaaggcggcgacgcttttgctcaagcttggaattttggaccgcgagacgttgatgctaggtcagttgaatggatagtcgaacagatgctcagcaaatggccttatgagcaccctgggtatcaggtaataagacaggatcgtatgcatgaagcaaatatgctcaagctggactgttccaaggcgttgaaggagcttaattgggctccaaggtggcagttggatagagcattggaagctactattcaatgggttgctggttatttgcaaggcagagatataaaggaactgtgtgagcggcaaattgctgaatatgaagcagattgtttggatggataaaagaaaattatattgcacagtatgaaactaatctatacaaatggccattacttctttagttttcatatgaaataaaggtagaaccctcaagcggacattttttttgggggggttacctttattttatatgttagaaatgaaaggttgcagtttcaatgacccacatgtatagagtaatcaattttaaccattctattcaaactcatgcattgggaaccgataaatataataaataatcccatcggaggttgtaagatgaatctgcaattctctctttcgacgaatgcggtgagtggcaaagcaaacggcgtaagccaacatagcgatgctatagcaaatcaggatagccagcaaatacaggccgtgagaaatggatcagaattaagcaagctcgaaaggcagggagtttcattctccatgggggatgaacagctcattaaggcaatagatagagccgttaaagctcttcagggacctacaaccacgttagaaatgagtgtgcatgaaaaaacacatcagatcttggtcaaagttctcaataaagacactggggaattgattcgagagattcctcctgaaaagacccttgatttagtagcaaagatgatggagattgcagggattcttatcgatgaaaaagtataaggaggaagtgaaatgcgtataaatggtttctcaggaatggatatagacagtatggtgacctctttaatgaccgcgaagaagtctccattaaataagctgaaccagcagaagcagacgttagagtggacgcgtgatagttaccgtgaattaaatactaagatcgttcagtttagcgataagttgcgcgatttaatgactaagtctgacaaaatgaacactcagaaatcgacgttaactggtaatacaacggctattaaagcggaagctaatgctgatgctagctctacacctatgtctgtagttgttaacaagttagcaacaaagtccaatatgcaaacctcaacaggcctacgtacagccggaagcagcacggcagatgccactaaaaataccacattggagcaaattgcaggtggcagtgcgtcagatacttatgagttgaatatcaatgacaaaacaatcacttttcttaaaaccgatacaatatctgcggtgatgggccgcatcaattcagaaggggcgaatgtaacagcgacttttgatgaaatcagtggtaagttctccattacagctaaagattatggggataaaaatgatattaaattaactggtgctgataagcaggttaaaagcagtacgcttatggatttattccaaattagttctacagatgtaaaggcggctgaaaaaggggaagttatagtaacgaatactgcagattcgagttccaaaacttataatcctgataacaattcccttgtcgttaatggagtgtcactgactctgttagagaccacgggaacgactggaccagccaaaataacaacccaatcagatccaacaaaagctatggagaccattaaatcttttgtggatacttataatgacctattaagtacatttaatacgaagctaagtgaacaaaagtatcgtgattttcctccactgacagccgatcaaaggaaagacatgaaggaagatgaaattaagcagtgggaagaaaaggcgaaaagtggtcttcttaaaaatgactccattttaagttctgctgtgtcttctatgcgtatggttatttccagtaaattaggcgatttaagttcggttggtattactacaggtcaatatttcgaaaatggtaaattacaaattaatgaagagaagctgaaagccgctttgacgacaaatccggataaggttttgaatatattcaaagggtcgtctgatgttgtaaacagcaagcctctctttagcgaattaagaagtaagcttgatactacgttagacatgtttgtaaaaaaagcaggtacatcaaaattcgatacaaatgctagtatgaccttaaaggctgacagtataatgggaaagcagcttaaaaactataacagcgatattacagagatgaccaaaaaacttgctgatgctgaaaaacggtattataagcagttttcggctatggaatcggctatgaacaagtaccagtcgcagtcgtccagtttgacaagctttttacaatagtttagaaaagggtgattcgtttgatctcatctccttatgaaaaatataaacagtcttcggtgcagacctctactccggggcagctcattattatgttatatgacggtgccattcgctttgtaaaggccgggcttgatgggatatcatccaatgatattgttaagactaatataaacttggtcaaagcccaaaccattattagtgagctaatgtccacattaaactactcgtatgatatttccaaaaatttatatgctttatatgagtatatgaactatttattgattcaaacgaatatcaagaaaaggattgagtcaggtgaagaagtcctgggttatctgcaagaattacgtgaaacttggattgcagtgaacaagctaacggcaggtatgtcattgtcaacggaacagtaagctatgataaatgacgccttatctcaattagagcaactaacccaacaattcatacttcgactgaatgagacaaattacgaggaagttgagatttttgtcgaagttcgtcaaatgaaggtggataaactgctgagtgtcttgaaaaatacgcctatgacagcggagcaaaaacagaaattagagtctattctaagccacgatgcaataattgatcagcatatgcaatcgctaaaacaggaagcccaaaattggcttgtccaaagaaatatggccaaatcgcaacgcagtgcttatgaaactaactatacgcctgatagctttctgatggatcgtaggaaataaatttaaaaagctctcgcccaacacgttttattgtgtggacgaaagctttttttacatttgtaaagccgtcactaattgagtttaaacgaagagaaagacctatacaaaaaaatctatcaatttattgtttcaggcactaaaatatagtttaaaacatgatcagtaagtctactttagtccaagttctaatagttcaaggaacaaagttgttgactatttacccattgtattatatatggaataactatacatgaaaacattatcaattccaattgacaatggataactttgggtggtatagtcggaaatgtgggcgagagcttcacttcatttgatgacgaagggaatgttagtgcatgcaaggtaaagtaaaatggtttaacgcagaaaaaggttatggtttcattgaaacatctgacggcggcgacgtatttgtacatttttccgcaattcaaacagaaggcttcaaaacacttgaagaaggacaagacgtggagttcgacattgtcgaaggcgcacgtggaccacaagccgctaacgtaaccaaattataatcatccccggcatagccgacctacataattggtaagatggttagcaatggataacgcgctagcaactgccctggaatatattccagggcttttttatgttatctaattacataaaaaagccccttacccagtggtaaggagcttaacacaatagaacttttactctaaagaaccgtcaaagtcagccatctccacgaaaatggtattggaggaggcagattgtttctctacgcttccgtctggatagcggaattgatagcgcaggataacctgggcgatcagatacgcgcggagcgcagattcgatgtcgaaagagaatacgatgactgctttgtggtttggatcaagccgacctaacggaataccttggagcaggttaggatgcgaaagtggcacagaattcacggtgacagttcgtagcaaaatgaaatcttcggctgcaaatggtgcagtgagcaagagctcttccagtggggtgtttccgatgttttccacatggacggtaaaggacagggtatcttcttggccgacacgcaaagcgctggagctaagcgtaagtttagggatggctgcaataacggtcacgccgacggtgttggtctgggaggtttcctgaatggtctctcctccactacgacgtgaggtatattcgatggtggcctggttgctgaatgttccatctgcaggtgcttcacggatttgtgcctgtaatgtaagggtgagcgtctcccctggtgcaatatccgggagcgtgatacctgcagcgagattagcgcctggctgtgctttttcttgaatagtcaggctgttgggtacataaatgagtccatgcggcaacgggtctgtgaacagcggatactgcgctgtgattccccctttgttagtaatctgtatggtgaaggtgagtgtgtcgcctacagaggcatccgtggtactcacctttttaactaattcgagcagtgggaatacaactgggatcgtaacggtattggtattcaatgtccccgatacgactcttcctccaggtaacgtaaacgagtaggcgaaggtagcttgatttacgatgtagccggatggaggcgtctctaatacggtcacttgataagtcagtgtcaatgactgtccgggttccacagacccaaggctaacaccgacagcaggatcgactcccgacagtgactgaccattcaactgtatgctgtcaggaatcaatagagtcccggcaggaatgaaatgttgcagtgtaacttcggatgttacgttgccaaagttgttgagcagtaccgtataagtaaggctttctcctgcgatggcctctgtattttccgtagagatacttgcggcaagctgtggatcaaaaacagttatggtcacggtattgctggtaacctcgctcgcaccgtcactgccagcatattgacggagcattgatatcaatttgaatggcattggcatttacagtgtaaatgtcgccatttgttgtcagctggaggacacctgtagtttggctgttgagcagcgtggaggaaatatcgacattggtaatgtcccaaccttgccttccgcccgtcacctgcgttccaggtgccccattcacggcattaattgtaccgaaggtcccggtcgtgaccaatgtaccgtcgtctccgtttatttgagaagcgaaaaaattagttgaaaaattattaggcccagacagcgcagtcaaactggatgtggtaggtccaaacaatgcacggtcaccagtgatgtccacgtcaccctcttgggcgctaatcagcgccctaccgcgcaaagtcccctgtacgggcgtggcaaagccactcaccaccacattgaccgagcctgtagcggtactgaccccttcaccaccaacgcgtagcgacaggttacggaagggcagagatgggttattgtacaccacagccagcgtccagccggcatggttggtgttggtggaatcgggaaccgtgatggtgcccgtcacatttccgaccgtatatgtccctgcaccgccttgaatgactagatttgtgacattcgctgttctcacataggtactgagactggtgacgttgactgatgttgcagattcaggactgaccgtagtagataaagcaggtgtctgaaatgtgaccgggttgttggtgctggataatacattggtactgccgttcgcataacttcctccccaaataagctcagcgtacagcaccgtactgcccacaggaagcacaaggaatgctgtcgatgagttactggtaaaggcagaagtcgtaccgaatggatacgtgccgaagcgagaggctgtattggttgtgatgaaagcgccaatgctggtcgctgttcccggcactcctaccgaattagagcgtgccagcccaagtgtattccctagacagcccccgtctgattcgttacgtaacgctgaataaaagccatggattagcttcctactttccatctcttccaaatccgttatcttgggatctccgtataggaagagccagctaggctgggtgtaataatcctttcgtataaatggcctgcgttgtaaccaggcattgcataccgcacaagcccatgtacctgatccagcgggaaaagggcaccccctttttcgataaaatcacttagcatgaagcccaaaataattgtttgttatgacgtcagcggagcaatttttatatatgcacacattattcacatatgtatgcaagtcaaatttaaacagacttgttttcaaagaatgacgttatgggaagcgttttagcgaaaaaagaagaactttgtaaaatagcttcgaaatgttggtctctttttttacttggcgttaacatatgtgctatactgaaggggcaaaggaggcgtgccctatgaacttaacagtacgaggtcaacagatcgaggttaccgacgctttgaaggactacgttgataagaaattcagcagacttgaaaagtatttcgatgcacccccgacgtctgatggaagtgtaacgttaagcacaaccagagatttgcacactgtagaagtaaccattcctttgccggggcttgtactccgtgccgaagacgagagcgatgacatgtatgcatccattgatgccgtggtagacaagcttgaacggcaaattcgcaagcacaaaaccaagctaaaccgaaaattccgtcaggaaggtagtttgaaaaccctttttgtggaagatccggcaggtggcgtggctgttgctgaagatgaggatgtagaactggatgagctggaagtcgtccgcaccaagcgtttcttattgaaacctatggatgtggaagaagctattcttcaaatgaacatggttggacataatttctttgtattttccaatattgacaacgcggaagttaacgtagtttacaagcgtaatgatggtaaatacggtctgatcgaacgggaatagcctgtgaagtaggaacttttcacattttaaaatgaatagaacgatttcgaatgaagcatgcttcatggatattaggaaaatgaaaacaacacgagccttatccttgcgaatctggcgggataaggctcttttatatgtttttttgtaaatgtaaggaaaattcaacttggataagtgtaaccaagttgtgtatctcgtgcgtcaattgttttggtatctttaaccggatgcaaatctggaggctgcttgtgttgcggcatgtcctacaaactgttacaatttatgcaaagaacatcgcacgatgggctggtacagccgggcctgtcaaacatatcgggaatcaatttcatcatggaccctttcttattgtgaaattgattctattaattgttttgcgtgaaaggggtaaaccatgctaggaattgttaagaaaatcttcggagataccaatgaacgtgatgtcaagcgtttaatgaagacggttgaactgatcaataagatagagccggatttcgaaaagctctcggatgaggagttgcaagcgaagacggaggaatttaaagctcgggtcgaacaagggactacggctgaagaaattttgccggaagcttttgcaactgttcgtgaagcgtccaaacgggtgctgggtaaacgtcattatgacgtacagttgctcggcggtattgcgctgcatgaaggtaaaattgccgaaatgaaaaccggtgaaggtaaaacactggtaggaacactgccggtttatttgaatgctctgttgggcaaaggcgtgcacgtggttacggtcaatgactatttggcgcaacgtgacagcggagaaatgggacagatttataacttcctgggaatgtccgtagggctgaatttggccaatatggatcatgccgccaagcaggaagcgtatgcttgtgatatcacgtacggtacaaacaacgagttcgggttcgattatctacgcgataatatggtgctttacaaagagcagatggttcaacgtccgttgtacttctgtatcattgatgaggtcgattccattctcgtcgatgaagctcgtacaccattgattatttcaggacaagctcagaaatcgacagagctgtatttcgcggccgaccgttttgtgaagagcctgaatgttgaagaagattacacgctggatattaaggtgaagtcggttgcattgaccgaaaacggcgtatccaaagctgaaaatttctttggtctcgaaaacttgtacgatcaggaaagtgttacaattaatcatcacattgtacaggcattgaaggctaatgctattatgcgtttggatgtggattatgttgtagctgacggtgaagttctgattgtcgatgagtttacaggtcgtctgatggctggacgccgttatagtgatggtttgcatcaagccattgaagcgaaggaaaacatcattgtacaaaatgaaagcatgacgctagcgacgattacattccaaaactatttccgtatgtaccgcaaattggcggggatgacgggtacagcgaaaacagaagaagaagaattcaaaaaaatatatggtctggaagtgctccaaattccgacgaatcgccccaaccagcgtgtggatatgcctgacgtagtgtacaagagcgtaaaaggcaaattccatgcagtggtagatgaaatcctggagcgtaacaaaaagaaccagccgatattagtaggtacggtttctattgaaaactcggagcttctttctgaaatgctgaaacgcaaaggcgttcgtcacaaagtgcttaacgccaagtatcatgctgaggaagctgagattatttcccgtgcaggtgaagctggcgcagttaccatcgctaccaacatggctggacgcggtactgacatcgtactgggcgaaggcgtatcagaacttggtggtttgcacatcatcggtacagaacgtcatgaatcccgtcgtattgataatcagcttcgcggacgtgcaggacgtcagggtgatccgggttccacacagttttacttatcgctgggcgatgagttaatgaagcgttttggtgcggacaacgtactgaatatgatggagcggttgggtttcgaggaagaccaacctatcgagagtcgtatgattacacgtgctatcgaatcagctcaaaaacgtgtcgaaggcaacaactttgatcaacgtaaagtcgttctccagtatgatgatgtaatgaaccagcagcgtgctattatttacaagcaacgccgtgatgtgctggaatcagagaacatcaaggaaattgtgtttgacatgatcaagcctgtcattgagcgtgtggtggaagctcattgcggtgatgacattcctgaaaactgggaacttgaagaagtagcagagtatgtgaacaacaacctgcttgaggaaaatacacttacacgtgacgacctgtggggcaaggaaaaagaggagatcgtggatatgatcttcgaaaaagttaccaacagataccacagccgtgaagaaatgattggcgaagatatggtacgcgagttcgagaaagttatcgtactgcgtgcagtcgatagcaaatggatggaccatattgatgctatggatcaattgcgtcaaggtattcacttgcgtgcttacggcggtaccgatccgctgcgcgaatatcaatttgaaggcttcgaaatgttccatgctatgattgctagcatccaagaggaagtagcgacatacatcatgaaagcacaaattgaatccaatcaagagcgtcaagctgtcatcgacgaagacaaaatctcgacgagtggtgaacccgcggctcctaaaaagaaatccgctccttcgcgtccgcgtagaaaataacggattgaaattaagggagagatcttgagatacactattccctgcagtgcatataatggcaggcggcagttcaaccactgaccgtcggccattttgtgccatacaggggtgagactgatgtgttcaacttatagctcttctgttggaggatcagtttgaatattgatgaatggctagattgctctcaattcttttaaaacaattatgacaagcaagcaggtatctgcttgtttgtcagttaattcagcagttaatctggctcacataaccagagccagttatttaaaaagcagtttgactttacggcgtttacggcggtcggtagcgaagcggaggatttgaatctggagaagcgtcagcgttcgcctttgcagtgagatgcccacctttgaatgtgttaatccaatcaagggcatctcactgcaacagcgatcgtaagatcaaatcattcgcgcagcgcctacccaccagcccgtaactcataacgcttttactccccctaaccatatattaaaaggagaatgacatcatgattgatccaagtgtaaagcatgatttacgagaaataggcaagaaactaacaaaccttagggggtctctttgacttagatctcaaacaggaaatgatcgcaaactttgaagtaaagatggctgcacctgacttttgggatgataatgataaggctcaaggtgtaattgcagaaatgaacgctgttaagtcatcagtagacagctatgaacagcttcgtcaggaatatgaagacgctggtatgatggctgagctggctgatgaggaaggcgatgaaacactggctggagagatcgagaacagtgtcacttctctgctgagcaagcttcaggagtttgaattgcaattgcttttgaatcagccgtatgacaaacttaatgccattttggagttgcatccgggagcaggcggaactgagtcccaagactggggacaaatgttgctacggatgtatacacgttgggctgaaaaacggggctttaaggtagagaccctggattatctagcgggtgatgaagcagggattaagagcgtaacactattgatcaaaggttataatgcctacggctatttgaaagcggagaaaggcgtgcatcggctggttcgtatctctccatttgattcctccggccgtcggcatacatcgttcgtatcctgtgatgtggtgcctgaaattgcggatgatgtggacgttgagatccgcacggaagatcttaaaattgatacgtaccgagccagtggtgcgggcggtcagcatattaatacgaccgattcagccgttcggattacgcatttaccttccggtattgtcgtgacctgtcagaatgaacgttcccagatcaagaaccgagagcgtgccatgacgatgctccgttccaagctctacgagcgtaagatcgaagagcagcgtcagcaattggacgaaatccgcggagaacagtctgatattgcatggggtagccaaattcgctcctacgtgttccatccatacagcatggttaaggatcaccgtactagcgtggagactggcaacgtaggagctgtcatggatggcgatctcgatccattcatcgatggttacctgcgcagccaaattaagctggacgcagaataatagcctgtacgttttcctacagtccgcagaccatgtgcctgcggactgtaggaatttttgtgtaacggtattttttaactaaaggagaacacgaatgatgtttcaattgaatcctcccgctgcccgccgaagacgacgcaagcctctgattgccgccagtggacccgcacgcaacgtgaccgatattttgctgattatactcggctctttcattacagcgctgacctttaacatgttcttgctcccaaaccggattgcatccgggggtgtatcgggcttgtcaatcttgggcgaggacctgtttggcctggaaccagcctatacgcagtggggaatgaatattccgttatttatcgcaggggtcctgctgttagggaaaaaatacggtttgcgttctttgctgggaagtattatgctcccgctgttcgtttatgtgacgaaggactgggcagtaccgacaacaaatccgttgctggcttcgctatatggtggaattggagtaggattgggtttaggtaccgtgtttcggggcaggggctcgacgggtggactggctattttggcgcagattattcaaaagtatacgggttttagtctttctctctgtgtcatgttgatggatggcacggtgattacactggctggtttcgccctctcgccggaacgggcgctgtatgcattgatcggcttgtttgtaacgggcaaggtcattgatgccgtggaaatgggactgagctattccaaagtggcttacatcatatccaatcagaaagaaacgatcacgcaggctattttgcaggatttggaccggggattgacagagctggcgggacggggcggttacacgaacgaagaacgtcctgtgcttatggttgtagtcggacaaaacgaggtaactcgccttaaaacgctcgtccgcttggtagacccagaagcctttgtgattattagtaatactcgtgaggtattgggtgaagggtttaagaaggaaagctgaaaccaagagagccttctggaggcatgctcttaactgaatccatgcaggagagcccactaatgtagtgggctcttctctcttcagaatggctttactagctagattctttttactaatcgttcaagccaatttgccgtttgtccttgattgaaatacgaggttggcgtcccttttacgcctgttttcaccatgaatagaccgcctgctaagggttgatcggaactatcatcatcttgagcagtcgtaatatataactcatccagatgttcaccgccaaaagcgcacgaagtcacacaattgacggggagtgacacctcagcaatcacttctccatgagcaggatggatacgggagacacgtttaccgccccatctcgcgatccacaacatgccctccgcatcgattgtcatgccatctggatacccttcactttcatccaatctagccaccagttgcttattcctaatcgtaccttgtgccacatcgtaatcgaaggagacaacctccaatgttggagtatcaatgtaatacatcatacgatgatctgcgctccaggctaatccattagatatggaggctttatcaaccagtaaggagacatggccttttgtgctcaaactatacaatgccccttgcgcgtgttcgtcatttaggctcattgttcctgctaaaaaacgccctgcaggatcgcattttccatcattaaaacgattacctagtctaccttcctcaggatcatgaatcaatactttggcccctgtctcaatatccaaacaatatagaccactaatcagcgctacgatcactttatttttgagataaggtacaactgcaccaatatgttcaccaacatctattgtacgatctgtacacgtagagggatcatagatatgcaattgaaaaccttcaatatcgacccaaaataaacgctgaaaccgctgatcccagctgggcccctcgcctaactttgcttttgcatctataacgatattcgcagtatatgtttcgatgtgaagcactcctaacgttttggtttattttcgacctcaattatccgcttcagcggctcctctgcgcagattcactagatgcaacccatgtgatttgctcttgtgtgtagtgctacgtgtactcccttcatgttcaacaagttcataaagtgcagcaaatgaccaatcgagatgaataccaatatgtgaaataatttaaagggaatatcccccttttctttatgcaaaacggcagactgtattcaagaggccctctgtttattttttatttcctttattatagcctgtactgcctgcccgtcaaaagaataggtaagagcgcatattttaaatttggaggaataacatgacatgaggtgttgtatttatatgaatagagtcgtataataatacatatttcatagggacggaatggaggaaggtctgtgagcagcaagttaaaagtggcaattgtcggttccaccgggtatggcggggtggagctgattcgttttttggttcatcatccgcaagtagagattgtatctgttatttcttcatccagcgcaggtgtcccaatcagtgacgggtttccacatctgacggacattgtggtgcaggatttggacggtgtcgaagtccacgaaattgctgccaaggccgatctggttttcactgctacgccatcgggcgttagtaccaagttagtgccgcagcttcttgatgccggactgaaggtcattgacctttccggggacttcaggcttcgaagcggggaaacgtatgaagcatggtataaaaagcctgcggcttcacccgagtatctcaagcaagcagtatacggactcagtgaggtgtatacagaaaagctggcgggcgtttcttttatttctaatccaggctgttatccgaccgcaacattgctgggcattattcctgcgctgaaagcggattggattgaccatcggtcgctgattgtagatgccaaatccggggtatccggctcaggtaggggcacaagcctcgtttcgcattatgcggaaatgaacgagaattttaaggcttataaggtgaataagcaccagcacatccctgagatcgaacaggtactgggtgatattaagggcgaggacgttacgattacgtttacgacacagcttgttcccatgacccgaggaattatgagtacaatttatgtcacgctgaagggtgaccatacaaatcaggatcttatcgggttataccgggattattataaagggcatccttttgtccgtgtacgtggcgaaggtatatggccagcaacgaaggaagtattgggttcgaattactgcgacatcggttttgcagcagatgctcgaaccgggcgccttacgattatttccgtcattgataatgttgtgaagggtgccgccggacaggcgattcagaatttaaatttgatgatgggatgggaggagaacctcgggctgggcttcataccggtatatccgtaagtagcaagtaacgcaacatggatacggaaacgtcagcgagcggaatttcgaatacaggcagctgtcattcatcgaatatgttgcgaacgagggcacataattatgggcaaagtagagtttacagtagtaaacggaggcaacatcgtaactccgcgtggctttacagccgggggattacactgcggactgaaaaattcgaaccgcaacgatatgggcgcgattcgttgcgaggtagaagcgacagctgctgcggtgtacaccaccaatgtgtttcaggctgcaccgctgaaggtgacgcgcgagagcttggcagatggtcgattgcaggcagtagtggtgaacagcgggaacgccaatgcctgcacgggacaacaaggagagcaggatgcctacgctatgcgttcggctgcggctcatgaactgggtgttgctgagagcaatgtagccgtcgcctcgacgggcgtgatcggcgagcatttgaaaatggattgtgtgcttgacggtatatcctccttacctgaccgtatgaacggggcaaacgatggagcagagcaatttacgcaagccattctgacaacggatttagttaaaaaggaagcgtgtgtggcggttgaagtggacggtgtgaccgtacacatcgccggggcggccaagggatctggcatgatacatccgaatatggcaacaatgctcgcttttatgacctgtgatgcagcgatcggacagacggcgcttcatcaactattaaagcaggcaacggataccagctttaatatgattacggtggatggggatacgagcacgaacgatatgctaatcgccatggcgagcggactggctggcaatcgtgaactgcacgtagggcatcccgattgggatgcttttgccgaggcgttcacctatatctgccgagagttggcgaaggcaattgctcgcgatggagagggtgctacgaagctggtagaggtgtctgtaagcggagcggtaagcgatgcatccgctcaagcgatagctaagacagtggttgggtccagtctggtcaagtcagccgtcttcggagcagatgcgaattggggacggattattgcggccgtagggcgtgctggagagcccgttaatccagatacggtagatattcgcttgggtgatattgttgtgctaagccaatcgagtccggtcgcttttgacgaagaagaggcgctagcctatttgaggggagatacggtgcaaattattgttgatttgcatcacgggaacggaaccgctacagcatggggttgtgacttaacctacgattatgtgcggataaacgctgcttatcggacatagagaccagaataaaatacggattgaataaggatagtagataatagaaacaacgagcggatggaagtccagtatcatttgaaaattgcacggatatgcagagaagaaaaggagagatgatatgcaatcggcagtggaacacgcggatcaagcgaatcatgcgggagtggcacgtcgtaattttgtgatgaaatgcggaggaagtacgctggctgcgttacctgattccttttttgaagatttggcgcgtttgcagtcggaaggtcttcaacctgtcattgtacatggcggtggccctgcgatttccgacaacttggcgaagctggggatcgaaacagagtttattcatggattacgcaaaacgaccgaacctgtgctggatgtcgtggaaatggtactggcaggcagcattaacaagcagattgtacgtagaatagggatgcatgggggccgagcgttggggttgtcaggcagtgatggctatttaatcgaagccaagcctgtgtcgaatgccgctgaggtcggttgggtcggagaggtaacgtccgttcaagcctcgattattacaggtgtactggatatggactatatgcctgttattgcacccatcgggattgatcgatctggtcagcgttacaacattaatgcggatacagcggcgggtgcggtagcctctcatctgggggtcagtcggatgatcgtcgttacagatgtaccaggcatattgaagaagtatggcggagaaaagaaagtgctggattctatcaccgtacaggagattgaggatatgatcagcacaggtgaaatatatggtggtatgatcccgaaagtgagagcggctattgcctgtatccacggcaaagtgaaggaagtcgtcattgtgaacggtagcgaaccgcaggtactaagccgtgtgctgggcggagaatcgatcggaacacgcatcgtgcgtatgcagtaattgcaatatatagctcgacctatataaccaaacgataaaggagcgtgaacataatgagtaaggaaccgaatacgctggtgagcgaggaaatgccaagtacggatggaagcggagtgcaaacggaaaaggtgtcggcaaaagcgcagacagaaagctccctttttccaacctacgcaagatacccgcttacactggtgaaaggacaaggaagctggctgtgggatgatcagggcaagcgttatctggatttcatgtcaggcattgccgttaccaatctcggccatgcgcctcaagcagtagctgaacgattgaaaaaacagatcgatgaattgtggcatgtatccaatttgtttcatattccggggcaagaacgggctgctgccttgctgacagccaatagcagcgcagatgccgtgtttttctgcaacagcggggccgaagcgaacgaagctgcaattaagttggcgcgtcgttaccaccagaaggtaaagcagaccggtcgctacgaaatcattacgttcacgcaatcctttcacggacggacgctggcaaccttgaccgctacgggtcaggacaaagttaaagagggctttttaccgcttcctgccgggttcaaaagtgttccgcttcatgatcagacggctcttgaagcagccattagtgagcatacggcggcaattatgctggaaatggtgcaggccgaaggtggcatgtatccggtagaccctgctttcgtagatgtgattacaaagctgtgccgcgagcatggtttgctgctgatcattgacgaggtacaaacaggtatgggacggacgggcaagctgttttcctttgagcattatggtatagagccggatatctttacattggcgaaaggactgggcagtggtttctctgtgggtgcgatgctaggcaaaggatatttgcgtgaagcgttcacagcgggcagtcatggttctacctttggaggtacgccacttgctatggcagcggttcaagctactattgaaacgattattgatgacaagctaccagaacgtgcagctgagatgggagattaccttttccatagtctgcaaaagcagcttggagatagcccttttgtaaaggatatccgtggaaaaggtctgatggttggtattgagtgtgcggaaccggtagcggagcttgttttggcaggacagaagaagggcattctgttcattacagcaggaccgaacgtgattcgtctgttgcctaacttgtatgtaacgaaagacgaaatagatcagggtgtaaccttgattgctgaattgattcgggagcatgtggcttagtgtaaaggccaaattatcatagactagagtgtaaaaggagacgatagcatgagccagagcggcgcactgcagcagatgaatttgaaaggacgggacttcctggagctggacgattactctccagaggaaatccagtatttaattgatctcgccattgaaattaagcgtaagcacaaaaacggggaaacttatcagccgctaaaagggaagacgctcggactgattttcgaaaaatcctctacacgtacacgggtatctttcgaagtcggtatgtatcaattgggcgggcatgcccttttcctcagcaaaaatgacattcaactgggacgcggcgaaccgattagcgacatggctcaagtcatgtcacgttatctggatggcattatgattcgtacctttgggcacgataatgtggtagagttggcacgttatgcatccgttcctgtgattaatggattgagtgatttggcgcatccatgccaagtgctagctgattatcaaaccttgtatgagcaaaagggtaagctaaaagggctcaaattggcttacatcggagacggtaacaatatggctcattccctcttaattgggggagcaaagcttggagtgcatgtgtccattgcaagcccagttggatacgagccggacccgagtgtggtcgcagcttcccgtgaaattgccaaacagacagggagtgagatcgttataacccagagtccgcaggaagcagtacaagatgcggatgcgatctacacagatgtgtgggcgagcatgggctttgaggaagagcagaaggagcgggagcttgcttttgccgacttccaggtgaatgaggagctggtcaagatggcgaagccagattatttattcttgcactgtctgcctgcgcatcgtggggaagaagtaagtgcaggcgtaatcgatggtccgaattcggtcatctttgatgaagcagagaatcgtctgcatgcgcaaaaagcgctgttagttgctttaatggcataaggttgataggtattgataggtaaagaagataaaggctagaagcattcggggaggacttcaacaatggcaaaagaaaaaatcgtactcgcatattccggcggtctggatacgtcggtcattctgaaatggctcaaagaaacttatgatgctgaaatcatcgcattcaccgcagatatcggtcaaaaggaagaactggacggtttggaggaaaaagcactcgctacaggggcttccaaagtgtacattgatgatctgcgtgatgaattcgccaaggattttatctacccgatgtttcaggcgggtgctttatatgaaggacaatatttgctcggaacgagtattgcacgtccattgatcgctaagcggatggtcgatattgcgattgccgagggagcaacagccattgctcacggggcaacaggcaaaggtaacgatcaggtacgcttcgagctgaacgcggcggcgttgacgccggatatcaaggtgatcgcaccttggcggctggaagagttccgcaatcagttcccgggccgtgcagaaatgattgcctatgcggaaaaacacgacattccggtaactgcttctgcagccaagccatactccatggaccgtaatctgctgcatatcagctatgaaagcggcgtgctggaggacccttggtttgatccaagtgctcctgaaaataaaggaatgttcttgctcagcaacgcgcctgaggacgctcctgatgaagcagaatatttggagttggaatttgaagcaggtaactgcgtcgctttgaatggagaacagctaagtccattgcaagtgatggaaaaattgaatgagctcggcggcaagcatggtatcggacgtgtggatatggtagagaaccgttttgtcggcatgaaaagtcggggagtctatgagacgccaggcggtacgatcctgttcacagctcaccgcaaaatggaatccatcacgatggatcgcgaggttatgaatctgcgtgatagtctgattacccgttatgctaccttggtttataacggtttctggttcgcaccggaacgtgtcgctttgcaggccctggttcatgagagtcaaaaaaatgtcagtggtaccgtgcgtgtgaagctgtacaaaggcaacgttatcggtgcaggcgttaaaagcccggttagcttgtacaacccggacattgcaaccatggaagccgacccgacacaagcctacgatcaaggcgatgcaacaggctttatccgcttgaatgctctgcgtttgaaggtcaacgcgggcgtaacacaaaatcataaataatgatgtaacctaaaaaaatgtacgggatgcgggccgttcttgtccaaacgacgagggcggcttgtattgcagggaggggatcatacaatgagtaagctatggggcggacggtttacgaagcaaacgaacaagttggtagaggaatatacggcttctatcgggtttgaccaggcgttggcggaagaagatattcaaggcagtttggctcatgtggccatgctggggaaatgcggaattattccgcaggaggatgcagacacgatcaaggaaggactgcacacggtcctggagcgtatccgccgtggggaaattgaattttccgtttcggatgaggatattcacatgaatattgaaaaaaatctaattgaggccattggtccggtcggcggtaagctgcacactgggcgcagtcgtaacgatcaggtagcaacggatatgcacttgtacttgcgaggacgtgtggtatcgctggtgggtatgctgcatgacgtacaagctgcattaatcggccaggcaaaggataatctggacacgattgtacctggatacacacacttgcagcgtgcacagcctattttatttgcacaccatctgctggcgtatgtgtctatgctggagcgtgatattgaccgactcaaagacagctataagcggattaacgtgttgccgctcggtgctggcgctttggccgggaccacctttccaatcgaccgtcactttgtagccgagcagctaggatttgatggtgtatatgaaaatagcctcgatgccgtcagcgaccgagattttatcgtagagttcctggctggcgcctcgctgattatgacgcatttgtctcgtctgagtgaagaattggtgctatggagtagcacggagtttggttttgtcgagctggacgatgctttttgcacaggcagcagcattatgccgcagaagaaaaacccggacgtaccagaactggtacgtggtaaaaccggacgtgtctatggaaacctggtgggtttgttgactgtattgaaatccttgccgctggcatacaacaaggatatgcaggaggacaaggaagggatgttcgataccgttgccacgctggaaggagccttgcaactgttcgcaccgatgatcgccacgatgaaggtgaacaaggatcgtatgcgtcaagcggtcaatcaggatttttccaacgcaacggatattgcggacttcttggtcggcaaagggcttccgttccgtcaggcgcatgaggtcattggcaaaaccgtactgtattgcatccagcatggaaaatacttgcttgatctgacactggacgaattccagcagttttcggatctgtttgacgagcgtatctatgaggtacttcaaccagaagcggtagtgaatgcacggaatgtatatggaggaactgctaccgggcaggtacaggcagctattgggcgcagtgaacagctcctggagaatacatcaacatggtttgaagggcacaagccgaaaaattaatcagtaaagaaagatattattctcttgcatagcagcgggatgctgtgtaaaatcaaattttaaggaattagcaatctaagtttcaaaggcaccgttcgcggtgtcttttgtgttttttagggtgttaattcatagttccaaatacctataaatacactggtgtgaaagtttctagaatttacacttttgtatactacacctatgatgattatggtagaatagcactaagtttttcattgaattaccaattcaatagggcaagaactatattcaataaataaatgtcaagttactaggggctcttttgctcaggcgaatttcataaatgtgtaaatgaagggtttgaatgagaacagaggtatgtcctggtttcgggagaacggcaagtaaaagctttaaagtagcgacgtagcagaaggcagagtcgggatgatccagggaggtattatgagaactaaaaggacggcgcgtcagttaaagagcgcttggatcggttatcgcgcttctgaagccgatcaactgatatcttcattgcatgaggaacgggtgcaagcggaggagttactgcgtgaggagcgggaacttttccacgcggcgctggaacggaaaaagcagcgggatgcggagttaaagcagctgcttgcggatgcgcttgcggaagagcggcgctggattgaaagggcgggaattcatgggtgacaagcttaggtggcaggttggaggagtttcaattcgccaaaccaagagaagaataaaagaagagcgtcagcgaatcgaacaactgcaacaacagctagaggctcagaggtcagagcaggccccggtgctatacaagcttgattttcatatcgaagagttggaacggcgacttcaagatacagaacttcgtatccaggcgatacagaacgccaatgatacagcagcagctgtggaacaattgctggatgaagggttacaggatggacaagtgcaggaggctcaagtccaatatgcatctgggcaggaacagacagcagcaggagctgctatgggcgttacttccagtatccttggtacggaaggcgaagaggccgcaacaggaacgcagagcggacgaaacggcaaggcacgtctgggggatcaactggtggagaacgggatgatcacccgcgatcagctgacagatgccatccgcaaccagaagcgttacggtggcaggctgggcgatattcttgtagaaatgggcttcattacagccgagcagctccaggaacaggttggcggcgacgagtccaaagagcgcctaggcgatatgctggttcgttccggctatatattgccggaacaactggagcgcgcactggagttccaggcgaagagcggtgggctgcttggtgacatcctgctctcattgcaaatgctggaacctgcggatttgtaccgcgcgattgctacacagaaccgaatcgggcgtattggcgaggagctcgcgctggatgcggcgtacaaactacccgagcaagtggcaatggcttatggcgtggtcgtcatccatcaatatatgaaccgttatattgtggcggtcagcgatccactgccagaagagcgacgcttgaagctggaaggaattttgggtatgccggtagagcaggtgcttgctacgaaggaagagatggagcaactctggggtaaaatctacggtgaagaaatgatgcaggagagcacgaccgggctgttggaaaaagaaccgcacaattcggcgcggacgacttttacaaagggacaactttgggtgttcgcggccatgggtatgattacactgctcggcctcttgtggaacagttggaaaacggtgttgatcatcaatatgatgattcagctgttttattttgcgatgacgctatttaaatttggcattatttatctcggttcccggcgtggggcgcagcttcgtttcacgaaggaagaggttgacgccatggatgaaaagaaactgccgatctataccattctggtacctatgtataaggaagcgggcgtacttccgatgttattgcggaatttggagcagctggattatccaaagtccaagctggatgtgcggctgctgattgaagaggatgacattgagacgatcgagctacttcgggaaatgaagctgccggcctattacacgacactggtcgttccagacggtttgccgaaaaccaagccgaaggcatgtaattatggactgattcgggcacgtggcgaatttgtcgtgatttacgatgctgaagatcgtcccgacgctgatcagcttaaaaaggtcattgcagcgttcgattcactccctgagcattatgcgtgtattcaagcgaagcttaactactttaatagtacacaaaatttgctgactcgctggttcactcaagaatacagtatgtggttcgagctactgctgccgggtattatgcagttagataccccaattcctttaggtggtacatccaatcattttcgggtatctgtattaaaagatattaatgcgtgggacccctataatgtaaccgaggatgccgatctgggcatacgtttgtataaaggcggctacaaaactgctattgtcgattcccgcacatgggaggaagctaacagccgcgtgggcaactggattcgtcagcggtcacgctggatcaaggggtacatgcagacatggctggttcatatgcgcaatccggttaagctggtgcgcgaagtgggctggaaaggctttttcggctttcaggtgatgattctggcaactccgatgttgccgttgctgaatccgattttttgggggttgcttattttatggtttggctgggaattgtcctttattcccaagctgttcccggggtatgtgtattacctggccagcgcggaattttatatcggtaactttctgttcgtattcagtaatgtggccggaatgtattgggtcatcggggaactggaagagcgcggtgaacgaacattttcatacgcgatggtcaaatacgggctactctcaccgttatattgggtacttatgagtatagctgcggtgaaagcagcttggcagctcattaccaagccgttctattgggagaagacgacacatggtctgaccgatatgcacgacttggacgatgctccggcacagtcatcttgaatatgaagaaagaaggagcaagcatggagacaaaaacaccttttttatctgtcgtcattcccatgtataatgaaagctcacatctcgagcgttcacttaaggtgatcgatggggtactgtctgttgtcacttcacgttatgagctcatcattgtagatgatggttccaaggatgatacgtggctcaaactgtctgaattgtcccgtcgtatgccctctttgctcgcgctccggctgagtcggaacttcggtaaggagctggcattgtgcgcaggtctggaaaatgcctctggcgatgcaatcattgtcatggacggtgatttgcagcatcctcctgagatgattggggaaatggtacgtttatggcaaaatgaaggttatgatttggtcgaatgtgtgaaagaatttcggggagaagagtcggtgggcaaaaagctcggtgcttcattgttctacgcgaccctgaaccgcttgacgggctttaatctcaaggatgcctccgattataagctactggatcgaagagtggtggatgcctggatggcgatgccagaacggatgccgtttttccgcggaatgacggcctggctcggtttccgtaaaacccagatttcattccgggtggctccacgcgaagaggggccaagccgctggagtccgttagggctgattcgactggcagcggaagcgatcgtttcgttttcgacagtaccgttgcgggtagtaagtctgatgggcctcatttttatgctgatttcagtcgtattggggattcagaccttaatgcgcaaattaacgggtgacgctgtgaccggttttaccactgtgattttgctgctcttgattattggcagtgtactcatgctgtcgattggagtggtaggagaatatattgccgccatatatcacgaagtcaaagctaggcctcgctatctgatagcagataaacgggcgaatgctgaccgattgtgggtggacagggagtttaatcaacatgatcagacgttcatatctaaagtatccaatcattaaatacggtattgtggggttgctaggtacaggtatccatgtgggtgtgcttgtgctgctggtggagttgtttacggtaccagcagtaacggctactacaatcggattcgtggttacattgctcgtttcgtatgtgctgaaccgaaactggacgttcgagcctaccggcgagggaagtcgcacccagtttcttaaatatttattggtctgtacctgtggcttgctcttaaatgctgctctgatgtacgtgaccattcactggatcggttggtcgtatctgatcggtgaagtactaactaccatcatcgtgcctgttcataattatttctggaaccgctactggatcttctccgttccgcaacagcgtcagaaagaggtttcatgattttaagaaaacacggaaaatttctatcattgtttgcttgtattactgctcttgaactggccgtgggcgtgtattttgcatggtatcttggttatatgcataccgatgcgctcagtcgagtggctaacgcattttatgtgctatacagtcgtgacccacacttgggtgctatcgggtttgtatggaatcccctgcccagtttgatggaactgattgtgctgttgttttatcctttatttccaggactcgcttcccacgggctggcggcagtgattgtgagcagcctgtttgcaggggcgagcggggcattattgtatgcgacgggcaaacagttggggcttcacggtgcaaccagcttgctgattgcgctattattttcactgaatccatttatgtttctgtttggcttcaacggtttaagtgactcgccatatatctttttcatcctgttgacagtgagtcgattttgtatgtggttgaaggaccgcaaggcggcgaatttgatcgtatccggttttgcgcttgcactggctttttgggtacgctatgaagcggttccgcttggcgttgcgatggctttgggtgtattgctgacgatcttttttctgcataggtggcgtacaaacagagagagggttagaacggaattgtctttaaaagagcgcctgtacaaggtggaagcgacatggcttctattgttgttgccacttgttttttccggtctgctgtggctcttttttaactggattatcatgggcgatccgctttactttttacgctcgcaatattccaattccacacaatcagcggctttgttagaggatcaacgctttgtggccatgtttgcccaccctgtgctgatgctaaagtttatcgggcaacgaaccttatggtatgctgctccgttgattgccattttgctcatacgtttgttggacaaacgtctgttgagttggagcacgcttacgctattagcaatctttttatcggtgcctggacttcagcttttgctgatgctcaagcagtcttcttttgggtggttccgatattttatgtatgtgttcccgattacggttgcctggttgccgtatgagctaagtttattgaagggaaaaatgagggggatcggaatctctctggtaacagcaggaatgttggtaacagcaggcttgttatcctacgcactgacgaaccccgcgattgcagcagatgaacacagctatttgacgcatagtggtaatgaaagctacgaacgtcaaattattgagcggaaaatagcgccgtggctggatgagcattatggtacatctctcattttgacagattcttatgccgcctatccgatcattttgagcagcaaaattccgaagaagtttatgattacgagtgattttgattttggggaatctttaatggatctgcctgcttccaaggtggattatgtgttggtcacgcgcttggtggatggggtgccgctggatcaggtaaatcggaactatcctgatttgttcgaaaagggagcgtcgtgggcctcactggtacatgactttgacgggcagtggcgactgttcaaaataaagcatgaagaatcgaaataattattatattttagtgcatcgtagcggagggaagaatacagctgtagggtgtgagtgggctacagctgtatcaccgcaagaagtttgagggggaacgagaggaatgtcctttcgcaaatggtctgcaagcagatggatggctataggtctgtttgtatttatacttgcgttggagttgtctgcgggcatctatttaagctatgttctgggatatatgcacacagacgcgctcagtcgcgtagctaatgcattttatgtgttgtacagccgtgacccgcatctgggcgcaatcggatttatctggaatccactacctagtcttctggaaatggtgattctactgctgtatccaatctttccggcattagccacctatggattggctgctgtcattcttagtgctacctttgccgctttgaccgctatgctgctgtatcgggcgggggtcagaacagggcttagctcagggatgagcatcatgctggcactgctgtatgcactgaatccgtttattttactgtttggtgccaatgggctgagcgattcgctatacatatatttcattatgatgacggtgattgagtttgcattgtggctcaaggatcgcatgacggcaagtctgattgtttctggattagcgcttgccatggcgttctggactcgttatgaagcggttcctctgggcgtggcaatggcgggtggagtggtattggcgatcctgtttctacatcgaaacatgggcagacgtgagctggccttgcgagaaaaattgcacaaggtcgaggcaacttggttactgcttctgctcccggtggtcttttccgggctgttgtggattttcttcaactatctcattatggggaatgctttttacttcctgaattcggagtattcgaacacagcccaatcggcagagctgctgaatgatgataagtttgtagagattttctccaatccgctggtggccttgaaatttattgcttccaaaacactctggtattcggtaccgttgtttgctattctgttcattcgtctgttaagtggacgcttgttccgatggggaacactgattattttgctgctgttcctgtcagtgccggggttgcagtttttactcatgatgaagcaatcttcgtatgggtggtttcgttattttatgtacgtgttcccaattactgtagcttggttgccctatgagctgagccagcttcagggacgatggcggagggcagcctttggcctggtatccgtcagtctgctgcttaccgctggattactttcctatgcgttgactcgcccggatattgcaccggatgagaacagctttctcacacgaacgggtaatgtgaactatgtgagacaggagtcagatcgtaagattgccgtctggttggatgagcatctgccgaagtctaccattatgaccgattcggcctcagcctacaccatgattgtctacagccaatatcccaaacgcttcctgatcaccagtgattattcgttcaataaggcattaagttatccgcaggataaccatgtggattatatccttgtacctaagatcatgtcaggcatgccactgagtaaaatcaatatggtatatccgaatttatatgaaaaaggcgctccatgggtccagcttgaacgtgagtttaacggtgagtggcgcttgtacaaggtgctacccaagtcactaactaaagaatctccatcgacggagaccacgacaaatccgtaatgtgcaaaaaaatccccgagcctatcccttcgccatggtgcgatgagggaagctgcggggatttttttaacctgtttagtgctctttgagtggtagccacgccagtacatcctgaattttcgcgtcccagtatccccattcatgagccccaggaccttcttcgtaggtcagcggaactccggtagtattacatgtttcacggaaagcctgatttcccttatataggaaatcctccgtgccgcagcattggtaaagccggggaagcgaggtccccaaggcagcatgacgttgtaacagttccagcaagtcgtgatccgttccacgtatttcatctggaccaaaaatgttaagccattccgctggactcatcgcattttgcataggatcggtgcgtgatgcgtgtaaatccatgactcccgaaaggctcgcagcagctgcaaaacgctctggatgctggagtgccagtttgaaagcaccatatccacccatagaaagcccggctacaaaattgtcttcacgcttgtcggacagaggaaagaatgaacgtgccaaagccggcaattcctcactgacaaaggtccaataagccgctccttgctccatattcgtatagaaactccgatgtacctggggcatgacgacagctaggcccaatgaggcgacatagcgttcaatggaggttcgacgcaaccaggttgaatcatcgtccgacaggccatgcagcaaatatagcgtcggatgtggcccggttccttgcttgccctccagtccaatttgcgaacgggttgcctgaggaagaataacattcatggatgtgctcaggcctagaacttccgaataaaactgacattgaataagagccataagaagacctctttcctagggttttgtgacctcattgcggtgttccagcatatgaccgattattcattcagtataccttagcctgtctaaatatacatatccaagtgaataactaggtattaagtcccgtttcttatttatcctacattaggtgggggtatggttatatgggacgatttttttaatttgggggttatttgggtttgatttctggtaaagtgtttaaaaaagaatgatgaatccaatcagaggaggaatttatagcatgggaaaaaagttaagaaacacagttacaggtgtattgagtacaggtcttattcttagcgcattcagtgcagcggcagctgctccccaaactacaagtggacattgggcgggagatcaggtgcaacgctggtcagccacagggcaattggacggggcggtaaaaccagatgcggcgatcacacgtgccgaatttattgttcttctgaatcgcagcttgggaacgttcacacaggaaactccagcagtgacagacgtaacatatgcgggtggtgtgaaagtaaatggtaatggaagcagaacgttcacagatgttccagcttcgcactgggcatacaacgagctgacaagtgccgtgaatgcaggctacataagcggctatgcagataacaagctcaaaccaaatggtaaggtaacacgtcaagaggctgcggctatcgtaggcaaagctattggactgactgcgggtaatgcagcagatgttactaaattcattgactccgacaaaattgggtcttgggcgaagaaaagtgtagcagcagctgcggagcaaaaaatcatcaacggttatccagatggtaaattccagccactgaagtcgctgactcgtgcagaggcgattgctattctggacgctgcttccggttacaacctgagctctgtcgataatctgacgacgactcctggtggaacggtgacggactccacatacagcaacgtgacagattccacttatggtaacacgtcaactacttctggcagcgaaacaggagatagcagcacaagtaccagcacagatagcacgactacggacaactctacaacaatagataccaacacagataccgacacaactacggatacgactacgactacagatagcactacagacacagttgcaactacgggagcactgaaagtcaacaatgtgtatgatggagaaggtacaattacggggacagctaaagcaggttccacagtaaccgcctattccaacgaactacctatcggtagtgcagtagccaaagatgatggcacatttagtatcagtgtgcttactcaaaaagcaacggttaggctggtaatcaaagctaaagatgcagatggtaacgaaagtgagcctgtagaaatttctgttttgggtaaacgcagcgagtaatttatagctgaaatccccctttcactctgtctggaacaagtccagccgacagtggaagggggatttttcgtttattcgcttataccgtcctcgacaatagatttctcgggttcacgtgtttgtggctcagacgatgtgccaccgccataactagctataatgcgttgctgcgctcgatacgtatcgcggctgattcgggtgcgatctacagtttttccgtctaccttttttacccggaatgtttctaccacatacccttctttgccctgccgaagtacttgatagaagccgggggaaagtgagtcattacggagtctcttctccggtatgggaagtatgcgaactgtatgggattccagttcatacgaaacattggatggaaatgtaccaaaaaatttaacagtaagcgttcggttttggacagcggcacgaagcagtaaatgcttgcctgtattgtttctaaaacgaaaattaatggaccctgtagcaaaagtcgcatcttgacctttgggtaggtagctgactggcaaagaatggttgcggcgctcaacaatgtccaagccgactcgcagcgctgcattatacactgtgctggatacctgacaaatcccgccgcctatgccagactccaactgaccgttgacgatcactggagcttcacgaaagccatgagtgcgctcagccttggcaatcaattgaccgtagtcgaatatgtcgcctggcttgagaattagaccatcaacggtgcttgccgctgaattaacgttatacacgcgtccttccgagctactgccgagactggtggagaactggacgattttgcgctcaatcccttcgttccgtagactgtccatcgaaatgttcggttccagcttacggaaaggtaattccactcgtacgggctcttccgaatcggtaaaatccttgggtagcgccttatctagtgcggcgtccaatctgggccaatccaggcgtcggacagaacgccccggaatataacgaacctggtcattcccgtcaatctgacgcacagcattgataggcatgccgtatcgttgctcctcccaatcggctccgaatcgggcccttaatatctcctcctgtcgaaaagatgtgatagaccattccttttcgaagctaaaacgtgtctgcacacgagtccatagatgctccgagctgagtgccttcacggcattccgaaatgcctccgctttataatgaatccctgctgccccgagtgtaagttttatatcctgtgcactgctgtcactgtccgtcagaagcagtggacgttgctttaatgcatccaattttttatccaccagccgaagagcggctgtgtgatccatgcttcctacgttcattcctccgaccctcactccctccggcagcgtttgtctgtcggcgtacagatgaagtcctccccacaacatggccagcgccagaacaccagaccatatccaaatgacagataaatgaatttttttcataatgcagatgtctcctgtctgataagcttgatagcgattcgtgtgccataatattcatatatatgtgccaaaagcagaaaactttcggtactatttaggtaacaaatttgttacaatgataaacggtatgatgaaatagagaagtttttaaaggaaatgcatggaatatgtcgaatggatattaggttatgcgtaatatgattaagcagcgggaagtgatcgagtgattgaaatgcaggatgtgtggaagacctatactaacggaacccacgcacttcaaggagtatcggtcagaattgaccgtaatgaatttgtatacgtagtcggcccgtctggagcggggaaatcgacttttatgaagcttatttatagagaagaagtacctaccaaggggcaaatttcagtcaatggttttaatatcgggaagctcaagcagcgtaaaattccctacgttcgtcgtaacatcggagtcatttttcaggatttccggcttttgccgcgtttgacggcttatgagaatgtggcttttgctatggaagttattgaagctcccaagaagctgattcgcaaacgggtgccagaagtgcttgaactggttggcttgaaaacaaaaatgaatcgtgagcctgcccagctttccggtggggagcaacagcgtgtagcgattgcacgggccatcgtgaacaatccttccgtgatcattgccgatgaacctacgggaaatctggaccccgaaacatcgtgggagatcatgcagttgctggacgaaattaattttcggggcacgaccattgtgatggcgacccacaataaggacatcgtgaactccatgcgtaaacgtgtcattgccattgaaaatggcaacatcgtaagggatcaggtaagaggggagtacggatatgacttttaacaccttcttacgtcatgtgcgggaaggtttcaaaaacatattccgcaatggctggatgtccgtggcatccgtcacctcgattattgtgtcattacttatattgggcgtatttatcatgctggtgctcaacgtcaattccctggctgatcaggcagatagtcaggtggaggttaacgtatttctggagctaaatgtagagcagaacatgcgtgaaacgctgcaaaaggaaattgcggcgatgccggaaatcagcaaaacgacctttgtgactaaagctcagggtttggaggagctgcgcaaagatttgggagacagcggcaaggagctgctggagggttttgacaaggacagcaatccactcccggacaaaattgtggtagaggtaattgaaccaacaacggttccatttgtggccgaaaagattgagaagctgaatacgttgcatccagagaagccgattttaaaggttcgttatggaaaaggcaccgtagagacactctttacaattacgaagctcattcgtaatgtaggctttatattcgtcgccggactggcgatcatgtccatgttcctcatctcgaatacgattcgcgtgaccatattggcacgacgcagagagattggcattatgaagctggtcggtgcaaccaacttttttatacgctggccgttttttatcgaaggcgcgcttattggtctcattggttcccttattactgtaggtattttatttactggctatcagcgtttgctgaccgccgttcagggcgatatagctctgaatatgttgaagcttatgccacttgaaggcatttggattcagttgagtgcattgctgattattttggggatgctggtcggaattgttggcagtaccctgtccatgcgcaagttcttaaaagtataaaagaagcgttgactggacgtcgtgttcgatatcaattagaacggggaagcccggtgttattttgcgataaaggatggggagtgcaagttgaaaaaaacaggatctgtgttggccgctaccttggtagccgcattgctaatccagccttctgacggatatgccaaaagcatgagtgaaatcaattcgcagctgaaccaattggaaaagcaggcccaatctgccaagcaacaacaggaaaaggctgctcaagataaacagtatgcccaacattacaaaaataaaaccgtgcaaaacctgaaaattgtgcttgctcagattaacagcgtcagtgatcagctgactcgtgttgcggttcagattgatcaaacggaagataatctgcgtgcgactaaaaaagatttagccgaggccattgatcgtatccagtcacgggaaaaaatgctggaaacccgtgtgcgcttgatgtatacggatggaaccgtctcatatatggacgtgcttatgtcttcgtccagttttagtgactttctcagccgggtagattccctgaaaacgatcgtggagcaggatcaaatcctgttggacgagcataaaaaggacaaggcattggtcgtaagcaagaagaaacagctggacacggaatataaaaatgccaagaagctgtatgcgctcaagcaggacgccaaagcagaactgaattcgaaagagaaagagaagcaaagactgatttccaattacgatcatgatatagctgagtcagatgaaatcagcgaagagcaaaatgacatgctggtagcactcgctaacaaacgtgtgggtctggtgcaggagaagaacaagctcagagcggagcaggctgccaaagccgcacgcgctagagcggctgcacgtgcggctgaagccaaacgatatgcatcttcatcctcaggtgccgcctcgaattccagccatgcggcagccagttcgtatacaggtggatcaggcacattggcttcgcctgtatcccattaccgactttcatctacttttggcatgcgggtacatccgattactggcaagcttaaaggccacacaggtgttgatatggcggctccgcagggaaccgatattcatgcagccgaagatggtgttgttattgttgccgaatggtggagtggctatggaaacacagttgtgattgaccatggagacggactatggaccctatacggacacattcgcaatggcggtacggtggttcatacggggcagactgtgaaacggggtcaaaaaattgcagaagttggttcgacgggcaattccacaggacctcactgtcattttgaggtgcgcgaaaataacaaacctgtaaatccgatgaactatttatagtagataaggtaagccctatttatagccattacggttgtagatagggctttgctgtaatggttaatatccgatgaagaacatgtgcattgagacaccgagtaggatacaattaacatattccgtacaagctagacgtatacttcgtggatggatatgcgttgtaaggcaataggatacaagataatgagaaggcggtggacgattagatgttgaaaaaaagtacagcgatactcttgatggtgatcgggctgcttggcgggagtctgctcacttttgcctatactggaacgactacagtagggaacagcgctctgggcgaaggactgctggcgagtgtgacaggtagcagttctacctccagaagtgatatccgtaaaattgagacggcgatggacttgattcaaggacaatattatcaggatgtggatcgtaccaagctggtggatggcgccatcaatggtatgatggagtcgctcggtgacccgtattcctcttatatgggtaaagaaactgcacaacaattcgagcaatccatagaaggttcctttaccgggatcggagccgaagtagcggccgaaaacgggaaagtagttgtagtcacgccaattaaaggctccccggctgaaaaggcagggttacgctctaaggatattattttgtctgttaatggtgaaacactggacggattggatctaaacaaggccgtttccaaaattcgtggacctaaaggcagtcaggcgaaagtcaaaattcagcgcagtggctctcctgatccgctcgaatacacgattacccgtgacaacattgatatggaaactgtaacggctcatatggaaagcgacggtgtaggcgtcatcacgatcacccagttctccttaaatacagcagaacgcttcaaggaagagttagcgaagctcgaaaaacaagggcttaaagggctcgtcattgacgtgcgtaataacccgggcggcgtgctttccgtcgtcattgagattgcacagcaatttgtaccttctggcaaaacgattgtacaagtggaagacaagaatcagaagcgtgaagaagagaaatccaaaggttcacgcaaaaattatcctgtgactttgctaatgaataaaggtagcgcaagtgcgtccgaaattctggcaggtgctctccagcaatcagcgggtgccgtgttgattggggaaaattcctttggtaaaggtactgtacaaaccagctatgacaagcaaatgggtgacggtagcctgctcaaaatcacgattgccaaatggttaacgccaaatggaacgtggattcataaaaaagggattaagccgaatatcgcggtggaacagcctgaatacttcacagcagcaccgctgaacaaggaaaagtccctgaaatacaatatgaatagcagtgatgtgaaaaatgcacaaatcattctacaaggcttgggttacaacccaggtcgcgaggatggctattttgacaaagtaactgaaagctctgttattgcttttcaaaaacaagcgaagctgacggctagcggcatcattgatgcgaagacagcagcagcgatggaagccaagctgattgagaaaattcgtgatccgaaaaatgataatcaactcaagcaggggattgaagagattcggaaggaaatgaagacaagcgtagcgaaataatagtgaggctacaacaagggggctggaaacagcctccttttatattgggatttatttgcagtctgtcggtttgtcttccctacgttggcaatttcatatagaataaatggatatgaaatgtacgtgatccgctatacagcgggccaggggcataaggagtgtgaatggacttggaatgggcattacaatggggatggagcatcttaaatgcttgcttgtacctgcttttgcagccgttttattatatctcaatactcattgtagcacttggttatcgtcggcaaatgctgctggagcgcaagctatttcataccaaaatgcatagctgggcttcagagacctggcgtgtcgtatggagtggtttgcttgctggaatggcgctatctgctctgggaatgttcgtcagcgtgcatctgaactcggcttccatcgtatgcctgtgggtagcgacattactgctcatgctggtacgcgtccgttacctgtgtctcgcttattcggtaggtctgctaggtgtggttcaatttttcctaaacgtggccagtggctggcaacctggaggagcgctcggaacatcagtagcagctatccgcggattggatattccagcactgttggtgttggtcgccgtgctgcatgtggctgaggcgctgttggttcgctggcaaggggggaaggcggccactccgctgtttgtcgagggcaaacggggaagattggttggcggctatcgtatggaagacctctggcccattccgttgttgttgctggtaccgacccagggaggattcacgcttccctggacacctttgttcggcggcgatgccggaaccgggtatatgctggcagccttgccagtcctgatgggcttcagcagcgtgacgctaggccagctaccacgacagaaggcggtacttacttcgaaccgtttgctcctgtacagtgtggctttacttctgctgagcttgctggctgcatggtggagtccgctgatattgttagcagcgttattctcctttctggctcatgaggcgctgatctggtatggtaatatagaggaaagtcgccttagcccgatgtttgtccatccggagcaagggatgcgtgttctcgctgtgctgccagacagtccggcgacagccatgggcatactgccgggcgaggccatttaccgcgtgaatgggattgttgtgaatacccgtgccgagttacaccaggccttgcggatcaactctgctttttgtaagctggaggtacgcaatctgcagggcgagagcaagtttgtgcagcgaggcatgtacgatggcgatcatcaccagctaggggttgtgcttgcaccggatgcagatgcgagctgggccgtatccatacagccagcctccatctaccggattgttgccatgcacataggcgcacgccaacgtaaagctggacaggcatcgcaggcagagggtgcacaattggataccatggacaaatagatgttacaacaagagggtagtcattatttgattagagtcgaataaagctacgctctttttatatgccgacagtagcctgcttgaaatcaatattctgatcggtatacaatgaatatgtaataagaagcgttgatgaaccgaatgcctatcatgtgtgtcaagcagggagaggaaaagatgaacgcgatccactttattcgagagtacatcaggcatccacgcagcgtaggcgctgttatacccagctcaagacagttggccaaacaaattgccacaccgatttactttgacaaagcatcgtgcattattgaatatggtgcaggaaccggtgtgtttacgcaagagttgattttgaacaagcgtccagaaacgctacttttagtgattgaagctaatgaatcgttttacaaaacgctacaaagcaagtacggacacttggagagggtacacattattcatggatcggctgagcatgtagctcagtatatacgacagtatgaggtcccaaaagtggattatgtcgtgtcagggctccctttcaccagcttgcccgctgcattatccagcctcattttgggacaaacggcggaggttttgggccaggaaggcaaatttattacgttccagtacagcaaggtcaaacacaatttttttcgcaccttttttgctgacattcagattaaaaaggtaaactgcaatgttccgcccgcttatgtgttcacttgcagcctgtaactttgcagtatgtagaggattagaataaatacgattgtgaatatacggatgattatgagaagacttggtcagtgtcattagatgctgaaacggtctttttttgttgtgcatttttatggatatataagaaggggatatgttaaaaagcaaaattcattaaaggaatcatattttaaaatggggcttaacctatatattacataagatggaacccgctagatttttgtaagattcatgataaatctgaacttttgttaaaggagatttatatatggtaaaaccgttgatattcatgcgttggtgtgagtactatgagttaagtgaccgtgagacggattttgtatctttttttatgatgaatttctcggctgcccgttcaggcaatcaaccgaagcttagggagcagtttgttgaaattcagaaaaaaacctttcctgaatacccgtttgatattaccccggaagaactggattactccaaattcgaaggcttgatgaagcaagtgttgaaaattcattttgacacggccgagctgctatactccttttatctccaaaaactgtgcgcacctttggcagaatacattttatccaccggagaatcagagcctgcacgcatctattataagcttattcaaaaggataaagtgcgctagggaagacgagtgtggatgagcaagagctattgggatacctcaagctatatggttatttaagaaattaatactagctaattaaaacaatagttaaaaatgtcaatatacctttgtgttaaggtaatattataaatccagtttcaaagaaagagggtgttgttttcggctggaacatttcaagcacggatatgacgctgcaacggaacgataagctcgtttggggacagggaaggggccttaaagcctcaaggaggggcattcgtatgggtgccgctctttttaaattgaagggaggaagcggcatgaaggcgaaaaatagtagtagtatttggtccaaacgttccaaatggctgcctgtcgtcatggcatgcacgattatagtagggggtgctctaccgactccaactgtagttcacggtcaaacggcaaagactgttaccattaaagtcgatacatccaaggatcgtaagcctattagcccttatatttacggtacgaatcaggagttgtcaggcgatgagaatctgactgccagacgacttggtggcaatcgaatgaccggatataactgggaaaacaatatgtccaatgcaggaagcgactggatgcagtccagtgatagctatttatgcgacaacgccggattgacaaaagccgaatgtgaaaagccaggtgcggtggcaacctcgtttcacgatcaatcgctgaagcagggcacatattctttagtcacactgccgatggccggttatgtggccaaggatggaaacggaagtgtgcaggaaagcgaaaaggctccttccgctcggtggaatgaggtcgtaaacgctaaaaatgcaccgtttcaattgcagcctgatctgaaagacaatcaggtttatgcggatgaattcgtcaactttttagtgaaaaagtatggctctgcttcaacaaaaacaggtgtgaaaggatactcgctcgacaatgaacccgctctctggtcgcatacgcatccgcgcattcatggtgaaaaggtcggagcgaaagagttggtagagcggtcggtaagtttatccaaagccgttaaggcggttgacgcgagtgcggaaatttttgggcccgttctttacggttttggcgcctataaagatcttcaaactgcacctgattggaactctgtaaaaggcaactacagctggttcgtggactattacctcgatcagatgcgcctcagctcgcaagccgaaggcaagagattgctggatgttttcgatgtgcactggtatcccgaagcgatgggtggaggcatacgaattacgaatgaggtaggcaatgacgagacgaagaaggccagaatgcaggcgcctcgtaccttgtgggacccgacctacaaggaagatagctggatcgctcaatggaacagtgaattcttgcctttactgcctcgattaaagcagtcggtgaatcagtattacccgggaaccaagctggccttgaccgagtatagctatggcggcgaaaatgatatttccggcggtatcgctatgaccgatgtgttgggcatcttgggcaaaaacgatgtttatatggcaaactactggaagttaaaggatggtgccaataactacgttagtgccgcttacaagctttaccgcaattatgacggaaaaagctctactttcggtgatatcagcgttaatgcgcaaacgtcggatattgttaatagctcggtgcatgcttccgtaacggatgcatcctacaaagaactgcacctcgttgtcatgaataaaagcatggacagtgcattcgacgcccaatttgatctttccggtgagacgacttacggttccggtaaagtatggggcttcgacaaaaatagctcgcaaattaaagaagcagcgccaattacgcaaatttcaggcaaccgctttacctatacagtaccgcctttgacggcttatcacatcgtcttgactgctggcaatgatacgtctgtgccacctgtggaaggtcctgaaagttttgcgctgagggctgaggctggcgatgggaaagtcgatttatcctgggacgcttccagcggagttgtaagttacagtgtacagcgggcaacgtatgaaaacggtccttttgctgctgtaacatccaacttggtcgaaacgtcttatacggatacgaacgtaacgaacggcacttcttattattataaaataaccgcactaacaaaggcgggaacgagcgaatccaatgttttgaaagcggttccgcgaacgcctgtagacggaccggatcgctatgaagccgaagatggcacgctgaagggaaccattgtggaatccagcggaaccggcttctccggtactggttatgtaactaatttccacaatgcaggggattccctgacgatgacgatccaggcagaggcggcaggcttgtacaatcttacaatcggctaccgttcgcctcatgatgacaaacgtacgaatttctctttaaacggcaaagcgtctggcgagctggtactttggaaatcggctgattttaaagaaacctccggtggtaaggttcttttgaatgcaggggcgaacacgatcggttttgaaacaggctggggctggtatgatatcgactacgtcaagctggagccagctgctgaccgtccaccacatgcggtaaccaaaacgctcaccaatccgaatgcgacggtagaagcgagagcattgatgaactatctggttgatcaatacgggaagaatatgctttccggtcaagaggatatacccgaaattgattggcttcaagccaatgtaggtaaaaaaccggctattgcggcgcttgacctgatcgactattcgccaagcagagcggaacacggtcttagttccacagagacggaaaaggcgattgaatgggataagcaagggggcattgttacctttgcatggcactggaacgcgccgaaaggtctaatcgatacgcagggaaaagaatggtggagaggcttctatgccgattcgactacattcgatatagaatatgcgatgaatcatccagagtccgaagattataaattgcttattcgcgacatcgatgtgattgcagggcaattgaagaagttgcaggatgcgaaagttcctgtcctgttccgtcctttgcacgaagcggaaggcaaatggttttggtggggcgctaaaggtcctgagcctgttaaaaaattgtatattttgatgtacgatcgtttgtctaatgtgcacaaattgaacaatctgatctgggtctggaactctgttgctcccgactggtatccaggggatgagtatgtggatattttgagcttcgactcttatccgcaagcaggcgactacaacccgcaaattgcaaaatacgaagaccttgttacgttgggtaaggacaaaaagttagttgccatgagcgaaaacggacctatcccggaccctgatctgatgaaggcgtatcaagcccattggagctggttcgctacatggtatggggatttcttgagagacggcaaacaaaacagtcttgagcatctgaaaaaagtgtataatcatccgaacgtcattacgcttgaaaagctcccgactaacttaaaaacgtatggtattaccgagcagccatcagtaccgggcagcttcacgctgaacgcagcgggtgaaacggcgaaagtaaagctgagctggacagcatcggcgaatgcggcaagctatgaagtgaagcgttcgacggctgaaaacggcgctttcgccacagtagcgagcgatgtatacggaagcagctacatcgacatagccgtaacggcagacacgatgtactattaccaagtcgtagcgaagaacgatgcaggtcaaacggtttcgaacacggctagcgcaacgccgaaagcggatactcagcagccgacaacgggactggtgctccagtatcgcacagcggatacaaatgtgaacgacaatcacttgaacccgcatttccaaattgtaaacaaaggtacaacctccgtaccgatcaacgagttgaaaattcgctactactacacgatcgacggcgaccgcgcgcaaacattcaactgcgactatgcgacgctgagctgctcaaagctgaatggtaagttggttaaaatggataacgctgtaaccggtgctgattattatttggaagtcagctttaattcggatgcaggcgtgttagcacctggaggaagcacgggcggaattcaaacccgtattcataaagcagactggtcgcactataacgaaggtgacgattactcgtataaaggcacgcagacttcattcgccgatcatacgaaagctacgttgtatcataatggcgtacttgtttggggaaccgaaccgacagctaattaaaatgatataaatactatcgctgaaatgagcagggggatttagtatcctacctgctcatttatttttacgagaaaaatcatatatgattattctgtaaaaaatgaaatgatatgtttattttaatcttttttgtaacacatcaagaattagaatggaattagttagtagggaggagatgaaaaaatgaaaaaactagtattttggtgatgtctactgtctacaattgcttggaagtctaatgtttaatcagtaaaaatacttaaagaggagaaatgacaaatgaaaagagcgatcttagcactatcaatttctgcgttagctttatctttagggggagtagcatccgcttcaccagtaagttcaacaatatctgttggagctcctgccacagtgaaagtaacatttgtgcctgctaacggagaaaaggcacctattaaactgcaagatacagaagtacctcttggtatgggaagtgacttctacatggaaggttcaaactggatgcttttgtatggaagtaacgttattaagctcactggcaataaagctacagttattggatatggtacagcccaagtggcggcatataaatctaatggtgacaagttaggcgtttatacatttatagttaaaagataagctagtgaagaaagagaaatatactttcactttcttcactgaggctgtcgagattcctctcgacagctatttttatgagtttattggtaagctgatctctagatcagggaaatactcctttattgggttgccgtccttatccaattcaaactgacttttattcccttctttaaaaatgtatttataaactttaatagtaataacttttggaggggatataaagggttcaaactgagaatcagtcattagaacattaccgtctgttgcactccaacctttgcccccgatttgttttatttcatttcccttatcatcataaagttcataacttattaaaggtaaagtagagatttttaggggtttgggtaattcaatacgtgtagttatattagttgtaattggggtcagctcaatcttttccaatgtataatgaattttctcatactggcgcttgaggccaggtgtctgtactatgttgtttttggtattcttctcgacagggatatgaattttgaacggttgctgaacccctgccacgggcatggaaagtgttaaatcaaacttatctggaaaggattttcccccctggttacgtaaatctgagaactgtataattactgagttggagctttttccaggaatcatataaggatcaatggagttgcttgtattagcaggtgcataagagtttatttctttcccattaatagtaagtattatatcgttgatcagtgatgatactgtttcttttgtaaatcttttgtcagtggtttgtcgttctaaggcaatggatacacgtgttccgtcaaacatgacctctggtacgctgagagtcaggccatcgtgagtatcgctaagattgggctttgatactagccctttttcgtctgctgtttgtaaaccaagatcaccagcaagctggaatatagaatcaatacctggaatttgttttaaggatgcagccattgttggtgaaataaaaccagtactaactacaagtgcaaacgctactacaagtgcagcggaggttccgaaaaaagtattgcgaaccctttttgaacgagagttagagcgctcatagcgtcttgttttcatattaccatagcgttccatagttctatcaattaaatccacttggaatggggtattccgaataagcttttgtaagtgctcaatttctttatcttccgggtttaaatgagtgctcaatttgttttcctcccttttcattgtagttgattagctttttacggagtcgctcatatctttttcggatcgtggatgatttcagccccataattgtagcaatctcttcgtagttgtaatcctcaagcgaacgtaataataaaatttgacgatcttttaatgatagctgatccagtaactcgtgaattaaatttgtatattcgtgtatcggctgttgctttagattcagtttgtactgaatgaaggacttgaatgttctagcgtttctttttaataggtcagtacaatgattttgagcgattttgtaaagccaagctgaaaaagagacggtaggtacaaaatgatgtatatgttctagccctctaatgaatatttcttgagcagcatcttccgcttcttcccgatttttaagtaaatagtagcagtataaaaaaatctgttgttgataacgccgtatgatatgtgtgtatgcttgtttgtcgcctgcttggacctgctctatgacaagattgatatctgcgttttgattatttgtatttagcttttccattaacgtccctcccttctgcctatataactgaaaaagatatgcatttgtgacattcaactaaaaaaacttgaagtttgcttttaatgcttctccagatgtacctcatttaacttttcaattatcacgggattcattaaaaaaagacttccttctaaggcatcataaaataaaatgactttatagaccatatatttcactattttagttattttgtaatgtaatgaagttcttatggtcgagatcacatgttaagtatgacctacgatatatctgtaactatattgagggggattgaaatggaacatacacctacgatccgctcgacgatagagaccgaactcaagcagagaggctatacatttagcagctttagcaaaatatccggtattaaccgtggtacattcagtaccatgctgaacagtaacccacccaagccgatctccgttcggcagatggacttgattactaaggcattagggtatcccgaaggctggttgtatgagttatacatagatgaatgctttcacgaggggaaagggcactggaaacggatcaaaccttttttattgcgttgtgtggaattggggaggaaggagtgtattcaaaaggtgttgtcgagactaacggaggacttgtcctatgtgtcgacggtatttgagtttgcaaagaactgcataaaggggggaaggaaaaggaagctgtccctttttacgagtgtgtggtagagaacgaaagatattaccactcggagcgcctggctattagtcaatacaggttgtttcgcatacaattaggtaccaatgcagaggagaatttaaagctaactatcttattttctccttttctagatcgtttacctgaagtttatcagttggacgctttattgcaaatggccaatatttattcttctttacacaagtggcgtcaaaccattttttttagccagaagttgctggaactcacaaaacgtatataccaatatagagttgctaaagataatttaaatcatgaagaacttgagccgtattccagcgaacgatcattagtagtgtattatgggcaagcgttattaatgcaagctttctcactacaaaagcaagaattgtatcaggaggctaaaaaaattgtttcgagatacgcagatttaagttggttcaaaggtttggatgaggttggccaaagagaagttgaaaaattaaaaatgtatgcaacagctaatggatatgtactagatttattaatgggggataaaagtaatttagaaaagtatattttactactggaagagaatgggaaagagatattgccaggaattctcacattattagaggtggctaataagcaatcttttaatatagacaatatattaaagcgttttagtggttacattcaaaagttctctgaaaatgaggatgcattatatatggatgattattgtaattttaatttgcaactagccatctatcaatttaattttaacgattatacggctggaataaacacgattcttaaaaatataaaactggctacattggtaaataattcaagtgtatttgcacaatctattatattgtttgagaagtacaaaaattttgctacagagtgtcagtataatgaacttacaattcataaagagaattttgggaaggactttaattttgcgttttaagccaacgatcaaggaatatgaagtccattttgagctaacagtattatttgaaaatgaggtgctaacatgaaacatacacctacgatccgctcgatgatagagaccgaactcaagcagagaggctatacatttagcaccatgctgaacagtaacccacccaagccgatctccgttcggcagatggacttgattactaaggcattaggatatccagaaggctggctgtatgagctgtacatagatgaatgctttcacgagggggaagggcactggaaaaggatcaaaccttttttattgcgttgtgtggaattgggaaggaaggagtgcattcaaaaggtgttgtcgagacttaccgtggacttgtcctatgtaacgacgatatttgagcttgcagaagaactacacgaatcaggtaagaaaaaggagtctatccccttttatgagtgtgtggtagagaacggaaggtattatcactcggagcggttggctatcagccagtataggctattttcttgcgctttaaacaaagatctggagaataatcgtcaacaagctataaaatttgctatttatcgcaaaaatttgcctgaaaatcttcaactggatgctttattaaagctagcaaatgtgtactaccaagttgatgactgtgagacaactatacaatatacaagagaacttgaggtagttgccacaaatatttatcagcagcagattcaggctagattaaaaaaacgtgaagttaagcctctaaatacagaaagacatctaatcgtctattatggccaagcctatttaacgcaggggaatgcctacgagaaacatgggctatacaaaaaagctatgaagttcatcccctactatgcaaatttaactgattttgaaggtctagatgagattggcatgttagaggcacggaaatttgaaatgtgggcagaagaaaaccgcttgaatttagaaattctaatgagagatatgactaatttacccgcctatgtagaacttattaggaataatcctcaggaaatattacttgggttactaaccataatagagtcggccaatacttataatcatatgatagacaaaattctaattctttttgctgagaatattaatgaatttagagacttacgtacaaatatttcttattacaagacgaattataatctagtaaactattcctgtttttttcttgagcttagtcgctagtattttagtaagggaaactactctgatgcgattgatagtatgctgaacagtctcaaagcatcctcacaactgaatgataaagctttctatatcaagtctatcacgttgttgtttgagaaatacaaagaccgttcgacacatgaacaacgggcagaatatgaaaaaatacttaaagctgtcgagtataacataaagcaaatgacttcctaaaactttaaaaagctatgtgctctcttctgctattaggtagagaaacatagcttttctgacatttaaagagcatgactaatatggaaaatttaattttttacattagcatgtgaatcatctgagttactctctaaaagctcactctctgacgagaaaagttcctttaaaatccgataagctttattttgatccgcttcactctgctgggaaaggatatgaatgcattcccatatccagggctgacttttgagttctttaaaaggattaaaatcaaaaaatgcaaatacattggtgtctagcgcttcggctattttctccaaggttttaatttgtacattgacctcaccgcgctccaacttgccgatataggaacctgttgaatcggatgcttctgctaactgttcttgtgtaataccccgcaattttcgaaattgacggattttcgttcctaatagtttcgttgtttccatagacacccacactcctatagtaagagtgtagacaaagctagattaagcttggaggtaattaaattaccttaattattcgatatttagttcttgtaagaactattttaataaacatcaaattccataatataataaaacagtgtagaaaaggggttgaccgtcatccaatttattcatataatttctagtatattgtaattgattgtcgaggagggtgattttttaaaatcctctgaatacgccgggggtgtttttattggaaaatgcaaccacgatccgttcggaaattgagaaagaattaaaactaggtggctacacttttaatagttttggacaagctacggggcttaacaggggcatatttagtgctatgcttaacggcaatccgcctaaacctatctcggtaagacaaatggacttgattaccaaagcgtttaattatccagaaggctggttgtatgacctgtatgtggatgaatgtttttatgatggaagaccacattggaaaagggtcaagccgttcctgattcgttgtgttgaagtaggaaatctgcgatgcgtggagaaagtgctctcacgcttaatggaagatcttaaccacattccaacaatctttgctttggcagaggagctttatgaagaagggaagttaaaagaggcaattcctttctatgaatgtgtcattgaaaatgagaaataccaacattcagagaggttggcaattagtcattatagaattttttcaatctctgttagtgaaagtatggaaagaaatttggaggccgcactaagatttgtaccctttagaaatcgggtacccttagaatatcatttagatggtttgcttaaactgttaaatctttatcacaatttgcatcaatggaaagaagcggagcgttatgcggatgaattaagagcgcttacaactattgtatgtaaaagtagagaaactaataaaaagagttttacattgaaaactgaaaggcatttagttgtctactatggtcaaggttatttgatgaagggaattgcattggaaaaacaagaaagatatgaggaggccatgaagtatatttctggctatgctgatctgagttggtttgaagatttaggggaaattggacaaaaagaagtacaaaagttcaccctttgggcaaatgctaatcaacttagcttgaaaattcttatgggcgatacaagtagtttaccaatgtatattcaatttctgaaaaataacccacccgagattttgttgggtttattaacgatagttgagtcggctaacaagcacggttttttaattgaacatattctccaacagttttctcatgaattggcctcatttaataatgaattatctatgaaagccagctactataaacagtcatttagttatgacacttatgctgatttgtgttaccaactggccatatatatgtttaataacctttcccatgaaaaaggcatctattatgttttaaaaagcttgaagaaatgtctggaaatcagcagtaaagaaaagtttatgatttgtacagcattatttgaaaggtttagaaacaaagcaacaaaagaccaaaaatcagaatatgaaggtatcatggaggaggttttaatcaatgcgagtaaaaaaccttaaatacatgctgattatggttttttttagctttttagcattctctcataacattgttgtttttggacatggtgcaggaggttaatagttatcaaaaaaccagccttactggtcatacccctgtcaagtagacagaactaaaaagacatctttaagcggcaaccgtttctcggtattcaatcggggaacggttgtttaattttttctgaaatctattttcattataaaatgaaatgtactcccgtacgtgttgttctacctccgctagggttccgggtttcgttaaataaatcttctctgttttaagatgggagaagaaggattctatacaggcattgtctaggcaatttccacgccttgaatggctcccaagcattccaagccgcttgagtttgcggttaaacggcttggaggtatactgaaacccctggtctgaatggagaatgacaccctccatgttcacgttcttacttagaacgtctagcgtctcgctaactaaagcaaggtcatttcgttccgaaagacgccaagccacaatttcattgttaaacagatcttgaatgacagagagatatacaaaccgctctccagctcgtatgtatgtaatatcggtaaccagcttggataaaggagaatctgcctgaaattgtcgatctaatcggttggcatttaccacagatgcctgtttgccgaaaaagcgccgcttctttcgaatgacggaacggatccccaatttcttcattaggcggtacacctttttgtggttgaccaagataccttctctacgtaaagcaacggtcatacgcagataaccaaaatagggatgaatccggtggatcgacaacatatgcgattccaggagctcttcctcttgcttacgttgctggattgtttgctgagtctttctccatttataatatcctgcccgagaaacatgggctaattcaagtaaccatttcaacgaatatcgtgtacgcatttcctcaataatttcaaaccttgcttctttcctcgtcactccttgtgtagatttggatactgcttttttaaatattcaatctccgcccgtagatacgccatctcttcttccatactggaaaatttcgttttgggtcgtccctgccttgtggtcgttggctggaggttctccctcgctcgatgtttcatcacccagctttgcacttgggatttattacgaatgtccaattgtttcgtcacttcacgaatactcatatgttcttcgttcaccaaccggactgcctccatcttcacatctaaggagtattgccggaatgattgtccctttttagccatgaaaaatcccctccgttcaacaagattaagtccatcttaccagatgtcttttctctcttgtctactagaaggggataataccaactgaggctggttttttgattcatcccgttaaaggaatgaactgggttttattatatttttaacctgtagggaaggtatcagcttgtaaactaatgtaaataccacaccgaacaggaggtttattgatgtgaaatggaaacaattggaggaatgcatcgaagaaaagcggaaggaactaaatgatttggcgaatgaggtgggattgaaggatcggcgggtgttaatcaagtccatggagttggatcgactccttaataaatatagtgactggaaatatagctatcgcagacaacagagcataccccaaagttcacaaatgcaagagaagcaacacgagcttgtcctatcttattgattttcaagtatcatgacaagataaacctaacttcaccagggcttctaatacatagtgggatatagaataaacaaaataatctctattgcatctcgtacgccgctcttatccacgttgttcgtacagtttattgttctgcgtctacatcagaggggaagccatgtaacatgaagatatgtatcaaaaaaacctcccgattcacgttactgcgtgactcaaggaggtttttgggttttactgttgaagctggcgtaatacggtgatttcgacacggcggtttttttgtcgtccagcttcggtactattgtcaccaaccggtcgggtatctgcataacccgcatactgaaatcctgagggtgaaagttgctctctgtcgagaaagaatcggagtacagatagtgcccgtgcgccggaaagctcccagttgtccttatacgtcgatgagttcgaggagcgcgtgaacggaatgttgtccgtatggccctcaatgctaatcggtgttttcaaatctcgaaacagactggccaacttggatagcgtgttggcagagccttgcttgagtgcagctctaccttgatcgaataaaaagcggtcattcagtgtaatgacaataccacgcggctgatctgacacgaaaatctggttttccagtttgttgtccgtaatatattcttgaatgacacccattaaattttgcagctctttttcctgcgtgcggaatgcttgttcacgttcggtgagctttgtcgatccagcttcctttttatcggctgctggttgcttggtcgtgggtggattcttgctggtgtaacgatcggcagtacctgtaatacccgagccttgctccaaaatagaatctcccttgtggaacgtatcctggagggattgaacaacgacatcgtattttttagcatccagactactcatggcatacatcacaacgaaaaatatgagcagcagggtgatcagatcggcataggtaatcatccagcggtcacgatggtctccgccgcctccttgacccccacggcgcttaccgcgcgctctcatggaagtcctcctttggagaagcgtcatctgtgcgtgagcgacgaggcggtttgtgatctatattttgctctgagcggataaagaactccaactttttgcgtacaagctttggattctctccgttttggatagccaaaataccttgcagcagcaaatccatagtgataatttcactctcactggcagctcttattttggatgcgatgggcaggaagatcagattagcgctagcaacgccatatagtgttgcgataaaagcaacagcaatggacggaccaagcgcagtaggctcggtcaggctgcccagtacatggatcaggcccatgacagtaccgataatccccatcgtaggggcataaccgcctgcggattcaaatattttggcgtatccttcatgtttgtgttcaatggcatctaactcaagctctaaaatctgtttgatctgctcctgctcggtgccgtcgatgaccaactgaagaccttcacgcaaaaatgcattcggatgctctgatgaagtacgctctagcgcaagcacaccggatcggcgtgaggtggtagccatggaaaccaaatcttctatatattgcttcgtaggattgtcctcacggctaaatgccatccgtagggcggtggggatcgtcttcagcttggaagctgggtagctgatcacaactgcggcgaaagttcccccaaatacaatgagagccgatgtaccttgaagcagccctgtaaattcgccgccttcccataagaagccaccgattaatgctatgattccggcgatgatgcccaatacgatggtgatatccaaaatttaattcactcctattcaagacttatcgtttgcatccatggtaagaaagaggtataatacgggaacaaacattcttatctaaccatatttcccaagtatcattgctcgggaaatatcgacatagagttacaggtaaagacgttaaagctcgactggtgtaaaatcatgatgtttccattttagacgataagggtgatgcagggcaatgagtgatatcgttgttagcgataagacttttgaaattcagtcggaattccaacctcaaggcgatcagcctcaggccatttttgaattggtagagggaattgcagaaggaaagaagcatcagacgctattgggtgctacgggaacaggtaagacgtttaccatcgcacagaccattgccaagttgaatcggcctacgctggttattgcacataataagactttggctgctcaactggcgagtgagtttaaagaattttttccgaataactcagtcgattattttgtcagctactacgattactatcaaccggaagcgtacatcccgtcttccgatacgtatattgagaaggattccagcattaatgaggagattgataaacttcgccactcagcgacaagctctctgtttgagcgtcgtgacgttattattgtagcgagtgtctcctgcatttatggtttgggttcaccgaaagaatattcaagcctgctgctttcgcttagagtcggcatggagaaaccccgcaatcagattttgtcccgcttggtcgatattcaatatcagcggaacgatatcaacttcgtgcggggtactttccgtgtacggggggatgttgtggagatattcccggcttcccatggggaacatgctatacgtgtagaactgttcggggatgaaattgaacgaattaccgagattaatgtgcttacgggtgaattgatcggtgaacgtgatcatattgccattttcccggcatctcacttcgttactcatgaggatacgatgaaggtagcattggtcaatattgaacgtgagcttgaagagcggttaacggagttgaaggagcaagggaagctgttagaggcacaacgtttggaacaacgtacccgctatgatatcgagatgatgaaagaggttggtttttgttccggcgtcgagaattattcaggtccactgacattccgcgagcgaggtgcgacaccatatacactgatggattatttcccggatgatatgctgatcgtcattgacgagtcccatgttacgttgccgcagattcgtgccatgtataacggtgaccaagcacgtaagaatgtactggtagaacatggtttccgtctaccatccgcattggataatcgcccgttgaagtttgaagagttcgaggacaaggtaagtcagatcatctatgtatcggctactccaggaccctatgagatggagaaatgcgaaacgatggtacagcagattattcgtcctaccgggcttcttgatccgattattgaggtgcgtccgagcaaggggcagattgacgatctcattagtgagatacggcttcgcatagaacgtgaagaacgggtactggtgaccacacttacgaagaagatgtctgaagatttgactgactatttaaaagaagtaggcatcaaggttcggtatatgcactccgaaattaagacgttggagcggatggctattttgcgggatcttcgtctagggaccttcgacgtgctaatcgggatcaacttgttgcgggaaggcctcgatttgccggaagtatcgctggtcgcgattttggatgcggacaaagaaggcttcctgcgttctgagcgctctctgattcagacgatcggacgggcagcacggaacagtgacggtcgtgttattatgtacggcgataagattaccgattctatggataaagcgataaaggaaacggaacgtcgtcgtgcgatccaaattcagtataatgaagaacatgggattaccccgcaaaccatccgtaaaaagattcgtgatgttattgaagcaaccaaggtggcagagtctaagaatgattaccttcctaatgagacgggtaaactttccaagaaggagcgtcaatcactcattcagcgtctggaagcagagatgaaagacgccgccaagaacctacagttcgagcgggcagccgagctgcgtgacgctttgctggagttacgagctgattaaagattgagaataagctagaagcaaaacatatgaaaataaaatgtttgattgctttgcttttaaaaatagtgagggcggcctatgtggtcgttctctttgcgatatatcacttccatgggataatccaatgcgatatagcatgacgtgaactacggctaaggagatgaaacatttggcgaatgaaagcatcatcatcaaaggcgcacgcgcgcataatctcaaaaatattgacgtgacaattccacgggacaagttcgtcgtcctgacagggcttagcggctcaggtaaatcgtcactggctttcgatacgatctatgcagaagggcagcggcggtatgtggaatctttatctgcgtatgcccgtcaattcctcggacaaatggagaaaccagacgttgattcgattgacggtctgtctcctgccatttccattgaccagaaaacaacaagtcggaatccgcgttctactgtcggaacggttaccgaaatctatgactacctgcggttgctgtttgctcgggtgggtcatcctcattgtcctgaacatggcattgaaattacttcgcagaccgttgaacagatggtagaccgcattttgcaatatcctgaaaagacaagacttcagattctggctccattggtctccggccgcaaaggtgaacataaaacactgtttacggatatagccaagcagggctttgtacgggtacgtgtgaatggagaactacgtgaattatctgagaagattgagctggaaaagaacaagaagcactcgattgaagtggtcgtagaccgcatcgtagttaaagaagatgtgcgtgcgcgtctgtctgactctattgagacggcactgaatctttcaggtgggcagttgcttgtagacattatggggcaagaggagttgcgtttcagctccaactttgcatgtcctatttgtggattcagcatagatgaactgtctccaagaatgttttcctttaatagtccgtttggtgcttgtccagattgtgatgggttaggagttaaaatggtagttgatcctgatctgctcattcccgatcctgaaaaaagtgtggaagatggggcgtttcaggcttggagtggtggaacttccacttattatcctcaatttttacagtcagtatgcgagcactacggtattccgcaggacattcctgttagtcaattgacgacagaacaaatgaacctcattttacatggaacgggtgagcagaagatccgtttccgctatgagaatgattttggtcaacgtaaggaagcctatgtgacctttgagggaattatccccaatctggagcgtcgttatcgtgatacggcttctgaaggtatacgtgaatttattgaaggctttatgagtgcaaagccatgtaacacctgtaagggacaccgactgaaaaaagaaagtctgtcggtaaccattcaagagcgtaatatagcttttgtgacagctttgtctatcggtgaagcttcaaactttttccatacactggagctgagtgagaaggagaagtcgattgccaatctcattttaaaagaaattaacagccgattgggattccttgttaacgttggtttggaatacctgactttaagccgtgctgcaggcacgttgtcaggcggtgaagcacagcgtatccgattggcgacacagatcgggtccagtctgatgggtgtgctttatattttggacgagcctagtatcggtctgcatcagcgagataatgaccgtctaattagtgctttggagcatatgcggaatctcggcaatacgttgattgtggtggagcatgacgaagatacgatgatggcggcggactatatcattgatattgggccaggagctggaatccatggtgggatgatcatgtcgcaggggactccgcaggaagttatggaagacccgaattccttaaccgggcagtatttgagcggacgcaagttcattccggtcaataccgagcggcgcaagcctgctgataagtggctggagattcgcggagccaaggagaacaatctcaaaaatgtgaatgtcaaaattccgttgggtgttttctcagctgttactggtgtatccggctctggaaaatcgacgctggtcaacgaaattttgtacaaaaccttggcgcgtgatctgaaccgagcgagagtacgtcctgggcagcataaagaaattcgcgggttagaacatatcgaaaaggttgttgagatcgatcaatcgccaattggccgtacaccgcgttccaatcctgcaacgtatactggtgtatttgatgatatccgtgatttattctcgcagacgaacgaggccaaagtacgaggctacaagaaaggccgctttagctttaacgttaagggaggccgttgtgaagcttgtagaggcgacggtatcatcaagattgagatgcattttctgccggatgtgtatgttccatgcgaagtgtgcaaaggcaagcgttataaccgggagaccctggaggttaaatacaaagggaaaagtattgccgatgtgctggagatgacggttgaggatgcaacggagttttttgaaaatattccgaagattcatcgcaagatccagacgctgatggatgtaggattggggtatatcaagctgggtcagcctgcgactaccttgtctggcggtgaagcacagcgcgtgaagctggcctccgaattgtatcgtcgtagcacaggcaaaaccatttatattttggacgagccgacaaccggtctgcatgttcacgatattgaccgattattgacggtgctgcatcgtttggttgattcaggagagacggtgctggttattgagcataatctcgatgtgattaaaacagccgattatctgattgatttgggaccggaaggcggaagcggcggtggaacgatcttggctaccgggacaccggagcaactcgttagagtcgaagaatcctatacaggtcgatacttaaagccgatccttgaacgggatacccagcgtagtcaatcgcttcagacagtcgatctataaataccatttaacgtatgatttaaaaaccctgcacaggcaggaaggcagaatacgaactagtgtattgatgccttcgtcttgcagggttttattttttttgtaaaaaaagaaaacttttatcaaattcctgcgttaaagcatgtgacacatagtttaccaagcgctggaataataaatctatacgtatattcatcgacagaaagtctctgagtagtctctaaattttggagttttggatgtttaggctcgggcttgaagaggtaaatatataatttatgattacttagcatcatacggagttccgtgcccgcgtgacaaccattacaagttgaagcgaaaccgtctgtagttttatcacatctaaggttcatacaacatctttgaggaagtcatgaagggagctggaacgcttgaagattaagcaaagtagagttttacgtacacgtgtatattcatgggcagcaggagctgctttggcggcatgtttgatgggttatagtgctgcaccgtcctatgcctccgaggtgtctgaggcgtttgcgcccaaacaagccgaaatcgaaacaagtgcagcaattggcagtattaaggatttagaaaacgctcatgattacattcaacccgcagcgaatggtgggtttttaatgctgaacgtcgaggacgatacagaagcaagtgtagtacacgtcacatatggcaagctggacagttctgtggaggctgtatggaaacatcagcaggacctgaacgtacaacccggaacaagcagcaggggagtccagcgggagacatcggataggggcttgctgtttctgattgattatacaaaaccgaacggaatacgagatttgcaggcttcacgattggacgaggatggaaacaccttgtggtccaaaacattacccacagatggcttgatatctcatgggcaggattctcaggttggtttggagacattggaggatggcggtttcctggtctcctatctaaaccttgctgagcagtccttcactgtactcaaatacactgaaactggcgatctacaatggaatcgaacgacggccggagtgacctcgggttggctggtcggcagtcacaatggatattatgcgcttttgaacagctcagatggtcccgttggggtacaagcagatgtatatggtcgcgatattcgtgacatccatctggacttaggatcaggtaaagaaattgccgcagtacgtgagttgccgagcggtcatattgcagtaacagggcttaaaggaaacagcaagcgtacacaggtgcttagtaatggtctacaattatttagtaatacagaggactatgcggctgaccgggtgtatctgcctgaggagcagttgtatgtccagttcagtgatcaatatgatccactgggtaaaaccacgaagatgcatggcatcaccattacaggcctgaaaggaaacggtacgaaggtgtgggaaacgaggactcattataaggaggataattccttcggcatccgttacgatacgggattgatatacaagataccttcaggctacgtggtggtgacatctacaacaggagctcataagccaacagtactggattttgcgaaaatattgataccggagtaatccggtgtcttttttttgtgaaattgagggaaacgatattgcgaggttgtatgacgataagaaacagcctgcttgtatatgtaatacaaacaggctgttaatagactctatattttaggatgcaacgtggctggattgtaaaatggcagacagcttttcctggaaagtcggaatacctacacgctgtacatatgcgtaaaagctttcgccagcgctcctgttttctttgtagaacagaatgagctctgccagtacaggtccaacctgatccccgcgtacgcgacctttgagcgccttgttaaactgggcgcctgctccaagcgctccgccgacagcgatatcgaacgcgtcgaccaagccttccggtgtcttaataagcgagccttgcagaccaatgtccgcaatatgcttttgaccgcaggaattcgggcaaccgataaaatgaatgcgcaccttttcatccaattgtacgtgctgatccaaatactcggcaacgtcaaccgcccgttttttggtttccacaatcgccaaattgcaaaactcatttcctgtgcacgataccgtacgactcataaaatgcttgggctgtggtgtcaggcgttgcagcacgggggcttccagtagttcatccacttgctcatccggcacgccgctcagcaaaatattttgtgacatcgtggtacgaatctgaccatcgccataacggtcagccaggtcggccagttcatgtaactcgtcagcactaaggcgaccgacaggcacgttcagaccgacatagttcagacctttttgagcttgaggatgcacgccgtcaaaataggcggcttgccagccaatcgttttgtcctcgcctcgtccgggcatttcaccgatgtactcggtgagcttagccagaaatttgtctgggccccaatcggcaacgaggaatttcaagcgggcatggtgccgcttttcccgatagccgtaatcacggaaaatggtggtgacagcaatagcaaccttcagtacttcctcaggacgaacaaacaaatccagcgactgtgccatatgcggcttggcggacaaacctccaccaaccatcgcatggaagccgaccacttcttttccgtcgaggatcttggtggctggagtgaaggacaggtcgttaatttcagcctgtgcattattgtacgtattaccggagatagacattttgtacttgcgcggcaggttggaaaagtctcgattcaataagaaaaatcggttcacttcatctacaatctcctgggtatccaccaattcattgggatcgatgccagccagtggattaccaacaatggtacgcgggcagtctccacaggcttcaaaggaatacaaattgactttttccagtctttcgaaaatatcgggcaagctttcgaccgtcagccagtgaaattgaatcgcctggcgagtggtgacatccacaagaccgcgtccatatagcgcggatatgtccgccaatgcatgtgcctgtgctgaagtcatgatccctgtgttgatgcggacccgcatcatgaaatgaccatccttgggcttttgctgatataccccagcccatttgaaacggtccatatcgtccgcagagatcgagtcatagccttcgttggcatagttttcgataatggtacggataacgtcgagaccgtccttttccagcttgactaactcgaatttgttaagcttatcgggatgagcgttccagattggttcgtaggccattcttttaacctcctgtaggtgcttatttatactttagtgttttggatagaggattcatgattttattctttatttccgacaataaaactaagatataatgtgatggtatcatagttggttatgcccgtaaacgaaggaatgacctaaacggtataacgattatttatcgtttttgcttatttttttgatataaggatttggaaaatttataatataaatagcatgaggggacagggatgtagcaaacgcgccttttagaaaaagatagggcttaaagcgattgtatacgtgtcccctctatggtagatttggactaactgatagaacagggtcatgtaagagaggaaatggtgagtatatgcgtaagatggggaaaagggcagttgttctagctctgggcagcgctctatgtgtttctggaacggcaggtgcagctagcagtggaactgcgttaaaggccaaagtcattaatggtggggtctatgttaacgtaagcgatatgaataaagcattaggaaccagcggcgcatataacagcgcaaatggtacatatacgttatcggctgatcgtgtgccgcaggtggttaaaaatgtatctccttctgtggtcggtatcattggccgttcagccacgggagagaccgtagcaggaggagatcgatacaacctggctcacggcacgggtgttatcattcgtaccgatggatggattgtgacgaatgcacatgttatcgaaggattaggtgatgccgtggtcgtaacctcggacggaaaatcttatggaatcaccgacagctacagcgatccgatcagtgatttggcattagtcaaaatcaaggcaagcggcctcaaacccgccaccttggcagcttcaacgaacagtctacaggtaggtgagcaggtagtggctattggtacgcctatatccttttcacttcgcaattcggcaacctcaggtgttgttagcgggctgaaccgtggtgtcaacgctgcttatcgtttgatccaaagtgataccgcgatcaatcctggtaacagcggcggtccgctggtcaatcttaagggtgaggtcattgggatcaatacgatgaaattctcggcggtcggcattgaaaatatgggcttttcgattccgtcggatacggtgaaatatgtcatcggccaatttttcaaatacggagaggttcggcgcgccagtcttggtctgagtctggaagagagctggtcagctatcgttggattacctaccgaggaccctctgaaagttacgaaaattacctcagccaatgccattcaggccaaaatcaaggaaggcgatgagctgtatagcattaacggtaagcgtgtggcttcggccattgatgtcaatgagctgcttaaaaactatcaaccaggtcaaacggtgagtgtactaatgcagtcggacggtgatattgtgaagcgcaagctagtactgacacaggataatggtgaaatctatgagtccattcagtctggagaagatggtgaagattcgaacggttcggaggccgctgaagatggcggcgtagcgcttcctaaggaaacatcggagccagctcaaggggcaactactggaaagtgaacaataacggctcttgaatttataaaataaagctaaagggagatttactgtgaagcatattcaaagaaaaatgatgcgtaagctgggggtcggcgctgtcgcattgtcccttctgctttccgctttgccagcagttgcagcagatcaagataaaaccatgctggaattgcggttgcaaagcggcagcaatacagccatcatgaacggccataatgccaatattacgaagccatattcaaaaagtggtgcactgatggttccagctggtatttttaaaaaggcatttaacagcaaaattcgattggctgaagataatgtggttaaaatcactagcggaactcatgttgtatcgctgaccattggtagccgtactgcttgggtgagaggtcacaaggtgacacttccagctccaccggaaatgtcatcaggtattctcatggtgcctctgcgtcaagtagcagaagggcttggcggtaagttggagaagaacggcgccggaatcattattcggatggaagcacaagaagaggcgggcacggtagctgaagagacaccgaacattgataatgatgagggcaagacgcagatcgggaacagttactatggctggtctatgaactatccaacaggtctcgtcatcggtcagggaggtggagatgagagtatctccacttttatggacgagaacagtgcgtactatatggaagtgcacacagcgtcacagccggttccactgaatgcggacgatctgttgcaacaattagtgcaggcagccaaggaaacgggagaaactgtgatcgatcgaaaatccttcccgaaagcgaaggtaccttatgctcgtgtcattacgaaggatggggacggcgtattgtgggaaaatcgtcagtactatgacaacggacgattgtatgtagtttatttttccgatgctaaagcaacgaattataaagatctggcccagtatgcgggactgttaaattccttcaagacctcttttgatgcgcaggataaaagtattaaggacttgtccactgtcgtaggaggcacacgcgaggccggaaatccagactacggcgtgtcactcagcatacccgcaggctggaaaatggacgatcaacggatgcaatatgaaagtaatgatggatcgagcttccgcatgaaaataacctcggctccagcggatggaaagttggagaactggggccagcaactgcaaaaatggctgagcgattcatttgtgtctacggcttatgaggcacagaagacgtatccgctggaagttgcaggcgttcaagggttagtacaggagtaccgttataattttggcgatggatgggtcaaagagtacaatgtgctgatccagcaaaatggataccgctatttggctgaatacgcagtgcctgaaaaagtaagcaaaggaaatgatcagttcaatgcactcatttcctcgcttcaaatcgattttcaaaccgtagcaagtaactttggacagttggaagaagacgactatttgacggacaaaacgaaaacggtcaaaaagacgtcaaaagcctatgaatatacggtgaatatcccacgatattggaccgcgattagcgatcaatttgaattgggcgatgtagagtaccagtttaccggaggtcgtttttccatcaaaatcgacaacgaccaatcatttgaactaacggtatcccagctcaaggacttctatgataagcaagcaaagaactacaaaaacctcaaagttgaggaagttaaggacgtaacgtttgctggtgttccggcagtgtcctttacattccatcgtatagaggaaggcattggctacacaggccaccaattggttttggaacgtgacggaaaaacgtatactgtgacaacaacattaaatgatgcgaacaacacggctgtacagtctaacgcactggattcgacgttaaattcgtttaattttgtgaagtagaaggtgtaggtaaaagattagcgaggttgtgggggaagcgctacgcgtgccatttgagcctacgatcgctgacgcttcttcggattcaaatggaccgcttcactgacgctcgccaaataccaccaatcttataatgagtgaagtaagcactagggaagtctatacgtatttccccgtataggaggaatccaaaatgattacgctaaaagcagtcgacaaacataattgggaagcatgtgccgaacttgaaccgacacctgagcaaaaaagatttatggtatctaacctttcttcgattgcggagtgtcagtttttagatggatttttatctaaagcaatttataatgatgacgaattaattggttttacaatgtatggtttagacccggatgacggaaattactgggtttaccgatttatgattgacgaaagatttcaaggtcaaggttatggctacaatgcgatgttgctggttatcgacgaaataaggaaagccagtgataggacggatgttatcatgattgggtataaaccagacaatgaactagctagaaagctatatagtaaaacaggcttcagagagaagggaatatcaccttggggagaaatgcttgcgaagtataggtttgcctagttaatgataggatgactcacctccaaagaaccgcttgacgggattggaggtgtttttagtattattttttaaaggaatcgcttggaaagtgtagaagcttaggtcgcagtctggtacactagattagttacaagataagaatgattctgccgcagatgtttgtgatgcggattttttgagttggatgtaattcacgcgaggaaccgatggttcagtgtgtggatgatcggacaagatgatagagacggataggatttaaaatatgattcttagtaggcttccattcccctgactaaacatgatcagctttggaatgagtctatggaacatccatgagattaccaagtaagcagcatagctgccctgaaaacaacgattattcctcgggggatcattcgttttcagcatatggggagggcaataatgaaatcagcagtacgaagagaagatgttgagcttctggcaccagccggtgactgggattgtatgcgtgcggcggtggcaaacggggctgatgcgatctttttcggggtggaaaagttcaacgcacgagcacgggcgaataatttccgcatggaggaactgcctgaaattatggcgtttttgcatagctatggggttaaaggttttttaacattcaatatattggtatttgaaaacgagttggaggacgctaaggagctggtcgatgcctgtattgatgctggagtcgatgctttaattgtccaggatatgggcctggtgaaaatgatccgcgacatttcaccggattttccaattcatggttctacccaaatgacgattacctcgccggaagcggtagagtttacaaaaccctacaatatggaacgggtcgtgcttggacgcgaaaacaacctgaaacagatccaaaagataggcgatcaggcgaggcttccaatggaggtattcgtacatggagcgttatgcgtatcttattctggtcaatgcctgacttcagaaatgtggggcggccgctctgctaaccgtggtgagtgtgcacaggcatgtcgtttgccttacgatctaatggtggacggagagcagaaaccaatggcagatgtgacgtatctgctgtcacctaaggatctggcagcgattgacttgatgcctgaactgatcgacgcgggtgttgtttcttttaaaattgaagggcgactgaaaacacctgaatatgtggcaaatgtggtcagcaagtaccgcaaggccattgataagtattttgatggcgatacgtccaagaccagcaaagaagatatccgcgagctgcagcagagcttttcacgcggctttacgcacggttttctcgaagggaccaataacaagaagctggttgacggtacattcccgaaaagccggggagtgtatctgggccgagtggaacaaatccttcgtgatggcgtagtatgccgtattgatgccccactcaagcgtggcgatgggattgtattcgatgcgggagatcccacgcaaaaagaagaaggcggacgcgtatacgatatccgccgcaagggcgtgaagattgaaggcgaagccggagaaggctggatcattgacatcgtagcgggacgcaacgatgtggatctgcgccgtgtacacgtgggcgaccgcatttggaagaccaacgacccagcgctggataaacgtctgcgccagtcgtacgacacggacaagccgtaccgggtcttcccggtacatgtgcgagtcagcggctccccagggcaaccgctgtcgacatggtggaccgacgtgcagaagggcacaacggtccgcgtggactccgagctggaactcgaaattgcccagaagcgtccgatgacgcacgaactgctcgaagagcagttcggccgactgggcggaacggtgttccagctggaagaactggacgtccatctgcatggggacgtcatcgtgccgatgcgcgagctgaacggtatccgccgccaggcggtggaactgctcgcgggcgagcgccccaaaccgcccgtgtacacgaaacgggcggtcgaggtgtatgacgatgcatcgactccggcatcgtctgtggcacgcggtcaggcagagctgaccgcgttgtgccgcagcctccctcaggtggaggctgcgctcgaggccggcgtggaattcatctacgccgacttcgagttcatcaagcaattcccggcagccgtagaggctgtgcacgctgcaggccgccgaattgcgctggcgaccccgcgtattcacatgccgggtgaaaatggctaccacaacaatatcctgcgcttgaagccggatgctgtgttggtacgcaatccaggggcactgtatttctacttgcgacatcggttggagaacccggacgcacatcacccgcaattgattggtgacttctcgctgaacatagccaaccataaagcggctgatctgttcctggattctggctgcgacctggttacgccttcgtacgatctgaacattcagcaaatggtcgatatgctcagacgtacacgtactgataagctggagatcgtgatccaacagcatatgcccatgttccatactgaacattgcgtatactgtacctttatgagcgaaggcaccgactacactaactgtggacgtccatgtgaggaccatcgcgcatccttacgtgatcgaattggtatgtctcatccagtccgtgtggacgaaggctgccgcaacacggtgtataacgcgattgagcaatccggcgcggaatacctatccaacttcctggagctgggcgtgtcccgttaccgcgtggaatttttggaggagacaccggagcaagtgcatgaggttattgatctctataaccgtgccctgcgcggagaaatcagtggaacacaagtatggaagacgctgaaagcgacgaatcagttgggtgttacacgtgggcagctggtgaagtaaaaggatgctataggttatcacagttatttattttgatatttgaacgtagaaaaagaaaaaatagggtatgtgctttgagagcacataccctatttttatcaataagtccatttgaaatactatgaatctcgtattgttatactttctggactttcgtttttttggaaaaaacaatgaatttttgcccgacataattaattaaagtatagaatatattcccgattaggatggacagattgcctaaaattgcattgtttttaatactcagacttgagatcaggaagtggctgattagatagctgagacaatacgatagcaaatagcatatcaatatgataaagacaaacttccaaatggtctgtccatggcttgcattgtttttgaaagtaaatcttttgtttaagaaatagcttacagtggcacctacagaattaccaataaaggtcgataaccagtagttagtccctaaagtattaaagagcaggaacatgacggacatgccgcatattgtatttaggacacctacgacaagaaaacggaaaaagctattctgaaataaagtcaaattagtcacctgttcgcatctgtttattggacagccacagcttccctctcactatttttcactttttttgtgttttcagtatctagggtgctcttggaatctaatagggtctcaataatatatttgggtctttgttttacctctttatatattttaccgatatattcgccaatgagccccagtgctacaagttgcagaccacctatgaaccagatggacaacattaaagaagaccagccccagacagtggttccaaggagcttactaataatggtatacacagctattaataagcttatgccaaacattgcaaaacctaccgctgagataagccggattggggttatactaaatgaagtgattccatcgaaagcaaacgcgagcattttctttaaaggatatttggattctcctgcaaagcgttcatgtcgatcgtaataaacttcagtagacttataacctattaacggaactagaccacgtaaaaagagatttacctctttaaagttgcttaattcctggagaactcttttgctcattaaacggtaatccgcatgattgtatacaatattgactcccattttactcataacacgataaaagccttgggctgttgaacgcttgaagaatgtgtcggtggttctactttttcgaaccccatatacgatgtcataaccttctttgaactttattataaattctcggatggcattgagatcatcctgcaggtcagcgtcaacggatatcacacaatcagatgtctctttagcttccattaacccagataatagggcgttttgatggccggcattttttgccaactttagaccactgacaaaaggattttttagattatatgatgctatgatgtcccatgttttatcacggctaccatcatcaacaaacaacattttactatgtttagaaatgagctggctctctgccaactcctcaagaatgaccgtaagtctgcttatagtttcaggcagtacctcttcttcgttataacagggaataactaacgttaaaacagggttactgattattgaatccaaagaactctctcctcaaattttggcatatctggtactcaaatttctatcctttttagtttataatatggtttacttaaattatataacattgcaatgactaagtgctataataaactattagcaatttacaaacgttaatcgaattattgaataatttagtaagttttgttgaaaaggagttttaacctatgaaaatccgtaaagcgattattcctgctgcgggattaggaacccggttccttcctgctacgaaagccatgcctaaagagatgcttcccattgtagacaaaccaacaattcaatatattattgaagaggctgttgcatctggtatagaggatatcattatcgttactggtaaaggcaaaagggcgattgaggatcattttgactactcctttgagctggagcataatttgactgcgaaggaaaaatgggatctgctcaatgaagtgcgtaaaccatcggagatggcagatatccactatattcgtcaaaaggaacctaaagggttggggcatgccatctggtgtgcacgtaagtttatcggtgacgaaccttttgccgtccttttaggggatgacatcgttgagtctgagaatccgtgcctcaaacagatgatagacgtgttcgatgagtatcagcgttctgttgtaggtgtaaaacaagtggattggaacgaggtacatcgttacggcatagttgaaggtcatgcacttacttccaaaatctctgaagcggaacgattggtagaaaagccaaagaaggaagaagcaacctccaacttggcgatcatgggacgttatatcttgacgcctgatatttttgatatcctgggtcagcaatctgcgggagtaggcggggagattcagttgacggatgcattgtccaaactgggagaaaagaatccgatcctggcctacgaatttgacgggaatcgccatgatgttggcgagaaattgggattcattgaaacaacgatccattatgctctacagcataacgaaatcaaggatgaagtactggcttatatgagacaggttattgaagatattgatcaacaaaaataaacacctcaccaaacctctctttctccaaataaaaaagagactaccggatgatataacatcatctgatagtctctttttctatactatttctccgattttaactgagcaatttgctccctctccttcggatcagctttaatcagcttatcgtacaatgctttgtcatcctgtccctgctgttgcagagcagcgatatagtagcgggcgacctcacgattcgtagcatcactcaaatcgtccttcagaccgtttttcaggatgctggcagcctctgcaggcttgcctgacatgaattcaattttgccagtgctgagcgcaatacctggagttacctcaaaagtacgtgtcaactgaatttcaggtggaaccgtcttaatatgagctaccccatccagaacctgctggtatgcagcaaggcctgcttggaaatatttctgctccttggcggtgtccttctgttcacgtgccttatcaccaatagagtaggcttgagtaatcaacatgttgtaccagtcattgtcccatttgaagttggaaatgttattttccaaaatactgaaggcttgctcatgctcaccttttgcttttaaaaggttaactttggagttatacatgattttattatacggttctgccttcaggcccgtattaagtacctctattgcagcattataaaattcttcttttttcgtttgatcatacacattcttgtacagtgcagccaaacttataaccgaatctgggtgcgtaggacgaagttcaagatccttattaatggcactttggatttcctcaaaagatgtgctgaccgccatgatctgtttggcagatgtggcagcattggccgattgcacgaagcggagacctgcaaaaagcaccacaatgcttagaatgccgatgactgcactatacatgattcggaaaccagaagtactcatggacaagcgtctaagaggtttgctgtccatagcagcggtcataccaccaagactcataaatatcagtatgcccatgaacacgtagctcagattaaagtccagcaagctatgaagtaagatcgagagcgccaaaatgagatacagaaagtgagaatcccgttcttcatcattttgtctaatatagttacggatatatttgtagaaaataaataagatgaatgacatgaaaattacaaaaccgagaataccaacctcaaccagatactgcatgaagaagttatgggcctgacggcttgtgtaaggatagtcttggtatttctcatataaagtagcccaaccgccgccgccggtgccaataacaggatgatctttaatcgatttggcagcatcctgatagaatacaagtcgttccagtacactatgctgccggaaattgatattttcaaaccggacctggacgttttctggtagtacgctgcgcaggccagttccaataaacagaaaagccagcaagccaatcacgacaactgatccgacaggcagccataggttggataacttacgggaagtccagcctgtgagggcactttccaacttcggtgccagataacgttcaacaagccacagtacaacagctacagcaagggagaccccaataagtaacccccaagccttcgcagcctcaccaccgttgtaggccttattgagttgtaatcccatatttgtaattggcgccaagatagatattgacgctacaccagcaatggcgcaatgcaaaatccatataatttggcgtgcaggtttaaggaaaagcaagagcagcacgaaaacgactggcaacataaccagaccgccccgtgacaaggtcaggaataacgagaccagaataggcaccaacatgaagccgtgaatagccttgccataccatagttttgatttcatcagacagaaaacggcagcgaataggaaagccattagaaaagcggcatatgtattcgcatattgaaacacggatgtcagccggagaccatttgtatctgtcataactgcattggtataacgatattgatacacatattgggtaaaccagcctaccatcttgccggcaattacccactgtccgaaccagttaataaagccaaagccgacaatgacataagcaacagtcataatcaggttgtgaataatcttattgcctaagcgatcttgtagtagatagattgagatgataaacagggcggcatatatgcactgtaccaccaccatattcatggccaagtaatgcgaagctgctgaagtcagtgaaagcacataagacaggggaagcagtagtactaatacagccagccaatccctttgctcttccagcttgaattttttataataggttacaattcctaaaatcaatagaatcgtgctgatgatcaaagcccaatacaaaggcttctcaaagtcgagcatttgaccattaaaaagcgcagcctggaagggggcccaagctaaaaacagaatcatgccaacaattaacacccaaaacatagccggccttttatcgtcacgggtcgacgttttggcctgtttcccgtatactggattcgacaaggtttacaatctccttttcttgtagatacgtcaacattttagcatatcgtagctgttagagccatatcgcaacaaagaccataccaaatttttacaatgtttgattgtaagagacttaccaaaccatgtttaaggtcgtgacacactcgtatgaatttaactgaaaacttatcaaaaaatttaaagttactctgggaactgtctaaaaaagatattaaatctagataccttggttcgtttatgggggtactctgggcttttatacatcctatggtatctatacttgtttattgggtcgtatttcaggttggttttaaaaatgtacctattggagatactccctttatactttggttattaacaggaatggtgccttggttattcttttctgaaagcttagcaactgcaaccaatagtattatagaaaacaattatttggtaaagaagattgttttccgagttggtttgctgccgatggtgaaaattttgtcagctctgtttgtacatgtattttttatcattgttcttttcattatgtttaaaatctacaatgttgaatttacgatttataacattcaaatcctttattatttattagccacgatttttctttccttgtccatttcttacataacagcgacattagttgtttttgtaaaggatgttggtcaagttgttgcggtatttattcagctattcttttggcttacgccgatcttttggaatttaaatattgttgaagataagtatcagtttttctttaaactaaatcctgttttttatatcgtcgaaggatatcgggatacttttattgatcacaaatggttctgggagcatccatcaatgacgatctacttttgggctattgtgattatcgcaggtactataggaatcaaaattttcaagaaaatgaaatctcattttgcagatgtattgtgaggagaaaatgatgaatcaaacagaatcagttgctgtggaagttaataatgtcactaaaatatataaaatatatgataatcccaatgagcgattaaaagaggccgttcatccctttaaaaaaaagtatcattctgaatttaaggccatcagtgacctgtccttttccataaataaaggacaagcgattggtattattggtaaaaatggttctggaaaatcgactcttttaaagatgatcacaggcgtgattactcccaccaacggaagcattaaagtgaatgggaaagttgctgctcttttggaattgggcgcgggttttaatccggatttaacaggaatggaaaacatatacttgaacggaacccttatggggtatagcaaaatagagatggatggtaaacttgaatctattgtatcctttgcggatatcggggacttcattaatcaaccagtcaaaatgtactccagtggtatgtttgccagattagcttttgcagtagccatcaatgttgatccggatattttgattgtagatgaggccttgtctgttggagatatttattttcaggcaaaatgtattaccaaaatgaaagagctctccaaaaaaagtacggttttatttgtctctcattccatggataccattaaaagtttttgtgatacagcgttgctgattgataaaggacacatggtcgaaattggtccagtgaaacgtgtagcacaaatttatgaaaatattgttaaccaggaaattgcagatatgaaacgtgttcaatctttggatgtatttgttaattccgaaacagataagaagagttcgctgttgctattagaagaggatcctgcttttgcaaaacgtgccaatgagtttcgttctggaacgggagatgcgcgctttataagagcggacttgttagtcaatggagaagttgtgaaccaggtcccttttggcgaaatggttactttgcgtttattggcacaatattataaagatatagattctgagggaactattggctacatggttagaaaccatactggtgtcgatgtgtttggcatgaatatctataataaagcaaaattagttccgaaaatgcaagcgggaggcattctggaggttaactttaatttccgtaatctgttatctgaaagtggtaaatacaccatttctattggtttgaagcctaagccttttgagcctctttatctggatagcgtaagtatagcagctgtatttgaggttcctaagcccgagaataattacgtaccaggattaatatttgtagataacacaatagatttgcaagtcattaattaaggctggtgataaaatgtgtgggattttgttttctaatgtagccataaataaagaagtatttcttaattctttaaatataatgaaacaccgggggcctacggccccactttgtgtatatcagagtgaaaactttatgctggggcataacagattaagtatcttagatttggatcggagaagtgatcagccctttttctctgatgacggaagatatgtgattatatttaacggagagatctataattataaagaattagcctccagctattcaattcaaatgagaacaaactcagatactgaacttttattgaagctttatattcaatatggtccccaaatgttgaattggcttaatggaatgttcagttttattgttttagacatccagcagaaatcattttttgtagcacgagatcgtatgggagtaaagccgctttattacaacagatatggggaagagttcattttcagttctgaaattgctccattgctcccattagtccaccacatttctatagatcaagaagccgtaagacaatataaaaagatgagatgcttttttaatgatcgtactatctataatgaaataaaagagtttccaccaggatattattacgagaatggcgaatttattaaatattgggaaattgattactctgaaaaagaacctccttccgatgaggaacttgaatttctaattcgctctgcagtagagtaccgtaagatcgcagatgttgaaattggaagttacctaagcgggggattggacagtacgattattaccgcacttgccaaagtagagcatacttggactgttggttttgaagattataatgagtttcagtggtctgaaatcgcagcaacaagatacaataccattcatcatccgatattgtttgaacctgatcactttttatcattagctcgagagcttataactgtaaaaaaagagcctctgtctgtgcccaatgaagtgttactgtatcatatgactcagcaagcatctgctaaaaatacagtcatattaagtggagaaggcgctgatgagcttttctttgggtatgaccgcattttcagatgggctagtagcactacagacttcgatatccgagcctttagtgaactctacacctacggatctgaagatgatatagagattgtagaagacgctttggcacctttcatgaagttaaagtcgcctcaaaaaatcgtagctgcattctttcagcaagcccatttgagagggttacttaaaagactggatagtgcctcaatgttaaattccgtggaagcaagatctcctttcttggactatagattaattgaaaggcttgcaggtgtaaattctctgtacaaaatgaaggatggggttgttaaggctcctctcaagagaatttttaaagatattgtccctgcagagattgtaaacagaaaaaaggtgggttttcctgttcaacttgaaaaagtcctatcttctgagaaaattgaagggaagacgacattcgacaaatggtttaacttcaatttaactacgttaggagaaatcttatgattatcggctatacttccggggtcttcgatttatttcatattgggcatttgaatttgttgagaaatgctaaatcactctgtgataaactcattgttggtgtgacgacagatgagttagtttcctataagtacaaaaaagcagtaattccttttgaggaaagaattgagattgtcagaaacatcagctttgttgatactgtaattcctcaggactccatggataaatttgaggtttggcaaaaattaaaatatgacgtaatgttcgttggtgatgattggtttcaaaatgaacgttgggaccagtatgagttgcagtttaaggaagttggagtgaaaattatatattttccctatacgaagagtacatcatcgactttactgaatgagacattactgaaattaagaaaataagtataagatttttgcctgaaaggaagaggttttgcagtgaatatgaacagatctatagcttttgtcattcacaatctagttttatatgaaacgattaagcctttaattgaggagtgtgaaagaaagcagatcgtttgtgatatttatgtccctcacattgaagaagaagattggggagacatgtccttagatacctatcattatttgaagaacaatggtataaaagtgactctaacaagctctgtacctgacaaggcatataaaatagccttctatccttatctcccttattatttggaagttaagtccgattataagtttagatatcagtatggaatggctaagccaaactggaatttagacacatggagtcgaaatttcgattttatcttttgtaatgggctgtatgattcctcggttctggcagcgtacactcagactgaaatcgtaggaatgattaaatacgccaaatttcaaaggaagaagcgcgaaacggataaatataatttgctttatttgcctacgtatgggaatgagtcgtctattgagcttgttatgaaccatattgaagaaatgtcagatacctttaatatgaaggtgaaattgcatcatggcacttcttttttggagcatgatcgggttagtctagttaagtctcatattcctgatgtgcttgatcataaggcttctcttgttcatttaatagaggaagctgatgtgatattgtctgacggctctggggctatatttgatgcgctgtttacggacactccaattgtaatattccaacatccccaaacagaatctttcgaggggattttacctttggaagaacaaatagttcagcaaaatattgttccttttgtgagcgataacggcaatattaaacaaaccttacttaatgcaatcttagatgaacaactaatacaacaaagaaggaaatttactttagagatgtttccggttaaaggaagagagacgatagataagtgtatggatgtaattagcagatttctaaaagatgacgtggaccatgcttatagagcagggcatacacgcctgaataatgaatttaatgaattacaagctcataatcatgctcaaagccaagaaatagagcagcaaaaacaacacattgttgagcatatggatcagattaacacattgattcaaacgcgagatcatcaggaaaatgtaataagtagcatgtcagcagattttaaatccctgtctgaaaagaaagacgaattagaacagaaatatgttcaacttacacaggattataataacgaaaaaaacaacttggatatattaaatcatcaatatagacaactatttggtcaatataatgaactgaacacccagttcagtgagttggaagaatataatggaagactgtctacagagattcacaatatttataactctaaaaggtggaaaatggcgaataaacttaaacatatcttacacaagtccaaaatgatatatgttcttaagggatatagagtatggaaaagttatggcaccacaatcttactgaaaaagataaaatctaaagtgtcgaataagcttaaaagaacgaacgcgggggatcagccgattgatctacgtaaagatgaagggaattacaatcagttattaacctggtatgagtataaattttacaattataaagtatctaaagataactcattttctctggagcttgataagttcgagattaaatttgagaaggatcttatatcggtcgtccttcctgtatataacggtgaggattatgtatcaaaagctattgatagtattctgcagcaatcttacaagtattttgaactcattattattaacgatggttcaaaagactcaacggcagaaattattgatgagtacgctaaagcagatcatcgtatcagagtagttcatcaggaaaatcgtaaaataccaagaacattatccagaggttttaaactagccaagggtgaatatcatacgtggacaagtgcagataatatcctccctgaaaatttcctggagaagatggtagctgatcttaaaagagatgaaaatattggtatggtatatgcgaacatgaggttaatcgactctactggtcaagtgatttccaaccatggctggtatgaagaaccacagttcagtggcaatgttatgctgcctaagtctgcattggagttaaacgtatatcctaacaatacgattggtgcagcttttatgtatagggccaaggtatcccagttattgggtgactattctagttataagcatacccttgaggattatgattactggatgagagtgaactctctatttgagctcaaacatgtgacgttcgatgagcctatatatgattatcgctggcacgataagtcactgaccgctttagatcaagaactaggcatcacctctaacagatataaactcatggtacttgatgattttagaagagatttttatctgaccccattagtatggatcattgagggagatgctactgaagttggtgagtttaagaagtatgttcttgctaaaggacatactgtggttggaagagatgaagtgaatacgattattggtcttaatttggcaacgcctatttgctatttatatataaaaacaggcgaagtccatgattttgaatttattgattctaatactttatcgtctatgtatgcactgcttatagataaatcagagcatacaacagatacatttgtagctgactatccgtgggatctgaaaataaaggataaaatgaatgatgaaacagatagcaattatgacttttttgcacaggatacggaagttctgttctctcttataaatacgaaggttaagaacgatcacttgtaccgtattgaggcggtcattgaaagtgaacccgtttataataagagattatcagttattatttgtacttaccagcggagtgaaaagctatcgaatgcgattaaatctgtcatagaacagtcgttggataaagcagactatgaaattatcgttgtaaataatgattatttgaatgatgagattcatcatttggttcgtgagttcagagcaacctgtaatattgacgaatccttcctccgatatatggaggctccattaaaaggtctttcctttgcgcgtaatgttggtttatttggggcagaaggagaggtcatactctatattgatgatgacgctattgcaaactctaacttgcttgaggaaaccatcagagggttctcagatcgtcccgatatcggggtcatgggtgggaatatcatactcaatttacacgaggaacggcctgaagtggttaaaccaggtactgaagcatactggagtcagcttatcgtggaaggcgaagaaattatcgattctaattttcagtgggagttcccttatggagccaattttgcagttagacatgctgcgctaatgcgaattgggggctttagaagcgcctatgggcgtaaaggaaacaattacgctggaggagaagaaattgttgtatcttttgctatgagagaaatcggctataaggttggtcttaatcctaaaatgaaagtcattcatgatgtggacacctcccgatatactgttgagcatgttagaaagacaatgcgaaacagtattttaactaattaccaattgcaaaaggatctgtatgcgccgatggaatcggatattgcggcagataagaatcacctcgaaattgttaaagctgaattagatcatttgcagaagattccgactaaaaatcgagacgttgaaattgatattctgtataaacaatacacagttgaagcgtatgaagaattaatacaaatgaaggaaaacgatataaattcccgaaaacagttggcaagagcatatagataattaataaaactttaaaggcgcctcttttataaaaaaataaggggcgcctttattagtatggagcggttaaatgaaaattttatatttctctccaatctattggaatgatttaaaacaacgtccgcaacatatggccgaagagtttgctaaaatgccgggggttcacatcacctttgtagaaccatccattagcatacttaatagtattgtaaggcagaactcagattataagagaagaaatcaaaccataaatgatagtcttcaaatattcaggccttcgggcagtctgagattgcctagaagctttgaaagcctagacatattccatatgaatcaatggtttgaaaaaaggcagttggaagatttagtttccagtgcagatatcatttggttaggaagtccagtcttttatcctcttattaaatcaaataataataagaagattgtgtttgatcgaatggacgactatgtatttctaactaacaatgcattaatgaagaaattactcgaaaagtgggaaattgaattacttgccaaggcggatctggttatttctacaagtaatcatttgcataagcattctcaaacattatgtagacaatcttatttagtgaaaaatgctgtggatacagctatactaaacataaatgtagatagcttggttgctgatgaattgagacgtttaaagcaagagggctactatatttttggctatgtgggagcgattgaccactggtttgatgtagaagcggttaaggctattactgattttgatgagaaatttgttgtatgtttggttgggagaaataacctgaactataattttgaacagcataataggattaaatattatgagactgttcctaaatcagaaattggtgcgattattaatgcttttgatatttctttatacccctttttgaggaattcggatagaattgatacgatcaatccagtaaaagtttatgagtatttgagttttaataaagtgatattagcggtggatagcgaagaaacaaggctcttaaatcaggaagggatttatctatatcatagtttagaggaaataagaaaatatctaatggatatagataccctacaacgccctttttatgatcaagagcaactggaaaacttcgtagtccataataattgggaagctcgtgcaaaaaccattatggagctacttataaaagagcttcaataggaggaacttagatatgaaagggattatattagctggagggactggatctagattatacccccttactaaagttacaaacaaacatttgttaccgattggtaaatatccgatgatatattactctattgataaactcaaaaaggcgaatataaatgatattttaatcgttactggaaaagaacatatgggagatgtggtcaatctcttaggaagtggtgtcgaccttggagttactctgacttacaaagtgcaagatgaagccggggggattgcacaggctttgcttttagctgagcattttgttggcaatgacaagatggttgttattttgggggacaacgtttttaaagatgatatctcatcgtttgttgaaaaattcaaacttcaagaatcaggagcgaaattattacttcataaagtgcctgatgctaatcgctatggagtaccagaactacaaggcgataacattgtaaatattgaagaaaagccagaggttcctaagagtgattatgcagttacgggcatttatatgttcaatcactctgtattcaatatcatcaagaccttgactccttcagcaagaggagaatatgaaataacagatgttaataacgcttatattcaacgaaaccaacttacatttgatattttagagaactggtggactgatgcgggaacacatagttctttgatgcttgctaacaaattagtaagtgaaatgggttatgagctgttttcttagtattatcatagaactaaagataccttatgctaaataattaagaaagcgagtctatttaaatgcaaattgtaaaagctcttccaactagaataaagtgggtggatgtactaaagggattggcgattatttttttagtattctcacatttggtgccccatggttttaaaggtaatgaaatgatggataagagctttattataggctatttttattccttccatatgcctcttttcttttttgcttctgggtttacttctaattttcagaattataagtttagtagttttttgtggtctaaaatcaaaacaatccttttaccatatacgactctgtatatatgctcactactgtattttggttggatgcattggatggggattgtcggaacgctcgatccaatggttgttattgaaacttttttatatgcagatggagatcacttaggtattctaaacatgtctctttggttcctaccttgtctattcttagcccagatcatttcgtacttggtcttgaaaatttcgtccaaaagaagttatatgtatatattttggatattgctaaccatacttggtgcattcttaagcaagcttgacacacatgcacttccctggtcatttggcacgtcaattaatgcagcctctttaattatttgtggttatatattcaaattgcatgaacaatattttattgaaaaaattagaattaacaaaccatatgttgcttacgcagcgggctttctgggtcttttattatttttaatgaatgataaaccaggcatgtcaggaaattactatggacataattatgtattattttatctgtcggtattggctagtttaatattttatatatacttatccaaaaaaattgagtcatctagtttactgtcctattttggtaaaaactctttaattatatttggtctgcatggattaatacttagcttctgggagaatataaatttttacgagaagttttctgttacaacaaatatgtatttagatggaatttcatttgttgttatttctaccttgcttgtcttcttaagttgtattctttttattgaactatttaatagattcttacctttcctgattggcaaaaaatttagttctggtagttctaataaaacagcaacaattcccagtaagattgtttaacgattaacttaaaaagccctcgaataaaaatcgagggcttttttgtatgcatcgacatctgtattgaattagaaaagatctggattatcagggtatatttttttgaattgtgaacgtattagttcaactttttccttcgtgatggatgatgtcttttttaagactatggctttaacgttattatccagagcatagctctttaaaggtttataattatttttaagagatccgttcataacctcttctgcgagtatacctacaactttttgaccactttcacctaaatggtattgtgtaggtaatgcgatcacgacataatcggactcaaaaaacgacactggaaaaccatctcttaaatcaacgtgatgggtcagattcataaatggaagagcgttgctattgtcaggcatttcaatctgtctgagtatgtcatcattaagaattccagagctagacagaacatatactttatgctgctctgatgagatttccttaagataagtcgttaattgttttaaaacaggtatatctgttcttactctaggtgtttgtttaaagtcactgaataaagaagaaaaataggtaacaggacgtgcatttacattagtgaacgttaccaagaaattacaagcgactaaataaactagaataactaagaaaacattttttgcatattttatcttggacaaatagtttagaataagaataacgccacaaataaataaaattaatacgttcacggtaagaagataataatgctgagaagctaagctttgaattcttgtaaaaagaaagtacgtaataaacaagtttgtaactagaaagattgatatatacctagttttactaataaataacaagcctatgcaaccaacaagagctatcagaaaaatgaaggcaccataatgataaaataaattctgtaagttacttaagacgtcaccaaaataataagctgagtaggcgtttttaaagttattggttagggctctttgaataaattcattgaagaatataataagaaataatgcacttgaagatcctataatgaaaaaatttaaaataacctgcaagagctgcttgaagcgaaactctttttctagaatccatttgaacaaaaaagcgatactgatcgagccaaaaagagatacgatccaaaacccataccatcttcttgtaaatgttagtaatactaggcaagcagctaagagtaaaactgcttttaaatttaagcgttcaaagtcattattaaataagataacaagcgacaagcaaataaaaataagtcctatagaatccagatatccacctaacataggagctatcataattggaaaggtaaatgtaagtacaaagatcatgaaaatgttcaattttgtgtttaactggatttgatcagcaatcttgatacataataagaaaagtatcaaacaagaaggatacaagaagcaggtatagattgccaagacatagctcatgtagcttgtacctaagaactttaatggtaaagagagaaagattgttgggaaaacggaataatcatctcttaaaatgcttgcatagatttgtttagaagctgctataaaatctgtacttaaaaggttattaaattgtatggatgtattccaataggctgaaaagtcccaataataaatgaaatgttccctttgaaggaaggcgtaaatgaacattattccaactagataaccgccaaaagctaggtactgcaccattatttctttcttggcatatgttaagataccactaatgtgtaaaatgtatgtagcacctatgacaaacgactgtgcaatatttagaccgaataatatggaaatatagtaagaatcgactttaaacagtattagaatcgggataagtagccacgtcaaaaccaaataggaccaaacaaaatttttattaactctcgataaattcaaaagcatattccctcccaatatagtgtgcttattaattttatagtaatcataaatgaaagtatatactcaagatgttggaggtttcgtgaatgataataaaggaagtactttcaggtgcaaaaatcatcgaacccgtggttcatggtgatcaccgtggtttttttatggaaagttacaatgaacagatcatgaaagaaaacggaatagaccatgcttttattcaagataaccaatccttgtctgcagaagccggtgtgattcgtggtttgcattaccagcttaatccaaaagcacagactaaactcattcgtgtgctttctggagctatctacgatgtgattctggatattcgtaaaagttctccaacattcggtcaatgggtcggggtaatcttaagtgaacataatagacgtcagctactggtgcctaagggttttgctcatgggttctgtacgcttgttccgtacactcaagtgctgtataaggttgacgagtattattcacctgaaaatgatcgtggaattctgtggaatgattcagcactagggattgattggccaacttctcatgctattctttcagagaaggatcagaagcatccagcactgaccgacgctgacattaattttgattagaggaataataagatttaggaggtcagtatgaaacttcttgtcaccggcggggccggatttataggcagtaactttgtattgtatatgttaaaacagcatccagattatgaaattgtaaatatagatgcccttacctatgcaggtaacctggagaatttgaaatccattgaaaataaccccaagcatagcttcatcaaagcagatattaccgacgcacaagcgattgaccagctgatgcagcaggggattgatgtggtggttaattttgcagcggagtcacatgtggatcggagtattctggaaccggaagtgtttgtgaaaacaaacgtattgggtacgcaagtgctactggacgcggccaagaaatataacgtgaccaagtttgtacaggtatcaacagatgaggtgtatggatctttgggagaaacaggcttgtttacggaggaaactccgttgcagcctaatagtccttattctgcatccaaggcaggcggcgatctgctagttcgtgcatatcatgaaaccttcggtttaccagtgaacatcacgcgttgttctaacaactacggtccatatcagtttcctgaaaaattgatcccgctaatgatctcacgtgcattgagcgaccaacagctacctgtatacggggatggcttgaacattcgcgactggttgtatgtagaggatcattgcagcgcaattgatctagtcattcatcagggtaaactgggtgaagtatataatatcgggggaaataacgagcggacaaatgtgcatatcgtcaaaacagtattagaggagctgggcaagccagaatctctgatttcgtatgtgaaggatcgtccaggacatgaccgccgttatggcattgatccaacgaagaccatgaatgagctgggctggaagccaaagcactcttttgaaacaggcattaaagaaacgattcgctggtatttagacaacgaagaatggtggactcgtattcaatccggcgaataccaacaatactatgctaaacagtacggttcccgcttgggggatgcgtaaaatgaaggtgctggttactggagcatccggtcaacttggtaaagatgtagtaaacgtttttcaggatcaaggacatgatgttcttggatatgatcgggaacagctggatatcacggatttggagcaggctgtgaagatcgtggaacagtaccaacctgatgccgtaatccactgtgcagcgtatacggctgtggatgcagcggagactgatgtagacggggcttatcaagtcaacgcggcaggtacacgtaatatggcaatggctgcggaaaaggttggagccaagctggtttatatcagcacagattatgtgttcgatggaacggcaaaacagccatatcatgagtacgataataccaatccgcagagtatctacggaaagtccaaacgggcgggggaggtattgacccaaacactttcctctaggtattttattgttcgtacatcttgggtatatggattgcacgggaacaattttgtcaaaacgatgctgaagcttggacaggagaagccgcttctccaggtggtgaatgatcagaagggttcacctacctatacggtggatctggcacgctttttggcggaattgattcaaacggagaagtacggcatataccatgcttccaatagcggctcctgtacctggtatgaatttacgcaagctattttacaggatgcggcggaaatattagatgccaagatcacagcgaaattggaaccatgcagcacagagcaattccccagaccagcagcgcggccacgtaactctgttatggagcatatcgcgatccgaaccaatggattgaatgatttgcgcgactggcgtgagggattgcgtgattttttgcaggagtgtcttagtacatctgagtaaataaaaccttattataaatatcaacaatctcccatcagtttatgagtgggagattttattatattaaggcctatgttgattaaggacaatgagcattataatgtataagcagatgaaacatattgtccctctattgcacattttaaaagaaggaggtcattactctgaacagacctaacgtacaaattttattatctacatataatggagcagcttacttagatgagcaaatagaaagtctcatcaatcaaaaagacgtagaaattcagattctaattcgtgatgatggctcgacagatgatacggttgccaagttgagcgcgctgaagcaacgttatcctcaacagatttttttatgccttgagagcaatgtaggggttattaaaagcttttttgatctgattcaaagatcgtctgatacattcgactattacgctttttgtgatcaggatgatgtgtggatgccgaataaacttgctcaggctgtggcacatctcagggagcaggatgggagccgaccgctgatgtactgttctgctactcaaatggtctctcaaacattggaaccactcaaagtatggccagctgacatcctacgacctgtatccttctataatgctctcattgagaatgtatgtgtaggctgtaccatggtgatcaataaagaaacactcaagctcgtgaaaaagagaatcccagattctttggataaacttattatgcatgactggtggatttacttatgcacttcctcttttggtaaggttgtttttgaccccgagccgtacatttggtatcgacagcatcaaaacaatgtgctgggaggttctacggatggttgggttagcaagtggaggaaaagactaagtagatttgcaaaaggaaaaaatcgctatattttaagcaaacaagcccagcaatttattcaactttatggacaagacatgtctcctcaaatgtataaagatatggatcaattcctggacagctaccaaaagggtgtgttttctcgtatgaaatatatttggcagtctccattttacaggcagtcacggttggacaactggatttataagttggtttttgtattgaggaagttatagaggtatggaaagaaaaaatattgaaacttttttccatatataagcgtcaaatagtcaaaggtgcaaatgaatactagataaaataccatcgaatgcgtgttcctttatggaaaaatatagtataattgaaacgtgcaaccgatagagctgccaagggcggtcggctaactctcccgaggaggggggtgaagcctgtgacagtgtttgaggcgctcagtttaatgctgacgttcggggcgttaatcgtcacactgttagagtttaacaaacgaaaatagaccgcccccgcaaggaagggtctattttcggcctgattgttccaaaaccgtccgctcttggagcgttggttgcgcaggggctggctggcaccagccctttttccatgtatatcttaccacgatgaattttagacctcaaccgaggattttacaaaaatctaataaacgacttccgatgaacaatatatagatcgaaatggtttcgtttgtctatatttgcactttggagcgactggaatcgaattttgtgaaattctactaactatgtaaggttacaagttatgtgcttttttgcgccccgtggtctgcgcggtatgctataataggcgatagtagaatagattactgaatttgtcaggagcgttttaaatatggatgtaagcatactggtcgtcaactataatacgtgtcgattgacgctggattgtttgcaatcggtgtatgcgtcaaagtcgcagtaccgatatgaagtgattgtgattgataatcactctagtgacggatctgttgaggctattcgtgctgcatacccggagattacgttgatagccaataagaataatacaggttttgccaaggcgaacaaccaggggatggaagtagccagcgggcgttatgtattgttattgaactccgatacgttggtgcaaccggacacgctggatacaatgattcagtttatggatacgcatccggagatgggagcatcgggctgtaaggtcatcttgccggatggatcattagacaaggcttgtaagcgaggatttccaacgccgtcagcttctttttactatgctttcggctggtcgaagcgttacccggatagcccgaagtacaatcaatatcagcttgggcatctaagcccggacgatgagtatcctgtagatgtactggtaggtgcttttatgctggtgcgccgggagacaattgaccaggttgggggcttggacgaaaccttttttatgtatggtgaggatattgattggtgttaccggattaagcaagccgggtggggcatttactactacccgcgcacatatattattcatatcaaagggggcagcgctcgccgtcgtcctttgaaaattatttatgagtttcatagagctatgtgggtatttcatcgtaagcattataaacagcaatacagttggatcaccaatatggctgtatatgcgggaattaccgtaaaatttggaatggcctttctaaaaaataagttgtccgcaccggtcaagccggacagcggggaacaatctcgtactgaggtgaaagcatgatacgcagaaatcagcgttttttaacccaattatatattgtggcggatttcgcggtcattcaattgtcctttctgatcgcttggtttttcaaatttgaaagtgaatggatcacctatacagaaccgcttcctattcaagtatatggaggctggagcttaatctacggcctgattgccgtagtgctagggatgttattctcgctctattcgcccaaacgcaaaaaacgatttgcagatgacgtattccgcgtcacccaaattcatattgttggcctgttcgtgctgttgagtgtgatgttcttcgtgaagcaaatcgacatttcgcggtcctatctggcgatctatatggttgggaatgtgctgcttattttgttttaccggttctttttgaagcaagttcttaaagctctccgtcaaaaagggtacaacaagcagttcatgcttattctcggggcgggtactctaggccaacgattttatcataatcttggacagtatcctgatctaggatacgaggtcgtgggttttctggatgataagcggcattggagtgaagaggaagcggcgcattttcgcccgattcttggaggtttagatcaattggaggctacgctgtcgcgtctgatgattgacgaggttattctggcgcttccgctggatgcccatgataagtatcccaagattatcaacatgtgtgaaaaggctggagtgcgcacgcttataatccctgacttttttgattatttgccggctcgtccgtactttgataactttgcaggtatgccgatgattaatgtacgggatattccactggatgtggcggggaatcgattgtttaagcgtctatttgatattttattctctttattcgcgattctcctgacctctccgatcatgctggcagtggcgattggtgtaatgatcacatccagagggcccatcatttttaagcaagagcgggtgggcttgaatcgtcgcaccttccgaatgtacaaatttcgttcgatgaaggtgctgcctcctggaactgaagatacgggctggacgactgctaatgacccaagacgcacacgttttggtacttttattcgtaaaacgagtctcgacgagctgcctcaatttttcaacgttctgctgggtgatatgagtgtcgttggtccacgcccagaacgcccctattatgtggatcagttccgtgaggaaattccaaaatacatggtgaagcatcatgttcgtcctggaatcacaggctgggcacagagcaacgggttgcgtggagatacatctattgaggaacggattaagcatgacatcttctatattgagaactggtcactcttattcgatattaaaattattttccgcacgattcgcaacggtttcaagaacgcgtattaatacagaagcaccctacggtttagccggagggtgcttttgcgtctggcagttgttttgagcatgcgtatgtggggtattgacctgtacgaaaaggatgtgacctcctatgaaacgacttattgttgcggttattcttttaatgttaatcggcacatttttactggcatacaaaggaaaatctacagaagaatatactggctttaccacgcaccgtgtgatttcgcatgccatgggagccgttgatggtttggcctatactaatgcgcgtgaagcgtttgtggaaaattataaaaaaggcagccgcgtattcgaggtcgacctgatgtttacatcggatggacaattggtggcgcgccatgaatggacagaatcttttacagagcaaatgcaacaggaacatgcagttgctacggaacagggcggaaaaccttggagctatcatcaatttaagaacacccccatacacggttcctacaccccggtagattggaaggatgtattggatttattggaaacatacccggatgcttatattgtgaccgatacgaaagaacaggaccctgtccaaatcaaacagttgtttgcgcaactgacccgtcaggcacaggagaaaaaccccgagcttttgtcccgtattgttcctcaaatttataatgaagaaatgttgcgaacgttacgaagtatttatccttacccatccattatttatacgctctatgccacagaagataaggacgaccagatcattcgatttgtacaacaaaatgatataacggcagtaactttaccagagaatcgggtgagtggtgctttagtggaaagtttgcgtcaggcaggggcagtgtgctacgtaaataccattaatgagttgaaggatgccgctgagtatgaacagatgggtgtgagaggttactatacagatgttttaacggaaaaagaacttagtgaacgcagttggttgtatgcgttacgaccatgagttgtctgaacggggtgttcccatttgatacgaacattgacaccttttaagcactatcatagacttagcatagaacgcttttggatattggaattcggctcgcctggatcatgacaaaagcaatgaatgctggaggaatgtgtgttggcagattcaattcaatcatggaggcatgtgtttaagcttgatcctgacaaggaactggatgatggtgcgcttgacgctgtgtgtatgtctggtacggatgcgattatggtaggaggttcctcaggtattacctatgaaaatacggtggatttgctgtcgagggttcggcgttatgaggtgccgtgcgtgcttgaggtgtccgatctggaggctgtagtgccagggtttgatctatatatgattcctatggtactgaatactactgacagtaattggattctagggcagcaccaacgtgcgattgaacagtttggttatatgatcccgtgggatttgcttgtggcggaaggatatattgttttgaacggtgattctacggtcgctaagcttaccggagcagatacttcgctgggtgctacatcagccgcctcatatgcacagattgctgacaagctcatgcatctgccgattgtatatgtggaatatagcggtgcttttggggatatggagctggtgcaaaaaatacatcgcagtacagagcactctcgtgtcctatacgggggaggtatcgtggataaatctaccgcgttacaagcggctgccgtttgtgacaccattgtagtaggaaacatcatttatcgtgacttggcgaaagcgctggagacggtagctgtgaaattggaagtatagaacgtgaatttatggaagctcagggaaaggagcatgcacgcatgcaatcaatagatatacacgaggcggtagctcgccttaatccgcctcagcgtcaggctgtggaggcggtagatggtccgctgctgattatggctggcgcaggcagtggtaaaacacgagtgctcacgcaccgaatagcctacctcatcgcgacccgcaagacggctccatggggcattttggcgattacctttacgaacaaggccgcgcgtgagatgcaggatcgcgtatccaagctgattggcccacagggaagagatgtatgggtatccaccttccactcgatgtgtgtacgtattttacgtcgggatatcgagcggattggatttacctcgaatttcagcattttggattctacggatcaattgtctgtcattcggagctgcatgaaggatctgaatatagacaccaaaaagtttgaacccaaagcggttcagtctatgatgagtacggctaaaaatgaactggtcactcccgaaatgtatgaacgcaagattggcgactattttgaggggattgtggcgaaggtatataccaagtaccaacaacgactcaaaaataacaactctcttgattttgatgatttgatcatggcaacgattcagctctttaaagaagtacctgaggtactggatttctatcagaaaaaatttcaatacattcatgttgatgaatatcaggatacgaaccgtgcgcagtacatgctgtgcaaaatgctggccgacaagcatcaccggatttgcgtagtaggtgacagtgaccaatccatctatcggtggcggggggcggatattagcaacattttgaattttgaagaggactacccggaagcacgcaccattttgctggagcagaactaccggtccacctcaaatattctcaatgctgccaacgaagttattggccaaaatacaggccgcaagccgaaaaaactatggactgacaaagaaggcggagccaagattaaagtttatcgtgctgactctgagcatgatgagggctactttatcgcctccgaaattcataagaatattaatgcgggcaaaacctatagccatcatgccattttgtaccgtacgaatgctcagtctcgggttgtcgaggaaattttgattaaatcggatattccttaccagatcgtgggcggtatcaagttctatgatcggaaggaaattaaggatttgctggcgtatcttcgcctgctctccaatcctgacgacgacatcagcttgatccgaatcattaatgtgccaaaacgaagcatcggagacacaaccgtcggcaaattgcaggcagctgcagcagaacgtggagtttcaattttccgtgtccttcaagttgtagacgatttgggctttgcaggacgtacgcgcaatgcgttggttgagttttacgatatgatcgaaggtttaagtcggatggtagactacctgtcggttactgagttaacagaaaaaatgctggaaaccacccaatatcgcttggagctgcaaaacgagaatacactcgagtcacgctcacgtttggagaatattgatgagttcctgtcggtaaccatggaatttgaaaaaggagcggaagacaagtcactcgtctccttcctgaccgaccttgctctgattgccgatattgattccatgaatgacgatgaagaagagcaaagcgatgcggttgtattgatgaccatgcatagcgccaaaggattggagtttcccatcgtatttattgtcggtatggaggagggagtattccctcatagtcgtgcctttctggataacgaagagctggaggaagagcgcagattggcgtatgtcgggattacccgtgcagaggagcaactgttccttacatgcgcacagatgcgcactctgtttggccgcaccacagctaacccgccttcccgctttctcgaagagattccggacgagttaaaagaggatacgatcatcaaacgtgaccgctaccgtcgctcaggcaatgtaggcggatcttatggtgggcgcggactgaataaaggtggtggcagcaactttggtggagaacgctcgtttgatacgatgagccgtagtggttcgtccgcttccgcgtcacctcgcgtaacagtaacgacatcttcatccgcgaaacccactccggctgcttcggcaggaggcccctccatttttgctgctggagacaaggtacagcatggtaaatgggggattggaactattgtagctgtaaaagggacgggcaatgatatggagcttcaaattgctttcccggctccagtaggggttaaacgactgttagctggctttgcaccgattacaaaagtagaataaatctcaaacatcattaaatctcgaacctcatgagtggcagcttggtttaggacctctgccctgatgaagttcccggagggatacgcctgcatgaacccaatgcacaggatggagcagcttgttgctgaactgaacacatataactatcattactacacactggatgaacccaaggtcagcgacaaagaatatgatgtgctttatgacgagctggtagcgcttgaacagacgagcggccttgtgctgccggattcgccgacacagcgtgtgggcggggagttactcaaagggttcacaccgcatcgccaccttgccccattatggagccttgataaagctcagaatatggaacagctgcgtgcatggaacgcgcgtgtcgtgaagctggtcaatgattacaataccaagaacccagagcaacctttgccatctccaggttatgcgatagaacttaaatttgatggtctaacgctgaacctgacatatactgatggacagctggtacaggcttctacccgcggtaatggtgtggtgggtgaggggatattggcgcaggtaaaaacgattaaatccgtgccacttacaattccttttcgaaatggaactattgaagttcagggagaagggataatgaatctctctgtactgtccaaatataatgagactgccacggaccctcttaaaaacgcacgcaacgccgcagctggcgctttgcgtaacttgaatcccaaagtgacagcagaacggcgattgaatgcatttttctacaatgtgggttatgcagaccggatccagtttaacagccaccaggaaatgatgactttcctgcgtgaaaatcattttaaggtaaacccttacctgacttactttgataattttgaagatgtaatggagcaactgattgagattgaagaatctcgtgccggattggattacctcattgatggggcagtattgaaaattacagatatgcgcacacgtgaggctctcgggtataccgataaattcccgcgctgggcggtggcctataagttcgaagccgaggaaacaacaacggtgcttaactcggttgagtggaatgtaggacgaacgggtaaaatcaccccacttgcaagggtagagccggtagaactggcgggagtcactgtacaaaattgtacactgaacaatgctggtgacatcaagcgcaaaaacttgaagtttgctttgggtgcacgtgtatttatccgtcgctcaaacgatgtcattccggagatattaggaaaggtaacatctgagcacgacggagaggaaattgtcgtaccagatcattgtccagcctgcgggtttccgttgcagcagcgaggtgcccatttgttttgcgacaataagctgggttgtaaaccacaaattgtagctcgtatttcccattttgcatcacgtgatgctatggatattgagacattcagtgacaaaacggccatacagctgcatgacgaactggaagtgcgcgagcctgcggatctgtatacactccaatatgatgatcttgtgaagctggagcggtttggtgagaaaaaggccagtaacctcttggcggcactagaaaagagtaaagagagagatttggcttctttcctttatggtctaggtataccaaataccggtaaagcaacaacacgcatgttggctgaacactaccgtgatttgcacaagacgatgtccgctacggtggaagaactgatagaactaccggatgtgggcgggatcgtagccgaaagcattgttgctttctttgcagatccatttactcaggcgggaattgaaaagatgctgtctctaggggtgaaagctcaggcccctgaagctccacaggagaagaagacagacagctttttcagtggcaaaacggtcgtgcttacaggtaccttgcatcagcttacgcgtgacgaagctgcatccaagctggaggcgctgggagccaaagttgcggggtctgtatcgaaaaagacggatctagtcatagctggtgaaaaggctgggagtaagctggctaaggcccaacagctcggaattgacaccatagaagatgaggatgaatttatcagactgctggaacaagaataatagttttgcaatgagtgcagtcattccgctctggggcggggtggctgccttattatctgttgtatagtaggaaataaaatagatataaataaatgcttgctaaataactttaggcatgatatattattagacgttgctttgagagtatcatttcttgaagcgaggttgctgaaaagataattgaaaaaaagatttgacaagaaagcaaccaacatgatatgatataattcctggctcgttgaacgaacgagaacagacaagttctttgaaaactgaacaaatggatgatgaaacaaagatttcttcttttataaagaagaatcgctagcattaaaaatgagcttatcgctctt

SEQ ID NO: 44 - DNA, 109572 bp, Unknown
  Kingdom: Bacteria, Phylum: Firmicutes, Class: Bacilli, Order: Bacillales, Family: Paenibacillaceae, Genus: Paenibacillus
acttgtgtttatggtggagtagtgaccaagctctaggtcctggaggccaatccgccatttgaatatgtattaataacaaacagtacgcaccgtctgtatatcaataacttctgaataacttagatatgtcattttctgcatgtcatctcgtgtaactataacgtaaaatttaagatagttcaacggtgcattattaattttttaattgataatgattatcgtttgagaaatcgaaaaatcattgacaaacgttccaggattgctaacaataggaatgtaatctatttcagagcaatcgtaaatggagtgtgcgtgggaaccgcgtatattttatttgtcgcagcgcttgttagtttgatttttctatatcacatgaagtgggattcgtaaaatcctgatgtagataaattaaccggcatttagcagattcttcgatattcataagcgaagaagttgttgtgatgccggttttttggttcagtataaaatgaatggaaataccgttccaatttagagtgtaaagagttttattaatgaagacggattgaggtgaacaggatggcgaaccggagcgacgatcaatggaatcgtccgttacgggacttaagaatatccgtcatagaccgatgtaattttcggtgccgatattgtatgccggaagaaatatttggccatgactatccgtttttgccaaaagaaaaaatattgacctttgaggaaattacgcgcctttcccgtatttttatctcgctgggcgttacgaagttgcgtattactggtggtgagccgttgctgaggaaaaatttgtccttgcttattcattcgttaactcaactcgatggcgttgaagatattgcaatgacgacaaacggcgtatttttgcctaaatatgctgtagcactgcgagaggcgggactgaaaagagtgacggttagtctggattcgctcgatgatgatcggttccgccaaatgaacgggggcagaagcagtgtaaaggcggtgctggatggtattgaggctgccgctcaagcagggatgcaggtgaaaataaatatggtcgtgcaaaagggctttaacgatcaggatattgttcccatggctgactatttccaaaagaaaaagcatattttacgttttgttgagtttatggatgtaggcaacaccaatggctggaaattggatcaggtcgtttccaagcagcagatcatcgaagccattcatgagcatatgccgttagagcctgttccaccccagtacaaaggtgaggtggcgacgcgctacaggtatcaggacagagacggggaaatcggcattatttcgtctgttacggacgccttctgctccacatgtacacgagcgagaatttctgctgaaggctccttgtacacgtgcctgtttgcctctcaagggtacaagcttcgcgcgatgctgcgttccgaacagtctgatgacgagattagagcttacattgagcgtgtttggagagaacgtaccgaccgctattcagaggaacggctgaatcatacacagcaagcaacgtctaaaattgaaatgtcacacatcggcgggtgagccgaagagcccgcctgtcagaaacaagggagtggagcacatggaaaagccagctgaggtaaaacgtgagattctacgttatcgtgacggtcagatcaagcgttttgaagacactgtggtgacggagcatccggtgaccatcaaaattaatcagcaggaatttgctaccatggtttgtacaccagagtatgtggaggatatggcagtaggttttttggcctctgaaggcgtcattcaacggtacgatgatattgaagatatttgggttcaggaaaaagaaggttttgttcatattaaaacccgtcgaatgaatgagttttatcaaaactttcattccaaacggtacattacctcctgctgcggaaaaagcagacagggcttttattttatgaatgatgctaaagtggcaaaaagaatgaatgatacccatgttacgctgtcttttgacgattgtttccgcttgatgaatttaatgcaaagctcggcacttacgttccaagagaccggtggtgttcataatgcagcgttgtgcgataaagacgggatgatcctgtccagaatagatatcggccgacacaatgcgctggataaaatctatgggcattgcctaaaacatgatattgtattacaagacaaaatcatagtattcagcggacgcatttcgtctgaaattttgttgaaggttgcgaagattggctgtgaagttgtgttgtccaagtcagctcccacagagcttgcacttgagttagctgaggatctgggaattacaaccgtcggctttatacgcagtcattctctgaatgtatatacgcataccgagcggattgatgaactggttgaatctaaaatataatatacaaatcctcattgtacaccgtcatagttaaccagcatggaataaaacctttcggggtattcattcatgttggtttttcttggtacatatgtggtggacagtcactgtactgaaaaggaggggatgttaaatgaactatcatattcaagtatttgccggacttgcggaacagatgggagggcctataattacggtgcctactgatcaagaaacgatgagcgtttccgcgttaaaaggcttgctatccgagtgtttccctgaagcagcagcccagttgcagggttcttttgttgccagaaatcaagcctatgccgctcctgaggacctcataagtatccatgatgagatagcgattattcctccggtttcaggagggtgaattctattaatagaataaatgaattcgatagaataggtgcaagggggcagatcatatgcaataccgtattcagctattcgcaggtatggcggagcaacttggtgatgtgatcacggtagaactttcacaggaagcagtgaccattgcagacattcgaaaaaggctgaatgagctgtacccggaagtgacttcacaactgccaggttctttttttacccatcataaaaatttggcttctccagatgaacttgtgcttccatcagatgcaattgctctccatcagtcagcacccgggatggagacggtcgtttcaaaatgtggcttatttgctattacgtacgacccgattgatgccgatgaagtaacctcaaaggtgctcgacccttctcatggcgcctcgctgaccttcaatggtacgactcgggaatttacgcaaggtcagcgaacggtgctgctagaatatgaggcgtatgtcccgatggccatgaacacgatgaagcagattggtgacgaaattgcagagcgttggccttctacacgtactgcaattacacatcggcttggtacggtaagaattggagagacgagtgtggtgattgctgtctctgctgcacaccgtgatacttgctacgaagccagccgccatgccattgaacggttaaagcaaatcgtaccgatttggaaaaaggaagtgtgggaggacggctcagaatggaaggggcatcagctgggtggctggaaccctcaaaatactccaaagctttcgcataagggcgaggacatttgaacttttagcttgtctgatcaacttgtagctatcaatggataagtatgggggcgtaaatcaacgatgtcagaaatggacaaaaatcagaaaaaagaagttgatgcacaagcacatgcgcataagtctcatgcccgttattctagacaggaattattctcgaaaattggaccgacaggccagcaaaatatccgtagtaagcacgtgctgatggtgggggccggcgcactgggcactgccaatgctgacatgctggtgcgagcgggcatcggacggctgacgttggtagaccgtgattatgtagattggagcaatttgcagcgccaacagctctatgacgaagcggatgcccgtgatcagatccccaaggcagtggccgcgcagaagcgattgcagcaaatcaattcggacgtggacattcgtgcgctagtccgggacgtctcgctggaggaaatcgacgatatcgcagcaggggtggatcttatcgtagatgccaccgataatttcgatacacgtctgcttatgaacgattatgcggtcaagcaccgaattccttggatttacggggcatgtgtgggcagctatgggacaacctttaccatcgtgccagggcagacaccgtgcttgcattgcctactcgggaccgtaccgcttggcggtgcaacctgtgatacggtcggtgtgattagcccggctgtacagatggtggccgcttatcaaagcgccgaagcattgaagctgctcaccggggacgattcggctttgcaaaataagctgatttctttcgatctgtggaacaatcagcatcaggcgattcaaatcagcgccatgaagaaagccgattgcccaacgtgtggtgagcacccagtgtatccttttttacaatcggagcatcaggctaaaacggctgtcttgtgcggacgagatacggttcaaatccgccctgccccgggtactgtacgtgatctgaatgaagcggcacgtttgttatcccgtcaggggggcaaggtggagcataatccatacctggtatccgttgttatcggaacgcatcgaatcgttctttttcaggatggacgcgtcttaattcatggcacgaaggacatcgccgaggcgagatcgatttatcacaaatatttgggttgacccaaaagattcgaccggttatgagatgtacaatgtttccttattttcgctatcacatttcgtcatctcattttggaatttataggataggggaaaaacaagttgaaaaagaaatttgggtacatatttacgttcgttggattgttggcatgggttctggcgggctgctcgtctccggctgctgtacaatcggcaaagtccgcacccaagacagaactagttgtatctgccgctgcaagtcttcaagatagtctgaatacgctcaaagtccagtatgagaaacagcacccagatatcaaacttacctttaactacgcttcatctggtacattacaaaaacagattgagcaaggcgcacccgctgacgtatttatttcggcaggcatgaagcaaatgaaggcattaaccgatgcttcattggtggaaaaggataacgtgctgcttcaaaataaactggttgtggttattccgcaagataaggcgaaaagcacagataacaaaagcattacgctcaatgacttgatgggtccttctttcctgaaagtggctgttggggagcctactaccgttcccgctggacagtattccaaagaatcgttaacgaaggctggactatgggacaagctggaacataagatggtattcgccaaggacgtaagacaggtattaaattatgttgaaacaggcaacgccgatgcaggactcgtctatttaacggatgccaaatcatccgataaaacggtcatagcactggaagtgcccgaggaattgcatgcacccatcctgtatcctgaaggcattgtaaaagcaaccaaacatagccaggaagcaggcgagtttcttgattttctacggacagaggaagctatgagtgtgttcagtaaagatggattttcagcccccacagaaatgacgggaaaatagaattcacagataaaggagggggtcccgttggattggtcagcttttcttcctccggttatcgtatctgttaaagtcgctgtcgtcgccagcatcatcgtctttttattagctactgtggtagcgcgaatgatggcgaactgcacgccgcggaggggaaccagcgtgatcgagaccgtcctacttcttccgctcgtcttgcctcccactgttgtcggctttattttgctcatcttgctgggaaggaaaagctggattggcactgccttcgaaaacctgttccagcagacgattgtatttacgtggggagctgcagtggtggcggccgtagttgttgcttttccactggcttaccgtacgattaaagcaggatttgaagctgtagacccggagctagaacaggctgcacgtgcgcaaggtgccaacgaatggcaagtgtttcgccacattacgatgccccttgcctatcgaccgctcatttcaggatacattctcggatttgcccgagggttaggggaatttggcgctacgctgatgcttgcaggtaatattcctgaacagaccgaaactctgcctacagcaatttacactgcgtccgaggtcggaaatatgacactctcctggagctgggtagccgtcatcattttattctcttttatcatgttgatgctttctaatcgactggtaaaggattagtccgtctggagtaagaacatgcgcagtctgacgatagggcagctgcggcaacgttatagagcagcttagatcaccaagaaaccctgcgattactaaaacgcagggtttcttgttcctttcgacaacgattacggtgacctcccggtccttggtatcgcgcatatggtgaaatttacaataaaaacaaagaggatgaggaacatgaagaaattcgggcaaatgtttctggtaggtttagccatggctttcgggcttggtctggtggccggaaatgtgcaacctcccgccgcttccgcggccggtacagaatattatgtggccacgagcggcagcgactctaatgctggaacgaacgatgcgccgtggaagacgttgcagcacgcggccgacgtggctcctgcgggcagcacagtttacgtccgaggaggcgtgtacaagcagaaattaaagattacccgctctggctccgcttcgcagggtcccattgtgttcaccaattatgggacagagagcgccattattgatggcagcggacttccggtcagcgggaacgaagggctgatcgaactggccgatgtcaattacgttactgttcaggggtttgaaatccgcaattttaccactgcttccaagaacgtggtgcctgtaggtatttatgtccacggttcgggcggcttcattaatctgtccaacaacaaaatccatgacatcaaaaacacggtcactccgaccggcaaagatcggttgggtcgggacgctcacggtatcgctgtttacggcacgaaagctccggcttcgattcacgaccttacgatcagcggcaatgagctgtacaatctcgtgctgggctccagcgaatcgctcgttttgaacggcaacgtggatggctttgcggtgaccgacaaccttattcacgataatgacaacatcgggattgatttgatcggctttgagggcaccgcgccgaatacgacttacgatcaggcgcggaacgggttggtgaagggcaatcgggtgtataataattcagttcaaaataacccatcttacaagagcgatgacaactcggccggcggcatttatgtagatggaggcaaggacagcattattgagcagaactacagctacaacaacgatatcggcgtcgaaattgcctctgagcacgccggtaaagcaaccagtaatattacggttcgcagcaacgtgatatataacaaccgactgaccggcattgccatgggcggttacaatgaggagcgtggcttcacggtaaactgcaagatcgtgaacaatacactatacaagaacgatacgtttgacgacggaagcggtcagcttttggttcaatatgatacgcgaaacaacgtgatcaaaaacaatattttcgtggccagctccacggatatgctgatatccaatggatacaccaaaaattccggcaatgttgtggattataatttatatttttctccaggcggcagctcagaggccaattggacttggaaaaataaagagtatacgggattctccgcatataaatcaggaaccggcaacgatacgcattctctatttgccgatcctaaattcgtgaatgccgcgaacagcgacttccatttgcagtcttcgtcacctgcgatcgatgccgggaatacggaccgtgccatcgttggaacactggatatcgacgggaagcctagagtacagggagccgctgtgaacatcggtgcctacgagtaagtcctatattttatgacaaacaatgcatggcgaaagtgtttggggccactgtttgtacatttttacaatgttccttgtaattaaaacaccttcaaagtgaaaccccatgtcgtaagatatggagataaccttgaaggtgtttttgcgttggcaacaagattaagctatcctcggaaagtaaaaatggaagtcatacaaatgagattagaaagttgttcctgttcgataggctacgattaacatagttgttgcacaccttttaaccatacggatttgatcgacaaagtatccgagatgttggttgtcggatcaccgtttactagtataaggtcagcgagcgaaccttcggcaatacagctgcgatcgttaagcccaaagcaacgggccggtttcgcggtagccgactgaagcgcttctatgggagtaaatccggcctcaaccagcaattgcatttcatgatgaacgctggctccatgagcaaggccgccaagattgggaacaggaacgggggcaacatccgtcccgaccagaatatccacaccggcacggtgaagatccatcacatttttaaagctattctccaaattgccttgcgggaaagtatggaagcttgagttcaaaatatcgatccattctggacttaatttggaataaacacgtgaatcatttgccaattctgatgccggattccccagaatggatgagttcaataccaagcacggtataacaaacgcgcctgaatccgctatggatttcaccaactcagatgtgtattcgggcctgtcgagaaacaagtgacccaatccgtcgactcccatatcgatggcggtttgcgaagagtgagccgtcaagacgtgagctatgactattttatcgaacttatgggcttctgccacggctgcctttaaaatctcgtcgcttaaaataggcagtccaggggcacccaagaccgtcccttcttcaatcatgattttaatatagtcggcgccactctccacttgggtatgcacatgtttgatcgcttcttccactgtcgtcacttggggcactttttcgtgatcgtgagcgtaggcggctagcatagcttcccggtcctccttgggtaacttctccaattcctttaatacgaactcaggaatttcatcctcatcctgcaataattcatccggatgaccacctggagcagtgatcgctgtgccggcggaacgaacttcggcgacgtcattcacgtttttcaactggatcttgcgccctctttctgtaaaactgccgttcatttcgagttctgtcgtgacgccgaattttaaagcatctcgtaacccaccgattgaagtgtggacatgcgcatcaatcaggccaggcaataatgtcgcattttccccatcgatgatcgttgcatgtgtcggaaggtctccgcctaccgaaataatggtttccccttggatgacaacatttctgggctcaataactttttctccatcgaaaatacgtacattcgtaatcgctgtaactttttctaccgtagagctgctttgagttacattcttcatgtcgttcctcctaagtgttcagttttaaacacttagaattctaactattagttttataactgtcaataaactgattttcatttgacaaacagtttagagatttatatagtttatttactgacaattagacttctaataatttgaggaggtatgattatggaaacccaaaaggatacggtttttctggatttgtttcaggttatcggtcttaagttaaagaaaagagcggacgagagcataaaagagttgggattaaatgctcaacaaggaaaaatgattagatatatctacgagaatcaagaaaataatttaattcagaaggatctggccgatcggtttcatctgcgcggagccagcattacaagcatacttcaaggtcttgagcaaaaaggattcatcgagcgcaaaatcccggccaataatgagcggcaaaaaaatatttatgttttaccaaaagccattgaattgattgaagcttttagcgactcttttcaaaaggtggaggacgaaattgttcaagccctgaccgaaaaggagaagcaaatcttagaggaaatgttaaataaaattaatgaacgtttataattttagataaaatcatgttccaaaaatcactttcgctagtctctgttttataggagaggaatcggttatgatggatatagtaatagggattttagtagattttaggagagcggtgcgatatgagaagggaaacgggttttaacgaaattattcgaaaagtacgtaaagagctgtttgggaaaggcccggagcgcatacatacaacctttgtagataatatggccatcacgatgctgtatggaaatttaaccccatctgaaaagtttctggcacaagaagaatctgggaaagagatggtgcatgcagctcgaaccaaaatggttcaaaaaatatatcctacacacttcaataaagaactggaggattacatggattcccggctgctgcacctcttttcagatattaaagtggaggaagatatagccatctccgtttttgtatttgaagataatattaccgcaaaataaaaagaaggcggaaccgatatagcatccatattgttggagagttcggctacaccctcgatttaattaacgatgtcctaattgaaatggaatgaatagagagtttttctgtttacacgttttttcttcttcgatattgatattgggaccattggtagagaacaaaacatcctatgcaaaaaccaaggatagccaccaaagccgccactaggaccatggccgaaaatacataagcgacaatactccactggagcataaatcctacccaagcgaccagcagaaaaaagacggcaagaagctgattaaacctttgctgttctcggtcctcctgcacatatgaggaggggcttttcttcaagaaaagcttggctatccgcattactggattgaagttaaaaaggacgccgagcaaccccgcgataagaggaataactagcatcccatatccccctgtaatccaagtaaaaactacagataaaacaattacccattgattagccctgactaacgggcgcggaatggatggattttggctcaaatatatcatccttttcatatcgaaataaattcaaagatggaaatattatagcctaacatttggggaatagataccaaaaaaccaaagactctgcaagcccatctgctaaggttttttgtcttgcttaattcctagcaatgcataatccaatttgttacaattcttatatacgcctattggggaagatagacattgttgtactctatgcgtaaatcacggatcaggaaagggacctacatagtttatgaaaaaaaatgattttggaaataggatgaaggaatatgaaaatgcctatagattaagcctaccacgccgtttacccaggtcagcctttagccacttttgatgcgagagcatgggtcttgcccaaggatgaggttacaaactactttctatggagacaacaagatgctactaaaaatagcatttctatggtagctcaagcccatttcaggcattcagaattagaaggattgaacggaaaacagctacaagacaagctttttgtggaaaaagggctaaactggaacgaacttccggtctggcaaaagcggggaatttgcattaccaaacaacagcaccaacaaaggcgaagccgtcagaagcaagtgggatgttgatcatgaaacaccgattttttcacagaatagaaattacattaaccaatatgtatacttggacaaggatgtgtagatttggagtgtgtcatttttataggaattcaggcttcgggcaagtcgacattttataaagaacatttcttcaaaacacatatgcgaataaaccttgatatgcttaaaacacggaatagggaaaatatttatctacaagcctccatcgaaaccatgcagcgctttgttgtagacaatacaaatgctaccgttatagaacggaagaaatatatagatgcttgtaaaaataaggggtttaaaattattggctactattttgagcccgattttgcagaatctattaagcgtaatgggcagcgtacaggcaaagagtatattcctgaaatcggtattaaaagtgtaatgagtaaactagaggttccaagctacgaagaaggatttgatgaactctatagcgtgatttccattgaaggaacgtttcagatcagaagactgccggaaaaccatacaatataggggggactaccatgaacatacctgagagattcatcaaacgttttccagcatacgaagatgtatttgccagcgatcttgaacatcatcgcaagcactttctgccgatttgctcgattaatcttcagtttttattcccggagcaggacgagtggctgcattttgtttccgcaaaagaaatctacgaaggctgtgtgggtgaaaatactcagcaatttcatacctcatataccaaggaagatatgctgggtttcgatgtcattgacggcaaatacaaattcgaagcagactggaattattttagtctccatcagaaagagcaattggaagtcacctatgaggcgctgaaatctaccggagataaagcgtacctacgtatgaagagagaagtcatggcgttggacggactggaacaggtgtacatggctaatgaacaagactaccaagctcgcaaagcatttttcctggaaaacaataaaatttatacatattcctcctttggagaggccaaaaattctgtggaagaactcatccgtgattttgaggaaaagcaatccagcggttgggggctgagtttccctgaagttaacggtattttagaggatatcgcatttcagtctgacaaggctcaaagttttatcaaggaatatgacgaatctctggaagagatgctccagttcgagcaaaccaatctgcttcatgtgcctaagcgtcccaatggtgagacttttatctatatcggttccattaccggatattattttcaagcgtgcggggcggatgccgtctatttattttacgaccaagaattaagcaaagcggtaatttgcttcgaatattcataagtgaggattttgcaaaatcctgaagtatataaaaaactcccatcaagggagttttaatatttatttcttattcatctccacatcatgctctttggcaagtgtgttgacctgttcaccaaaatctctgaatagttttctaccttcgctgagcttagtattactttcattgattaagttcagatcctgtttatccaatgcatcgagcatcttaatgaaggcttccttttgagtactagcggccttgatgtaggtttcgtggacggctcttacctcaggcgtttccgtctttacagcttctaacttatcaacaaatttggtgtattccgggatgatatcgtcttttaaagcattatatagtgtaacatcatctgtaaagttatctccggtcacagcttcatacttatcagtaactgctttttcatcttgtgccaaaggaagcattccatcattgacatacgtaattaaatcttttttaaccggatcggtagagcaagctgccaaaatagagaagcaacataatactaacataaacacgctaagttttttcatctgtattccccttttttatgtatgttatgggtaattcgattcatttaatagtcagaaagaactatccatattgtttgattatatcgtataaataagagaatggtaggaattttgtggtaaaatagtgtcaaaattaagttgattgatatgcttttaacataagtgcaacaggaaagttaagcgaaccccaggcgcacataaaaaaaacggatcattcgcaccttaagcggggcgcgggattttagaaattcacgcctatttgcttccatttttgagttaaaaaatgagattcgcactttatgcggtgagaagccttatgcagtaaggcttctcaccacatgcttgctgtcgctccccatgtgggagcgtggattgaaacttgaaaggctcgactctctataaaagtgatgtgagccttctttgtcatggaaagatagaagtgtagatgtggggaacaaagcataggggggatgtacgattggaattgggtgaaatgaaaaagagaagcccaataattatgtaggcttcgtggagtgttgaattttagggtgtagcgagtgtacaataatcagttattttcttcctcaaattgcaacagtatggatatgtctttgatatctagggcatgggcgattttttcaagcatgagcaggttcacttcttgtcgcccatttttacaaagctgtgaaattcttgcttggttaacacctgatttttcagaaagttgcatttgggtcatgtttcgctcttttaatacttctttaagtcttatgtttaattttagcaaagaaaatagacctcctaaaaatccattgacattattcttttatgcgaataatatagtacatataaatattcgctaaagcgaatataatttatcgcccaaagggatgttacaacatacccttagctttgctattgccattttaccagatttcaaaaggaggaagatacagtgactacgaaattcaaagcgaatgagcaagcaatcaaggatattgtacgcatgagaccggtttggacgcaagaagttgaacatggagaaactgagctacactactatcatattatggatgccctcaatcgcaagtggcaaaccattggtataaacgtctctgacgctattgaggtgtttgaaaaaggacacaacgatgcatggacatacattttggagccagccccatttaatcctgacctgaccgctaacgatttaattaacaggctccatatcggccccgatgcgtggcatatacgcaatgctatgcaaatcatactgaactcggtggaaagacgcaatgcattcgtgagtcgtctcgttaatgtaaacagggaggatatctgcaagcttctttgcaccatgaaaaatgaatctccaaaataatcagctttcagacgaggcatttatacatatgtatggagtgaatcctgtggaggccttgtctgtttattttctggagtctgtggatattcatacccattgggaatggtgtgatgctggcggtacaagccaaaaggctattcaatataaacgggaggccccttttatgacgttggtccaggctattgagagagctgagttggaagcataaattgctatagcattatatttttgcccgcaaaatggacttccacggaatgtgtctcctttacgcccaattgaaaccaaaagctgaaaaggatatagagaagtacggtatgggttgcgttgaatataggtagcaaaatataataaataaagctggtgcgaaccccaagctcacataaaaatcccggttccttcgcacctcaagcgggacgcgggatttcagagattcacgcccatttgtttccatatatacgagtcgaaaaaggacattcgcacttaacatgctgggaagccttacacagcaaggcatctcagcaggtgctgtcgctccttatgtaggagcgtgggttgaaatttttttggacaccatatgttacgtataacaaaacagtcgctccttatgtaggagcgtgggttgaaatcatccaatagtaatccccatatacctaaatttttgtcgctccttatgtaggagcgtgggttgaaatgtcagatgcgtggtatccgcagtttcattcagacgttgctccttaagcaggagcgtgtctgcagacacgcaattcagaaaagctccttagagtgagggagcttttttgtcgtgatgtgatataaagtgcggttagctaggagagttgcagggggcgtatgaccgaggctaagcttgatctgttaacgttatagggagagctggcaattgctcagcctgtgatgtaatttattgcagagatacgtgacaatgaattattatattagccatctgtaaaattgaagtgaagtaggttatgtgaatggaaagaaatgatacacaaaaaacactggcgacctggtttaattttaaattccgactcttgataggcggcatagtagttggcttgttatctggtagcgtggttgtgttgttccgatttgtgttggaagaagctttggagcgtgttcttgaattttaccactatcaattgcgccatatgtggattgtcccattatggttcgtgatattagtaatagtcggctgggcaacgggaatgaccgtcaaaaaacagcctgcgatttccggtagtggtattccccaagtcaaggcagtcctacagaataagctacatatgaattggtggaaggctcttacagctaaatttctagggggtgccattagtattggttccggtttgtccttgggaagagaaggtccttctattcaaatcggggctctaactgcccagggatttagtcgtttgatgagtaaatcgaaaacagaagagaatatcctgatcacctgtggagcaagcgctggactggcagcggcatttaatgcacccattgcaggggtcatttttgcgttggaagaaattcatttgaatttctcgcctcttatcctgattgcgtcactcgcttcatcactggtggctgattttgtatccaaagagttttttggaatgagtcccgtttttcattttatgaatgtggggcctgttccgctgaatcagtacgttcatttacttattttaggcattattgtgggtattatgggcgttattttcaataagtctatatatgcctttcaagatttctatcaaaaaatgacctggctgcctgctccatatagacccattctcccttttgtaatttctggagtgcttggactaagcatgccattactgcttgggggcggaaatggcctggtgaacgatttgataacggattctttttcgttgaaatttcttcttgttattttaatacttaagtttttattcacgatgttcagttacggttcttctgctcctggtggaatatttttacctatgctcgtgatcggggccttaattggtgtgatgtatagcaagttcataaatggattatggggaatgcctgtgcttagcgaaagtagtttcttgattttggcaatggcaggctatcttacagcgagcttgaaggctcctattactggaatcatattgattaccgaaatgacagggaatttcactaatctgctatctacaggtgttgtctgcctcgttgcctacatgacggccgagctgtttcgttctcatcccgtgtatgaagttctgctggagcgctttttgcatcaaagaaaggcaagtggtgaaacggagcaatcatcaagcaaagttatacttgaagtacctattcttcagggatcgcgtttggacggtacacaaatcaaggattttcagtggcctgctcactgtctcattgtttctgtcaagcgcgggtcggttgaaaaaattcctgatggacagatgcttttgctggcaggagattatttgaatatacttacaagcggacgacacgctgcctatgtccatgattgtttgagagaacccgcaggtcaaagcaccgactggataaaagggattccaaatgaaaaaccttaaagaaatatcttccatcgaaaccagaattactttatgataaagatagatatcctataatttccctgtatatatttagggaatagctgaatatctttaatacatttgagaggagatttcagtatgaaaaggtttaaaaaggtggtttcagttacactaagctcaatgctcctgctttcattcgggatgacggcaaacgcgagcgggagaggacggactaagctgctcgggcagtttccaatgtgcagctaacaactgataaggaaagttttattgaacaattaacacgcgcggacaagccttcagtatcacagattcggtgtacaccattacagaaaatatgaacttggcgacaccacagaaatcggtattgaaaaagagagtgaccccttcgctcaaagccagcacaaaatcagtatcagctaaagccgcagcgaccgtagcgacagcgtccactgctacatattccggtacgatttcagaagagggaggcacacaatttttatatccgatctatttacagccaggtgaattgctgcaggctcagttggatggtccattttcagcccagcttgactatgacttatacctgtatgagtttgacatggcaacaggtgatactaattccaatcctatagatgtttccaactacgggacttatgttaacaattatgagcaaggaactgcttctcttccagaaaacgtaggagctcgcaactcaatcggagccgagaaggcttacgcgcttgcagttcatgccaagaaggggtctagcattaatgatcttttctatttaactgtagcagtaagctccagttatgatgtctatgagccggatgacagtgccttccatgcttataattttactgttaacgacaaaggctcctcgattaacttccgtaccatccattccgctatagacaacgattggaatcaagttacagtaccagccagccgtaaattatgatgcattaaatgtgaagctggatagcacttcggaaagctatgggtacaaagcggaagtttatgcagctcttacgggcaatcaaatggtgcttctaccgcaaaccaatcataatgttaccctaaacacagggacctactatgtacgagtgtacagcacaagtcagtattcagccgaccatttgtatacactatcaattaaaccagtgcttcgagctggcaaaatttaaattactggctataactccaatggctattatgattatccgacatattcttacggtcgtcattatcgtattaacggaggcagcagtctgatcgtgaacggtgttgtgaaaacaacagatggtcaactggttcccaatgctcctgtcacggtcgtatggctggataagaactggagcgagagcagcggtaaccgtacgagaacggcttctacgtacaccgatgatagcggtaaattcagtgtgcccctttctcttccacaatcgacaggaaaaaatgtagtttatataagtgaaattggttctacacactactatgatcttacaggagttgccgctcaggtcgatggaacttcgattagtgcgacggacattgtttatctgtttgcttatagcttgagaaattaagatatgctttaatgtagttttgattcatgagagtcgctttttttgaatggttagctgaggctttccacttctgaaagagcgacttttcatgtttattcaccaagaataagaaaatgatcttgttttcatagattacaaatagaaattgttttgcgtaatatattccaatagaaccaaagatgatttatgattgagccatacagcctagaaatcaccctggtttatccggggatagcgggaattccttaaaccatttgagaggggatttcagtatgaagaggttcaaaaaggctattgcagtaatgttaagcatgatgctcctgtttgctttcggaatgactgcgaatgcgagtgaaagtacggaggctgcatcggatcaagcgattaaagcagaatcaaagattcatctaacaactgacaatgaagacgttattaagcgtttgacgcgggcagacaagccagacagcgttacgtcttcggtttatgtcatgcaagaaaatctcaacttcaagacaccagagacaacctcattgagaagggaacccgttacttcgctgaaagcaagcccaatggctgcttcagccacagcttcttctgctacgtattccggtacgattacgcaagagggaggcacacaatttttatatccgatttatttgcagcctggtgaattgttgcagtcccagttggatggtccattttcagcccagcttgactatgacttatacttatatgagtttgatatgacgacaggtgacattaattctaatgccattgacgcatccacctatggtacttattttaacaattatgaacagggtgctgcctcacttcctgaaaacgtaggaacccgtaacactgccggatatgaaaaggcatatgcgattgctgtccatgccaaaaagggttccagcatcaatgatcctttctatctaacggtcgatacaagttccagctacgatgcatatgaaccagatgagagtgctttccatgcctataactttacctttagtacgggtggttcgtcgcttaattcacgctctattcattcaggcattgataacgactggtaccaagttacgatccctgtcagccgcaattatgacgctttgaacgtaaagcttgacaatgtttcggacggctatggctacaaagcggaagtctacggagctcttaccggaaaccaaatgatgcttttgccgcaaacgaatcataatgttagcttaaatacaggaacctactatgtgcgagtgtacacaacaaatcagttttcagctgaccattcatatgcactcacacttaaaccggtgcttcgggctgggaaagttgtaattaccggttatgattcttctaaaaatgggcctaatgactacccaacctattcttatgggcgccattatcgagttaatggaagtagtagttttactgtgaagggcgtggttactacaactgacaattatccagttgcaaatgctcctgttgacgtaacatggttgaatcaaaactggagcgaaagcagcggaaatcgcactcgcacaggtactgcatatacggatcagaatggagtttttagtgttactgtttccctgccaccttcaactggaagtattgcagaatatctgtctggagctatcagtttcacacactattttgatctttcaggggtagctgctcaggtgagaggtacttcgaatatagccacagatgttgtatatcactttgcttacagtatttatggagggtgatagatggggttataaagcaatcacttaaggtgaattgttgcttgaatgaaataaaagtagtttgtttcaatatttgttcattattgggacaaagcatatattcattccatatatgctttgtccgatatatatagaaacagggtcacattacactatacatacgccttagattgcctgttacaaacatgacaggaggaaatagaatgaattttggaccttttagagcacagcaagcgattcttaatgcaagtagtttacggattaatccgacaagcaagcaagctccaccaccccagcttcatgaagaacaggtctccagaatggtagttcaagactccatggagatcagtgaagctggtagacagttggccgaaggggctattgtatcacaggctgccaagtatttcggtacaacacagattaatgattcattaaaccgggttttggaaggtcagccagaagaagtgtctaatgcagtgtacagtatgattcaatctaattttatcgtcgacggaacagtaacggatgagagtcagcgagctgtgctactggagatgggagttactcaatccaagtatattgctgatcattacatggaaggcgacaaggccaaagagtttctggaaaccatgaaccagattgctggtattgctttaacacgatccactgatccagagaccggagatattagctacacgactccaatagatcgtccgtcaggtgctcctgaggattatgtcaagctgtcggagatgatgaagcaggtcgatcctcaaaaatataccgcgtacatgaatgatattaaaggtggaggaaatgggctgagccaactgttaaattttgcgcaaaaggttcctcaacatcccgattggattgagaaatacaaggaacgcacgggacagaacgcagagttgctaaataacacaccgttaaacaataggtttgacaaagctgatacgacatcagcttctgcttttatgaacagtatgcaaaatcttcttaaggaatcttccgctactcaggattcttacatgcaaaatatgcgaggattttttcggaacttgggcgttcagattcattaatatcctcaaataatttgtcagttctgtttacatcctgctaggaacgaagtataatagcttcaaaacatactcgtgatatagaggaagcacctcaaacctaggcattaacgccttcgtttgaggtgctttttctattttacccgaagcgagtttgtaaaactctttgaaaataaaataaagtaaggagaagtgtatgtatcgaaaaaataagcgaaaggtaaggaagtataggaagtgggtgtatggatttttggctgtattcctactattaacgatgattcccatatttccggaaagggcatcagctgctgctcaggagatcatggggggccctttttgccaaaacaatttgccgggtggaggcgatagttggggttcttggtcaggaaatgggataggagcaacagaagtatatactggcatgggttcggccaggtataaatgtgatggtactacgcagccgacaaatcgttttattgatattggaagatccattaagacttcggattacaggatttttgtttacattgaagggtcttatcatactgatatatatgcatctaataacgcagtaggcgacagttggaggcctaatggaacaaacttatatacatggactaatgtaacgaaattctatgcggatagatattatcagggaaaatggttagatatcaccgactctattacattaagagatgttcgatatttcagagcggtgggagatagccaacagacaagtgctgaaatatccaagtttggaatccgtgttattcccaaatcggacctaatgcctaaaccacctcagatccatgcaggtacagagggacaagcgatcacaggatggaccaaagaacctgtaaccgtgtggataaatggggacgtggctcctgaaggactaaaatactatgaatatagcctgaatggaggagcatttcagcaatacaccgggcctttcactgtttatgaacatggtgtaaatacaatttatgcccggacggtggatgtaaataatcagtatagtggtctttcttctgggaatgtccgaatagataagatgcctccaactccacccaccctaagcgcaacgggaaatagtaatgactacaccatttcattacagccgggaacagacgattattctggactagcccatactcaatttcgtttgacaggcgttatgaatcaagattggcaggactatgttggagtgtttcatgtgaataaagatggcaaaagcacggtttatgcacgctccattgacagcgtcggtaatgtgagccaagaagtaagcaaagaaatcacgattgataaaaagggaccgactgctcctgtcatccgggctagtgaaacaggtccaacgaaccgtgatgttaatgttaccattgattcaggaagtgattctacaaatggaattaagatgacacagtatcgcttgggtccattaggggaatggcagacatacaatggcatttttacattaaacgcagaaggggcttacgaattagcagcacggacgatcaataatctcgacgtgtctagtccaatcgtgactcaatcggtcttgattgatcgaacccaatcaacccctccgaaagtgacattttctgagttgacgacacctacccgatataccaataagccagttcagtttgctctatcgggtgcgacggatactacagcagtacattatgaatatcaattggattctggcgcttctgtgtctgattcatcaggaatattaaagggttcagggatcatacaagtgactgcacaagctgtggatgcagctggaaatcgaagcgatacggtgtccgcaatgtcttatattgatttggaaccaccgacgatccaactgacgccggattcgcgtgaatggaaagatacccctattcatgtgaggatacgatatgccgatcagcattcgggggttgagttatccacaatgcagtataaaatcacgaacagccctgattcacccgaaaactgggatgctgcagccgatacaacaatccagatggatctttcagatgaaggtgaatggtatgttcatgccaaggtcaaagacagggtgggtaatatttatgaaacagttagcagtgctctgtgcattcaaaatcagccccaaccggttgtgctctctgcgacatccgtacgaaatacggaagctgatttgcagtggactctcccgtcgggccttgatgatggttacgtttatacagtccgaaatctaacaactaatgaggtttgggatgttacgcatccaacaaattattttacagttagggggctacaaggaggacggcaatacgaatatgaagtgcgttccagtaaccatgtaggaggcaatgcatattccaatcgagtccatgtattaacgttacctgatgctcctgatcatatccagttacaacctgtctctcgtcattctacagaaatcatggctgattttacgccagttttctcagctaacaaatataacattacagcagcggacgtaagtacgggagaaatcatatttaggaataccgttacacaggatgtgtataatccaattacgggaatgaagcctggtcaatattacgatgtttctgtatcagctattaatgacactggagagggtacagcaaagcatgtatcttttctaagcctaccagacagcccgaacggattccggaatgtaactgtaagagaagatggaatcgatttgaagtggaattctgtaatcactgccacctactacgccctagaacgtgacgaggtctcggtttataacgatgtgtatacagaatttaccgatagtgatcttcaggcaggaacagagtatggttataacgtttccgctgaaaatgcaacaggattcggagactatgcccatctaggagtcatcactttacctgatcgagtaactacaatatcaagtgtgacgaaggatgtgtatgctatcggtgttgcgtggcaggatgtgcagggggctgaaggatacatcttgaatgttaacgatgaaccgaaggtgcgggttgcacgtggtatccattcatatacttttgagggcttgcctgcgggtagatctgccaatattaaaatacgagcctacaatcgaagtggtacaggtaaagatacatctatcaacgcattaacactacctgattcagctgtgcaacttgcaactgaagatgttcgtgagcacgatgccacgttgatatgggccccggttgatggggcaactcaatataaggtaacgatcaacggtcaagattattatagtacggaaccacgtgtggttgtatctggtttaacaggtgggagaaactatgattttcaagtgagcagtgggaacagtagtggtttcagccagccagcgttgggtaagctgttgacacttcctcctcaagcacaaaatgttaatgttacagaacttgaggatggacagattttactgagctgggatgaaatcaagagcgcttatcaatatactgtaacccgtaaagatacgggggaagtttttaacaccagagatgcccatattaagctttcaaatatccagcctggtatgatttactcgtttggtatacaggccgtgaatacaacgggggtaggtaatataactccctttacgcatcgcgctttgccaggtcaaataccagataatagattgactgtgaaagaagtaacagataccgacttggttgttacgtggaaagaagcttcgggtgcagatgcttacaatgtctaccaaaacggggggcttatcggtcatacgacctcccatgaatttaaagtagatggattggatagttctacattgtaccgtattaccgtcaagccattgaacacaagtggtgaaggtaagcagacagaaggtcaggtcgagacgctgccgtctccagcgtttgcattttcgaagacagaaacaacgaatagtgagtttatcatccattgggagtcagaccatgagaatgatattttcgtcctcgcgagtgaaggagtagaactatatcgtggtaaggaacgaagctatacatggagagaacttaaagagaagcaattgtataaagttcaactatgggcagaaaatagtcaaggaaaacgcacagaggcaaaacaagcgaatggaaaaacaacgggtaatactgcggacgcagggggtggagcaggaggggcggagagtgtaagacagattcagcctgttgtaaaggaatcgttagaagcagagtatattcaagattcaaccgttgagaagaagccaaatcattttagcgacattgaacgggtatttaataaagaaaaaataaatgtgcttgccgatttgggtgtagtaaagggaacaactcacatgctatttgagccgaacagacctgtgacgcgtatggagttcacttctatgctggtccgttccttgaaattaccgctcgaaacggatgtgactttaggcttcgaggatatcaatccatcggcgtggtacgttgatctgctcaaaacggcgattaaagatcaggtcgctcgtgggtttagtaatagagaatttggcccagatcggatcattaaccgtgagcaggcggctaaaatggtgaataacattatcaaagctactccacagcaagaaagcaatgcatactcggattcctctcaaattgtagagtgggccagaaaggatgtacttggactaaccgagattaatttagtacaaggatatccagatggtagcttccgtgccaaacaagaggtcacacgggcggaagcggctgagatgatttataacatgctacaaatgaaatagaatgaaaaaggggcggcgttggccagccccttttttgtgtgtagtgacttattctgcaatagcggggtttatgttggatgctctgtaggcaggaacgccattaatgagtgcggttcttagctgaatatatcgtataccataataggaggttgtactactcaagccggatgaaagtacagttattttataatatgaaaaaggaatctcattactaaattgataagttgtttttgcagtggttggcaaagtttcgacttcacctaacctaaaccaattttctccgtcattagagccgtgaaaagaaaatgaaagtataaaagctcgagaagatggctgagctaaaagaatatcattgatcgtcttacctgtatctaatttgaagatgatttctccacctttaccgcttaaactgctctcccaatagagattattatcgactaaaacatttttcggaaaagtatttttagactccccgttggttgaaacattttcctctgctataacaacaggatctacagaaaaagtatagttgtctggattttggctgaattttgccatgttgaaattccccttttagtttaatttttgaatgtgttgaaaaggttgatttatatcatttatatggaactctctatgaatatattccttgatgatggaatgtatactagtgtttaagcggtctaacatcataattgcaagctcatttgcgggcggggagttgcatgtttagaatataaataactaattgaggtgcgagaaaggaaatggatagaatatgaaaatatacacttattatttgggagacggcatattccctttggattgggaagtttgttttagtactgttgaggaatataaaagaaaattatttgagaagtacacggcttcccaagaatataatgattttgtaataggtggatttaatgtgcttaccgacaaaatagatgtgattctgaattgaggcgatgaaagtaatggtgctgagtttgctattgttttaaaacgagatgaagatggagatacaatggtctattccccactcccattgtcatatttagaaagaagttaatactctgctgaaagaaaaggaggaaatcaagtgatgaataatgtaaagctatcccgggtttccctctggctatatggagtgcgttgatttgtgtcgaagagatctctacgtttcgaattaagtatcggaggttgctccagaaaggtatctggcaaattgttgcggagcagttttcggagtacaggcacggatgggcacctgcctacatacaataaacagaccgcaagcccggtaagtaacaaaggccggtaagttcgcaactacctcaggaggtgtcatccgtgcccggactatttagcgctatcgctctgttcatcaaggaattgacgctgctcgtttcctacgtgaaaaacaacgcctttccgcagccattgactgagaaagaggaagctcgacacctaaagctgtttgccgaaggcaacgcacactcccgtaacacactcattgaacataacctacggctggtggcccatattgtgaaaaaattcgataacaccggcgaagatttggaggatcttatatccatcggtaccatcggactgatcaaggccattgaaagctttcagactgggaaaggaaccaagctggcaacatttgcagcccgttgtatagaaaatgaaattcttatgcatttacgatccctaaaaaaaacacgcaaagacgtatctctccacgatcctatagggactgataaggaaggaaacgagattactttgattgatatcctcggcaccgaggcggatgatattgtagataaagtacagctcaaaattgagaaaagtaaaatctatcgcaatctggatattttagatgagcgtgaaaaagaagtggtgatcggccgcttcggcctggaagccggaggagaagaacgaacacagcgggaaattgcacgagaactgggaatttcgcgctcgtacgtgtcacgaatcgaaaagcgcgcgctgatgaagttgtaccatgagttttacaagcagaaggggtaatggataaggagatatatgaagccgcttgaggcccttaacagggcctttttaggtctttttcataattcaattacttgcttcttttcagaggcgtgtttaaattgcatccccctctacccatccaatattcttatctaaggctatcttataaaaacaactgctccttttcgcttaaataataactattttgctatgtgttttcatttaaaacgcaaataaaagcctgtagtggttttctacactacaggctaaaaatgcttgatattattgggcgttttatacttcgtcaggacaagctccttcgctagtgggctctcttggattgaatttattttcctacatactcatccaaaaagcgatctactcttttgaaatactcagtagggtaatggttgatggcatcgatgtgctccgtattttgcgggtaccatacttctgcttttgggttatcttttaaggactcgtaaataatttctgtatttttataactaatttgctgatctccagtaccatgaatgagcataactggcttgtcttgcatcttttttaccgcatccataggagatatggaatcaagatcaaccttaaaggcccaatttgccatccatgtcgatgtataactgaatggaaacgcaggtaaacctgaaaagaagggcaaaccctctctcaaaaatagaccagcattacgaaaaggactatccgcaattacggctttgatgtcatcactttcacttgcggctagcaaagaagtagcagcacccattgaaaagccgataactccaatcttatcacccgtatggtctctggattttaaatagcttacagctcctagcaaatcgtatttttcattgaagcccagtgtaatcaaatcaccatcggatttaccttgtgagctgaggtcaaatgccaatacattgtagcctttcggaacgaaatgctctactaacttttgggtccgccctttgactaaacgattgctcgtatatccatggacgacaataattgtcttattacttgctttaccagaaagaccacttgcaggaaagaaggaacctctaatcgtattatcatttttcaaactcttgaactcgacctcttcgtagggagttttatcgatattcaatccgtagctgacattagtatctctaggatggtgcaacaaggtatctactactttataagatataaaaaatacaagagccatcacaagcaaaagcacgatccctaggctccataaaattttctttcgttttttcacacgaacgttaaatgtcagctcgggttgtaatgatgcctgactcattcagactcctccagtttttctttaggttgtatgggggcgaacaaataaaaggcatgccccttcagattttcccactcgggatgatgaataatactttctccaagagttaagcccactccatttaagaaagagatataggcacgagagatcattgctggagaaaagcttttgttgaattctcccattaactgtcccttggcatagacgcattcgatcgcatctgtcattacctttatactttcaaggaccttctgtgtaagttcagggaatcttattcgttgtcctaagacagattgaacaagccgcaattcatttatatagaagtagatatggttgaattgttctgccaccatgttcttaatcaatacgcccggcgtcccctcttgttgtagacaagcaagcgatttcacctgaatatcagcaagcggctcaaggacagcggcgtagtataaagcttctttgctggggaaatattgaaaaatggttccaggagtcactcccacactctgcgcaatgatagccgttgtggtattagaatatccactttctgcgaacaggacaacagcttcttctaggatacgtttacgccgctccagtcttttttcttcattgatgggtcttgccaaatgtattcccctctctttaaactaaactattattaattaaatgattgattatttaattaataatatatcttaaattatgacttatagcaagagtgaatttatcttacttacgagcaggatgaaccttaacaaataaaaaaccaatatacgcctccggcttgtttttatcaggttattttggatgaatacattgaaagctttcggaccgggaaaggcaccaagctggcaacatttgcagcccgttgtatagaaaatgagatcctgatgcatttacgttccctgaaaaaaacacgcaaagacgtatctctccgcgatcctatagggactgataaggaagtcacaaattgaaaagcgcgctctgatgaagttgtaccatgagttttacaagcagaaggggtaaacgacaaaggagatacgttgaactccgcagtatttgaaggccctaatcagggcctttttctcattacttgtatttcgaacagagttcaaaagggtatgggtagagtgcaggatcatgattacgattaggtcatcagctggaagaatatccttacggaacgcggacgtagtggcgagtcaaaattttcgtacgatgactctactagaaaatttgtttatactttaactacttaatagtgaatgcaatggatatgaggtggaactaatgattctggtaagttcgtgtttagcgggcatgaaggtacgatataacgggacggatagcctggatgtacatattcagaagttggtagaggaaaagaaagctttgacgatctgtcctgagcttttggggggctttgtgactccgagagagcctgctgagattgttggagggacaggcgaggatgtgctgaacggcacagccaaggtggtcgagttctcaggcaacgatgttagcgatatgtacattagaggtgcgtacgaagccttgaatatagccagagaggttaacgcaacacttgttgttttaaaagaaaacagcccgtcctgcggatcagcagcaatatataatgggtcattcgaaaatcgtaaaatagcaggtgacggggtaacctcggctttgttaaaaaaggaaggctttaaggtcatatcggaagaacaaatatcagatattttcttggattagaatatgtaagggtagatcaagcgccttgctagcttacaggcttatacctgcgagcgcaagacgcttgtttgtgctatgtgccgctatacgattagacatcacattatttaagctttaatgcaagaattcctaggtattccttgagggctgttccggttgtagacatggccccagcagacggcgagagcttgccagcatacagtgacagcttttcacttgctagatagtcggtaggataagctatgacctgcatgcctgcacgctgaaattccagtgcagcacgtggcatatggaaagcggaggtcaccagaacaggtctagtgagttgatgtttttttaaaatttgcgatgtatatacggcattttgctgtgtgttcaaagaacggttttcgatcaggatatcttttgccggaataccgagtcctagtagctgcctttgtgcaatattcgcttcattaccactgtctccaaacacttgcccgccggagaaaagaatgggtaagcctgttgcttcgtgcagtcgcgccgcagtgagcagtcgattagccgcagatcctagcagattgccttgtccattgatgtcgggggttccctgtgtggctccgcccccaagtacgacaatgacatcgccttgaacggtacggggttgtgggtactgtttttccaggctactgattaacaaatctccagccagattggtcgaggaaacatacagcagcaatgtgacaagaagcagtacgaccgcaggtatacgtgcccttttccatagccagatcacgagccctgtcatcacgaggatgaacaaaccgggagggagcacaaagctgtacaaaaatttgatgatataaatcaagtgcagacaacctcctatccttataagctttataagtctttttggtatattgtaacataggcaaatgactggattcctctgtccgaagacatacctcgatgaacaagcgggcatgaaaggtgcagctttccaatacatattttttgtttgataaagttgttctgcaggcgtagtatataaagtctagtgatttttttcatagaggagcgatagcgtcatgggagagttaacgacagccaagcggatgatgatgatcgcgctactggttgtattgtggggcatttcttggcccatttataaagtggcattggaattcacacctccattgttgtttgcagggctacgtacactgctgggcggtctgctattaggagcaattttagtaccgagatggaatcgcattcgttggaaagaaaattggcgggtgtatgctatttcaggtatttttaacgtggtactgttttatggcctgcaaacagtgggactgatgtacgtcccctccggcttgttttctgtgctggtatatctccagcctgtgctggtcggtatttttgcatggatgtggctgggagaagcgatgtccagactcaaggtgattggattgatcatcggatttttgggcgttgcagctgtcagtgtgggcggattttcagggcatgtggctgtggcaggtgtaatcatcgccattattacagccgtgagctgggcattgggaacggtatatgtgaaaaaggtaaaccagcgtgtggattcgctgtggctggttgcatttcaatgtacactgggaggcatcgtgctgacgggagctggaacggtgacggaaaactggtcggatatcgtatggaatgtcccgtatgtgtcagggctaatattcggtacggtgctgggaatttcactatcctggctgctgtatttcacgctggtcaattcgggggatgccagtaaggtcgcttcctatacgtttttggtgcctgtgatttcagtgtttgtcagctcgttggtgctgggagaagcgattacggctttcctgcttatcgggttgatcttaatcgggcttagcatttatttggttaatcgcagagcgagagtagtacgacaagcttgaaaataggatatggtacaagcaaggactctgcgcaggtagcagggtccttttttagaggattttaacacctgtccggcgaattttaggaagaatgaaacgggttcggctgaaacgaatttgatctataaggaggagttcaagcatgatccagcttcaaaatgtcaaacggtataagcctgccaagcggataatagttacatttgttttattggcaagtgtggcaatcggactgaacgatggagagcttgctcaggcagcgggaacttctgtatctataaagcaaggtcaggaaaccccaagtgtccgtgtttattttaacggaaatataatgtcgtttcccaaaggagagtcattcattaacaagggacaggtcatgattcctattacagatgctgctctgccaggaatagccacggactatgaccccaaaacacagacgcttacactcaccaatggtatagccagtctgggtcccggtcgaataaaggctaactccaatataggttttgtacatagcaggaaggttacttacgacgtttcagccagtagcattcgtggaacgctttatgttcctctggcatttatcagtgatgtggtcggaggcaagctcgaatggaagaaaaacgaacgaatggctagcataagctatcctcagttggttggggaatcggaggaaagcaaaggctatttgctggaagcaagcagcggagtattgtaccgtaaagaggatggcggccgtatccgtgcgctcagtccaacaaatattaaattgaaagaagattattttggcatgacgaaaatcatttcaaccaaggttacggaggatgcagatttggttacggtatggcaagcgtatggcgagcccatgattaatgccgatttttatacgctgttcgtccagaaaggaaaggtacttcgtcaggcaaagtctcattattggaattttaatgccgacaatatcaagctttataatggtaaagcagtcatgaacgatggacagaccgttcgtctgattgacgctaatggttctgtaaaagaaacatggaatatggggaagctttccggtcgtttgaaggacagctttgcggtggaaggcatgggcgaggggtttattcttgccagatcgaatgatgagggctttttaatattatttaatcttaaaacccaccagtcattgttggtgtatgagttgcttcaattaactcctgagcaactgaacggattcagggaagatggtattaagtttatcggtcagaacaaaaatgacggtgaactgcgcttcgagctacatgatagtgaaggacggcctcaaacgttcaattatgctttgtaagtgggtttcgggcgtcgatcaggcacctcatattacataaaacttcacaaatatccgaattgttcactcctccggacactcctttgttcatgaagcataagaggcttcacttttcattttgaatgcgcttacataaaatacacttatacggcggcggtgctacaaaccttgctgtcggcaacgtatacagagggggagtgactcacattgaatcagcctatgcccaaaaattctgcaatgcttgcaacggattcccgcctgaacggtaagaggctgggaacgggtagaaaacacggttttttctatgaactgttccgcaatcgggtattatttctgatgttgttgcccactttaatttttttcttcattaactcctacattcctatggtgggtatttattatgcatttacccagttcgacttcaataccagcctgtttgatgccaagttcgtcggactccaaaattttcgctttctatggcaatccggcacgctgacaaaactgacattgaatacggtcggatacaacgcagcgtttattttactcggcaacgtgttagcgattgttctcgctattttgctgaatgagctgcgaggccgctactttaaaaagatcgctcaatccgtgatgttcctgccttattttgtttctttcgttattctaagtgtcatcgtgtataacatatttaattatgataatggttttctgaatacgctgttgctgcaacttggtggtgaacgcgtggatgtatacaacaaaccatgggtatggattttcctgattatcctgttctatttatggaaaaatctcggctacagtatggtgatctatctggcagcaattacagggatcagtgacgaatattatgaggcagctaaaatggatggagctaatattttccaacgaatctggtacattaccgttccgatgcttaaatcgacattcgttgtgctgctgttgtttgcacttggtagtattatgaaaggacaatttgatcttttctatcaattaatcggcaacaatggggtgctgtacaatacgacggatattttggacacttatgtgtaccgttccttgaaagtgacttttgatgtgggtatggcttcggcagcaggcgtgtaccaatccttgttcggttttgtactgatcatgaccgtgaactacatcatccgcaagttgaacgacgaatatgccttattctagaaaggaggacccaaacggatggcgatcaaagaggatgtatacactcgaatttttaaaatcatctcttatgtgattatcattattgcttccattgcttgtttactcccgttcctacttattatttcggcttcactgaccagtaatgaatcgattatcagggatggatatcactttataccacagcaattctcactggaaggttaccggacggtgttcacctttcctgaagaggtgttaagagcgtacggggtgacaatttttaccacggttgtaggcacgacattgggcctgttcctgatgacgatggcaggatatgtgttggcacgcaaagattttaaataccgcaatgcgttttcattctatatatactttacgacgctgttcggaggcgggttggtaccttggtacattatgctgacgaagtatttaggattgcttgatacgtatacagtgcttattttcccgggattgatgactccgtttctgatcattttaatgaaaaacttcattcgttcttccatgccggaagaactgttcgagtccgctaaaattgacggcgcgggtgattttaaaatttactatcgaattgtgctgcctttatctacaccggggattgccactgtggggctgtttctggccttggcttactggaatgactggttctcatcctcactatttattaacgatccgcataaataccagttgcaatattatctgtataatgtaattaactccatgcaatttatcgctcaaatgggtgcaggtactggtgtgtctctttccaatgatatgccgacagaatcgaccaaaatggcaatggcgatcgtggttactggacccattttgctgctgtacccgttcattcagcgttactttgttaaggggctgaccataggcgcggtaaaaggctgaagcggcactaaaaggctttgatggcataacgtgctgacggtatgccatcaaagcagcactttttgtaagcgttttaataaacagactaccatttcaaagggaggattcacatgacattcacaaagaaaagaaaacaacgcatgtccatcctgattgcagtaatggtcatcatggcgctattagccggatgtggaggcggtagcggaaacagcgcacaaaaagcaaatggagaggatgataaatcccaaaaagttcagctgcaattttatatgctgggggatgctcctaaggatctgtctaccattgaggcagagattaataaattggcggaaaaggatctgaatgccaccgtcaaatttaactatacgacgtggacagactgggatcaaaaatataagctgttattgtcttcgggtcagcctatcgacctgatattcactgcagattggacgcagtatcaggcctatgctaagaagggcgcattcctaccgctagacgatctgctgcctaaggctgcacctgctttgcaaaaatttgtacctcaggacatgtgggatggagttaaaatcggaggcaaaatttataccgtgcctggcacgtataaagagtatgtcactaacggttttgtatggcgtgaggatttacgagagaagtacaatttgcctaaaccgacagatatcaaaagttacgaggcttatatggatgggatacgtcagcatgagccaaatatgaaaaccgtatctctgaacagcgatatcaagggaaatctgcatgaccgatataccgaattagtaacgaagagtgtaggtgccttgccttatggcattggcattaaatatgaaaaaccaacagaggtttataaatattggggctcggatgaacaaaaggaagagctgaacacttacaaacgctgggccgataaaggattcattcccaaaaacgtattaaacgtaaaagatacgcttcaggatcaagtgacttctggcaaagcagcgagtattttcggtgacaatccaacccggtttaatgatatggtcattaagctcaaagcatctcacccggactggaagctcgagtattatccattccctttgacgacaggttatgcaactccagtgcatccgattcacaacggctttgcaattccaaaaagcagcccaaatccggcgcgcgcattagctttttatgaaaagcttgtgacggacaaacgctataacttgctcacgcaatatggtattgaaggcaaaaactatgaagtcaaagatggttactatcatatgattggtagcggcagttctaatggattttcacgcgaaggtatgaacagttgggcttggcgtaacccggaatatatgctgtttgattcaggctttgaccgtgtgaagaagatatttgctgagctggataaaatccagaagcctgacctgtttaccggttttgcagaggactacacaacctaccaagctgaaaaagcggctctagaacaggtggagaagcaatatctgtatccgctccaagctgggctgatcgacaatgtagatcaaggcttgcagaccttcttgcaaaaggcaaatcaagctggtttggagaaaatccaaactgaatatacaaaacaatgggaagcttacgtaaaggagaagggtattaaataaaacataaagatttatgataaagaagaaaagcaagtctccagaaagttggaggcttgctttattaaggtcagtttatgtttttgggagcaatgttccgttctcggagcggtcgtgtagagcagtctacttattgcgcatttgttttagaacggcgaaaatctgtcggtgttacgcccaagctacgtttgaacatgcgatggaaataagagctgctcgcaaatccggtttgttctgctacgtcagccacggaccagtcggtctgttccagcagttcacaggccttgcgaatacggagttgttggatgacgtccacgatggtagacatggtctgttgcttatatagcctgctgacatagatcggcgacatatccagctcttccgcaatctgattgagacaaaaattgggatccgtataggtttgctctattcgttcattaatttgccgcaccaatcgttcctgcttcgtgtttcgtttttccgatagactggagcgaatatgttcaaagaccaattgataatgatcaataagatccccagcggtctctaaccgatctgcggatggtaattcaggtttagtttctatagcaaatccattgagctcactgatatgccgaacagcattattcacactcatgatgagccgggatattgccacttgaacggaggaaaacggatatttttccatatgcatcaacaattctttgaacatactgtgtgcatcctccgtatgaccagacagcagcgtatccagcatttttttctctttatcggctggatatacgtaagtattttggatatcctcgtctgtagtgttttgcgcattaataatgcagccatgcccctgaaaaaatcgatgcatagatgcgtcttgtacctggcggtacagcagatgcagccgttctggttgactcgtgatggcactgtaagtcagtgaaacgctcagcttcaaatattcaaagcaagcttcacgtatttggcgtaataaggtttctagcagtacagtgtctgtatgttctgcgggatcgagaatgttaagcatcagcagtacactgtcctcatccatatcaacggtctctacccggtacgtctgtccgcatatttcagaagcgatgttcatgattgcaaacttatagggtagcagatcaggtccacgttcgctttgccatcgggtatattcatctatacgcagcagcacaaggcggtagtctttgtcgaactggaacgtaatcccaagctcgcgcaatcgttccggttcttcactggcaggaagatttcgaattccccggatcacatttcttaaaatgttttgccggatcgtgtacatactgtttcgtttctccgattccagtgaattcatatgcacaacgatttgaccaataggcgtatacagcattttggacagcaaccacgaagccacgaatcctgccaatgcaatgatggcggctatcagtaacatcgcattacgaataacacttgccattttgataacgctttcatatggtgtaacactaatatactgccaacctagtccatccggggaggtgtaggaaatgagtgatcttttaccatgaaagtcttctacaaaatagcctgtttcttgttttttgactctcgtgtgcaaccatagctgttctttttcgttcaaagtttcgtctgtcaatgttgtaccagacaacagcctgccctgatcgtctaaaatataagcggtcccacctgagattggattcgccgccatttccttgttcatccaggccgccgacacattcacaatcacagccgaatttatcgcttcgttcgagttaattgcgtcataacataaatacgtataggctgcgatatctgggcttgcttgctctaatccagctctggagtctgaggcagacagcagcggatacgtgcgtggaataggagtaaagggtttatagtcctgataatgatccagcacgcgaatgatatctgtatcagccagttcatgtttgctgaataacccgttttgaccttgtgaggacgcaatgtagaaggtgccgcttttagggttaaacacgtagatggattcgatatacggcatggagttaagataattgttcaattcggtcatggcagcggttacatcatatacattaggttttggataatacaacaacttggacagggtactgctgcgatacatttggaatgccaaagattgagcaatagatgtcatgttaataatctctttgcttctcaacgtcaagctgttgtgattggcctcgaatgcctgctccttttccacgcgaatatagtaaaaataatacacagtggtggataccagcaacgttagcgtaatacataacgtaatgctgaccagcaatttgctgtgaagcttgtgatgctttttgaaattgctcatatgaacaggcctcctgtctgtgtgcacgtagctgtaaagtacaccctatttatgtattcattatacgtgtgatcttgtgaacaggacagtgaacaaaccgattctttgtgaaaaataatgattttttcgcaaaaaggccaggaacacttatacgcattggattgcgtcggttcccggccgggtttgtgtattcaaataaaagaaggaaagatgacggtactgcaactagtcaggaaattgaacgttaccattaacgatataggctccgcctgtaccattttccgctagagctgggattgtatcgtttagcacgacaccgcgaatgtccgtaatccgtattttcagaggttgttttcctaagttagtacctagaaagtggttgtaatcctgtttttcgagattgagccattgtccgttttgttggacttccatcttcaagaccggatatttatgattgcgtacttgaatggctgcccaccattggctgctgccttctttaatgcggtaggagacattgccgttaaccggagctttgacaactttccacgaaatattaatttttccgtctatttgattgccaatcaggttgaacgcgtttggggacagatcgagtgcgccacttggaccttcagggtaaagatcagttacatatacggttgttttccctttgggaccttgaacttccaaataggctccagctaatgcagctttgattccgttataattcagttgtgtgcgattaagcgctgtaattttggcatccgaagggatgggatcaagcagtaatgcccctccagagtaacctgatcctgtatatgtggcgtaccctgtgtatgtatcattccaagcagctgaagcgggaagggcgaacaatacgacactaagcaatgacgtcaaaccgatagttttcaactttcggaacatagatttttctcgcataatcatttcctccttgttcatttagtagatttatatagtaaatacaatcactatattacctaatattccaaattgtacaataggactttgaggcaaaaagaaaacattgatgatgtttgtcaacatagtcataggccatatggcgtgtttttttaagaaatggttgtacagataaagaacaagggaggattaagtaatgaggacgaaaataggacttttggatgaagtcttttaaatagaataagcgaactattgttctccttttgtttgtcgtatacaatcgaatcatgctgattcaaatggagtgatgttgaactctgttgtatgctacaacgaaaggatgttttgcaccatgatgggaagagcccatttaattattggaaccggggtctccctgtcggtattagctttaagtggatacgaagtgaccccggctgccgtggcagctgctgtggtcggttcactgttgccggatattgatgagcctaactccatgctcgtgagccgtgcgctgccaaccaaaatgcttaggcttatacagcttctaatgattggggctgctggttgggtatttttcacccgtttggctccaccgccatggaatcttgttttggctttgctgatgatcagtgcttcttttatgccttcacgatccatgcgcaaggttattatctttctaattggtatcggcctagcctggtatggagaatcatatgcaccgtggaattatatcgccgggtgtctgctgatcatttgtacgttagtcccacaccgggggttgacacatacggtatacgggacagtcgcatggactgcgttgctttatggtacgacacgtttgcacggtgacagcatatggctggctggaggtctagcgtacttgctgcatttactggcagattccttgacgaataatggaatcaaacctttgccgccgttcaaatggaagctgcgatttaaattgatgagtaccggaacccggaagggagctaagatagaaaacgtctgtattgctttaactactgtacttgtagtgattgctttgcttcgttataagcatttgatttgatatattctatcttttgtttctattaaattaaaaaaacagtcaatgcacgttgtacgtgtcttgactgtttttttatagattgcgattctctgttacaacttaggctcgttcaataatggtattcagcgttgtacgatccagattttgaactagcttgatgatcagctctttggctgcatcataatcatcagtgtgaataatggacgaggaagtatggatgtatcgtccacagatgcctatgacagtggatggcacgccaattccgctcaagtgcacttgacctgcatcggttccccctgtggagatgaaatattgatacttgattttgtgagtttccgccatgtcttgcacgtactccacaatcccgcgatgtgtaatcatacctggatcaaatacccgcagcagtgcgcctttaccgaggtgcccgtaagcattcgggtcgccgcccatatcgttggctgcactgcaatccagtgcaaagaatatatccggctgaatcagattggccgctgtgcgtgcaccacgcagtcccacttcttcttgaacagtggcccccgcaaacaatgtattgggaagcttgtttttttctttatgtaatgcttcaagcagttcaatagccaagcctacaccgtagcggttatcccatgctttagccatgatttttttaggatttgccagtggagtgaaatcacagatcggcgcaatggccgttcctggtacgatccccagatcttgcgcttcttgtctgctgtctacgccgatatccagatacatatgcttgatgtccataggtttgctgcgttgcgattcatccagcaaatgaggcgagacagagccaactacaccgataactgggccttttggagtcaatacttgaagacgttgtgacataatggcttggctccaccagcctccaaccggctgaaaacgaatcattccagtttccgtaataccattcacgataaaaccgacttcatccagatggcctgccaccattacacgtggtccactctcttgaccgcgtagcaccccaaatagactgcccaatcgatcttgcacgatttcatcggtataaccggatattcgttccttaacccatgcccgtaactcacgctcatgtcccggaatggaaggaaactccgttaaggttttaaacaattccaatgtttttgattccatgatgtatacctcactccttattaattaaccagtggtcgtcatgtattcagtatgaatggatttgtatcgaatgtccacgatatcattttcctgacataacatttctccaaaaagctcataatgaaaaagacccaagcaattcgaaccgccaagcgcgaaaacttacagataaggggtggtgaatgatgccagctaaatccgggcagcgcggttttcgtaccaatacgtcgccgctgtccataaatgagaaggactatcagaatatttcacaaaagcatgaaccctcgagaaaagtatttgccaattgtgtgcgcgcttttctggttggaggcgggatatgtgtgattggacaggcgattcaagaggcttttatggcaggaatgcacatatcagctaaggaagccgccccgccgacctcatcgatgatgatcttgctggcggtcatattaacctgtatcggggtttacgataaggttgctcaatgggcaggagcaggaaccgctgtgcccattacaggctttgctaactccatgtgttcggctgcattggaatatcgttctgagggactggtgcttggagtgggcgcgaatatgttcaaacttgcaggctcggttgtcgtattcggggtggtggctgcatttatcgtaggcgttatatatgccatcctgggtgtgggaggcaatcacttatgagaagacagggcggacaaacctggaagtttgaatcgagaccgcgcatcattggaagtgccactgttgtgggcccggatgaaggagaagggccgttgtccacagattttgattatatttatgacaatatagaaatcaacgagaaaacgtgggaaaaagcggaacgtagattgattgagcattctacagagctggcgctaattaatgccaatttgaacaaagaagaagtgcagttttttattagtggtgatctgatgaatcagattatcagtagctccttttcggctagcaagctggctattccctatttgggtgtttttggagcctgctcaacatcaatggaaagcttagccttagccgcacttattgtggactcagaggccggtgactacgtgatggcgggtacgaccagccataactgtactgtagaaaaacaattccgctatcctaatgaatacggatcacagaagccccctacggctcagtatactgttaccggttccggcgccgcaattgtaggacatgccaagtcagggacggtggtggattgtgctaccattggacgtgtaatggacatgggcattaaagacccttttaatatgggtggagccatggctcccgcggctgcggatacgctgttgtctcattttcgagacactggtcgtgaccctggttactatgatctcattgtaacgggcgatttagcctcagtggggctaccaattgccaaggagctgctcaataaagatgggttcgatatgaatcagacggaatttaatgattgcggtttactgatttacgacatcaataagcaaaagaaagtcattgcaggaggcagtggttgtggctgctcggctgttgtaacctacgggcatttattgaagcggattgaaaaaggagagctgcaaaaggtactggtcgtggcgactggagcgttattatctcctttgactacacagcagggtgaaagcattccttgtgttgcacatgccgtagcttttgaagcgggaggaacagtatgatatttctatgggcttttttagtgggcggtgccatttgtgttgtgggccagttgatgatggatgtgttcaaaatgacgccggcacatacgatgagtacgttggtggttgcaggtgcaattgctgatgctgttgggatatacgatccgcttattaaatttgcaggggcgggtgcgaccattccaattaccagttttggtaactcacttgtacacggcgcattaactgaattggagaaggacggatggctgggtgtcattacagggatctttagtctgacaagtgcaggaatttcctctgcgattattttctcttttctggcatgcttgtttgttcgtccaaaaggaagcatataaaagcagcttactttagatttgacataaaaataaatgattatatacatgtgcccttcggatctaatgaccgaagggtttttaattgttctgcacactgaagatcgaaaaaaggatggagtttgaataatacgggcagggggttaagtgtactctgtgcccaccttcatgtacaataataggaaacatgttgctatctaggaggtttacagagctatgcccgtacgtcaagaatctgtgcagattgtatctgcaatccgttctaatctggaatcatgtatattaggtaaatcctttgaaataaaattactgcttacggctatgctggcgggtggacacattctgatcgaggacgttccgggtacggggaaaacgcaaatgatcaaggctcttgccaaatccatgcgcggtgattaccgccgtgttcaatgtaatcctgatattctcccgagtgatattacaggggtatccatatttcatccacgggacgagcgtttttatttccgtccgggtcctgtgatgactaatattttgctggcggacgaaattaaccgagcgacgacgaaaacccagtcggctctgctggaggttatggaggaacgcagtgtgacagtagatggggacactcatatgttgcctcatccttttatgctgtgtgcgacacaaaatccgattgattttgaaggcacttatatgctgccggaagcacagttagatcgttttatgctcaaaatcagcttgggttatcctgacatggagacggagcgaaacatgctgcttcatcatcaggcaggccagccagcagaccgcctggaggctgtagctcatatggagcagattgctgacatccagcaggaaattagagggatttatatggacgaagcagtgacgtcctatttacttgatatcgttcgtgcgacaagagaacatccatccgtgctgctgggagctagcccccgcgcggcgcttgcttttgtaatggctgcgaaggcatacgcttttctggacaaccgtgactatgtgttgcctgatgatgtgaaggcgctggcaccttatgtgctaacgcatcgtttgttgctgcgtcccgaggcgcgtctggacagttccagtgcccagtccgtgctgcaggctgtcctacggcaggttcatgtacccgtacgaatggagcgtccttagggaatgaatatggtcaaaaggaagcgcaggcttccgcggctgtcaggccgcatctggcttctggtggtcatatgggtggtatgcctgctatatttgttgtttcagggcggcaagacgtcggtcatgctgttgtctatggttacgctgttaatcgtttatttatggatcgttggtctgagcggagttcgccgtgtgcaaggctcccggcagctttcgcaaggctcgcagtttggagaaatgctgcatgcgggagatcaggtgcatgtaaagctaagcctcagtatacctggttttcttccattaccctatgtcattgtccgtgaggtcctcaagcgacatacaggtgaatcctggtcgtttgaggacagtgtcattcccagtctaaaagggggcggtcagcttacatttcagactcctgctttagagcgaggaagctatcactttgaggatacagaatgtgtgagtgaggacatcttcggtctgttggagcacaaaggcagcttgaacgcacgcggtgaatttcgggtgctgccccgaacggtattcattccgtattggcagatgaatgatcgtcgctcaaggatgtctggaccgcagaccgttcaaactcgaacgcggcgtgaaacgacacaaattaacggtgtacgggattatgtatatggagatcggttttcgcgcatccactggaatgcgacggcgcgtacaggtagctggaaatccaaggaatttgagcatgagaccgttcctaaaacgatgcttgtgctggacgtacacatgaagcattatgtaaacgccgaacagtttgagctagctgtatcctctaccgcttcattgctggaatatggtggacgggagcgaatgggggttggattgtgcacagctggagagaaaggtaccgtctttcagccaagtgagcagacaatggaacgacaacgaatgatgcatcacttggtagacatacacacaacttcacaaggtagcttgaaatccgctgtagaaagcagtgtacgccagtttccgcaaggctgttattttatactgattagtccgctgaaggattatcaggcgatggagcttcttcgctgggccgatacccgggggatgactccgtgccacgtctatatcggagaaggttctgctgagggagaagctgaagaatggatgagcatgcttcgtgcaagaggaatcaagggctacgatgttgagagccttgaggagctcccggctgtaatggggggaggaacactatgaagagctggttacaatcgttaaagggttcctgggcccccgcttttacatttttatggattattattattgccatgcaatgggtttcttttgcttccgaattatggctggaagagacaagagcacttgtactgatgaccattacgatgctggctctggtgaagattgtactaccatttcgtccttggattgaatttattgttaaggcggcggcgctgttttttattttgtatcggacattggtgtcttactccatcattatccccttcggagggggagccaatcgcctggaccaatttatatccaatatgtctccttatatttggttttcccttatcgcttggctagttattgaaatggtgccgctcatcgttacaacgaagcaacggattcttgtttttgtgggtattaatattgccgcgctggcagtgcttgattccttcacgccaactgtgctgtgggaggaggttgcttggatcgtctttgctggtatgggttggctggtgacacagcatctgcagtattttcggcagcattatcctcaaggatggaagcatattcggcgctatccatataaaatagcagccaatattgcggtcatttttgcgctcattattatggctggtgtcaatatgcccgaggtacagccagctttgacggatccctatacagcgtggacccagagagatagctcaaccaccgctgggatcagcaatggatctggggcactgaatcagcggatgaacaccgcatcgggttatagtcgccaggataatcggttgggtggaggttttaattttgattattctcctgtcatgaccatcacgaccactcagcgaagctattggcggggggaaacgaaacgaacctattctggtacaggctggagtgacgggggcaacgatgatcaaacgctaaatgatgtgccaatgaccgcagagcttgaaaacacacaagaaacgcggcattcgactgagcaggtcgttcagaccattaccatgcaaaatgaccagagctatcctgttctgtttggcgcctattcggtgcaacgtgttcaatcggtggacagagattcgcgggcagatgggttacgttggaacccggaacaggcggagctgctttggaatccatcctcccgaagaactgcttatcctaaaacgtatactctggtatcgcatgtccctgtgatccctgagaaagagctacgcacaaaaacttttaatgagttgtacggaaaaaataaacaggaagcctatctacaaattccagatgagttgccacagcgggttcgtgatttggctcagaacgtaacgtcaacggcgaaaacgccgtatgaaaaagtcggattactacagcagtatttgcagcaaaattatgcatatacgaacaatccggacatctcacggaaaagaagcagagattttgtggatgcctttctgtttgagattcgggagggctattgcgattattattccacctcattagtcatgatggctcgctctgtgggggttccagcccgctgggttaaagggtatgcacctggtcagcagacgttttcagatgatgcaacaacgggcgaaagtgacgaaaatatgtcctcttactccgtgacaaatgcggatgctcattcctgggcggaagtatatttaggtgaatacggttgggtccctgtagaagctacgcctggctttgatatgccactgcttacggaacaggaggattcaaagactccagaagcccctgaggttaaagatcaacctgaaccagaacagcctgagcagaccccgcagactaatccggaggaaggttcaaagattcatcctgtaattataggttctgctgttgcaattctgctgctgtgggctgcttatatcgtctggcgtaatcgggcagacattcacttttacctgctgcgtttacgcagaggtaagccgctgactccggatgaaaaggtggtcgtcgaaactgagcactggttaaggtacatgcgtagaagaggatttgtccgcgccagtcacgagacgctgagggaatcagttgatagatggtcgctagaagtaccggaacacgcttcaattttacatcagctgcttggccgatttgaacaagcgcgttatagcccctcatccgtaaccgcaaaagattggcatatggttcgccagcaggcatctctgttacacaaagaaggatggataaaacgatgggctggacgaaaagctgcgacggatcagaaggatcaagactagtctatttttgattaggtccaaacgccggctattttaatctttagctatatatttagtgaaaaagctgtccgtttgttgcggatagctttttactaagccatagtaatatggtatagtttgtcgtatgaaactgaggtgaccgacgttgtttgaaatgctgatgcccaaattgcgggtgaataccgtctttgatattgatcttgaaggcttgtatgctcaaggatatcgcggcattattacggatctagataacacgctggtcggtgcaaaagcgccgaatgcgactcccgagctggtggcctggtttgagaaggtcaaacaggcgggttttaagcttgtcatcgtgtctaacaacaatatggaccgtgtatccgtgtttgctacgcctttggacattgaatttatacatgccgcacggaagccctccaactcgtcttttcgtagagccatccgtatgatggggctgactccggaagagactattatggtcggggaccaaatgttgacggacgtattgggaggcaaccgactgggattgcatacggtgttggtgctaccgatatccattcatgatgaaggagtcatgacccgatttaatcggcggttggagcgaatcgcgctcacaaggttacgtaagaaaggcttatggcttgaggaggaaaagaagaatgactgaaagacctgacggcggcactgccgtcaaatgtagtggttgcggtatcaccgtgcagaccactagcccggagcttccgggatatattcctgaaaaattgcttactcgcgaacctgtcatctgtcagcgttgcttccggatcaaaaactataatgagacgtcttcagtgacggtggatcaagatgagttcttgaagctgctcagccagattggcgacaaggatgcgctcgtcatccacattgtagatatttttgattttgaaggtagcttgatttctggtttgcaacgctttgtaggctccaatccagttatactggctgtgaacaagaccgatttgctgcctaaggtaacgaattggaacaaggtacgtaactgggtacaaaagcaggcgaaggagcaaggacttcgcacggaagaaatcgtactgtgctcagctaaaaaaaatcagggctttgaccgtctgttggatgtggtatctgagctccgtggtaaccgcgatgtatatgtagtcggagcgacaaatgtgggtaaatccacgcttattaatcgcttgattcgtgattatagcgatatggagcaggaactcacaacgtcccgttacccggggactacactcgatatggtgaatattccgctcgacgacggcaagcacattattgatactccgggtattgtatacccttggcgattcagtgaaatcgtctcccgccaggacttgagcgctattatgccagacaagccgctgaagcctgctgcatatcagcttgatgctggacaaacattgtttttcggcggtatggcccgatttgattttgtggagggtcagcaccaatcatttacctgctacattaacggtggtcttaagatacatcgcacgaagctggagcgagctgatcagttgttcgctgatcatgccggggaattgttatctccgccaacacgcgatcaattggcagagatgccggaatggacaagacatgagttccgcgttccacgcaaatctccatcggacatctacatttccggtttgggatggatcagggtaaatagcgagaacggagctctgattgcggttcatgctcctcggggagtccgtgtgcttttgcggcctgcgttgatataacgttgctgtaaccatgttatagggcggcaaggaacaggtactggttcctgccgccattcatgtatttgtacggcctaatattttgcaatatgggggagagcaacgatgaacagcggggagtctgaagcgaccgaacaaggtcttgtactattgggcgtattgggtgatccgatcaagcactccaaatcgcctctcatgcataaaatagctttacaggcagcggggattgaaggagattttgtacctcttcatgtcaaaccggatcagctggaagatgccatgaaggggattcgcgctttgcatttccgcggagtcaatgtgacgattccccataaagttgaggttatgaaatatctggatgagattgatgaaggggccagactcattggcgctgtcaatacgatagtgaatgacaatggacgtcttaagggctataacacggacggaattggctacgtacgttccctcaaagaagagacttatgtcgagttgaagggcgcaagaattgctgttcttggagccggaggggctgctcgtggcgtgattcatgctctgttggaggagcaaccggaatcggttattattttgaaccgaacacgtgacaaagctgagcaactggcattagagtggacgacggaagcgatcccagtgaggggttattccaacgaagatgccaagagcgtgcttgccacagtgaatgtgttgattaacacaacctcggtgggaatgtctcctttagcggatgagcttccactggaaacgagcttgattccggagggaatcattgtgagtgatttgatctacaacccgctggaaacgagacttttacaggaaagccgtgaacagcgcggctgcactgtacatgggggtttgggcatgttcgtgtaccagggggctgtggcttttgagtattttacaggggttgtccctgctgtagagcaaatgagagcggctgtgctgagtagcctgtcgtaagtaagattgtacattaaaattatggaaatgctgcattgtatatgtggcgacgaaggggttaaatatacatgttaacaggtaaacaaaaaagatatttgcgttcaatggcgcatcatttggacccggtttttcaagtaggaaaaaacggtacgaatgagcatcttatgcgtcacatcaacgatgcgattgaaaagcgtgagctgatgaaagtgcaaattttgaacaactgtttggacgacaagcatgaaattgcggaagaactggccgcggagacaggttctgagcttgttcagatcatcgggagcactattattttgtacaaagaatcccgtgatcataaggaaattgagttgcctagaggataacacgcggggagaaaattatgaaaatcggtattatgggtggtacatttgacccgattcatattggacatctgctggctggagaagcggcaagagatgcctatgggctggatcaagtatggtttatgccttctcatattcctccgcacaagcatcaggcgggggcgagcggtaaggagcgtctggagatgacgagtgaagcggtagcgggtcatcctgcttttgaagtgctggatattgaagtgcttcgcgggggagtatcctataccattgacacgatcaaggagcttcaggagttgcactctgctgtggatttttattttattattggtgcggatatggtgaactacttgcctcattggcagggaattgaggagctggcgcagcgaatttgttttattggtgttcggcgcccaggattccagcttgcgttggatgaattgccgcattatttgcaggacaaggtactgctggcggatatgccggtggtggatatttcgtcgacggatattcgagagcgtgctgcggaagggcgcactatccgttatcttgtgcctgatcgtgtgcatgactatattacaaggggcggtttgtatgaagtacagccgtgagcaattaatggaagccgtatctggtcaaatgcctgaaaagcgctggaagcacacactaggtgttatgcatacctcagtggagcttgcgcagcgctatggagcagatccggataaggccgaactggcggctattttgcatgatgtagcaaaatattggcctgttcagcagatggaagaggtgattcgcagtcatcccgaatgtgatcaggagcttttggaacatgacaagcagctctggcattcagaggtaggatactgcgttgcagcaagagattacggagtggatgatccggaaataaggaatgcgatccgctggcatacgtcaggacgcgtaggtatgagcctgctggataaagtcgtgtgtctcgctgattacatcgaaccaggacgggattttccgggggttgagcatatccgtaaacaggcaaagaaaagcttggagcagggccttatcgctggattcgactccacgatttcattgttgctggaaaagaaaaaggttatttttccactaacagtcttgtcgcgtaatgacttgattcaacaactaaaacagagaaaaacggaggttcatgaatgaccctaactaatgagcaattaatgcaaacagcggttgatgctgcaaatgataaaaaggcaatgaatgttgtcgcactggatttgcggggaatatcactagtagctgattattttgtcatctgccatggtaattcggatacacaggtacaggcgattgcaacagaaattcgcaaacgcgctcatgatgaaggtgtgaccatcaaaggaatcgaaggaatggattccgcccgttgggttctaatggatttgggggatgtcgtagtgcatgtcttccatcgcgacgagcgcgaatactataacattgaacgactctggtcggatgctaaggttgtggaaaaagtatgagtttgatcgccggtacttatgtcaccattatggtggatcgtgaggtatctcctttcggctactttctcactgttggtgagcaggatgtgctgctacattatacggagctgacacgtgaaattgaagttggtgaacggttggaggtatttatttttcacgatacagaggaccgcttggccgcaaccatgaaaaagccgttcttgtcgttgggcgaaatggcaaagcttgaggtggccgatgtgcatccgcgtttgggttgtttcctagagatgggattgggtcgtcagcttttgctgccgattcgtgagttgccagaaaaccgagatttacatcctcaggtgggcgactacgtatatgccattatggagcatgacaagcaaggcagactgcgggctaagctggcaggggaacaggagcttgctccgttgtgctttcacgcccctgattcgtggctgaatacgtgggtgcaggcgactgtgtacaagccgcttcaaatgggcacgttcgttctggtggacggaggtgtgcttggttttggtgcgattgggatgattcactcctcggaacgcaaccggatgcttcgcttgggcgaagaggttaaggtacgggtcacacttgttcgcgaagacggtcgggtcaacctggcgatgtcgccacgcaaggaagtaggccgtgatgaggatgcggagcggttgattgcttttctgaaggagcgtccgggtggcggcatgccttactctgacgcaacgccgccggatattatcaagcaacggtttggtattagtaaatccgctttcaagcgtgcgatgggcaagctgatgaaggaaggaatggttacacaaaaggaaaactggacctacctggtggagaaaatgccgaaaccgaaggacgggaatggggaataaaaatggcttcttaccggaagtttgcctatgtgtatgatgagctgatgcaggacatgccgtacccagactggttatgctttgcacggcaggcctgggatcagtacggtatgccgcatacggtggctgagctgggctgtggaacgggttcgattacgattcccctagttaactcgggcttcgaagtgtctggaatcgacttatcctctgacatgctggcagtagcccgtcgcaaaatggaaaccactccccagggacagcgattgtttcgtgagggaagcgttcgctggatacagcaggatatgagagaatggattttacccgagcctgtggattctgtaatttctttttgcgattgtctgaattacttgttggaggaagaagatataatttctacttttcgtagaactcatgctggactgaagcctggcggaaccttcttgttcgatgtacatcatccccagacgtttttacgttatgatgaagagcagccattcgtactggatgatcgctctatctcatatatctggacatgtgcgttggacactcctcgttgtgaaattgagcatcatcttagtatctttgcgaaagcagaacatgaaggacgcgatctataccagcgtttcgaggaaatacatgtacagcgtgcctatgacccagactggatgaaggcagaattgtccaaagcaggttttcgtgatgtgaaggtatatgcggattttgaatgggtagaagcagaagatgacgcggcgagactgttttatgttgctgtaaaatagtgaagactcattgagcaaatttaggaaaagaaagacgcttttcatgatgacatgaagggcgtctttttgcactcatatattcactttatagttcaactgaagctcatcacccggtacaccccgaataccccagttctgtttgggcgtttcaaatatagtaatctcaagatcctgtggagcaatgccaaaatggtccgtaattcgttggaataacagctggatgagttgcttcttagcttctgtcgttctgccttcaaagatactgatttcaataatggtgtacgcctcagagcgaccatcggcatatataaagtcttcctgatccataggaaaaaaacgatgaaacctcttgtctggaggatatttgaacgcatccaccacagcagaatgaatcacctctgatagttgctttttgattggatttagagtttcttttattccaaaaattttaatctgtgccatgtgtcagctcacctttcttatctcaactcaactcaatttgcatcaatttaattcgaagttattataaaacattcgtatgcatgtgtcatgaacaattagtatgaagagggtctttaacaccaaagctagtccttatttgacttttttcgcggttttcaatataatagtgccattattaacggttaaacaatcgctgatgaggaatagtagctttgtctggacatatagagagccggcgggtggtgcaagccggttgacagcgcaaagtgaactcgcctcggagatatgcgtccaacgcaggaacgcctttacaggtgcttgtatcctgttattaacccgcatcggatcacctccgttatcaggtgcaaagggagtagaacgcgaagaacgctttctgctaactagggtggtaccacgggaataaaacctctcgtccctagcgctgacacgctacgggatgcagaggtttttttgttgcataccgtttgaggaggaaaagacaatgacagacacacagccgaagcacggctatcaaccgcaaagtattgaaccaaaatggcagaaatattgggatgagaacaagacgttccgcaccggggaagagccgggcaaaccgaagttttatgctttggatatgtttccgtacccatctggagccggcctgcatgtaggccacccagagggctacacagctacggatattgtttcacgttataaaagaatgcgcggctacaacgtattgcatccgatgggttgggacgccttcggtctgcctgccgagcagcatgcgctggatacaggggagcacccacgcgaaattacggtgaaaaacgtaaataacttccgccgtcaaatcaaatcgctcggcttctcctacgactgggatcgtgaaatcagcacgacggaccctgattactacaaatggacacagtggatcttcatccagctgtacaagcgcggccttgcatatgtagctgaagtacccgtgaactggtgcccagcgctgggaacagtgctggcgaatgaagaagttattgacggcaagagtgagcgtggcggtcatccggtcgtccgtaaaccaatgcgtcaatggatgctgaaaattacggaatacgcggatcgtctgctggatgatctggaggaactggattggtctgagagtattaaggatatgcagcggaactggatcggtaagtctacaggggcagaggttcgttttccaattgaaggctatgacgagcaactcacagtatttacaacccgcccagatacactgttcggcgcaagctactgtgtgctggcaccagagcaggaattagtggatattatcactacgcctgagcaaaaggatgctgtacaacagtaccgtgaacaagctgctcgtaaaagcgatctggagcgtacggatctggccaaggataaaacaggcgtattcacaggagcttatgcagtgaacccggtgaacggcgaaaagctgccgatctggattgctgactatgtactggcaggctacggaactggagcgattatggctgtacctgctcacgatacgcgtgactgggaatttgccaagcaattcggattgaatattattgaggttgtccaaggtggagatgtggctaatgagccatatactgaggatggaccgcacgtcaattcaggcccgctgaatggacttaccaacgaggaagcgattccgaagatgattgaatggctggaagccgagggcaaaggacacggcaaagtcacctaccgcctgcgtgactggctgttcagccgtcaacgctattggggcgagccgattccggtaattcatctggaggatggaacgatcaaaacggttcctgaggaccaacttccgctcgtactgccggagatggacaatattaagccttcaggtacaggtgaatccccgctggcgaacgcaacagattgggtggaaaccattgatcctgagacaggtatgaaagcacgtcgcgagacgaatacaatgccgcaatgggcaggaagttgctggtattacctgcgctttattgatccgaaaaatgacaaagagcttgtatccaaagagaaacaacgtgaatggatgcctgttgatttgtatattggcggagcggaacatgcggttcttcacttgctgtatgcccgtttctggcataaggtactgtatgatatcggcgtagtggaaacgaaagagcctttttataagctggtcaaccagggtatgattttgggcaacaacaatgaaaaaatgagtaaatcacgcggtaatgtcattaatcctgatgatattgtcaatacatttggcgccgatacgctgcgtatttatgagatgtttatggggccgctggaagcgaccaagccatggaatgagaatggggtagagggagcacatcgttttctgtcccgcgtatggcgcctgtttgtttccgaggatggtagcctgaatgataaaattacaaatgacggcggtagcgatgagttcaatcgtacttggcataaaacgctgaaaaaagtaaccgaagatctggatgcgctgcgcttcaatacagcgatcagccagctgatgatcttcaccaacgatgcatacaaagcagaccttctgccgcgtgcagcaatggaaaacttcgtgcaaatgctgtcgccgcttgcaccccatctggctgaggaattgtggcagctgctggggcacaatgatagcattacctacgcggcttggcctgcttatgatgaagcatggacggtggacgccgaagtggaaattgttgtgcaagtaaatggtaaaatcgtacagcgtgcaacgattgccaaggaccttgatgctaaagcgatggaggcatacgctgtgtcgttggacaatgttcagcaggcactggccggcaaaacgatccgcaaggtaattgctgttccaggtaaactggttaatattgttgccggttaatcggctttaagccgaaggagacatctaccttttgcatgtcctcttcatacttgttgtgcgtggcctgtattagctcgggaaagacgctatgcaggctgatgtccaacaatgcgagagcttcggcggtaatacctccgggaaccgccactctggcctgtaactcggctggtgtcatcccgccttccgtgagcagctttccagtgccgatgatcatttcaccggccagggcgcatagctccgtacggtctatacctgtagcttgaactgcggcttgaatccactggtccataaaaaaggccaagaaagcaggaccacaactcgaaaaatccgacgtgatccgagtataagattctttaacccgaatcggcctgctgatgtgggacataagctcttccagaagggtgcgatcctcctttgtaatccggcttccatggatgcatagtgaggctccgctgcccacttggtgggtgatacttggaataattttggacactttggctttcagtgcatgttccaaaatacgaatctgcaccgggcttgtgatagatacgacgatctgctcttctgtaatgacgttgcgtatttcatccgttacggcttttgattccagcggcttcacacagataaacagaacatcgctttccgctgccgtttcacggttgctttgggctgcatgcaaacctggatagcgacggactagctcggttaccttggaatgcgttcgattgcttgctgatatttgctgcggcttgagtgcgttagaattaataaaagactcaattagcagacttcccatgctgccagtcccgataaatccaactttcattgttcaacgtcctcctttcatactttgcggtatagacgctgtgctgtcagctgtcattcttcttagtgtatgcgcctggtcttggccgacatgacgaattttatgtctgagcatgttagatcgtccccggggtcgtaccacttttttgtgaaaatgctcacagcgagaccgtatggaggttgtttgcaccctccggtttaacgggaattggacagacttgctctgtttgattgagacggtgttttcagtcagctcaatttcccgaaatccatgtggagtaggggacgatacggaaatgaaacgtgtatggacaggaacagcgataacgcttgctgtaatcgggagtggacttattttatttgccggagggcagcgctctgagccgcaagaagagtggactttacttaaccataaggtggagcaggctgtggcgatggagacagagccaaacgagtcgcagcgcagcagtgactacgcccagaaaaagcctggtgtaaaagaaccttcagacaaagctgagcgcagtaggaatgccgaagccgctgacaatgtgaaacgtgatactgtgcagatttctactggtgtatctgctgctgtgagcgaaaactctattgcgggaaattcaagtaccgaaaagcagtcaggtgttgcgaatccgagctcagacacaggtattattagttcgagtggtgcaacgacgagtaggaccaatagggtaagtgattcggttactacacccgattccggcgaaaaaaaggtaaacatcaacacggcgactgctgctgagttaatggaattaccaggggttggggctaaaaaagccgaggctatactgaactaccgtaatcagcacggggcgttcaaacgtgtgaacgatttggatcatgtaaagggaatcggagctaaaatgttggcgaaaatgaagccgtatgtcagtttgtaacttatataagattataatgtacaggtcctgagaacggcggtagcggatatggtttacgttttaacttgtttatacgggagagatggaaatgagtgcagatgtacgcaaggactgggacacctatttcatggatatcgcttatatggtatccacccgttcgcgctgtgcgcggcgtcatgttggagccgtacttgtacaaggtaaaaagcttttggggacggcctataatggagcaccatccggggtacctgactgttctgaggcaggctgcatgatctcagaagagtatgaggtcgttcaccgtgatgggcgtgaggaaatggttaagaagcagcgttgtattcgcactattcatgcggagcagaacctgctgctgtttactgaccgaattgatcgtgaaggctcttcagtatatgtcaccgaccagccatgctggacgtgtgccaatatgttggcgaacagcggtattgtggagattgtataccaccgaccttatcccaaagatgccgacaaggttcgtgctatgatggaggaaaagggaatcgcctttcgtatgctgaaaacctatcatccaccaaaagaaacactgatggatgtaatgaattaaaaaagtaaacgaggaagaacctctgacgaatgctattttgtcagaggttctttttgttttgtgttttttggacagaaagcaatgtttgctaccggaaggtgattgtattcaagctaagcttgtgttaactagacctatattgacccttactgtttgttggattacaggaagtgcgggagcatgtctgtattctggacatatgcttttgttactctgggcgggggttaccctgatctttccgcttatagctttatggatgaaaatccccatccggcatatggtattactttggcttgcattcagtggtggtggatttcattggttttggcatgatacgcataatgttagcagtattcccgatgctcttcatgtatcgtcttctatggtggaagacatgcctgttcaagtagcagggcttatcgcttctaaagtacaggtagatggtgatcgaacacagtttgagatgagagtcacctcaatcaatcactacggaagtcattcgaaaaaggacgagaatcgtacaccaatttctgaacaggtcattgttcatatcaagttggctgccaagcaggaacagcaacttgcggcagcatggcaacgtggagatgcaatcctagtgcgtggcaccttaaaggctcctacaaaagcggggaactttggaggctttgattacagtgaatacctgcacacacaggaaatccactggcttttcaaaggcgatggggtagcctcgttacagaaacaggaggcttcactgtggaaccgctacactttgttcagatggaatgatcagctaagggagcaactagggcagagaatggaatcggcatttacatcacttcatcacgcaggatatatgaaaggactggtgcttggggtaacagatgagttggacccagcaacgtataacgagtttacgaagcttggtttaacgcatattttagcaatatcgggcatgcatgtggcggtatatgcagctacactattatatttactcaagctactaagagttagccgcgagacatctcttacagtcgttttgatactcattccggcttatgtcctgctgacaggtgcttccccctctgttgtgagggcgggaattatggcgatgatcggcttgtttgcagctcgacgaggtatgctcaaagacggacttaatattttaagtatatccgcgttgctcatgctgatttggaatccatattatctacttagcgtcagctttcagctttcctttttggtgacaggtgggttgctcatttatatgccgcttatgaagccgtttttcgccaaatggcctttcctaatcggaggtgaagttgcgattacaattacggcacagcttgtttcgtttccaatgacggtattctactttaatcaattttcgctgttatcatttgcggccaattttgtgcttgtaccccttattacatatatcgtgcttccaataggtacggtggcgatggggctttcctttttgtggggggatggggctcgtattcttgcgtggccggcagagcaattgaacgatttgacctttttactagtgaaatggctgaatgtggatgatgcttatgtgagtatttggccgtcttcctccatcctgtgggtcatggcgtattacgcagctctgtatagtgttctgtactggcttaaaacgtggctgacatctcgcaggcaaacagacgataattctgttttgaattccacacccatatcatcacccgtttatacgggattagctgcttctgccgaatgggctgctgttttgaatacagctcatgaacctgagggagcagggaaatttgcgcgtcgacagtggaatggttatcgtcatttggcactggctctaagtgttatcgcctggcttggcatattgtatacaggttaccaatctcctagtggaggaaatacgggaactgttcaatatctggatgtgggccaaggtgacagcattttaattaccacgccgggcgggaaacatattttggtggatggcgggggtacaatggactttgctacagggaaaaatgcttggcgcaaacgcgcagatccctatgaggtaggtgaagatacgattgtacccttgctaaagcaacgaggtgtacatcggctggacgctgtcattttaacacacggagatcatgatcatgcaggaggactacaggctgtgcttgaccagattcccgtatctaccttgttttttaatggtaccctgacagataaagccccattccgtaagctgttgaacacggctttagacaagcagattaagctgtacggtgcacatcatagtatggaatgggaaccagaccaggctacgaaaatccgctttctctatccgtttacgccaccggagaacgaatctgagcagttgcctgttatgaaggagcaaaatcattactctgttgccatgatattggagatggagggagcctcttttttgttcacaggagatatggatgatgcagcagagtcgtcgttgctctctgaattaactcgtttttcatcaagtgtgaaagataagggagcagcgggggctgtcgggaaagctgtagatgtcatgaaaatagcacatcacggtagcaagtattccacctcggaagagtggttatcctactggcgaccgaaagtatccgttatttcggtcggtgcgaccaatacttacggacatccgaatgaagcggtattggaacgtttatcggcagttgattctgctatatatcgaacagatacgatgggagagatacagattcgagcgcagcaaggtaaactgagtgtgcggtatcaacgtaaacggtacaaaacagatactaatacaacaacatactaaaagggtgctcactctcaggagtgggctgtttgctttgaatccaatctgcatggacagtagctgtaagctttgatagaatcatatgagtaatgaaaatgagaatcattattaacaggaggaatattgtgagttattttaaatttagagcctcagcttgtttgttcatcatttcattaatgctggtattgagtgcatgcgctacaagtgggggtgggactgtaacagaaagcggtcaatcgactgctcccaagagcacatcaattggaggtgaggctgccacgcgtacatatgaaagtgataaaggtacaattactgttcctgagcatcctcagcgtgttgtagttgcagttggtgattatgtaggtgatgtgctagcacttggtattacacctgtaggggctccagataccgtatttaatgctccatattataaaaaatacttgaatggtgttgaaaatatcggtgacagctccgcattgtcccttgaaaaggtgatcaccctaaagccggatctgatcattacctatgatgagaaagcatatgaaaatctgaaaaaaatagcgcctactgtgtttattccatatggtaaatatcaatataaggaccgtctgatggagctgggcaaagtgttaaacaaggagcaggaagcgaagaattgcctggctgattttgcaaccaagattgctgagaagaaacaggctttgtctgacgtcattgattcgggtaaaaaaatcgctatttttgagattacaggaaaagaattatatctatatggaaaatcttatggacgtggaggagccatactttatgatgagctgggacttcatgctcctgagaaggtagaaaaggcagcgttcgagaaggggtgggccagcatttcaatagaggctttaccgaagatgctgggcgatgccgattttttaatgttgggtattcgaggcgacggagcagaccaaggaaaagatattttatctaaaaatgtgtggaagaacctttctgccgttaaatcaggtaaagtatatcaatactcaatcgacgatttttattttcaagatccgattgctctgacttatcaattagaacgcatatctgattttttggtttccaagaagtaacaatatgatcttgcagctcgataggctagcatttagatttatgtaggagctaggggaaggtgactaccttccctttttctgttattctaagggaggatacgctggggattctgggctttttggtataattttttttgttaaaaaaataaaattagtgtcagacgtctatcctgcaacaatttgcaaaatggatacgtctgtaatattgcagggagagggggatcctttgtggtagagcagggactcattcgagccgctcaatcgggcgatcgcgacgctctcattaccctattaagagagatagaacagcatgtgtaccgtacggcatattacattctaaacaatgagcaggatgccatggatgcttcacaagaagccctcatacggatctattcgaaaattaactcttatgaggaaaaagcgcagtttaaaacctgggtccaacgtattgtaacgaatatatgcatcgacaaattcagaagaacgaaaccctcggtttccattgacgagcacgacatgatattcaacgatccccaaaatgtggaggtcgaggtgttgacctcttacatggcacaggatgttcgtgaggctatacaacagcttccggagcaccaccggacggtaattgtcttaagatatttgcaggatttctcctataacgagattgcagattctctggatttgccgctaaatacggtcaagtcatacttatatcgtgcaagacagcaattgcaagggctacttcaggaatatcagaaaggtggtgtatcaggatgaagtgtggggaagaggtgatggattggatgcagcgttatgtggatcatgagctgggcgaagaagaaacgtcccaattaatgaaccatattgcgacttgcccggactgtgcggaaaaatttcttattcttcagacactctctcgcgagctggaggaattgcctgcggtttccccggcgttcagcctggtggattccatcatgcctcagcttgatgccattgaccgcgcacgtgaagagcagggaagtgcgcttcaggaaatgcagcctgtggctgtagagcctggaccagtgcctagacagcgtacccagcctacaccttggtggaatcgaatggctgggcgcgctgctatgggcgtggctgccgctgctgttgtactggggattgtagtatttaacttcgagcctaaaacagtgcaggatgcggaaggcatacttacaacccagtcgcccgaagtgacgaatccgcaaaatcaggcggaaaatacagatacagcaaacggcagtggaggtcgtgatgcagccattggttcggattctacacagcagccatcagagcaggggcaaggaacgaatgcatctcagctacctgcggataaagatcctgacctgagcaaaggtgcaaccaatgcagacgatgaaaagaactcttccaaacgggatgctgggaaacgtgacgatcagcgagctggggaggaagactcgacgaaatctgcaccagctgaacgttcttctcgtcaggaggaagggcagggacagctacgtacggatcgtcagatgacaaaggaaaatccgtctgctgcagatgctcctaaatctgaggacaaacagttaagtcaggaaaaatctgatcaacctacgattgcatctgatgaacagttagaaccgaaaatggaaaaagcgcccttagcgggtacgggtacggctcaggacggtaataacgatagcacaagtacgaatgattcatcttcgtcgcttagtcaggaattgaaggtgcaggagcggattgcgtcaaacgaaacgtcgaaagacaagacttccaaaagcatcactaaggattcggggaatgccttgggaacggatagtagcaatgcagcttctaatgatcagcaatcatccgtgtcacaagacccagttcgtaaagaaggctttgtatctaattcactggtctctccagacaacgataatgcttccagctatagtgcccaatccgcatctacagatcagctcaactcgcctgatggtagctatgcggtggctattgagggcaaaaagctgaaagtgtataagctttccgataacggtgtagaccgaacaaccctggaagtccgtactttaaaaggtgcctgggtcaaaggcagctggtcagaagacagccagacctttatgtatgagacggagcaggatgggacagcaagtaaatatacgtacaccgtcccgcgcagcactggaaaatagtttccgtaagttgacacacttttaaaaacagagaataaactatatgaaccgacgtcgtatcccgacggccgaaagtttctagagctttctgctgccgtgttgatatagatggtggtgaagggatcctgcctataggtagggtcccttcgtttgtatcatgacttgccttccgttcggatgtcgggtacgatcagtgggtggggggaacggaaaatggatgtaaaaacagcctctaaggctattcgcaaaggcgacatttcgccagtgtatttgctttacggcagtgaaaaatatcaaatgaaacagtttgttgagatgcttaaagagaaagtggtggaagaggagcatcgtgacttcgccatcattccttatgatttaaccgaaacgcccattgaggtggtcgtggaggaggcggaaacagcgccttttctggtaccaaagaagctgattattgtacgggataccagtgtatttgcagcaggcaaagatagcggtaagatagagcaccggcttgagacgctgttgacttatatggataacccgactgactatagcgtcatcgtttttacggttcaggctgaaaagttggatgaacggaaaaagattgtcaaaaaactgaaaagtgatgcttcggttattgcttttgctccaatgggtggagatgatcttgtggcttggattcataagcgtgcaggagaaagagaagtgcaattggcagcaggagctgctgaaagtctcattcaattcacaggtaccgggctgcaatccttggctgccgagatagacaagctttgcttgtacgcaggagcacagggaaccatctcatctgctgatatagaatccctggtgcctcgcaacacagagcaaaacgtatttgcgatggttgaggatctggctaatttgcggctggataaggcactcagtattttctatgagttgcttaagcaaaaagaggaaccgatcaagattgccgctttgatcacgcgccagttccgtattatgttgcaggtcaaagagctggcaggtcaaagctattcccagcaacaaattgcgagtcagcttagtttgcatccttatggagtgaaagttgcaggagaccaagcgcggaggtttcgccctgagcagctgcgtcagcttctctacgaattgggcgagctggattatcatatgaaaacaggtgtcgttgataaggtactgggactggaattatttttaatgaaaatgggtgcgggggcttcaatctaattccctccatgtgctgttatagagtcagctaatgtatcgtgaaaagctgactctataaattaataaaagttataaactaaaaaaacctgatcagccaaggctggtcaggtttttttcattaacgtatgaaagtagctcttgcttacgcttgagctgtaagagcgttaagttttttcgccaagcgggatttcttgcgagcagctgcatttttgtggatcagacctttagttacagccttgtccagcttttgggaagctactttgaaagcagcagcagcagtttcagcttcgttacctaccaacgctgtatcggcagcttttactgctgtacgaagcgcagatttttgggaagcgttcaacgcacggcgtttgtcgctagttttaacgcgtttgatagcggatttgatgtttggcattacattcacctcctgtaaaggcattacttatgaacacaaacgtttcacaacttaaaatattttagcatgccacacctcaaattgcaataagaaaacattctgaggcgatgcgaattacaggatgaaaatggatgtgcataaacctgttgggtgtctcgcacactatagtcaaagatggtatccaaggaggcttaaaagatggatctggatttgcagaagtatgcggtacgcacggatttggcattagaggcaagagaactggccgaacgggatcagcctgtacctctggcaggcataagtgagaatgtggaggaagataacggaatcaaaatcacacggctggatgtactgaatgaagaaggagccaaccgtattgggcgggtacaaggacattacgtcacactagaagtacccggcctgcgtgaaggcgacacggggctccagcaacgtgtcgctattgcatttgcaaaagaaatggagcattttatacaaaaaataggaatctctaatacggcaaaggtactggtggtaggtctgggcaactggaacgtcactcccgattcgctgggtccgcttgtcgttgaaaatttaatggtgactcgtcaattttttgaactgacacctgatcaaatcaacccgggctatcgagatgtaagcgcaattgcaccgggcgtcctgggtattacggggatcgagtccagtgaaattgttcaaggcatcgtagatcgcacaaagccagaactgattattgccattgacgccctggcgtcacgttcactggagcgcgtcaacacgaccattcaggtggccgatatcgggatacatccgggttcaggtattggcaacaagcggcgcggtatcaccaaggatattatgggcgttccgtgtatcgctatcggcgtaccaacggtatgctacgcttcgaccattgtcaataacgtaattgaactgatgaaaacacattttaccaaagaaaaggcttctacaaaagcaatcctggggatgttggacgatatttcagaacctgagagacttgggcttgtgagagaggtcctacaaccgctggggcatgatctgattgtgactcctaaagagatcgatgaatttattgaagatatcgcgaacattattgctactggattgaacgctgctctgcacgaagctgttgatcctggcaatgtcgccgcctatacgcattaatcaagggttggtaaaatcgtatttcatacacaaaagtctctatctaacaggaatctaatctctttcaaaaagggaggtgatatatctgtagtagagattttttgtgttctagcaattgttctccgttcatagagttgaagtataagagatttccgtagcagataggaaccctatgttcctaaataaagcgggtttcgacgggacgaaggaggacaaggctcacatgaaaaaaattcagacctggaacgtcggaagatggagaagaaaaggtatcgaaattttggcgatgggacacacgcttgtgctgctgatcatgggctcggcgcttttatttgtcgttttggggctagggggattggcagaaaatcgtctacaaacctctcctgtttcttccatgaaaggattggcaggatcggtgtccagcggttttttcgcggatatgctaggtatggaagtacctcatttggcacaaaagaagcagcaatcttcgttgtcgggtgaacaatggtcgccttttgtttttcagatgcttacaggtattaatccgcaggaccctaaaagtctcatttctcgtgaaattcctggtatgtctgcaggagcacctgtcttgctgcgtaagggttcggggaacaccaaggtagagggtcctacggattatcagcccgatcaggggacgacggatgcccctggtggctcagatacatctgagaatccaccgactactacgccggatattccgacaacaccggaaacagacccggtacgtgaggatcatccaggtgatacagccaaaggggacaagcgtatattaatctaccattctcatcccagagaagcatataacccactactcagcaaaaccagttccaatcctaattcaggttctaaatcagctaatgtgtcaagggtaggggactttgtaaagaagaggctggaaaagcaagggatatccacattgcatgtaaacaaggattatgccactacagttcaaaattacaattggaactactcctataaatattcacgcgaaacagtcaaggaagctttagctggaaataaaggtttaacttatctgcttgatatccatcgagattcacaacgtcacggaaaaacaacagcaaccattaatgggctttcctatgccaaggtatattttattatcgggcatgacaacaaaaattggcgcgagaatgaagcttttgctgctcgtattcatgaaaagttggaaaaatcgtatcacggcgtatcacgtggtgtatgggggaaagatggtggcaaaggcaataacggtgagtacaatcaaagcttgtcttcccacagtattttgatcgaaattgggggtattgacaacaccgaggaggagttaaaacgtacctcggacgttttggcggacatgatcggtgaagtgtattgggaagatcagaaagctcagaaagcgggcactaacgtatcggatacaaaaaagagcaacagcggcaattaaatgaggtagcggtaagggggaagggtaatgtctggacattttcgtaagaaagcacttggatttgtactgctcatgggggcaggcattctactcggtatgcaactggcaggatctggccttcgttcagtgtatggaccggaatggaatggggatacgattcaatcggtaaatcatcagaaagtcggatatgaacagacggttattgaggatacacccgcagctaacactcgtgcatatagcggtacgtatagcacaagtggaaatgttaaggttgagccgacaacgggagtgggtataaacgaagctagtggaagggaagaaaatgaggaacagacggagcatggggcatccaggtggtattcgacgactgtgcagcatgtcaatactcagggcctggagacaccgcgtgaactgctggccgtcaaggaacagcaagcctcggtggataccatggcggacaaaacagctgggttgcttcaaaacctgtcgagacagggcattcgatgggtcgtatctgtatttgatggagtaacagaatagaaatattgctgaccccccttacaactgctataataagctgattgacactaggcattgtgtgggggtaaggcatgactgacattttggcaagacaacgtaaaattcggaactttagtatcattgcacatatagaccatggtaaatccacgctggctgaccggattttagaatataccggtgcactcacttctcgtgaaatgcaggaacaagtgcttgaccagatggagttggaacgggagcgcggaattacgatcaagctccaggcagtgcgactcacttataaggccgatgacggcgaagagtacattttgaatttgattgatacaccgggacacgtcgattttacgtatgaggtatcccgtagtttggcagcctgtgaaggtgctttgctggtagtagacgccgcgcagggaatcgaggcacagacgttggctaacgtatatttggcgttagataacaatctggagattttgccggtgcttaacaagattgatttgccaagtgctgatcctgaacgggtaaaacaggaaatcgaggatgttatcggcttggatacaagcgagaccgtgcatgcttcagccaaagctggaatcggtatcaaggaaattttggagcaggtagtcagaagtgtgcctgctccgcaaggtaatccggataatccgctcaaggcactcattttcgattcgcactatgatccttataagggcgttatcgtatatgttcgcgtcgtggatggtagtatccgagccggttcgaaaattaaaatgatggcgactgacaaaacgtttgaggttattgaagttggtgcttttatgccgcgtatgaacatcgtggacgagctgaatatcggtgatgttggctttatcgttgccggaattaagcatgtgggcgatacgcgtgtcggggataccgtgacagatgcaaaaaatccaacattagaaccgatgcctggttatcgcaaaataaatccgatggtttattgcggtctgtatccaatcgaaacatcggagtataacgatctgcgtgaggcgcttgaaaagctacagttgaacgatgcttcgctcagttttgagccggaaacatcaagcgcgttgggctttggcttccgttgcggattccttggtctgcttcatatggacgttatccaggagcggattgaacgtgaatttaacattccgctgattacaacagcaccaagcgttatttaccgcataaagttgacgaatggggaaacgatccagatcgacaacccatcgaattatccggaaatcggacggattgaacatgtggaagagccctatgtaaaagcaggtattatcgtccctaatgattacgtaggtacggtgatggagctttgtcaaaccaagcgtggggaatacgtaaatatggaatacctggatacgacacgggtaaccattacgtatcaaattccgctgtctgaaatcgtatatgatttcttcgatcagcttaaatcaagtaccaaaggctatgcttcctttgattatgagatttcaggctatcgccagtccaacctggtgaaaatggatattttgttgaatggcgagcaggtcgatgcgctgtcgttcatcgtgcatagagatcgggcttatcatcgcggacgtattatctgtgagaagctgcgcgagctaatcccgcgtcaaatgttcgaggtgccgatccaggcatctgtgggaacaaaggttgtggcgcgtgaaaccgttaaggcgatgcgtaaaaacgtcttggccaaatgctacggcggcgatatttctcgtaaacggaagctgcttgaaaagcaaaaagagggcaagaagcgtatgaagcaggtcggtaacgtagaagtaccacaggaagcatttatggcggtactgaaaatagatgagtaaagctgcttgaagtattcgtccattctttcatggggcatttgccgtgcatggagaatggacgttatttatttgagcaagctatccagagatggagtgtttgttatctcagttgcaaaaatagtataacaacagcatctttaagcgtatttctaaagatgctttactcttactgcaacacctacaccacaaaaaaatgaccgatggtggtaggcagcggcggagtggtccatttgaatctggagaagcgtagcctttactccccaattttaactgtaagagtgcttatataatagaaaattgggaagtaacagcgatcagaagatcaaatggaacacgaagcggttgatctcgaccttcggcgtattttttcactattccctgaattgacaaggaggatcggtatgaccgcatccatacaaaaacatgaacattcatccgcccctcaagcggtttacctgcatatacctttttgcacgaataaatgcttttactgtgatttcaactcttatgtgctcaaggatcaacctgttatggaatatctgtatgcactggaacgagaaatggaacatacagtcaagcttcacccgccaggagagattaaaaccatttttgtcgggggtggaacaccaacaaccctaaacccgaaggaaatggagtattttctgaagagtgtccgaacctattttccacattgggcggaagatattgagttttccatggaagccaatccaggcaccactgattttgaaaaactctctgtgatgaaagaaggcggcgtcaatcgactgagctttggtgtacaggcttttcagaatgagctactcacaggtataggtcgtattcacagtacagatgacgtatatcgtagtttggaaaacgcccgtaaggtaggcttggacaacttgtcgattgacctgatgttcggtttgccgaatcaaacggtggacatgctgcatgaaagcgtgagtagagcactagagctggagcttcctcattactctatctacagcttgaaggttgaagaaaatacgctcttccacacgctgtatcagaaaaatcagctaccgcttccacacgaggatgatgaactggaaatgtatttactcctcatgcgtcgcatgaaagaagcgggttatgagcaatatgagattagcaattttgcaaaaccaggcttggggagcaagcacaacatgacctattggcgaaatgaagactattacggtctcggcgcaggggcacatggatatgttggcagagagcgtcatatgaacattaagggtattaacccttatgtggaggctagtcgtaatggtttgccacgtctggatagctttgaggtgccagcggcggaagctatggaggattttcttatggtcggtttgagaatgctagagggcgtttctaagtcccgttttgaagctcaattcggtcaggcgttggaggatacatttactgctcctctcggaaaaatgctcaatgccgggttaatcgaatccattgaggacggttatcgtttgagtgaacgcggcattttattcggaaatgatgtatttgcagagttcatcggttctatcacggtaaattcataagtcgtaggcttcagtacagtacgtttcaactttataagctgggacgaccattttataacaccattctgtcacagcagggtaaatggagtattgcgattctatgcgttatgttgtatatttattcattatatgcggcaagcggcaggaggagagcaagatggcttcagtgtgtaaagatgtattgtgcagaagtgcggttcctgaggatgtggagcctttatatcaaatgattagcggctatgcagagcgggggattatgctgccacgttcgagggaagtgcttacgcgccaactggagctgtttattgttgcagaggtggacggcgaagttgttggttgtggttctttatgcaaattgggcgctgatctggtagagattcgctcccttggcatctctgagggacacaaaggtatgggtattggctctaagctcgtggagggccttattatagaagcacggcggcaacgtattcctaaaattatggcattgacctacgaggtctccttttttataaaaaacggttttgatgtagtaagcaaagagattttccctgaaaaggtatggaccgactgcattcactgtagtaaacaaaacaattgtgatgaaatcgcagtgttgaaagtactgaactgacctgtcaataatgaggtcagttcttttttcatcaggacctaatcatgcgtatattatacaggctacattgtttaatcctgattcatttctcatatgttttgagcaaccaccaaatgaattgatgatgaggctccagttcggaaggtattccattcaggcttcttatcggatggtccttatgataatcagtatcattataaaagtatgcagtgccggctaatggaactcggtgtttatatttatacaaggcgacaacatatctttcagacgctccgcttctgcttggactatatgtatatccttcccaatcggctagtgttaaatcatcgtaatgttgtattgccgatatactgtattttatttgcttgggaatacttggactggattcttgagggtaaaacaaaatggtattccatatgcttaaaagtattgtaggaaccaagattaaggcacaacacagggggcttaatttacgaattaaatggatgactgaaataataagggctgcattcaggatgaataccaatggcaaagcaactattcttcctagtcttgtatacggaaacaactcgattaaaatttgaaacatacaaattgtaggtaaaagtgcgatcgatgcgtataaaagattgcggcgattagttctcaaatttaattcctcctcaaggacaaagaagctataatggtatggagacatagtctcgaatttttctattttctgtgcactatacataaatacggtttttatgcgctgtatattgagatttttcgtgaaaaagtgtaaacgttgtggattcattccagtaaactaaactgttgtgataaatcttgtttattgaaaatactgaactgacttgacaatgatcaggtcggtttggtatttttgtattaacggttagcactcatcgcgaacgagtgctaatgattccattaacaatcatgctattatggataaacaacaaggggggattcgcttgttaaccgaacgtcagagactcattctgaatgcgattattgatgactacattcgttcggctgagccagtgggttcccgcagcatatccaaaaggcaggatgtcggattcagcccggccacaatccgtaatgaaatgtcggatttggaggaacagggctatctggagcaaccccatacttctgcgggacgcatcccgtctcataaaggctaccgttattatgtggaccatctggtgccactgaatacactgaagcctatggaaatgcgggaactgaaagccttttacgccgaaaagctgaatgtaatggagcaagtgatccagcatgcgtcaggcattttgtcccatatgaccaattatacttccatcctgcttgggccggaggtttttcatacttcattgcgtcattttcagctgctgccgctcaacgaaacgacggctgtggcgataatcgtgaccaataccggtcaggtggagaataaaacggtagatattccaccgggaatttcaatttccgagatggagaaggttgtgaatttactgaacagcaagctggtcggtgtgccgatttatcagcttaaatcacgcctttacaccgcacttggtcaggagatggagaagcatgtgtctcattttgaggacgctatgaaggtgctggataaagcactggataatgaatcggatcagcgcttgtatttgagcggtgcgacgaacatgctcaatcaacctgaatttaaagatgtagaaaaggttaaacatattctcgatctgctggaggaaacaccaacgctacttaaactaatgacacctgttgccggagcacctgaaattcaagtccgcatcggcactgaaaatgatcatgaagcgtttgccaattgtagcctaattactgccacgtatgcagtagacggagaagcgttgggcactataggcatactgggtccgacacggatggaatatgcgagagttattaatattttgggtatcctgtctaaggatttgaccgcaatgctaacgcagcggtttaaatagaacaagaccgcataggttgcggtactacatgttccgcgccgggatacggtttgtatcctgcgcgggtgcattgttgcgtgtttttgtaaaggtagttatgacttgaaggaggtgaaacattttgaaggaagaacaagcgttccaagaagaaaaacaacaaaatgtaagcacagaggaagccgccgaaacgagccagcaggaagagccggttaatgaagcggcggcactggaagaccaagaaagcgaaacagagctgactaagcttcgcgctcaggcggaagagcatcagcaacggtttttacgcgctcaggcggattttgataattttcgccgtcgtacgctgaaagaaaaagaagaccttgccaaatatgcatctatgaagctggttaccgagttggtgcctgttttggataacttcgagcgtgcgctggcaacagcaccgcaaggagcggagtctgagtcattcagcaaaggcgtggaaatgattttccgccagtttgagagtgtgcttcaggcagagggagtaacggccatgaattcagtgggacaaccgtttaatcctgatttccatcaggctattatgcaggtagagagcgaagagcatgaggaaggcatcgtcgttgaagaggtacaaaaaggatacatgctgaaggacaaggtgcttcgtccagcgatggtaaaagtgagcatgtagctttttcaatatacattagaaatacatcaatttgattcaaccattctggcctgcgggcctcgtatatacagaaggaggaattgtccgatgagcaaagtaatcggtattgacttaggtacaaccaactcttgtgtggctgttatggagggcggcgaagcggtcgttattccaaatccggaaggcgcacgcacaaccccttccgttgttggtttcaaaaaagatggagaacgtactgtaggggagacggcaaaacgccaagcaattacgaacccagatcgtacaatcatgtccatcaagcgtcacatgggtacaaatcataaagaaagcattgacggcaaggaatattccgcacaggaaatttccgctatgattttgcaaaagctgaaatccgatgctgaagcttacctgggacaaacggtttctcaagctgttatcactgttccagcttacttcaatgacggtcaacgtcaagcaaccaaggatgcaggtaaaattgccggtctggaagttctgcggattgtcaatgagccaacagcagctgcattggcatacggtatggaaaaatccgaagaccaaacgatcctcgtgtatgacctgggtggtggtacattcgacgtatccattctggaactgggcgacggtttcttcgaagttaaagcaacaagcggcgataacaagctgggtggcgatgactttgaccaagtgattattgattacctcgtaaatgagttcaaaaaagatcaaggcattgacctgagcaaagataaagctgctgtacaacgtctgaaagatgcagcggaaaaagcgaaaaaagaactgtctggcgtactgacaacgacgatttctttgccgtttatcacagtagctgatggcgttccacagcatttggagttgaacctgactcgtgcgaaatttgaagaattgtctgaaggtctggtagaacgtactttgggacctactcgtcaagcgatgaaagatgcaggcatgagtgccagcgacatcgacaaaatcgttctggtcggtggttccacacgtattccggctgtacaagaagcaatcaaaaagctgacaggtaaagagcctcacaaaggcgtaaaccctgatgaagtggtagctttgggcgcggcagttcaagcgggcgtactgactggtgatgtgaaagacgtcgttctccttgacgtaactccactgtccctcggtattgaaaccgcaggtggcgtatttactaaaatgattgatcgtaacacgacgatccctacgagcaaatcgcaggtgttctcgacgtatgccgacaatcagcctagcgtagaaattcacgtgttgcaaggtgaacgtgaaatggcagcaggcaacaaaacgttgggtcgtttccaattgggagatatccctccagcaccacgtggtgtaccacaaatcgaagttacctttgatctggatgcgaacggtatcgtgaacgtatccgctacagataaaggcacaggtaaaagccaaaaaattacgatcacatcttcgagcggcttgagcgatgaggaagtagaacgtatgatgaaggatgccgagttgcatgcggaagaagataaaaaacgcaaagatttggtagaagcgaaaaacgctgcggatcaactgatctactctgtagacaaaacgattaaagatctgggcgaaaaagcggatgcaggcgaagtcgaaaaagcaaatgcagctaaagaaaatctgcaaaaaacgctggaaaccgacaacctggaagacatcaaaaaagctactgaagaactgactgaaatcgttcagcaattgtctgtgaagctgtatgagcaagctgctcaagaagcacaggctcaacaagctcaagatggtgcagcagacagcaaaggccgcgacaatgtggttgacgcggactatgaagttgttgacgaagaccagaagaaagactaagttacggatcaggtagtggtagctttacggtacaccgatgcgttatgatatactgaatagtaattgcagcgtagctgccttgataaataacaattagccgaagggtaacagttatttccaagataaataagcatattacgggttgtactgccttgaaatgatgggaaggtcaaagccgggtcatcccgtgcctttggctttccttttatatgtagtgcagacacgttgtaggcatgggggtggaacattggctgataagcgtgattattatgaggtgctgggcgtcgcgaagggcgcttcggatgaagaagtcaaaaaggcttaccgtaagcttgcgcgtcagtatcatccggacgtgaacaaggctgcggacgcggaaactaaatttaaagaagtgaaagaagcttacgatgttctcagcgatggtcagaagcgggcaagatacgaccagtatggtcatgtagacccgaaccagggcatgggaggcggctttggtggtggtgccgacttcggtggcgggtttggcgatatttttgatatgttctttggtggcggcggcaacggtcgacgcgatccgaatgcaccgcagcgtgggaacgatcttcaatatacgatgacaattgagttcaaggaagcggtgttcggtaaagaaaccgatattcatattgaacgtacggaaacatgtgatacgtgtcacggtacgggagctaaagcgggtactcaaccacaaacctgctccgtctgtcacggtagcggacaggaagaagtggtgcagaatacaccgtttggtcgtatggttaatcgacgcgcctgctccaattgcagcggttccggtaaaatcattaaagaaaaatgtacgacttgtagcggttcgggtcgggtacgcaagcaacgtaaaattcatatccgtattccagcgggtgtggatgacggcgcacaaatgcgtattaacggtgaaggcgaaggcggtgtcaacggaggaccggcaggtgacttgtacgtcgtgttccgcgtgaaatcgcacgacttctttgagcgtgagggagacgatatctactgtgaaattccgctgacgttctcacaggcagcattgggagatgaagtcgagatcccaacgttgaccgagaaagtgaagctgaaagttccagccggtacacaaacaggtacttacttccgtcttaaaggaaaaggtgtgccaaaactgcgcggcgtaggtcagggtgaccagcatattaaggtcgttgtggtaacgcctagtaaactgagtgaggaacaaaaggatttgctgcgtcagttctcttcgcttagcggagagcagacacatgagaatgagcagtctttttttgaccgtgtgaagcgcgccttccgaggcgactaagcccaattaggaatcgcggagcttcaaccatgaatcaaaggaaactattccgcaattgcgggatagttcctttttttatattcacgtaaacacatacataaccatttttgtataggaatgttgaactgttgaagacttaatatcaagtagaaaggggtgagttccatcggaaatgtacagctcaagctgcgtcggggtaaaccgctattaaagctcagaggcctaattacactgctagtatgtctagttatggcacttgtgcttctgcctgtaaccctgttatttgctgagagagtggagcatgaaactgagaagggactagaagaaaaggcaatgtccatcgcgcgtacactcgcccatacgccgcttattgtcgagcaattgcaagggacgggttcgtctccttccatgcaggagtatgtgaagagggttttagcagcaaatcacatccagtttatcgtggctatggatatgaagggaattcgtaaaacgcacccggatgctaggatgatcggcaaagcctttgtcggcggagacgaatataccgcacttcatggccatgagagcgtgtccgttgcgaagggaacattgggcttgtccatgcgagccttttcccccgtgttcagtttaacggggaagcaggtaggggcgattgttgttggtatatccatgcaagatgtacagatggctcaggaaggcaacaaccgtcttattgcaatagccattggcactggaatgttgattggcactggaggtgcggttgtgctggctcgtaaaatcaaaaatatgctagtcggtctcgagccgccggaaatcgcacgcttgctggaggaacgcagcgctatgttgcaatccatcaaggaaggagttattgcggtagatgaattcggttgcgtcatgctgatgaatgcagaagcgatacgtctgcttagacaagcggggattgaagatttctcattctccggacaggagattaccgtttatctatccgcttttcgattgcaagaggtcttggaagcgagtactccacaaatggatgaggaaatggagctgggtggaataactttgctgaccaccagtgttccgatacgggtcaagggggaaattgtgggggcaattgtaacctttcgggataaaacggagatgaaccagcttgcggaacgtttgacaggagtgtccttgtacacagaagcactacgtgcgcaggctcatgaatttatgaacaagctgcatgtcattatggggatggtacacttacgaatgtatgataaactggagcattacattatggatgccgtcgagcatcatcaagtggagattggctccatcacccggcagatcagggacccagttatggcagggtttgtgttggggaaattaagccgggccagagaagtaggggcgaattttgaactgactccaggtagttacttgcccgaatccagtcaaactcaaacgacgcatgaactgattactattcttggcaatctgtttgataatgcggtggaggcgatggaatctttggagcacaagcggattaccctttcactttattatgaggaaagtcagaagaacggttatctgacctgtatcatgtgcgataatggtccgggtataccggaagggcttgtaaaggctatatttgaaaaaggtttttcgaccaagggagagtcacgaggaatgggcctttatctggtgacgcaaagcgtgaaaagattacagggaagtataaagttgatcccagccgagcaagggtgctgttttcagattacgattccatacattatagcggggaatgatgaacatgattaatgtcctgattgtagaagatgatccgatggttgcggaatttaaccgcaaatatatggagcaggtggaaggttttcgatgtgggggctgggcttcttctgtagaagaggcgaagaaatatatagctgaacaggccattgatctgatactgctagatgtgtatatgcaggaaagcaatggcctcgatttactgtcattcatacgggagacaggtgtaaatatagatgtcattgtcatctcggctgcaagtgacatgaacagtgtcaaaaaagcgatgaacttcggcgcggtggattacttgattaagccgtttcactttaaccgttttttggaggccctcacggggtaccgagagcacattagcatcgtgcgtgagcacagtctactttctcaggaggaactggaccgactgatttatcataaaagcttgactaaagacttggcacggttgcccaaaggcataactaaatccacgctggctatgatatggaattgtatccagcggcataataaggtgctattttccaccgaggatattgcggagagcgcagggatatccagggtgtctatgcgcaagtacctggcttttatgacagagattgaggctctttccatggaaaccatatacggtaccataggacgccctgtttaccaataccgaatattgccacaggcagaaggcatcatgaatagttttatttaaatcttctttctgattactttaattacaaaagtgaatgattagttataaaaccaaataaagcgttttccaaggtgtagaatggaaacatgatcatcattcttcactttatggagggagatttatggaaaatgctacgaatcagcctgtcattcaaaaggggcaaagatggagtaaaaattttgtagatggcatcagaatgctgggtaggataaagttgggggttattcctcttccactctatgccgtgatcgcgctgattgtttatgcagctgcagttactgaaagacttccaaacgatctgttgggcgggtttgccgtcatcatgattttaggtatactgctcagtgatctaggggccaaacttccgttgcttaagcatattggcgggccggccattttatcacttatggttccatcgttaatggtattttggaatatgttcagtccatctgcgatgggtgcggtacacacgcttatgaaaacctcgaattttctttacttctacatcgcatgtctagtaacgggaagtattcttggcatggatcgcaaaatgctgatgaacggaattgttaaaatttttgcccccattattataggatctattgcagctgttggcgtggggatggtggtgggtatggcttttggctatagcgcctatcatacattttttttcatcatcattccgattatctccggtgggattggggaaggcattttaccgttgtccatttcgtatggattagtgctgggcaaggattcggcaatattcgtatcccagtttatcccggctgcaattatcgggaacattgttgcaatcataggtgcgggtgttctgaagagattagcagagaagaatccaaaaacttcaggtaacggaaggttactaaaactagataaagatgcagacaagttagccccggcaagtctggaacaatcgatttcttttccattgatgggaggaggtctgctgttggcctgtactttcttcattgtgggtaagctgctggagccgtatctccatattccaggtccgatcctcatgattctagcggcggcattaattaagtgtattcagatcatgccgaacacattggagcagggagcttttcacttgtacaaatgtataacggcaagtctgacgtggcccttgatggtgggattgggtattttgtatgtacctttggatagtgtagttgggattttaacggttccttatgccattacctgcgcatctgttgtagttgcattgattgttaccggatacttcacaggaaaatggattcatatgtatcccgtagaagctgctttggtgactagctgtcgcggtggattagggggcacgggagatgtagccattctgtctgcatccaatcggatggaactaatgccttttgcacaaattgcaacacgtattggcggggcaggcacggtcattttagccactttgttactccaattttggagctgatgagttttatacacaggactgagttttcatatccaaatagagacatgaaaggacggagaaaaatatgagcagtttaatagacgaaattagagaattacatgcaggtggcaaaatggagaccttaccaaagaagcgaattgaaacgatggaggggttgtccaaagtgtatacgccgggtgtagctgaaatttgtatggaaatcgccaatgacccagccaaagcgtatcaattaacgatcaaaaagaatacagtagcagtcgtttcagacggaacagcagtacttggattaggagatatcggaccggaggccgctatgcctgtaatggagggtaaagcagtgttgttcaaacaatttgcaggtgtcgacgccttcccaatctgtctcaacacgaaggacgctgatgaaattgttcaaattgtcaaaatgattgctcctgcctttggcggcattaatttggaagatatatcttcgccacgctgttttgaaatcgagagacggttgaagcaggaactagacattccagtttttcatgatgatcagcatggtacggcagttgttgtattagcgggtctggtcaatgcattaaaggtatgtggcaaaaaaatggaggatgttaaagttgtatttgcagggattggtgcggcgggtatggcctgctcccgtatgctgcttaaggcaggtgtgcgcaatctgattggcgttgatcgacagggagctattcatcgtgacgtggagtacagtaacccgcattggacagagtatgcgaacatgactaatccgcacaatttaagtggaagtttatccgatgtgattgtgggagctgatgtattcattggtgtgtcaggcccgaatatactgactgtagaggatatacagagcatggcaactgatcctattgtgttcgccatggcgaatccgaagccggaaattgatccagctgtagccgcacctcatgtacgtgtacttgctaccggtcgctccgattttccaaatcagattaacaatgtgctgtgcttcccgggaatttttcggggtgctctagattgccatgctacgacgattaatgaggaaatgaaactagctgccggacttgccatcgctgatgcgatctgtcctgaagagctaagtgaaacttatatcataccgaatgtttttaatccgaaggtggttcaaaaggtacgggatgctgttattcgtgctgcatgggagacaggagtagccaagtcaggtgaagctccggcagctactttacacccgtaaaagttatagtcttcacaaactatagttcactgtctaggcccactgtttccattatcgtctgcatccgtctagtcttcgtagggaatataaaatcgtgccaatgagcaggatataacaaagcgtaacgctctatgcttttgaagagcagttacgctcaatactacacagggagattttgagatgggcgaaaaaaatattttggcgtatttcaaaagtcctgaggaagcacagggagccgctagaaaactggaagcactccgggtagccgatgtgtcgatagaccgatttagccggtatccgcggcagtctactggcaacgccggattgcctgtattttcaggacagattagcagcttgtcctcactgacacagggcgtggactttacagatgcaactccagcaatactggctgcggctgatccgtccgccagtggcatgagtgatggaggacaaggcggaccgacaggccgcgatattttgttgaccgctgtggtggatgaatccatacatcatcaggcgatgtccatcgtggaacaggcgggtggaatgctgtgaaaagtttggagggagcagtgaccgatgtccaaaaacaaacggtttgataaagtgctgaccaaaaccgaaaaaatcaaacgcatacaatctgctaaaaatgaagatgttgagttctcggcagatcaggcagatgctgaggatctagaagcgatccggcgtagcgaagtagctgaccgtcgtcagcagcgtatcataaacgacaatgagtagaatttaataaaacgggttatccccatcaacaatgatgattttgggataacccgtcttatttgtgttctttcctcttcctattcattatccgctatatgctgttgcactaaaaacaagaggaccggagacaaatgcagtcgtcgcaggcgtctgattttcaataatcagttggtagttttgcacgcccaaaggtgcaacgtctaccgtttcgacattaagaataatattgttatcgaagacattcgattccagtccgtaataaatttctttgccagctctccaaatccgtacaagcactctaatgttgccagcaccgacaaaacgtagtccaatcgaggcttttaactctactcggttgttgacagctccaggaatagcaggatcaataaatacagacgtcgtagcaattccaagtccggctggagaaatcggaacaggaagatttataccattcgtgataggtgtaataacactggcattataatctaacaccgtctttgccatactaaatcactccttttctagtatattgtattgtatgtactagagttaaaggtgcttggactaaaagagagaacaacaaatacaagctctacaaaaaatattttgtacacggataatatcagcttttttgaactcctgtgcatgtatatagtacaatgtaatgtatgcatgtgaaatgaggaggaaatgaaaaccatgttgtggaatgaaattacaatacatacaaccgaagaagccatcgaaatgatttcgaattttctgcacgaagcaggtgcaggaggggtttccattgaagaatctggttcgctcaacaagccacgggatacgtcctatggacagtggtatgatcggcctttgaacgacatccctgaaggacaagcgatcatcaaaggctattttgccgaagaagtggacatggatagtattcgttcgcagattgagccgcgcgtcgaagaattgagaactttcgatattgatcctggcgaggttcagtatgagctgaaaacagttgatgaggatgactgggcaaatgcttggaagcaatatttcaagcctttgcgtgtatcggaccgtctgacgattaaacccacttgggaggaatatgagcctgcgagtgaagaggaaaaaatcattgagctggaccctggtatggcctttgggaccggaacgcatcctacgacatccctttgtctgagaacgctggagtctgtgattaagggtggagaagaagttattgatgtcggcacgggttccggtattttggccattggagctgtaaagctgggagcgaagcatgtacttgccttggatttggacccggtggcagtatccagtgcgcgggaaaatacgcgtttgaacggactggaggaacgcatcaccattaaagaaagtgatttgctatctgtgcttaatgcaagcgatccaacgctgggtatccagttaccggtcaagctggtggtagctaatatattggcagagattattctgctgttcattgatgatgtatataaagccctggaaccaggtggtatttatattgcttcagggatttggaagaacaaagaagaggttgtcgaaactgctttgaaagcagctggctttgagattgccgaaataagccgggatgaagattggctggcgtttgtggcgagaaagaggtaagtatggattttctacaaaatatttttcgtgtaaatttaaatgttcttcccttttatttactggctgtgatcatatcgttcacggttcatgagtttgcacatgcgtattatgccaataaatttggtgaccctacagccaagctacttgggcgcgtgactttaaatccggcagtgcatattgatctgctgggtacgctgctgctgttgatcggaggctttggctgggccaagccagttccggttaatcgtgacaattttagccgtccgcgcctcatgggcattatcgtatcggctgcgggtccgctgagcaatctgctgcttgcatttgttactactttgatctatgccgtgctccttcattttcaagtattgccggggatggagaaccaacgggtagctcaagcaatctatttgtttatcaatgctctgatcaatttaaatctatttttgtttatctttaatttgatcccactgcctccactggatggataccggattgtggaagatgtggcccccactcctgtacgccgcaaacttcagcaatttgaacagtggtcgatctttatttttctgcttatactggtcattccgcaggttcgagctgtaacgattgaacctctttacacgctggcccagatgatttatatacagtttttgcagttctctttttatatcactggattgtttggagcctaagggctcctttttttacgagaataggtaggtataaactgaatagaagagggaacagactggtcatacaggcgcaaaagatgatatgatgttgcttggtgatttattcggattttgtacggaacgttagtggataacagttatttttagaatgaggattttgcaaaatccaggaataggtgtgagagagaatgcagcgttattttattccggcagagcaatttctagaagatcacgtgattgtcgcgggtgaggacgcgcggcatatcgctaaagtcatgcggggccgtagtggtgacaaaattatagttagtgacggggtgtctaaagaagcgctggttgctttggatacgattgagcaggatcatattacggcgacgattattgagccgctgaagatgacctctgaaccacatgtgcaggtcaccatcgctcagagtcttcctaaaggagacaagatggagacggtgatgcaaaaatgtacagaaatcggagcaaccgggtttgtaccgtttttgtccgagcgtacggtcgtgcagtatgatgccaaaaaagaaggcaagcgactggagcgttggcgcaagattgtgaaggaagcggctgaacaaagccaccgtaatcggattccagaaattagcgcgcccatgacgtggaaagaacttctggcttcttttgctgggtatgatttgatatgttattgttatgaaaaagagaagggtaaacagctacgggatgtaatccagcctttggcaggacaatgggcgtcgacggacatgccgcgtgttctgctggtggtaggcccggaaggcggctttactgaagcggaaagtctggaggccgagcaggctggagcccagtctacaggactgggaagacgtattttacgtgctgagaccgcaggaatggctgcattggcatgcattttatatgagacaggagaaatgggaggggtttaatatgccgtcagtggcattttacacattgggctgtaaggtaaacttttatgatacagaagcgatctggcagctgtttaaaaatgaaggttatgaacaggtggactttgatgagcagactgctgatgtctatcttattaatacatgtaccgttacgaataccggtgataaaaagagtcgtcagattattcgccgtgcgattcgccggaatccagatgccattgtggcagtgacgggctgttacgcccagacttctcctgccgaaattatggatattcctggcgttgatctcgttatcgggactcaggatcgggacaaaatcattccgttcgtgcaggaaattcaagggacgcgtcaaccggtgaacgccgtgcgcaatattatgaaaacgcgtgtatttgaggaaatggatgtgcctgattttgctaatcatactcgggcatttttgaaaattcaggatggttgcaataacttctgtaccttctgcatcattccgtggtcgcggggtctatcccgcagtcgtgacgctgcgagtattattgcacaggcgcgtcaactggtacacgcaggctacaaggaaatagtactcactggtatccatacaggcggttatggtgacgacatggataattatgacctatctgatctgctgtgggatctggagaaggtggaagggctggagcgtatccgtatcagttcgattgaagccagccagattgatgaaaaaatgcttgatgtgctgaaccgttccactaagctggttcgtcattttcacataccgcttcaggcgggggatgacactgtattgaaacggatgcgtcgcaagtacacgacagaagagttttataacaaaatgcttatgattcgcaaagcaatgccagatgtagcgattacaacggacgtgattgtcggcttccctggggagacggatgaaatgttccgcaatggctatgagctgatgaaaaaaatcagtttttcggaaatgcacgtgttcccgtactccaagcgcagtggaactcctgcggcgcgtatggaggatcaggtggacgaagacgtgaaaaatgcacgagtgcatgagctgatacaactgtcagagcaaatgcaactggcgtatgctgagaagtttgtaggtcaggtgctggaggtcattccggaagttgcgccgaaagggaccgaagatagcggcatactccatggatatagtgacaattatattcaactggcgtttgaaggtactgaggatctggttggcaaggtatgccgcgtgaagctgacgaaggcaggcattaatgaaagtgaaggccaattggtccgcgtactagagaatgggctgcaaacagctctgtaagaacaaaaaaagcctgaacaggcaatagagatggcagacaaggatttcgcctttccttacagagaggacggaatccttgttgcgcaaggaagggagattacaggatggcagcaaaaaaggaaatttccgcaggcggcgttgtgtttcgcaaacagggggagcagcttgaaattcagctcattactgaccgatatggcaaggtatccttggctaaagggaaaatggagttgggagaaacaatcgaacagacggctttacgtgaaattcgcgaggaaacagggttgaacgggcggattatccagcatgtagatatgattgcttatacgtatcagcatccagaatttggggaagtagataaagaagtacattattatctcgtagaggcactggatggggatttacaggcacagattgaagaaattaaaggagttgcgtggcatacgcctgaggaagcatggcgtctccagcgccagggtggatatgacaataatgatgtcattttaagcaaggcgctgtccatgctaggaattaatgtttgattctgtggggagatatacgatcctctaaacgcgtccacacaggtagatagcagagaggcaagaccagcagagagctaataacgttaaacagagtttgggcatgggctaccttggctccgggctcggtagatatccaggcagcggtcatctctaggccagggatcaacggcataaagagcaaggctccgccgacgttcagcagcacgtgggaccaggctacaaatttgccggatacgctgccgccaacagcggcaatcagggcggttacgcaggtgcctacattggagccgatgacgatggcgatccccacatcggctggcaaggctccagcagcggcaaggctaatcgccatgccaatgacggctgcgctactgtgaaccagcgcggtcaggcaggctccagcagcgaacgcccaccacatgttggctgcagcgtgatcaagaaaccaacggaatagtccggcctgctcaatccagggtccgaccgactgcatcacgcgaatacccgccagaatcagcgaaaatccagcaaagacgaggctgatatattgtacagcctgcggacggctgagcccattggagccggatgaagctccggcagacacatactggcgactggggacagcttcactccacaggacggtagtgctccagcagagcagtgagccgcagagcagcggaacagccagcttgccgagctggagccccatcagctcggtggtcaggcaggtgccgatattggtgccgagaatgatgccgagcgtgcggccgtaggtcaacagcccggcgttgaccagtccgatcgttagcaccgttacggcggtgctgctttgcagcagggcggtaatgcctgagctgaacagcatgccccgccaaggggaaactgtggcgtggttcaaccagcgggtgaggaaggggccggccaaatgccggagggctgcttccatcagcttcatcccgcccaaaaaaataaacagcccgccgcacaacaggagtataacatgtataaacacgggcatagcccccttttctaggtgaaaatacttatgtaacagcctatgatctaccgaggacagccatgacaagcatggccgagctgttttttatagaacgataatttttgtagtatcttcacaagctttaaaagcgtgacgtcgatatacaggcgggcagtagcgaagcggatcatttgaatctggagaagcgagagcgttcgcctttgcagggggattcttaccattaaaatcatttataaaatccaaagaatccccgtgcaacagcgatcgtaagatcaaatgatccgcggagccgcgcccctatcgaacaacgttttaacactttgagtaatccaagaatgggagtgaaggattttgccttcagtaatattagaacgcagccgtaaaaaaaggctggagcatgcacacccttgggtgtttaaaaacgaaatagccaagattgagggtgacccagaggcaggcgatttggtcagcatcgttaaccatcaggggcgttatttggcgacaggttactataatccggcttcacaaattacagtacgtgtgatgtcctatgagccgctggaagcaatggatcaaaacttttttgcccaacgctttcgcaaatgtctggagcaccgccaacgttttgtgaccgggggagacgcttatcggttggtgtacggcgaggctgattttttgcctggactgattgtagatcgatttggtgatgtgttggtcgtgcagttgttaacgcttggcatggatcggcgcagggaagaaatcagggatgcgctcgttgaagtagtgggtcctgttggtatatatgagcgcagtgatgtatccatccgagagctggaaggattggaacaaacaaagggtcctttgtacggtgattgcccgcgtcatgtagtggtgacggaaaatgggctacacatcaaggttgatatcgtagagggccagaagacgggttatttctttgaccagcgtgaaaatcgtgcggccatagcaccgttgatgacaggttggggagcacgtagtggaattacgctacaagaagttgctacagactcaggggacgctggcacaatggtcatgaagccagtgaataaaagtggtaaggttgttgaattcccattctgggatggcgcaaccgtattggaatgtttttcacatacgggaagctttacgctcaatgcatgtaaacatggtgctaaaaaagtaacatgtcttgatatttctgagcatgcgattgagagtgcgcgggataatgtcaagctgaacggttttgaggaacgcgtcgagtttgtcgtcgacgatgcttttcaatatttgcgcaatcaagtgaaaggtgtagaggaacgcaatgcacgagccgggggcaaaggagatacatccaagccgctgacagcaggtggcggacgcacctttgatgtggtcattctcgatccgccggcctttgccaaaacgaagaacgctgtcaaaggagctacacgtgggtataaagatatcaacctgcatgggatgaagcttgtcaatgagggcggctatctggtgacagcgagctgttcgttccatatgcggccagagctgtttttggacaccattaaggaagcggcggcagatgccggcaaaatccttcgtctggtagactggagagcggctggtaaggatcatcctcaaattttgggtgtggaggaaggccattacttgaaattcgccatctttgaggtgcgcagccggacacagctttaggtttcatacaaagtcaatcgcctctttggtgattaaataggtaaaatagactcattttaggtataaatcagtcctgtagagaaggcatgcaccaagccaacctgcgggactgatttatttttagggggaggatgaattgctacaacatggcaaacgtacgttcttttctcccttgcctgatatgctatactgtttaatagaatgttgttcgttggaaaggaggccgcatcatgtcggtccgcttgttgattggccgctctggtagtggtaaaagtacgttaatccgcaatgaaatgacgtctatgttacgcgaggagccgctaggtaagcctatgctgttacttgtaccggagcaatcgtcatttgcttccgagcatgcgttacttacagaagccggaaacggtattcaggggtcggtgcgcgcccaagtgatgggatttcatcgtcttgcctatttagttatgcaggaaaccgggggttcagcactggtgcctgtaacggaagaaggcaagaagatgcttttatataaaattattcgtcgtcgcaaggatgaactgagcttgtttaaggattcgggagaccagctcggctttgtggatcggttgaatacattgtttacggagctaaagcagtatggaaatgatactcggtctgtacccgaacaactggagcgaatgaacgctgtgggagagtcaactccgattttgcgcggcaagctcaaagatatcagtctaatctacgaggattttgaacgagagctgacgcttaaatatatagacggtgaagatacgttgcgtatgctggcagaacagattgcggagtcttcccttgtgcgtggagcagacatttggatggatggctaccgtaggtttacaccacatgaatacaaggtggtggagcaacttatgctgcatgcctcttcgttgacggtggcgctgacttgcaaccgcagctacgagagcggacagcttccgcatgagctggatttgtttcatccttcggcggctacgtatgtaaagctcaaaggaatggcagaagagctgatgatagagacgcagacacaattactgcgccctgatccgttgccgagatttaaggagcgtccagcgttggcatatttggaggctaactttgaacatcgtacagggttacggaatcaggaacaacggatgcggctgcagcagctacgagagcagtggacagaagaacagccgaagggcataaaactgtacactgcggctaatcgccgtgcagagctggaaggggctgtacgcgaaatgcgccgtctggcccgagatgaaggcgcgcgttaccgggagatggctctgtttgtacgtcatattgaagattatgagccatgggtggaaccgatattcaaacagtatgaggttccagtatttctggatcagcgaagaagtgtattacatcatcctttggtggaattgattcgggcttcgctggatatcgtgcagcggcgttggcggtatgaggatgtattccgtgcggtcaaaacagaccttctactgccgctggacggtcgggtgagccgcgaggagatggaccgtttggaaaactatgttctggcctgcggaatacaaggcagccgttggacagatggtcggccgtggcaggctgtacccagcttgtcactggagctggaggagcaggaacggaaccgtaggcgggatgaaacgttggatttgatggagctatgccgggatgtgatcgtgacgcctttacgtgcgtttgagaaacgtgtgggcaaggcacgaactgcacttgagaagtgtgaagcggtatatctgttactggaagatgcagaaatcggccacaagctggacgccttcattcatcaggcagaggaagcaggaaatcctgagcaggcgaaggagcatcgtcaggtatgggatgcagtgcttgaactactggatcagatcgtcgaaatgatgggtgatgagagactggatacctctttgtttgcgggcgtgctggaaacgggattggccgagttccgtatgggacttgttccgccagctctggatcaggttctggttggaaacacggaccgtacacgtgtgtccggtattcaacatgcctttgtgctaggtatgaacgaaggtgtgatgccggctgtgttccatgaggacggtgtgctgaatgagcaggagcgtacggcattaaacgaacgaggcgtagagctggcgccggatatgacaagacgtctgttggacgaacgttttctcgcttatacggcccttacctcagccagtaaaagcctgtggatgagctatgcagtgactgatgaagaaggcaagtcattgttgccgtctgagttagtacgacatgtgcggcacctgtttcctagtctggacgaacgtccgttggctggataccctttgcctggggatgcttggacgacgcaatgggagtatgcttctcatccgtccgaggctttgccgcagctcactgcgcaattacggcattggcgacgtggcggtgacattttatctccttggtgggaggtatataactggtatgcaagccagcaagggcgtgagaaggacaagctgcgtcagctgttgacctcacttttttatgagaaccatgccgaaatgcagaaggaaacaagccgccgtctgtacggtagcaagctgcgtaccagcgtatctcgtatggaacgttttgtggcatgtccattttcgcactttgcctctcacggtcttcgtttgaaggaacgtcaaatgtatcgcctgaaggccccggatatcggacaattattccatgcagcgcttggagagatggcgatcaatctgcgtaaacgcaatgtcagctggggcagtctcagcaccgaggaatgccgacaagaggcggaaagtacagtggagcgtttggctcctcgtctgcaaggcgagattttaatgagctccaagcggtatggctacattttgcgcaaattgaaagacatcgtgagccgtgcttcgttgattttaggtgaacatgcgcgaagaggtagttttgagccgattgggctggagttggactttggaccgggtcagcagcttcctccgttaagcttccggttagataacggcgttgtgatggaaattgtcggacggattgaccgtgtagatgtggcagagggagaaaaggggttacttttgcgtgtcatcgattacaaatctagccaaaaggatctcaagctgcatgaagtgtactatggcctgtccttgcaaatgctcacctacctggatgtgctgctgaatgcggcggaggaatggttgggcgagacagcttatccagcgggtaccctgtattttcacgtccacaatccgatgttgcagtcgcctaacggtcttagcgcagaacaggcccgtcaggagcttttgaaacgttttaagatgaagggattattgcttgcggatcgggatgtagttggacaaatggatacagcattggacaaaggatattcctctattttacctgttgcggtgaaagcagacggcagtttttatagcagtgcttcggttgcttcgccggaacagtgggacagcttgttagcctcggtgcgtaataatattcggacgattggcacacggatgacagagggcgatgtggccattgaaccttatcgaatccagcaagagacggcttgtaccttctgttcttttaagcctgtttgtcaatttgacgacagtctggagggcagtggctacaatcaatggggtaaacccggtaaggatcaaatctggaatctattgggtcatacacaggaagggaaaggaggaatggaccgatgataggcacgtcaaacactaaagacatgtcgaagccggaaggcagtatgtggagcgatgaccagtggcgtgccatttcggaatcgggtaacaacatgctggtcgcggcagcggcagggtcaggcaaaacagcggtgctcgtagagcgtattattcgtaaaattgtcgatccccagcttggcttcagcgtggatcggttgctggtagcaacctttacgaaggctgcagccgccgaaatgcgtcaacggatacgcgaagcgttggaacgtgtgttggaacaggaaccggaaagtgagcatgtacgccgccagctgtcgttgctgaatcgggcctcgattacaacgcttcactcattttgtatggaggtcatccgcaggcattatcaggccattcctcttgatcctggttttcggattatgaatgagcatgagacagaattgttgcgtcaggagcttctagaagaactgtttgaggagaaatatgaggctcatgatgaaggtagtacattccgcagactggtcgactggtttagtggagaacgcaccgatgatgcaatgtacgtgcttgttcagcggttgtatgatttttctcaaagtcatccttggccagaacattggctgcgggagacagcggcagcatttcgtgtacaggatgtagccgctttgggagagactccctgggttcgcagcattttggcggatgccgtactttctttgcgcggagcagcgagcttgctggaacaggcgcatgaaacagctatgcagcccggcggtcctgcaccttatgccgtaacgctgcaagaggatgcgacgatggtgaagggattgctgcaagagctggggacacagccgtgggcatctctatatgatcattttcaggcagctgccttcggtaagctcaagccggtcaaaaaagatcagactgagcctgcattgcaggaacgggttaagacgctgcgcgaagcagccaaaaaaatgattacagatatgaaggcttccctgtttggcaggagagcagaagcctattgggaggagctacacgccgcggctccgctgatggacgaattggtagaaaccgtgattgtattcggggaacgatttcagcagcacaagcagtcaaaagggttggtggatttcggggatttagaacactattgtctgaaaatattacgacatcccgattctactccgtacaagctgctaccttccgacgctgcactcgaatacaaggcgcaatttgacgaagtgctgttggatgagtatcaggatacgaataccgtacaggaagatatcgttagactggtatcacgggaggaaccgggtaaccgttttatggtgggcgatgtgaaacagagtatttatcggtttcggctggcagagccgggtctgtttttgaataagtatcaacggtacggcatgcaggagcaggaagatggctttttagttgatctggcgcgtaatttccgcagtcggcaggaagttgtcgatgcggtcaatttggtgttccgccagattatgagtgtggatgtggcggaaattgagtacgatgaacgagcctggctggtacacggcgcatcctatcccgacccctcggatcaagacactgcatctgtatacgcacctgagctgctcttagttgataagggtggacagggtctttccgaggcttcggagctgtccgaaacgggggacgaatctgctctacaggaaagtgagctggctgagcttgcggagctagaaacggcacagttagaggctcgtgcgatcgcgcaacggattaaagaactgaccggagacactggacaaccactgttgatttacgacagagggttaaaagcgatgcgcccggcagtctacggcgatatcgtcattttgcttcgttcggcaagcgtgtgggcccctctaattgtggaggaactgcggcttgagggcattccggcctccggggagcagacgacaggcttttttaaagcaacggaagtagaggtgatgttgtctctgctgcacattattgataatccgcagcaggacatcccgcttgcatccgtgcttcgttcgccgattgtcggcttgaccgaagatgaacttgcacaaattcggttggaaaagccggatggattattttatgacgcattgctggcggcggcagaagctgacccactggaagagagcgaaaaaggaatttcagctgacatcatggagttggatcttttccctaaggactctttatcttcatctgactttagtaatagaaatgacgggaatacgttatctgcccgactacgttcatttttgcgtaatttgaaagcctggcggcaggaagcccgacaaggaagcttaagtgcattgatttggaatgtgctggaggaaacaggatatctggattgggtgggtggactgcctggcggctcacagcgtcaaagcaatttgcgggcgctatatgatcgagcgagacagtatgagacttctacgtccaaccgaggattgttccgatttctgactttcatttcccgtctacgggagcgaggcggtgatttaggatccattagcggggggactgaacccgatcaggctgtccgtattatgaccattcataaaagtaaaggacttgaattccctatcgtgtttattgctgggacagcaaaaatgttcaatcagcaggacctcaatgcgccgtttcttatgcacaaggagttggggtttggtcctaaatatgtggaggaacaaaatcgtgtcagctaccctacgctgcctaatttagcgatccgccgacgctcacagctggagctattggctgaggaaatgcgggtgttatacgtggcgcttacgcgtccgcgtgaaaagctgattatgaccggaaccgtgaaggatctcgcttcgcgcgcagcgggttgggcacgtgccaaagaacatacggaaacggtcttaccagactatatgctggcggcaggccgcagctatctggactgggtaggtcctgctttgattcggcatccttctgctactttgttgagggaagcggcaggcgatcaggatgggtactatcacaggctggaacatatgccgggaacagactggttatttaaaatcgtcgcctcggaaacactttccggctctcgtgtgaactcagatcatgaggaagaggtgtcgggcgaagagcgccaaaagaagacagaagcactgagaaatgcggagctaatcgacttgaacgaagagagtgaaacggatattgaagctgctctttcctggatctatccgtatgaacgggctggcaagacggcagccaatacatcggttactgagatgaaaagatggctggaaatgcaggaaatgggttcggacgattggctgaatctatctaactctctactagcagagtcaccggaggatcgggaggattctcacactgggggaagtcaattacacttgcgcagacctaagtttatggggaatcagcgactgactccaacggaacgaggaacagtctatcatacgttgatgctgcatttgccattagatgaggggatgagcgccgaagttattgaggaaaccaaggctcgtttgctcaatcagcgtatgttactggatgttcatgcaaaggcgctagatacggataaaatattacgctttttcactagtgagctgggtagcagaatgctgagggcatcccatgttcaaagagagcttccgtttacttataccatgcgggcaaccgattactggaaccacagcttaccatcaatgtcaccaggacaagaaacagattcggaaggtggacaggacggcgataaagtgctgatgaacgggattattgactgtctatttgaaactcccgaaggactcgtgctggtagattataaaacagatcggatatctgaatatcgtacattgtcccatttaacagaccaatatcgttttcaattggagctgtatgcccgtgtgatcgaagagattacaagcaaaaaggttgctgagaagtggctgtattttttagaagctggagagagtgtacagctgtagttatatagatagggagaggaggaatagcatgcggattttgcatacgggtgattggcatttgggccgcacgttggaaggacgcagccgtttgaaggagcaggaggcgtttttggaagaattggcgaaaatggctgacgatcagcaggccgatttgattatgatggctggagacgtatacgactcagtcaatccttcggccgcagccgagcaattgttttatgaaacgtctgcccgtcttacggcgggaggaagaccactagtcgtcattgcgggcaatcatgatcagccggaaagggtatcctcggtcacaccgctggtgagcgggcgtggaattacgttgctgggactgccccatggggaagcggtacgcgttcgtacaccgcgaacgggtgaaatggcatgcattgcagccttgccatatccgtccgagtctcgtctgaacgagctattgtctgaagacggagatgaaacagtcttgcgcgaggcatacagtcgccgtgtgggcttgctgatgtcacaactgggtacagcatttcggcctgacaccgttaatttgtcgatgagccatatttatgtgctcggcgggctggagtcggattcggaacgtccgattcaggtcgggggggcgtataccgtagatccgtctgctttgagcattggggcacagtatacggctctaggacatttgcatcgtccccaatatgtgaagggagacgggctgatgcgttacagtggctcgccgctggcttatagcttttccgaagccggacaagccaaatcggttacgttaattgacgtggttgctggcaagcctgctcaggtcgaggaactgtatatcaccagtggacgcccattagtgaggtggcgcgcacggggaggtctggaggaagtatatcgctggctggacgaaggattggatgccgatgcctttattgatctggaaattacgctggatgaagcgatgtcgatgggagatattcagcggctgcgcaaaagccgtgaaggcatcattcatattcgtcccatgtatccagaaatggctgccgcacagctggagcaccaacgatcagaactgccagtgcatgagttgttccgggcattctatcaacggcagacaggcggagcacagccggatgagggattagtgcagttgtttctggaactggtggaacaggatgatgcaagagactacgctgaggaggatgacgcatgaaaccaatccttctaaaactggcggggttgcaaagctaccgggagtcgcaggaaattcgctttgacgatttgaccgaaacagggctgttcggaatttttggcccaacaggtagtggaaaatcaacgctgctggatgccattacgttggctatgtacggtaaagtggagcgggcagtgaatggtacacaaggcattatgaatcatgctgaggatacattgtctgttgcatttacgtttgaattaatgtcagctcaaggacctcgccgttaccgtgtagaacgacgtttcaaacgtgctggaggcgtatcggttaataatacgcttagccgttttattgcgttaacagaggatggcgaggaagtgcttgccgataaggtgcaggatgtgacgcgctgtgtggaggagtatatcggcctgaaaatggacgattttacacgagctgtcgtattgccgcagggaaagtttgcggaattcttgtccttaaagggcagtgaacgcagacagatgctacagcgtttgttccatctggagaagtatggagaccaacttgcacagaagctaagccgtcgtgtgaaagataacgataccgcactgaaagcgttagaggcagagcagcaagggctgggggatgccagtgctgaagcgcttgaacatgtagagttgcgtctcaaagaggcgattgccaatgcagaagcttcgcgtcgtgagctagagcgtgtctcacgtgaatgggaggcgctaaacaaaacccgtgagctggtcgtcgagctcagccaaagatcgaacgagctggagcagttggcagcacaggagctgggcattgctttgctagagcgcaagcttcgacaagcatctgcagccgaggcattgctgcctgcgctgacggactggaaggaagccattgctgaagcggaaaaacggcaaaagactgccgaagaaatggaagtcttggccactaccgcgcaggaggctgcgcttgtgtctgcgcaagcagatgagcaggcccggcaagcactcagtgccgaagaaccgaagctattgcttcggatcgaccaactagagcaggcacttcaactggagcgtgatacggaagcattgcgtattgaacgggaacgtctggcggccgagcttgtgcaaagcgaacaaacccttgctgaacatgcagaaggactcgcaaaggaacaagagctacagacgcgaggcttgaagcgacagcaggagcttcaacaagagctaaagcaaaatgaagtgcgggcagatgagcggcgtatgctgcaagaggctgtgcaacggttgcaacagctggaaatcgcgaatgagcaattgcgtgaagctgaactggagtacaccgctcaggagaaacggcttgcgcaagctgacgaacgtctaaagctgacggaccaggagacacaggagacagaggcacggcgttctgcccttgctgcacaggcagctgatggtattgaggcattgcttacgttggaggcagagatcaccgccgatatgtcgtcactggcctccgaggaagaacaactgcgccacgagctccgtgcggaggagctggggcgtctcgcacagcatctcgctgccgagttgcgcgaaggcgagccgtgcgcagtgtgcggctcgctgcatcatcccgcgcctgccgtcgttgcggcgcatagcgcggatgccgctgcgccagatgagctgcaccgcctgcggcttggtttgcaggagctgcgcctcacactgcgccagcagttgcacgagcagcgcagcttgctggcgcagcccgccaccgcagacagcggcgcggccgccacgggcgagcctttcacgcctgcggcagagccagcagagccgcgcggtattgccgcttgggtggagc

SEQ ID NO: 45 - DNA, 133201 bp, Unknown
  Kingdom: Bacteria, Phylum: Firmicutes, Class: Bacilli, Order: Bacillales, Family: Paenibacillaceae, Genus: Paenibacillus
tctgctttgcagattatctttcaatgctggcaatgctttgcggtcgattttgccattcggacttaatggcatctgctccaattgtataaagtatgatggcaccatatagcttggcagctctcggcccagttcgcttctcagctcgcttgcgccaatttcttgcccggcgacgtagtacgccaccatttgcttttgccctgtttcttctgcttgagcaatgaccgttacttcccgtacaaaatcaacttgcagcagcttcgactcaacctcactcagttcaattcgatacccgcggattttcacctgatggtcgattcggccgataaactccaggtttccatcctctttccagcgggcgaggtccccggttttgtacattcgtgttcctgttgaaaatggattatctacaaatttgtccgccgtcaattccgcgcgattccaatagccacgggccaaaccttcccctgcaatgcatagctcgcctggtacaccgatcggctgtaattcaccctttgcgttaatgacataaatttgcgtattcgcgataggacgtccaatgtcaatctgtttggcctgggtaagttcctgtactgccgaccacaccgtcgtttctgtaggtccgtacatgttataaatgcggggaccgttcaatttttgcaaggcctccagcagcttgggtggaagtgcttctccccccaccataatttcctgtacaccttggagcgcacgagagccttcctcatgacccagcagcatttgcagccgggatggcgtcatttgcagcatgtcaatgtgatgtgctgtaatcagctcgccaagtgcctgaggattgacctgatgacggtggtcaccaagtataacggtcattccgcccagcaacggcaggatcgtttccaatacgaaaatatcgaacgaaatggtggttaacgatagaatcgttttgtccgctgcaaagtcgatcacttcgcgcattcctgtaataaagttcagcaccgagcgatgctggagcataacgcccttaggatttccggttgaaccagaagtataaataacgtaagccagatgctccggctgggcagtggcttccagattggtcttttccccttgatatacttcctcatcttcgataaacagagtgttggcgctgtaatggtgttctcctaccagatcgcgactggtcagaagtacggcggcctcactgtcattcagcatatattcaatacgggctgacggatattcagggtcgatcggcacataagcaccacccgcttttaacacggccagcagaccgatgatcatctccgccgaacgctgtaccatcaggccaaccagcttgtcgggtcctacaccgtgcgcttgaagtacccgtgccagtgagttagcgcgttcattcatctctaggtatgtcaactgctccccttcgaaaaatagtgctacttgctctggtgtttgtaaaacttgagcttcgaacaaaccgtgaatcgtctgtttatttggatattctattgccatatctccacaaccaacaaggatttgcttgcactcctgttcggtcatcgctttcatttcatgcacttgaatgcccgggttaaccacaacttgttctagtaggtgcaccaagtgtccataaatttgctttatactttctcgatcaaacacaagtgcgttgtaactaaagctcattcggggttttttccctgaaaaaactaccaggttaaaatcatagttggactgttcgaccgactcaacccccgtaatgctaaagtgggactctatatcatcacctagttgcccagactgttcctccacccagtcattttcaaaaatgagtatatgattaattaaattttgcttaagttctgagagtttctgaatttcatatagtgaaaaagcatcatatttactagaagccactgattgcttctgggtttgtttcattacttcccagaacgagttgttctcactactggtaatacgtacagggagtgtattcaaaatcaagctgagcatacgctccttatttggaatatcaccctcatttccggacagcgtactaccaaacactacatcatccgtgtcgttatatttttgaagcaaaatgccccacaccgtctgaatcagcgtgctctgattcacctgatagcggttggagatttgctgaatcccgctcatcagactcggacttaaagctacgttaaaatgctccgtttgacactctgctctactctgagttttagcctgtggcaaacagcaagcttcttcatacccgtctagatatgcgctccagtaacgcgaagctttctgacgctcttgatgcactctcagcacatgcactgtttctacctctgtgatccattccagctcccccagtttaatatcaggattcaccacaatagcctcagacaatcgtataaaatgacgcgtaatctgttcaatcgttttccgctcatacaacgatgttgcatactgcaattcgaaccgaataccttcttcttcctcgctcgcttccagcattaagtcaaatttcaccggagcctgctccatgtcgtatggacggaaacggatatcctccagtttcagctcgccttcttcggtattttgcagtataaacatagtgtcgaacaacggattacggcccatatcccgtttcacatttagcttgtccaccagttcttcaaatggataatcctgatgctcgtaggcttgcaaagcttgggttttcacgtcttccacatagcttcggaacgtttgcttagcggttggataattgcgcattgccagtgtgccaacaaacatcccgatgatcggctccagatcggcatgcggccgtcccgcaatcggagtcccgacaatgatatcttcctgtccagtatactgatgcagcagtgctgtataggctgcaagtagcaccatgtacagcgttgaacctgtctgcgccgccagctctttcaagcgctcgctgacttcgcgttccagtctgaataccactgtatcgcctgccgtacttcgtactgccggacgggcaaaatcagttggcagattcagtacgggtaactcactccggaaggtatccagccaatatgcttcctgacgtttcatccaatccttttgcgcttcactttgctgccatacggcatagtctttgtattggatccgtagcggaggtaacttctcaccgctatataagcgaacaaattcgcgggtcaacacactcgtcgacacaccgtccgagataatgtggtgcatgtcgatcattagcagatgctgtgtttcttctgtcccctctccgttaagatccagtaaggctacccgtaacagtggagcagcttgcagatcgaatggatttacaaaattgctaacccatttttctatttctgtctcaaatgcaagtgcgtctgtccctgcctgtttttcctgtaccttggcgtactccacctcaaaaggtaccctttcctgaatccgctgcacaggctcattgttcaccatttcaaaactcgtgcggaaggcctcgtggcgtgagattaactgccgaaatgctgcctctacccgtcttacatccagcggtccgctcacctggagtactgcgggcatgttgtagctcacatcacccggatcaatccgatgcaatatatacattcgtttttgtgcagaagacaaggtataaaagggacgctcttccgccgctaaaatagatgcatacgccacctcgttcagattttcaatcaccactgccagctgttcaatcgtcggtgcgtaaaaaatgctacgtagaggaattggtttgttcaattctttgtaaatcctcaagaccaacgtcattgcccgtagagagtgtccgccaatttcaaagaagttttccttcacgccgacttgcatcaaacccaacacgtcctgccagattaccgatagtttcgcttccaaccacgtccgtggggcaatatattctgtccctctttgtatattaccttccggtgctggcagcgccttccgatcgatttttccattcggagtcaacggtatacgatccagaaacacaaagtaagacggtaccgagtaatacggaagcaacttggcggcatgctcatgaattacggttaagcttggtgtttcttctgtatgcagtacaatgtaggcacacaagacggattcatgatctttgctttgatttacagtgacgacagcctctcgaattgcagaatggctaatcaaagcattttcaacctcacccagctcaatccggaatccacgtactttcacctgatggtcgattcggccgataaactccagatttccatccgctttccagcgggcgagatcgcccgttctgtacattcgtgttcctgttgaaaatggattatctacaaatttgtccgccgtcagttccgcgcgattccaatagccacgagccaatccttcccctgcaatgcatagctcaccagggattccaattggctgtaatgcaccctgtccatcaaggatatacatttgcgtattggcaacgggggacccgatatcaatatgtttagcacctgtcagttccctagctgatgaaaatacagttgattccgaaggtccgtacatattgtagatacgcagccctttaatttgttgcaatttcttcagtaacgtaggcgcaagcgcctcgcccccaagaataatctcctttataccttgtagtgcgtgcattcccgattcactgctgagtaacattttaaggcgagagggtgtcatttgtagcaaatctatatgctgagcaacaattaattccccaagtgtctgtggatcaacttgatgatggcgatcacccagtacaaaggtcattccgtttagcagcggcaatatcgtctcaaccacaaaaatatcgaaagaaatagtagtcagcgacagaatccttttgtcaggcttaaaatcaatcaattcatgcattgctgtgataaagttcataacggaactatgctgaagcatgaccccttttggatgcccggtcgaccctgaagtataaataacataagctaggttctctgattgaacattcgcttccaggttcgacttctctctctgatataattcctcatcttctaaaaaaagcatttttgttttgtagctattctcttctaccagtttacgatgggtcaaaactacagtcgcctcgctgtcttcaaacatgtatctaatacgggctggtggaaattcaggatcaatcggcacatagcaaccgcctgctttcagtatagctatcataccaacgatcagttctgtcgaacgttgcaacatcagacctacgggcttgtcaggaccaacgccattttcacgaagcactcgtgccagtgaattagcccgctcattcagttctaggtaagtcaagctctgatccctaaatacaaatgctatgttctccggggtcattgcaacctgcttttcaaatcgtccgtggatcgtctcatctgtcggaaaaggtacgacggtatcgttaaatccggtcagcagcaattgcttctcttcatcagatacgatcgtaatatcagccaactgcaccccgacatcctgcgtcactgtttccaaaattcgcacaaaatgctctgccagccgtcggatggtctccagtttaaacagcttcgtgccatactccaaagtgaaggacaaacgtcctttttcttcagtcacatgcaatgaaaaatccaccttggatatgcccgcgttgaattcttccggtttaaaacgaatccctcctgtttccaaaacatctgtgccgacattttgcagactgaacatcgtatcgaacaccgggtttcgacttacgtcccgtaccagttccagcttgtctacaagctcatcaaacgggtattcctgatgctccagtgccagcagcgaattttgcttaacctcctgcaaaaaggattggaacgttaaagaagattgcggatgattgcgaagaaccagcgtattgacaaacatgccaatcatcgcttgagtatccacatgccgtcttccggcaacaggtgtacccacgataatatcctcttgactagaatatttgcccagcaggacattataagctgccaaaagtaccataaagatcgtagattcggtatcttgggccaatttgtagagtgtgttagtaagtttggattccaatgtaacggtcaagctgtcaccttcaaaactttgtgcttgcggacgtgaaaagtccgtaggcatattcagtacaggaagctcgccattcaaggtctggagccaatatgattcatgcgcttgccatgcgtcgtcattgatctgctgcttctgccaagcaacaaagtccttgtaatgaagctgaatgttcgcaagctgtctgccctgataccgttgaatgatttcatccagcagcacggccatggagaaaccatcggacacaatatgatgcatatccactagcagtatgaagccaccttcgataaattcgtacagttcggcacggaataaaggagctgttcccagatgaaaaggctgaacaaacaaggcccgagcctgttttgcttcttctttggaaatacgggtataggggatgtcgaatggaatcgtgtcccgaactttttgtactacttccccgtcttccagatcgaaatacgtccgaaaggattcatgtcgtaaaataacttccttaacggcttcaacaaagcgggggacctccagatttccctctatgaaaagctgaccgggtatatgataggccgttccgcctcccatttgatccagcacgtacattctcttttgggaagaagacaccggataaaaggcctgcgattttacagatacaatcggttcataggtctgctttgttccacccgcaatatatgtagccagctcagcaatcgtttgcagctcaaaaatgtggctgagtggaatgtgtacacccaattccttgttgactctcgacagaatgaccgtcgcttttagcgaatcaccgcccagttgaaaaaagttatcgtcatagctgatatccgttacattcagaacgttcatccaaatgttcacgagctgatcttctacgccgtggttctcagaagcgacgtctgttttagcgaatacacttgctcgttctggcgctggtagagcctgtagatcaggctgaccatccggcagaagaggaatatgatccataggaatccaaaaacggggctgcgtataatctggaagaatttcgattgcagccttttttagtgcgttttcttcccaaggcttcgatgcgtttgcgaccacataggcggttatatatgagacttttccagcttcgtccgtttgtggtgtaatgacgcaggactccaattttaatatttgcagcaggtgtttctccaactgctccagattaacctgatgtccgcgaatgtggatagtccgattcaaattgccaatatgctgcagcttgccatcgttttccacgtaagcccattcccgggtcgttcccaacaggcctgctactgaggcttgatacacctcccctgctgtcccgacaggtgccaaatgcttgtaggcatcgagaacgcaaagatagtttccgttggcatcggtatttgctgcccatgcagctcgaagttgttcgttctctgacgcacgaagtaaagacatcgcggaaacgcgagccccttcttcctctacaatggaatgcagcagattcaggaaataccctgaccaagcttcgatgatgttttgctgaaaaagatccgaattgtagtcaaaatcaagacgtaattgcttctgtgcctctgtcacgttcaaaaacaactcatatttgctgaatgatacctcattctcaatgagttctgcttccattccatggaattgaaaacgcggaatcggtcgatccatattgaatacagcgttaatgacaggcaaattctttagccccagctgagcgagtccggcaaagctgtacttttggaagctgtccagttcattcatgcgctttttgaccgtttgggcatgctctgtaaaagtagcatcaggacgcacttcgctgatcactggcagtaagttgacacagttgccgatcagggagaaggcgtccatatgggattgtcctgcagtaggaacccccaccgttacttcctgctgccctgtcaggcgatgcagaaaaatctgaaaggcggatagcagtgttataaaaagactggtgccaagctttatgctggcggatctcaattgtttaacgagcggcgcttcgagcattacagtatgtctgcttccgctagaagacggaatctgtattcccctcaccggagatggtagattgaggacaggcggatgattttccagcactgctgaccaaaaagtaaggggcccttctttcccggctttcaattgatcctgctgccaaacaacgtaattccgaaaaggtactggatcgggaaggttgtagtcagcatttcggacaagcgcagaatagatgtgttccagttcctgaatgaatacaccaatcgaccagccatccgcgataaaatgatggaacgtaaagacactcagatgctcctcatctgatattttcagcagatggattcggaataacggatctcctggcgtcatggcaaacggggtttcgctgtcctggatcatccatgcccggatatgttgttcctgttcatttgggtggtgactggtaaaatcatgaagcggaacttccactttcatcacaggagcgatcacctgagtttccccatcaccactcataaaggtatgtaaggcttcatgccggtttacgatggtctggacagcccggttgaactcctcctgctgaagtggaccacgaaaccgcaacaaggcggtttcgtgtaaagattgagagtcacttcgttctgaaacagaggcgaaccaaagctgcttttgatcaggagtcagcgcaattacggtttctggaacactcactgcttcagcttctggaggtacagttacaggtacagtttgcttgcccggccctgggccgtttccattcgggggcggggccggtaaaaatccccctttacgcagctcgttcacgctatccttgaccgcttgtacgattcgcgcaatatcttcctcggtatgggccgtggacaagaagcagtttcgtccctcccagatatagatgcctttgtccagcatgtgataaaagaacagctccagatcgcctttgagcacgaagcggaatagggagccaaagtgaacgaccttcataggtacgcgttcgtcagtgaaatagctgttcagctccgcagctaacgccgaggtgcggctgttcaagcgattttgcagttgctcgccatgtttctccaaatgatccagcaccgctaaggatgcagccattgccagcggatgatggcagaaggttcctgccacaaaggttcgctgctgctcatgctgcggataggaatcgtccccaaagctccacgtgcctccgtcgatcccgttcataaaggcggcttttccggctacgatgccgatgggcagtccgccgccaatgattttaccgtaggtcacgaggtcggcttgcaccccaaaccacgcttgggcccctccgggctgaatccggaagcctgtgatgacttcatcaaaaatgaaggcagtacccgactgctccgttatctggcgaatttcctgcaaaaaggctttaggctgaaaatctggacggcggctttgcaccggctccacgacaaccgcggccagctcatgcgcatgggtgcggatataatccagcgattcgtccgctccataatgaagcacgacgatatcgtcgaccatatgctgcaagatacctggagcgagaggcgtcgaatgctccttgtcatcacccgcgctccccagtgccagcaccccgtcgaatgtaccgtgatacgagccagcaaaaaggacgactttagctcgtccagtggcagcacgtgccaaacggagcgcgaccatgacggcctccgtgccggaattatacagggcaatccgttccacaccggtcatcttgcatattcgctcggcgacttgcccagccatgttggacatggggccgatacacatgccgttcttcagctcttcctcaattttttcacgaataaaggctggattgtgtccgaacagattcacaccaaaacccatcgtcaagtcgacatattcattgccgtccagatcccaaatttttgaaccatcggcgcgttgggatacaatttgatacaccatttccttcaaaacaggccggaaaccagccacattgcggttattggcgtatacggagcgatactgctgggtgtactgtttggtgctacgcgtacgggtcgtgtagcgctcaatcagctcttgcaggtgttgttcctgacggagcgaaagcaattcacgtgctttaacatccagctttttataaggcgtatacggcttggcttcattgcctgtctgcttgaaaacagcctttacggatgaagctggtgctaatgcagccgcgactttctgcttggattcggtacggatgatatgcggactttcactacttgccgatagcaaaacgctcgtttccgggttaaatggctcggaagctattacggatgcagatggctgatgccggagaacatcgagctgctgtgacatcagatgtagctgttgctccaaaattcgctctacagccgcaggagctgtagcgattggaaagctttgagctcgtgtttgcccagccgtgtctatggcataaacggatgccgcagccggaacagcggattcatgagacggttgggttagcgggaaagctgcctgattcagagttgtttctggacgattttccacagattgaaccggggtttcagcagaagtgaaaatgctcacccgctcggctacgtagcttgccaacagctccagcgtggtcaacgattcgaaaaattcgttcattggaatgtccagtccgaaggtatccttgatactgtggcgaacctgggacaaattaatggaatccagcccaagctccagaaaatgtgtttgtggctccagttcctccaggctgagttgggacacgttaccgatcattttcgctaacttttgaagaatagatgatttgtgctggtcggtagcagatgctggcgctaaatactcgttccccataattccagactcctttattgttgagttttcatgaactggtaccttctgttccgttcgaacctgttcgggtacgttaatccagcatcttttccgttcgaatggatacgtaggcagagaaacctttttatagtgcttacctgcatagagggcattccaatcgatctgcgctccttgcacatacttggcagccagttgctccagtgattgcaacgtgtccaagcttccagtgaccgtctctgtgccaccagcgctatccgctttcccggtgtatacaccatcgacggctctgccttgttcgtgcaactgaagcacctttgctttcagcgcatctgctcctgccgcagtcaccgcaatccggtgattcaggtggcttcttcccgtgttagccgtatagcatacatccttcatcacgagttcttccgcccgtctaaaccgttctgcgtaccgcccgaccagctcgcgtaaagcggattcactccgcgctgacagggtcagcagcagcggtgatgatccattattgctgcccgtggaggatttatccgattccgtctttgcaatatattcctccagtaccacatggcagtttgtcccgctgaatccaaaggaactcagcccgcttcttctcgggaagccgttcgtcttccattccctcagcttcatattggcatataccggagattcctcgaaatggatcttcttgtttggcgtgcgaaaatgaacgagcggcgcaatctgttgatgcttcatggacagtacggatttgatcaagcccgcaattccggcggcttcgtataaatgaccgatattcgttttgaccgtgctgattaccacaaactgcttacgctgtgtatacttgcggaaagccttggtaatgccgtcaatctcaaccggatcgcccagcttggttccggtgccatgtgcttcgatataacttatcgtttcaggatcaatccgtgcatcgcgccacgcctgcgaaatcacttctgcctgagccagcgcattcggcgcggaaataccaatcgtgctgccgtcctgattgatagcacttcccttgatcacggctaaaatgttgtcaccgtcttgttccgctttgcgcagcggcttcagtaaaacggctccaactccctcaccccagcctgttccgtccgactggtcgtcgaaggcgcgtgctcgatcatcggaggattccatgccaatgcccgctttcagcggcagcaaaatggtcttcactccacctgccaaggccatgtcgcagtctccgctaaggatggatttgcaggccaaatgcactgccacgagtgatgaagagcatgctgtatcaattgttagcgccggaccttttagatcgagcaaataggcaatcctgctggaaataatggatgataaattaccaatggcaaagttcggcagcgcgcctggttccacctcggacaacaaacgctcgtattcgaagctggttttggagaagccaacatacacgccgaccttttggcctgccagttgcttccccccataccctgcatcctcaatcgtgctccaggctgtttggagaaataaccgttgattcgggtccatgagtgaggcttcccgtggagtcagcttaaagaaggagtaatcgaacttgtctacttcatccagatagccgccttctgcaatttgcatattccgtcctttcgtattcagacgggaaatgaaatcttcggcatcttttcttctttcatcgctgtacgggccgatattgtcagcccctgatgccacattcgcccaaaactgctccaatgtttccgcttgaggaaacttgcctgacatgccgatgatggcgatatcccggacatttgcttcctccttggcctcggactgtgctgttgcagccggatccctgctcatgccctgactagagatatatgcagcaagcttggcgatggtcggataggaaaagaagtccgtcacctcaatatgaatccctaattgatcctccaacacgtccacaatttgaacgagctgcaaggaggtcactccgatatcaaagtaactatcgtccgtcccgatcgattttacatttaaaatatcctggcagattccaatcagcttctgttctatctctccttgaggcaagactgcacgctcagctgcttgcacggtttgagtggcctcagccagtgctgtcaatatctcattaaattcgccctgctcataactctgggctaatttgaagcgctgaacctttccactggttgttttaggaatacgccgtatcggaactatatcctgaatatgccagcctccccggtaattcagatggcttttcagcttttggacaagcggtacaaaatgctctatctttttcgtgtgcatcacaaaggcaacaatacgatcctgcctggtctgcgcatcatgtacaccgcacacagctactttcccgagatccacgccatccagttcctcggcaatcctctcgatgtcatgcgggtagacattctgtccgtttacgaaaatgatatccttggctctaccggtaatagtcaggcggccgttccgcataaaccctaaatcgccggtgataagccagccatcctctgttttgaccttcgaagtagcctctggattgttgtaatatccagcggtcacatttttgccacggatttgcgtgtgtccaatcacaccatcttccagcacccgattttgttcatcgcaaatgcggacagagatgctggccatcggataccccaaatccacaaaagtaagacaccgcttgtcggacttgtccacttcttctatgggttcacccacgtgtaactgctgccggttcaaatgaatgggtataaaggtacttttgtccagaggtggagaggaaactcccacactcgcctctgccaatccgtagacaggcaacattgcatttttattcaaaccgtgaacactcatcgcatccataaacacatggcaaagctctacagatatcggctcagccccatttaaaatcatacgcacgcttgacaaatcccagttatccgctgtttcaggtttgtactgatcgagaaaaaatttatatccgaaattgggagagcatatttgagtcaccttgtgctccgatactttttttagccataaagacgggcgtcggataaaaagtgccgtcggcataatcagctgcttggcattagcgaccacacaggttaaatgaaaggcgatcaatcccaggtcatgcgtaagcggcatccaacccaaataagcatccttggagctcatgcctgtttgatttgcgatatcccgaatattgtaaaccagattttcatgtgtcaacatgactcctttaggatcacctgtagagcctgaggaaaattggataaaagccaaatcctccggtttggatgcatgaactgcccctttaccctcaatggaatagtcgaatgtatggcttgaaaaagttgcttttttaacaggctcaaaggaatccagcaatccgtgctggtgcgagtacttttccagttgttccattaccttatcatccgcaatcatataagggcgggatagggtattccagattttaaacagtttcattttatgttcatcattattcccgatgcttacaggaacaggaacgattccaccgagcaggcagccccaaaatacattcacaaaggtatgattgtcgtcgatctgcatgatcagctcatcgccaggttgtatccctttttcctgtaatgcatgaagcacctgtgatgcttgctccagaagtttactgtaggacacatattcctcttgcttatcaccggaaataaaggtgatcccgttctcatcccggcttgcacggtcttgaatgatttcaactaaagtttgaaactgttccatcctgatccccccttaattgctctagcattactttctgctctccttcggagacctgtttggtttgcaacaccaaggaaatacaccccagtatttcctgtctttgctcagaagcaggtgttggactactgcctgattctgagtttcgcaataattcttccagtcttcggataggtgaaataacaccctttaggtactcatcttcattccaattggcattaggggtagacacagccagtgaaagggaacgggcaacccaatcacggatcgagaaacggcgttccagttcaacgcgatccaattctctgtccagagacagcacttcgatggtagtgtttatttccttcgccaaatttttcaacaccgttcgtgggcctaactcgatgccttgtttcacgccatgattcgccatatactgcatggtttgaatccatcgaaccgggtgagtcatttgcaaaatcaatccttgacgaatgctgtctacatcagggtatggcagagcggtcacattggagatcacgggccactgcgcttcatggaaagtgtatttttgcagctcgatggtcagcctgtccgcagcatgttgcataagcgggctatgaaaaggaccactaacctgtaagcgagtaatttgggccccccgctgttctaacttgccagctaccatagctaccgatgtatgatgaccagagacgacatattgactaggcgaattgtaacaagcaatgacagcaggctgatcgattgtggagtgcagacgacagaattcttccacggcgttcaactcagctccgcgaatggcaatcatgctgcccagaccggcctctgcggctgcttccatgaagcctccccgctcttgtaccagtcgtaaagcgtcgccaaaggatagaacaccgctacttaccagtgctgaatattcacccaggctatgacctgctgaaaattcgggaataattccgattttgtgcatataacgacggaatgcaatgacgctgatcgtaaaaagtgcgggctgagtatagaatgtcctggataattgggtgatcggacctgccatgcataatgctttcaggtcatatcccaaaatatcagtagcctcttcaaacaaacgatccgcttcagtaaaatcgctatgccatgcgggtcccatccctacatactgagatccttgtcccggaaaaaccaaagccatgcgattcataccaaacccctttcttccccacaaagatgtggcaaaaagtaacaatatggatttccaaaaaaagtaaatatatattgtaaaagtgaattggttatggagtttccattcgtggtgtaactgagatcaaaagatgatgtgtgagtaaacttggaagtgtaaaaaactttggagtatactggaatttcaggcttggaacccaaaattcagcatcatagatgaatgtgatgtgaaagtgctgaggtcatacaaaatgttattccataagtaagaattaaatgtgaaatattttacttatataataaatatggactagaaaaatgtcaatatttttttgaattcctttaataagaaaaaaatgtgatatatgattttttatgttattataaacacaaaataaattaaagtatgacgttataatgtataaatatattatacacacaaacaatacccttttttgtctaaaaatcaggcattgtttgtaaatttttaatgatttttgtaaaaatttctgtgtcgtaagtgcaagaaacgcataatgtgttatatctggtgcttgacaaaccaattagtaatacgttgcagtcgttccacgcgaagctgcgggtgcccttttcgtgaaagctcgtgacttgaagctggaaaacggacaaattgcgtaggtttccccgagcgacgtaatgctgtaaacagctgctctccctgctcaattgggcaacgcagatcctgctccccgtgcaatatgagcagcggtgtattgatttgctgcacataagccagcggagattgtctccacaggagttcgaaatcttcccacggattcccgccaacttcgtcttctgtaaacgagtaccctatgtcactcaccccatacatcgatagccagttggatatggaacgctgggttacagctgcgcggaaacgatcggtatggccgacaatccagtttgtcataaatccaccatagctgccccctgttacgcccagcctttctggatgaatgaatggaaattgaagtatagcctcgtccactgcgctcagcagatcggtgtaatcgcgcccgccataatctccaaggacgacattggtaaaagactgtccgtaccctcggcttcctcccggattcgtgtagatgactgtatatccctgagcggccagcaactgaaattcatgaaaaaaagaattggaatacatggcatgaggaccaccgtgaatttccaatatggcaggataagatacgccctccttaaatccaacaggtttcatcacccatccctgcacccgtcgtccatcctcaacctcagtccagaagctctcaggcacactgatctcaatctcatcaagcagagggtcattcactctggtcagccgttcctcaattcctgaatggatcgcaattcggaacaaatcgcctggtaaagccacttcagtggaagcggcaatgatatgctgctcatccgaagtaagctcgaattggtaaatttcccgttctccttgcgttaaaattttaaaagttccatcatgcgcaaactgatatacgtgtacattcccttcaagagttactagcgtatacagggattgaccatccgcactgaagcgtggtggtcctatatggagatgtgaacgcatgtcgctcataccggcattaccgatgtgagcgtccagcgtctcactaacacatactaccgtcccgccactggagggaaccgtatacagtcgagtctgagtagcgcctttggcatgtcgatcatgaccgtaaaaggcaatcgttgaaccgtcgggagaataagcagcactctcgatgtgcagttcagaatgggtcagcttaagcggtgctgctgcatcaccatttgaaatcacaggaactatcgtaaacaaatcattttgcttacgtaaatccgtatcctctttcgaatgctctgctattctggcgacgaataaaatacgttgaccatccggtgaccacacaggctccgccacatcataagcgccggaagtcagttgaactgtgttccccgaagtcacattagttacatacaggtgatcacgagtatcatcccacagtccatatccgtcggatttagctttcgttcgattaacgactcgtcccttaagttgtgcctcctgagttcctccatcggatgtagggcttgacgggttctcggccgttttagctacaaacgatatgcaggtcccctcaggagaccaggctaatgaacgaacgttgttctctacgtgtgtaagctgtcgtgcctcccccccgcgttctggaataatccatacctggcgcttgccgtctgtcgtacgaagaaaagctagttgtgatccgtctggtgaccagacaggcgtttcatctttcggtccgtatgtaaagggtatcgggacagcgacttcggacgataatagccaaattcctgagttataatcggtccgatctttattaatatgctgctctacgtaagcgatttcaccgctgacaggatgaatagctggatcgctaacccaatgaaggtgatataaatcctcagcggttatacagcgcttggtcgtgctagattgcgagtcgctcaaaaaaacccctccttatatcgtcagatttctacatctcagattttaattaatccgattaattttatatgattttaataaatatacatttacgttactctttttatttatctctgtcaatttgtctagaactaaaaaaaactctctcagtcgctattgacccgaaaacaccgttacttcggttgctttcaagagagagggtagcattttcatcaatcataactgaaaaataggagaaatggagaagcctcattaggagtagcagccagtgatccattttctttgtgtagattcggcacctgctgccaaatagtgctgggaatctctcgcgcagtatagagatgatatcctcagcaaaccgatgcagctgttcaagttgctcctgctctcccagcccatccacgcaaagaattagaagaaaataacggctctccatattgtgccgccagctccgttgataatgtgctggcggcacttccatgccatatcggaatttgctgttgatacgggcgtgactgggtcgtgacctgatacagcggggaccgatagttgccctcccacgtaacttcttcctcgctccagagccgcttgagcagacgatagcgttctgctagcgactctcactgctcttcctccgtaattccgaacaacggataatgacgtgggtcattgccttttccgataatcagttctaatcttccacccgataaatgatccagtgtcgcataattctcagctacgcgtaccgggtcaagaatactaaggcaccgttaccatcgtcagcagacgaatccgttcagttctcgctgctatagcggtcagaacgagtggaggtgaagacgacaaaaaaggcgtaccatgccgctcccccacaccatacgcatcaaaaccaagctcctctgcgagcacagcctgctttattattttgctgcgaactccaggcttctccggtaatcgcattaggcagattagccattaggctgaacaatacaaacttcattcgttccctatgatcgcgtctaatttcgattagctgtctcggcttcatttttttcacgaatgtaggtggagaataattcaggattcaccactttacgcagtaaatgcatcgtcccgtcccctgttccatggtcaaaagcatggatacgttcatatccccaacgctcgtacatggatagcaaatagggatgcttttccgcagtcgccagtgtcacagcaggagcaccgaccttgtcacgaataatcgtttgctctacccaattcagcagttttttcccatatcctttgccctgggcagccgggtctacagcaaaccacatcacaaacggtagatcggttataaaattaagggctctatttttgagatgactaacggtagcctgaatgacaccatctacttccagcacgtagcaatcattatttttaatgttttcttgaatgagagcaacgtctgcctgagcggcaggccatcgaagctccaactgccgaattgtttcatacgcctcatacgtcacatactgcaatctttctgcgtcctcctggagtgccagacgatagatttcactcatactaacccgcctccttataatgtttttataaaacgagtgaaccactatataactattcccatctatttaataagatataaaagttaacataactgtagcatgctcaccattcagcgacaaattaattttttctataactccatttaaaatagcaatagcccctcgaaagatgggaattcgttcattaaagtcaacgcaaaaaagcccgaaaatcgggctcctctactttctagacgaaaaaatgctggtcttagctccggcattcaaaacaagccatgtatgctgtactactccgcaggggcagtaaagctgcgtttggcaaactcgctgtccagcatataaaaggcgttgctgtctctttcaatgcgcttaagcttctggataacactgtcgaacagagcttcctcttcgacttgctcatcaataaaccatttcaggaaatggatcgttgcatgctcgcgtccatcgagggccaagtcagccagatgataaaatttttgcgtgttttgctgctcatgcttgtagccatgctcaaatacgtccagcatggaatcgtagctatttttcggctccggcaatgcagccaatgtggcgcgtcctctacggtcattaatgtatttatacagtttcatcgcatgaaaccgttcctcctcagcttgtaccaggaagaagtttgcaaacccatccagactttcactggagcaataagcagccatcgccagatatacgtgagcggagtaaaattcaaagttcatttgctcattcagagcctgtgccaaattgtcattcatgtctcaggtcacctcggtcatgtatgtagtgatgtaacgatcatagtgtaccacgaatccgatcacaaaaaaatggacggaagtgaattcagtgctctcacgttccgcccgcattttccacaatcagttcacaatcaaggctccagaccccagacacgtttgtcgtttatatacaaaggtgctttgtcccaatccatataagatgtcttggttggatcataggaaaaatcatcactttcgttatagttactccagtccgtcttgttcatgcgaatttgaatatctcctgtattttcccctgctgccagacttcccgcaccagctccaaaggagatttccagataataatctgcgcctgtaacggccttatccagtttcacaaaacgtccctgaacgttactactgcccaactgtgcatagtcacaatggaattcctgtggcttgtcgccatctacggtgtagtagtatcgcagcttgacatttttcagatcaactgcctctttacccttgtttactacacggaacagtggccgaatctggttatctcccgggttggtgtcgcccacgcgatattgtgcaatcacatctcccgttgctggaatgggtgctgccgtaggcttggcactgacctcggcagaatctgggctggttcctaaagaatttgttgcatttgccacataataataagtggtttcattcaccactcctgtatccttgtaagtgctgtctgttacggttgctactgtggtataagggccaccactggttgtcgagcgcttgaccgtatagctatcggcacccgtcgctttgctccaggtcagtgtaacctgagcgtcccctgcatttgccttcacatttgccggagctttgggagctgtcggctcggttggtccactaccgttaatgagacggtcatactcggcataagccgttgccatatccacttgggaccagaaacgatgatacgtaaattctggagcacctttatcccattttttggtctgattgttccaagaagtcgtgtatttatctttgagataagaccattgcggatctttagtgatattaggccggatgtcactatagctggaatacgtaccattgccgcctttggacggatcagaagccgtagcgtcggtgccagggatcgtgttgccttgtccagtcttaccactccagccgctcggaatatacacttctttcgtgaaatagcgataataatcctcgcgcgcttccttcgttgtaatgcctataccatcgttataaccccatgcagcatcaagcaaagctttagacagatccttagcttccttgcctaactcggaatagtctcctttttcagctttcgttccagcagcaaaaaaagtaagtgctttaacatagctgcccagcactccggcatcctgccctggattctttgttatcacatggagattggtattccctttatgattggcaaatccgctccaggtttcaggctttccgctccattccagattgctcggcagccagaattcccctttagctgctgtagtagccactttcggattcttgccacccagaatacgcttaccttgagcgtccaaatagtatccctgtgcatcagtcacaggccgttcgttggcaaatacatagctcttggaccacgctatccagttttccgtcacttgtttagccattttaaactgctcggacgaagtatcccctttcttggctaaaatgtagtacagctcggcaacccgctcgacaggccaagcctgcatcccgaaccagttgttcgacggtggatcgttatatacaggagcccctgtataagccatgccataaaaggtacttgtgccagatggataagccttgtaggcaccatcccagctattcgtcgctccgcctgcaatggccccctcatcggattgcagccaagtataaaactccagttggcgcttcagcgaggttgcccagtcctgtcccgccgttggtgaattcggtattaatccaccatcttgatccgacaacgcatacgctgcgacgacattttggtagccctgatgcgcatggctggcaccaatacgccaagcccagttgccgctttgaccaagtccgccgccccaagccgtataccatgccatcagataaagactggcatccttccccgtaccagcaataggacttccattggaagcgcttccggttttctggaagtatttatcgtacatgccgtaccgcaaaaagtctcccatctttttggctttatccaaatatacggagttgtcatatcccaattccttagcccagtacatcgcttgaactgcccgtgcatccgcatcggtggcattcgtgtagcgccattgctgtgccggggcattattttccttagtgaacaggctcataaagccttcattaggcttgccaaacttatgattatcttgtgatggatgcggtacagcctcccagactgattcctgttccccacgctggaaggtgtttacataggcagctgtatgcgacggattcagaagattgccgaagccgtaccaattatccacatccaacaaccagtgcatcagataagtctggttgttgccataggttgccttcagctcagagtccagtggatccttgccagcaccatactgaccactcagacggcttgggtactgatccggctgcgaatattctgcggcataagtggcggggctgttcggattatagttactcattgtcggttgctcttccttaccgtccccttcattaacaggaatgatatatttctccatgttgtcccatgcggattccaaatgcccccaatccccggtataatgaccatacagcacttccagccacatccagtagctgtacgcttccgaagtcgttaagtgtccgtaatccggagcctcgctcatgagcgtttcaacggaatgataagggatgccttcttttgaaaagtatccgctagccgggtccttcagctgtttatataattgtagaaaacgtgtcgattccggtgttgcggctgatgcacggtcgggtcctgcctgaaataagcccaaggttaacggaagtaccaaaatggctgacatgaccacagagacagatttcctgaacacggattttctgctgatcacttttgcattcatcctctccattatcaattttggctttacacaagattttattccgaaaaacgacagcacaaaaagacagcatcatcacctcactttcccgtaaaaaaggtggaggacacgctgtctattgctccaaatgcttcgcattggccctggaaaaaatatatcatactaggagccaaatgagagtcgaaaaattctataagtttagagattcacaaggaaaattgacgaaatcgattggaatcggtactatttcacagggaggcgttaaaacatgaaaattttgctattgcttggttgtatcgtgatgtttttagccgtagctctgggagcgttcggcgcgcatgcattgaaaaaaagactttccgcagacatgctcagtatattccagacaggaattcaatatcaaatcgctcatggactgggtttgctactgcttggagttcttgctgacagccttgtccattcttctctcatcgtaaccgcaggttgggttatgctggtgggtattctcctgttttccggcagcctgtacgcccttagtatatccggtgtgagaaagcttggagcaatcactccccttggcggggtggcttttttggcaagctgggtcattgtgatcgtggcggttgtgcaaggttaaagaaggataaaggaacggagacttggaaaaggaggcgcttccaagtctctcaattactaacgcagcattcctgattatatgaaagaatgcactatctcgtctgcacttgttgcgctttctgagcggctatccgatgaccttcgatataccgtctggattcagccatctcatgctcctgagcagcttccataataatatgaacccccggcttgtactgctccagtagttccatgtagaggccatagttcatgtctccaaaacccggcggcaccgtctcaatttcacctgacgatgacaaccgccggtctttggcatgcgctgcgataatccgggggcccagcagttggaaagcttcgcggatgatctcatcctgttgcgccagattttccgttttcagcagattacccggatcaatcacaacaccgatgtgtgaagaaggtacttcctccagaaaggtagccaactctacggcggttccgaccaaatgatcgtttgcagcttccaatcctacgaatacgccccacttctccgcttcatctgctaattcacgcactacttcccttacaactctccagtcacgttccgtataggcggtaccgtcctcattacgtccgacttcagctgcaaccattggtgctcctaacagacccgcatatcggatcagctctttgaagcgctctacattttcacgcagcaattcctcatcctgtataaaaaaatgtaaatagcacccgagcaccgatatggatacaccatgcttacgaaattcttctgcgatagacagtgccaatcccggattgaacttacccggtttattaaaatccacatcactgatcgctctccacggagccagctgaacatgagtaaagcccgctgcgcctacctttgcagccaattcacgataaggcaacttgccaaacaaatgtgccaatacacctactgtcactaaaaatcacctcttatttttattgttgtatgctacttgttaccgaactctgctccaaggtctcattgatgatgtgcgtaatccgttccacttcatcatgaataaaaaagtgtcctccctcaaaggtaaacatacgaaattgctgatccgtatggtgtgcccatgcctccgcatcttgtaaggtcaccgtgttatcggtcattcccgtcaaagcggtgataggacaatgtaaaggtacggctttagccatgtacttgtacaactcgacagctttgaaatctgctcttaacactggcataaaatagtcgtataattcccgattgtcaaaaatcgcttccgaaagctgaccgtaccgctgcaaatgcgtcctgaactgatctgcgggcagatcgtgtaaccacggggaatttcttgggacatgcggtgcccgtccacctgaaacgaacagatgagcaggctttccatatccaccggccaccagcttgtagtacagctcgaatgagatcatcgtccccatactgtgtccgtatatggcataaggatcgcccggggctatctcttcgctgatcttgtgcaacagatcctcgctcatctcctcaatgctttcctttaacgcttccccagaacgaatacctctgcccgctaattccagtggaacaagcttgatctgcggaagcagcaactttttccatttgaagctgaccgacgccgatccgcctgcatacgggatgaaaaataatgtgataggtgccattcttgcaacctcctgccttgctaagttctaacttttttattttagcataaaaaggtatatttacccatttcaaatattttgcaaattccagaagaatggtttagaaaatcaagcacatttgtataaggcaggaaatgtctttctaaagaaagaacggctttatgtttgaatataatcatgtgttgggtcttttgacgggtacagcggcatggaactttatagctattactcaatccattctcggtattcagcccgaatgggatggtctgcgtattgatccgtgcattcctacagcctgggacgaattcacagtcacccgtgtcttccgcggtgatacctacgtgattcatatcacgaatccacaacatgtctccaagggtgtagttacagttaccttagatggcaccgtcctacgaataatatcctgccggttgaaggggacggggctatccaccaagtaaaagtgttgctaggctaacaagttcatggccttcaaaaaaattagcttcaacttcatcacatagtatcttataatacgagaatggctaaagatacattaagtgtggtgacatcatgaacaagacaaaacggcttactcaaaccatggattacaaaacaaagcaagcccgctgggtacgcaaaatgttattactgtattggatgattatagctgtacattttatcgtccagctgggcagctacttatttcttgattaccacgcttcgccttatgaattttacgtcggaacccttattgttcccacgctaatcatgagtggttccaacttactggcagagttggctcattttaaatttaacaggtattcttttgcgatcctgtttatggcaagcaccgtcatttgctggatgattattcgcctaaattatgatattcggattattcctgcgctatgtttgttgcctattttctcttctattctgttcttcaatcgtcgcttaatatggctttcctttgtattgcaagtggtcgtcttttttctgttgctggcagcagatggatcattccgcagctatttgtcagactttgatatcgtggcgattccaacctttttaattatgtccacctttattgctctcattattcaggccagcggccgcgatttgttagtggatttgtataaaacaaagcgcgcccaacaggaattaatgatcagtaacgcgattatcagcaaaatgtcaatgactgatggtttgacaaagctgtacaatcatttgtcctttcaaaacttttatgaaaaagcactcgaatatgccgaacaaggcgcgatcatccatctggcgttagtggatattgataatttcaagaagatcaatgacacttacggacaccagttcggagataaaattttggaaggcatctcgcaaatcattacagaacagattaccgcaaatgacattgcagctcgctatggcggtgaggaatttgctattttgatgttcgagcatactttcgaagaagcttatcagatcgtcgaaaacatccggcgtgaagtggagaaaatgacctttcaggagaaattgcaaatcgtttctgtaaccgtaagcattggactgaaaagctatacagaggaaatgaacaaagataaagatgtattttttcagcaagcagatgactatctgtatcaagctaagcgctccgggaaaaacaaaattgttgctcttaatcatatcgcttaatgtaaaaacacttcatttgttgagactccggcatgagcttgccggagtcttttgaatatagagcttaaaatgtaatagagttgacaattccataagttgaaactaaaattgttacatatgtattggttatttacttacattaaataagttcgaaggagatggttttttaaatgtcaaccctcgttattgtcgttcaccctgatcttgcggaatctcgcattaacaaaagatgggtgcaagaactcaagaaacaatctgacgtaaccattcacaacctgtatgaggtatatccagatgagcaaatcaatgtcgcccaggagcaggaactgctagagcagcatgaccgtatcgttctgcaattccctttttactggtacagcactccttccctgctgaaaaaatggctggataaggttctaacctacggctgggcttatggaagcgaaggtggcaagctacagggcaaagagttgttgatcgccttgtctgctgccagcgttgaggaaaattatcaacatgacggacggaacaggtatacgatcgaagagttgttgagacctctggaagctacagcccatatgattggtgtcaaattgctcccttatttcgtacaatatggtgctgcagtattgaccgatgagcaactagagcaatccgcacaaaaatacgcgcaaacggttatttcttaattttttactagaaagccccttggacggcgcctgccatacctgctttacagcagacggcagctccagccaaggggctttactgatcgatttacatcgtaaccaaggtactggttacttgtgccatactttctttaataatttcgcagcccttacgcaagttttccaagcttatcgttaacgctggcataattttaattaccgtatcgttacgcccagcacgttcaataatgagtcccctactaaagcagagagacgctacctccttggcgaacacttctcccagatgagacacatcaatcccccagatcaatcccatgccacgaatttcaataagaggatctatcgattggatatgttcacgtaagaactgctgaacaaaagcctctttttccttcacttgtgcttccagctctaccgtatctctgaactccagcgcagcctttgccccgacgaaagcaagctgatttccacggaaggtgccgttatgctcacccggactccatatatccaattctggcttgagtagcaacagagacattggcaatccgtatccactgatcgatttggacaaaacaaccatatcaggaacgattcccgcccgctcgaatgagaagaacgaaccaacccggccgcaaccgacttgaatatcgtcaacaatgagtaaaatatcatgatcatcgcacagctgtcgcaaatcacgcagccattcggtctctgcaatatgaataccgccttcagcctgtaccgtttccaaaatgatcgcggcaggcttttccacacccgaatgggtgtctgttaaaagctgctccatatacaaaatggtatccattccgttaaatgtgctgttataaggtatgaaggtaacattgttcagggggacccctgcgctctctcgcatggagttgttgctggtaatagataaactacccagcgacatcccgtggaacgcacccataaaagcaaagataccatttctgtttttcaccttgcgtgcaagtttcagtgctgcttccactgcattggttccggtcggtccgcaaaattgcagcttataattcaagcccttgggctggagaatacgctctgaaaaagactccataaactcttgcttggccgtcgtgtacatatccagaccatgcataatccgatcggaagttaaataatccaatatccggtttttcataaaatcattattgtgcccatagttcaaagcccctgcaccggcaaaaaagtcaatgtaacccttgcctgcctccgtgtacagtacatcgtttttagctttgttgaaaacaactggaaaacttctgcaataggatcttacattggactccagcacttcgaatgtgttcatgatctctcgtcctcccgctgacctgattttaaaaaatacaagcatggaaagcaaaaaaatgtaaatatgtaatctaaaagagtagacagtctgaattcacaatgggatatccacaccaaagaatcataagtatgatcgcaagaacaattaaagtacgaaaattaaatacagagatagcacattgagagtaagttagtagaagattaaatagtgggtttttctaagaggcctatcagaggatgtcaactcctatgtaataaaataccataatattcatttaagtcaatgcatgtttctgaggtgttttgttaaatttatgtaatttatcatcaacgacttgtagtatattgttataagaaaacgaaaattgtcgtattatagaaataaatctcaaaaatagtacatttccatatcaaatagatatacatctggactatttgtccacaggattgccacaacaagcctgatcttttgacagactgtccaaaggagtttactctatcaacaggacctgccaaaaacttgttgtaaacattgcagttatcctaactatttggctcgaatttgatagaaagataaggaaatatgatcatgtctaatgttttaattattgaagatgacaatatgctgggagataccctttccttgtatttaacaggagaagactacaacgttactcgagtggaacaagcgtctgagggtattgctaggcttgagatcgtacagcccgatattattttgttggatctgttgcttccagatttggatggaataaatccctgcccactgatacgcaagcatacggacgtgcccatcatcgtgatttctacagaaaacaacatatcagagcgcattcgtacacttacgttgggagcagatgattatatttgcaagccttttagtatgcaagagctaaaagcacggatggaggctcttttccgtcgtattgaaatcacacgcttgcaaggaagaggcagagcacctgaacctgaaacgggcattactttggatctagcgaaaagaatgattaccgttaacggacagaatgtggagacaacatattcagaatttgagctcatgaagcttttttatttgaaccggggaattgtattcagcaggtatgctttgattcaagctctccgtggcacagactcctttattaatgagagggctgtggacgtacatattaaccatttacgcagaaaaattgaaaaagaccctaagaaaccgcaattgatcaagaccatctggggaatcggctacaaatttatgcaataatacggtcagctccagggaagtgatgacctgatctgattaatctccttctgaaccgtactgagttgctctttccagtccggatacagttcacctgttgaggtttcattgctgcgcttcaatgccttttccaggtctatcacctttgccagcagctctggcgcgcatagattccccgttcctcccttaagcgagtggattaatcgaagagcagaagataactgcccattgcccatttttttcagtactctcttatcaagatgctggtattcttgaatccatttataaagggcaaattgaaaaatgtacaccttgccatccatagcggctatcgcctgatctgcgtgaataccatgtaaatcttgcagccatgctaagttaatccaactagttaacactctagcagcggtcagttcatggataggcttgagaagcacggcattaataccggcacgaagacaaacttcctgttcatgctgcacagcatcagcggtaaaagcgataatgggaagcctgttaaaagctttgtttctccgaatatgtctcgccgtctcaaaaccatccatctctggcatatgcagatcaagcaacaccatatcccagtaacgcagttccagtaacgctattagttctcttccgttcgtgaccatcgttacctcaaagttacgctctgctaaaaactcggtaatcaccacctggttaatttcgttatcctctgctatgagaatttgatacttctgtgttgtatcccccacctcattgcgggaactcatggtcacatgagtctccagagtattaccatctgcaggcactgactgttccttcttccagcagagaacctccagcagagcgttccgggtaacgggcttggacaaaaaggcatctatcctatgatccatgtccccatcagctatggtttccatctgaaacacggttgtaagtccaatgatctgagttatctgcctatccagcatttgaagccattgcctccgggagtccagttctctaaaaccttccatccccatatcaatgataacaaaatcaaaatgctcacccttttgaaaagcgtccatactttcttggaaggatgaaatagtgaatggttttagccccaaatcttgcagtaattcgttcaaactgtacctcaccagttcatgctgcgcaacaattaaggctttgcctttgatttgtttttctattcgtgtgcttcccgcattcaattccccggtatccaactcgacattaaagtaaaattgactgtactctcctaatcggcttttcacttctactttcccgcccatagcttcagccaaatgcttgctgatggtcaaacccagcccagagcccccatatctgcggctggttgaggtactcgcctggataaaagggacgaatagcttgtccatacacgtctcggaaattcctattcccgtatcttctaccataaaagaaacgcctactcgtccgccctgctgactgagcattttcacctgtaacaatacatgtccctgatccgtaaacttgatagcgttggtcagaagatttgaaagcacctgctccattcgaagcggatctcccttaacccttttcggtaacgccaggtccgttataaatacgatctctatttccttatcttccagcaaagttccaacggtatctgcgagatgccgaagcattttttccggctcaaattctaccttttccagttccagactgccggcttccattttggaaaaatccaatacgttactgagcatggatgaaagggtacgcgaggaggcaagaagcttgtggaggtaatctctttgaacggcagtcagttcagtcttattcaatagctttgacagaccgatgattccattcagcggggtgcggatttcgtgactcatatgagccaagaagatgcttttcgcatggttagcctcgtccatctcctttctcttctgctctgaagctttgtactccgtaatatccaacacgtgaccgataacatacctagtaatcccgtcctccttaaccggatgtaaggtaatgagagccgaatattcccaaaactccaattcaaatacggctcgatcaccaaaccaggcttgcttgtagtattgactaagctgctccatcgtttcagaggaaagctccaatatgtccccgagacgcttcacatgctcccttttgttgtagttgacttgcagattcagacctacgcgcttcagcaattccccttcaagcagcctataataaaattcatcaccacttttctccagcctgaaggtaaaacccggttggacccgaagtaaattcagcagatcacggtctttgtttaacaaacgttgtccatatgtatacttagcggtggttaaagtgtgcacaaacagagtcatgaacattagaccaatccctagctccagcaagcaggtcagcagtgttttatcacttataccaatacataagagcagaattcctgccactccataaaatacacctgcgatcgtctgacgaacaagctgacgctgaaaaaccaaaactaacaataatatcacgatagcacatagcattaaatctcgaaccaagtgttcgcccccttataatcttccatgttttgtacaataaatcgaaaatataaaaaactcaggacagattccttatgccataaggcttaaagaactgtcccgagcattcattgtactatagattccatagggttcaagctcgttttaatatttgaaacgactgatcatcaccttcaaatcagtagccatggttgaaagcaactgtgcagaagctgatatttcctccatggaagccagctgctcttgtgaggaggcggcaacttcctcagatgtggcggcattaccggttgcaatcgtcgcaagttcgttggctgtcgctgcaatctcttgtacactggctgatatttgctgtgcaatcgcagcgacctcctctacctgaggtgttgtctctcgaatgccttccatcgcatgacccaacttgacaatggttgctttggaaatctgcagtccatcctgcacctcagtcgtaaccctgtccatcgtcttcactgttgtttcggtttcatgctgaatttcggcaatcaaggtggcaatctgtgtggcggatgtctgagactgctctgccagcttgcgcacctcatcagcaacgacggcaaagccttttccatgatcacccgctctggctgcctcaatagctgcattcaatgccagcaggtttgtctgattggagatatcgccgataaccttcgtaatttcaccgatttcatgagagcgggcttgcaaggtttgaatcatctggttggaacgctctactgattgatgaatggaattcatttgctcacctgtctgctcaacagactttcgtccttcctcggcttgcaaggcagatcgtttggccaaatcggctaccgaaatcgagcgttcagcgatttgggtgattccttgtgcaatttcatcgagggccaccgaattattttccagccctgtagtctgcttctctgcaccactggctatttcttgcacagcctgggacacctgctcacttgcagcactggtttgttccgcgcttattgtcagttcattcgaagaaattgccacatgatctgcactgttccctacgttctgaatgacagatcgcaagttattctgcatattttgaaaagccactcctaattctccgatctcgtcctcgctctttacttgaatgtcctgtgtcagatctccggcgctcacatttaccgcttgttcttttaactttaaaatcggtttgatgatggaacggatcaggaaataaacgatgataataccaatcacaagacaaccgatgatggttagtaaagtgctgatcaaaatcggtcctgctgcctcatcgacttcagacaaatatagcgttccgcctatcttccagccagttagcttgttagtcgcatagttcatatatttgggctgtccttcatactcatactcgtattcaccagtatcgctctgaaacatgcgtgattcaatatctgtaattttggtgcctgcttccttcgtcggatgtacaatgtaagtatggttgctgtccagcaatatagcataaccctcatgacctactttaatattgttcaacgtctctttaataccacttattttcaggtcaatgccaataacacccgatccatctaacgttgccttggacaccgtaaccgtcatttgcttcgagcttgccgaaagatagggagaactaatcgctgtctttgcttgctcctttatcgctttatcgtaccaaggtctgactcgtggatcataattatccggtaattgcttctgtggataggttgtaaatttaccgtccttcgtaccataaaaaatggattctgcttcaggatgaagtgcagcatattgcttaaaaaactcttccagtttggccgcttgttcctccgtctctacccgattgccttttagtctttctgcaaaatattctgcgtcatgtaccttgggttcaatagtactatcaataataaaattagtgcggatgatagcctgctcggcactttcttcaatctggtttcgaatctgctgactagcgctcacaaacgacaaagcccccacgatcatggacggtaaaatcagaaatgcaataaaggcgaccattagcttcgttttaaaatttttgctgagcatccttgcgactagccacttttttcccgataacttcttcattaataaacatctccatttcatttcctggatttcctaacctatggcgaatctcttcgtcttgccgatgacgacaatcacccgacagactctctttcacatttttcacatctgctgctaaaacgcttggacataaaagatataaacacgctagttaaataggtatatgtacttattttcgaaaacagcaaggctggtcggaaccggttctttgatataatatacctaaaaaatattaaaaaaaatgcgtagcatatgttaagaaaatattagtttcatctcactatacctacctcttaatatgaaaataatccccttgaaggtagcaaacatagggttattttcgaaaatcaccttatgcttactacccccgaggggattaggtttgatcgctttattcagttcaatccaacaacaccttcagatcttcaagcctggtaacaggtgcctgacaggtaaaatgctcacacacgtatacagctggtttgccttccacaagattgtaatcacggatataggaaactgtctctgcaatctccgactgtccttcatccttcagaataacgaccgtattcggcctgaaccccgctcgaatcgcctgaatgaactgtacggtctgtggatcgtccctatgacctacaatcacaatctcttttgtcgttcctgttgcatacaacaacgcgctgagcaaggctgagcagcctgacgggtaatgagcaaccatgccgccaaaagccttaaactgcttggctgcataattctccaatcgggattcacccgttagccgtgcaagccgcacaaaattatgagccgcaatgctgttacccgacggaatcgcaccgtcatagatttctttaggcttggcaattagctgctcactatctgacccataaaagaataatccgtcccgttcctcatcccagaataagtcgatcatattttgattgagcgtcaacgcccgttgcagatactctatatcgaaggtcgcctggtacagctcgatcaagccccacacataaaaagcataatcatctacataaccgggataagctgcttctccgtcccgataacgtgccaacagccgtccattctcctgtctcaaatggttccacaaaaacgtctcagccttccgagcttgctctgtatatcttgtgtctccaaaagcttgtcccgccttcgcaagagcagcaatcatcaacccgttccacgaggtcaaaatcttgtcatccttatgaggatgaacccgctgctttctggcagcaaacagcttggcgcgtagctcactaacccgctgctccagttcctgctcagtcaagtcatgcttgatccgataggcttccagattgatatcaatcaggtttggaatgttgtggccttcaaaattgccgtaaggtgtaatcccatacaaatcgttgaaaaaggcggcatcctcatcgcctagtatagcccttacctcagagtggtcccagacatagaatctcccctcttctccttcggaatccgcatcctccgccgaataaaaggcacctcctgcatccgtcatgtctcttgcgatatatgtaaagatttgttctgtaatccgtcggtacagttccttgcctgtcacctgccaagcttctgtatacgcgatggccaacagagcattgtcatacagcattttttcaaaatgcggcaccaaccatttctcgtccacggagtatcgtgagaaccccatgcctacgtggtcgtagattccgccacgggacatcgcatctagcgttttctctgccatttccagtgcctgttgattccccgtatgctgtgcatatcgcaacagaaaagacaggttatgcggagaaggaaacttaggagcttccccgaagccgccatattccttatcgaaggtgtggctgtattcatggaaagctttattcaagctctgttcatccagttcaccgcgataacctgcaagcaagtcctgccgctcatgctcggtaagcacctgctcactcagctccaccagctcttcgggctgttttttccaccgggcgcccaccttgttcagcagctccaacagtccgacacggccatacttttgctccttgggcaaatacgtccccgcaaaaaaaggcttctgatccggcgtcatcaatattgtcagtggccagcctccatgccctgtcatcgtctggcagatggacatatagatatgatccacatccggacgttcttcacgatccaccttaatggatacgtaatccctgtctaatagctcagccacttcttcatcctcgaaagattctctccccattacatggcaccaatggcaagtggaatagccaacagataggaaaataggcttgttatcacgtttagcaatttcaaaagcctcatctgaccaagggaaccaatttaccggattgtgagcatgctgtagcaaatacggtgatttttccttggatagtctattcggtttgctgctcgttgtcatgggacatcaccacttccgttgttggattttatgcttggtactattttaccctaaatgggtggtaaaagtcggaagagatgaaaaaaagatgatatcagattagaattactacattgttaagaagtatcaatgactctcaaccgaatctatccataaattgtttattcagatcataagtaggtatgaaaaagcactgatggatattcttcatcagtgctttatatactgcagtcgtaccttattagcgtttagcattatactcattagaatttatatcaaagatctccagcgctttcagtaaggcgtattcacttgttctggccccttcttttgaaaaatgtgcatccggaaacgcaggagacatatgatggtacccgggatagacatgtaattccactaagactccatcaaaagccagttgtttggcaaaaaccaaggcttcatcaatgaataaatcaatggtacctatatttatataagtcggtggtaacccggccaatgacttagcacgggccggcgcataatactcatttacctcctcttgacccggttcttcccccaatacagatttccagcccaaataattactttgttttgtccaaataaactctcctgcgtatggatgctctggtgcggtacttgtccgatcgtctagcattggcctcatcaatcttagatgatggatttcgaattccttctgatcacgaatgtacaaggctaggccagccgccagacctccgccagcgctgctgccccctacggcaactttctgagtatctatccctaactcttccgcatgttcaatacaccattttaggcccgaataacaatcctgtaactgacttggctgcacatgctctggtgctagacgatagtacacagatacacaacagaaaccatgttgtgcagcaagagatgcattagcaggacgatccacgactggacttcctaagaccatcccgcctccgtgtatcgaataataaagaggcatcttatgatgctttgaatgtttgggcttaataatttctatttgaatatctggaccactaaaataacttggcacaacctttttttctaatgtaatagggaacatctgcgttacatctatttgttgcatcatttggattgatttttacgtgcttccattagtgtagattcggtaagatcggttgttggtattaaatcaactgcactgataatttccggatcaatcagatgtctacttctacttttttgctctcccatagtaattgtttcctcactttcttattttaaagacaatgaatcaatacatttttccctttaattgttgctgttgtttatattcatattttaaagattaaaataagcttaataaatgaaaacaacgatttagaatcatttttggcataaaaacaataatgaaaaaatgaagtacagcctttgaaatagaatgggtctgttggatcatcggggagggtgaacggaattttgggatcaagaacggtatgtaaaaaagctcaagagagaaaatgaaatgcgaacacacatcaaaccttttgccaaacaaaaagacgtgaccggattgatttttcaccacgatcatccggtcacgccctaagctcaccatgttaagaggccaaaaataaattcattgacgcgagtatagcaccacgccactttgcaaactaggtatttttatgtgaatacacaattttcttaatggtttcggtagagaggaaaaactccttagctaattgctcgatactgctgctattttgaaaagcacttctgattgcagcatttcgctgttcaagcaaccttctcccgccactcaaacttccccaatccatatattccgtttttggcttaggaatatacagagtctctccttgaacatatttttggatttccataattagtttttgaggtaaaacttttgtagcattcgtatatctcaattttgctcgccccttattttgattctttaaaataaggtgcaaagccaaaaatattaaaaaagcttgtagcgttaaaaattgtttcgccccatacaaagtaacgctttcctaataattggctttgcatgagtgtaagaagtcacagacaatcccaatagattctccatcagtaggcacccccttttacttcgcaagtatagcataacttctgctcacctgggaccagctaaatgatatcagtacaatcaaaccattaaaattgagctgataaataactgatcttcattcgtttatgaggtgttgccgggacttttgtttgcccgactcttgttattcgcaagccgatgttttatattgacataagagtatgtcaaaaataaaagaggtgaacggacgagatgtctccacgtacgaaggaacaaaacgaagagatccggctgcggcgtctggcgcaaatccgaaaagccgctgccgatgtgtttttgaataaagggcctttactggaaatccgcgatgtggccgtgcaggcgggactcggctatggcacggtataccattattacagcaacaagggcaatttgctccacgatctgctttgggacgcgttggagcgggccgggggatggctggaggccccgcgcgcttcggcttcgggggaggcaccggcgggcgggcaattcggcttggctgctgcggcggacaccgggaactcggctgccgcggattcccaaagcagcagccgcgaaacggccgcttccacagagcttggctccgtcgccgtcgccggcattcggctgctgcagctttgggcggaggaccacgccttgtacctgctgcataagctggccggtgagggctttgcctcgctgcctgaagcgcgctctgccccactctcggctgcctttcgccgggaggtgctcgcgccgcttgccgcgctgctggaaaccggtcgtgcggcggacggggctgccgcttccggcggaaacgcggctgagccaccgtatcggctacagcgcgcggaaatgctgctggccgccttggtcggctgcgcgtcgctttcgcttcgccgcggaaagctgcacgaagaggccgaagatatcgtccggtttttaaaattatagaattgataaggagcgaatagacaaaaatgatcattttaaaatcacctagggaaatcgaagagatgaagccggcgagccaaatcgttgcggactgctaccgcgaggtggccaaactgatcgagcctgggatcaccacccgggaaatcaatgactttgttgccagacacatcaccaagctgggtggcaagcagtttacgaaagggtacaacggtttccccgccgaaacctgcatttcggtcaacgatgtggtggcccacggcattccttcgaaccaggcgcttatggacggtgacttgctgaagctcgacatcgtcgtggaatacggtggatggtttggcgattcgtgctggtgctatgcggtgggcaatatccggccggaagcgcaaaaattaatgaaggtgacaaaggaatgcttggatatggggatcgcccgggcactcccggggggccggctcggcgacataacgtcggcgattcaacaacatgcggaagcgaacgggtattcagtcgtacgcgatctgctggcgcatgggatcgggcggagcctgcacgaggagccgagctacgagcatatcggcgtagccggcaaaggcattcggttaaaggaaggcatggtgtttacgattgaaccgatgctcaacgaaggtacgttccgtatcacgatcgacgacgatcagtggacggcgagaacggccgacggcaagttgtcggcgcaatatgagcatacgatcgcagttactgcggacggaccactgattttaacggcccagtaagaatagaggagaacggacagcaatgcgtcattttaggaaaataagtcgccacccgccctccttggcctgacgaaagttcgtaatccgaaacgcgaaaaagcgctggttccagcttgggaccagcgcttgttttatatagtttgtaactttaccgatttacgaaaaaccacgttgttatacgttttttttattatgcctttggtatcgtgttacggatttacactctctgctttgctagcctgtcttgcgtgtatttttttcattgcaaatcttgctattggctgagcgaccaatagctcaatccaaaatgctacaccaaaatttctaaaccaactgtgaaagaagttctgaaaaggttatattgtttccctccgaaataaaaatatttcagatggtagacgtatcatgcgacatatatttttggtcattaaaactagtaccaatatctctacacactgatctaacaattataacaacttttttaaacaaataaaagggttttctaagtttatcaaggtgacattcgttaactgtgacgatccttggattgtcgctacaagacaagagtagcaagagaatgaacgctaggctacatggtcgtgctaataatgtaaaatataatcaagtatagaactgataaaggagtatatgaaccagatgaacaattttctaaatgaatttgaggaaagatttagggcaggatttttggatgatcttaaaagcatactggaagaagtgaagaatgagcaggtttacgcttgtgcttttggcacagacagcgattttatcaccttgtttcttactgttaatacggaggaatcacttgttagacatatcacaaacatgaaagcccaagacctgtgcaacagcaaggaagatgaaaattattatagatggggattaagcgaatatcaatatggcgatacaacacatctcaatcatattagcaaatttctgcatgcaaccgaaaatgtgtttgactataaagatgaaatgataaaaattatggccaaagtagttaaggaaacagacgatgtactttttaatcaatttggccaatccaaagaagatattatttttttcgtgtccatgacggatgatgatatggctgaggaactggaaaatcagtccgtaattcagatgacaaacgccaaattagttgatggcttcttgcatcgttatcaataaaagtgcgtttggaatattacactcatttcgtttaggtaggttgctttgctagacaaattcgcaatgtgcttgtcctatgcatcgctagtaccctcttgatctacacggggtagtactagcgaagctgacactacccccgggtcagaaacaactactatgatcagccccccatttctcttcgcaaactacgccgctatcatactcatggtatgggaattcgtttgttttactaatgcgagactccggtgcagcttatgattgacgattccgatcaccacgtccggctccatttcatcctgatgggagagcataaccattgctgcaatatcccccatctgatatgccgccgtcaacgcccttagaaaagtcttcgagttttcactttccggtaaggataactctcctttgaggatatccttcttgactgcttcaagcgattttcgtgcccggtggagtgcaacttttaccgctccctccgttgtttcgagcatgtcggatgtctcgctaatcgaatatccaaacacatctcgcagcaaaaaaacagttctctgaagcggagataaatgtttcattaaggactgcaacgctatctcgatttcaaaagatccatgatccggtacagttactttcgcttgttccctattcaatattcgagtgtagactgcttttctccgtatatcatcaatccaggtgttcttagcaattcgtagcaaaagcgctttggggtttgtatgctcgaagctatttaacttacctaatgcttttatccaagtgtcctgagccagttcttccgcatcccaatttgatttcgtaagcgacagacagtaacgtttcaggaccgcctgtaattcctccaagttctcgatgtttattgtattatctgtcatttgtatagaatcatctatgcgcataggtcctctcctccacagtcttattctgccctttcctagagcaaagccatttgttacctccaatgtaaacgaacaagtggttgtaaaagttacaccatttacgcaaatcgttttcccattgaaacctccgtatctttttacggcctcggttcgtttacaaggagaaatcaactgaaaacgggaaattgggggtatcaaaatgagtgcttatgttccttatgttgttgagcaaaccgctcaaggtgaaagatcgtacgatatctattccagactcttaaaggatcgtattgtgtttgtcggggcagccatcgatgatcatttggctaacagtattattgctcaattattgttcctggcggcagaagatccggaaaaagaaatttacatgtatatcaacagcccgggtggctctacttccgcaggatttgccatttatgatacgatgcagtacatcaaacccgatgtacacacgatatgtacgggattcgctgcttcgtttggcgcgatcctgttgctggcgggcgccaaagggaaacgttcggcgttgccgaacagtgaaatcatgatccatcagccgcacggcggcgcacaaggtcaggccagcgatattgcgatcagcgcaaaacgaattttatggactcgtgaaaaggcaacccgtatcacagctgaacggaccgggcaaccttttgaaaaagtcgaaaaagatatggaccgggatttttacatgtccgctcaggaggcactggaatatggtgttattgatcaagtgataacttctttgtagagtatgctcaaaacctaatgatctgcaagaaacttcaagaaataatacgaggtgatatcatgttagcaagcttacaaggcaaggaagtaactattcattttatagatggaacaaatgtatgcgacggggtactggatcagattgacgacaagttcgttaaatacctaacgcaatatcagacgcttgttattcctattacatccattcgcaccgtatccattgacattaaggaacggcaacgccacagagttggattcgccccttgaacctattttagcatggggtggcaatttcattttgcggaggcccgatattatggaaatttcacagggagtagaaatgcttcagctagattttcatgggaatatgattcaccccattcttttgtgggatcaagaaacggctgttttaatagacacaggatttcctgggcaaatggaagatttacgcgtggctatggaaaaggtaggcgtgtcgtttgacaaactaaaagttgtgattttgacgcatcaagatgtggatcatataggttgtcttcctgagattttgcaggagtgtggccatcatatcaaagtctatgcacacgaactagataagccgtatattcagggggatatcccacttttaaaagatagtcaccttgagaatcccccgaagggcaaagtggacgataccttaatagatggtcaggaactgcctttttgcggcagaattcgagtcatccatacgcctgggcatactcctggccatatcagcctttatttaatgcaaagtaagactcttattgccggggattcgatgtacagtgttaacgggattctcgggggaattcatgtcccgaccacaccggatatggatgcagctcacctctcattaaaaaagtacttagatctcgacattgcatccgtagtttgttatcacgggggattaagtaatgtacatgtgaatgatcagatattaggacttacccaaggattataaagttaaagttccagcaagttacctttggtgaaacgatgttgtgatcgagaagattatttaaaataacactttgttaattcgtgattgaactttaacaaagtgttattttgcatttcacaaaatagatcttcattgtttattcctgcaacccatactctacgcgtgctaacttgtatatagatcagactttaactgagaaaaaatatattcttgcatttgatctaaaagaagaatgatgttagtatctttaccatttttcaaaacccactgaatagacatcattgagttagcagcatatagttctgctaaatactccaatgcgatcgaagttgaagaattctgttgctttaaataatctaagcaagttctaaacaaaatttgttcaaattctttacgtaaatcagctgatacttcatgaacggttaacaatgttgaaatttcccgcttatttttaatcatattatcggttacaagttctatggcattggccaccttgccatcttccatggaatcaaaacgctgctcaatttcaactttaaaatcagaagcatactgtttaactactttttctagcaagtcgtacttatccaaataatgactataaaaggtagaacgtccgataagagattgatcacacgtgtaagatatcttacagattatgcgatactaattattttttatgtagtaactatactctatagtaagcacatacccaaattgaaggaggacagtatatgtttaaatcctatgtcaataacgaacagttcaatcttcaaattaatcgttttatcaatgattattatcaagaagatgatcgagcacaagctgacttggaaaaaataattccgaaattaaaagatacccatagctggtatgaagcttggctcaattttgctaagaaacgcgaagacagcaaggactatgacttagcctcagtctactatcaagctgcagaattttatcttgcaaccacagaccccaataaagaaaaaatgtatcgaaaatatagagaaacattctataaaggctttcatgattttgattatgaatcctacaagattccctatgaaggttcctatcttcctgctgtaaaattattgacacctggagctacgaaaacattgcttgtctttggtgggtatgattcttacatggaagagatgcttaaaatgatgagatttatgaagggtattgattacaatattattgtattcgatggccctggccaaggaactgctttaaaaaacggcctaaaattcattcacaactgggaaaagcccatatcaacggtgattgattatttcaaattagatcgtgtaagtctcgtaggtgcttcttggggaggatatttagcaatgcgtgcggcagccttcgaaaagagaatcgataaagtagttgcttttaacattttttattgtggtttagatgccttaaaaatggggatgccagaagaaacgtatcagagtttgatgcagctagtcgatcataatgaagtagatcaagtgaatacattattcgaacagatgatgactcacaatattgatttgcattggaagattaccaaagggatggaaaacaccggtgaagcaacgccttttgacctcattaaaaattttgaaaagcacacaatgcacggcattggagcattcattaatcaagatgttcttttactagctggagaagatgatcaatacgtacctattatccgactcgctcaaatccaacaagaattaatcaatgctgcgtccattacaaccaaagtatttactaaagaaacgggcggtgagcaacattgccaagcaggtcacagagagttagcatttaatgaaatgaagaagttcctataacaaagagggatgaatatttagtttttcccatataaaaatttagaacactaaattccatcaataaatgtacgtgtggttccccaaccagctatacccaataggtaaaaagatgatcttgttatcacgcttggtaatttcaaaagccttatcaccttttgctctctgagcagtatctcataaaaaaggtttgatgttcctagggcgtctttagcttttcatgcgcactatcaatttaatttggtctcattggttacatatttccatgagtctacgtttgaagtgctttggtatacttagattcacaaaaaaagccagaacgcattttgtttacgttctggcttcgcttatttcagttaatgaatattttcacatctatttcatttacattcactatctaaattattcaaagctttatcactaatatcattaataggaatgtttaaattacgccaatagttcaaaggataagcggacttacccacaagcatttcaccttggcgtatataaaaactcccccccctttcaaggaatttaattatcggttcatacaaatctacatggtctaatgcttctttgatcccttgatcagctaatgcggaaatttccaagtaacagtaacccaaagctttgatatatatgttctctagcttttcaagtttggggaaaactttagatatatcaaggttaactgtttttccaagcacattagcgatactaaatatgggatacttatcgacagcaacagatgcagattctataaatgcattgactcttctgaaatattcactaatcaaaatatggtgtgaatcacacacctgatcctctaaactttcaaaatgaattgaagacaaacgctctacagcttgattaagtattcttcccaattggtttaacctcgcttatttaaacatatttttaaagtaataatcttcatagcctggaaaggatttattgggttgagaaggggcattttcgtgagcaccaggcggataaccttcgtaagttcccttttcttgattccaagattcaagcgtgcggtacttctgcccttctgccattaatttacgttctgttagctcatgttcagccaattgcttgaaccatgttttttgttcaggagataactctcctttttgggctgttttccatgcaaaagcaatctcatcatcagcagtaaatcgttcaagcctaaattctattcctcccggttgaggtacttcatgcttaccaaagaataaatgctttttcatagctcttatttcatccacactaaggtctgtattccgagcaacttcttcaatatccttcatctttatatttcttattgattggtactctgcttctgcaaatgtatcataatcctttgaaccagcaccagtaaatccatttcttgtctctgtgttagtagcaggacgctgttcgctttcttttaaaatatttgtacttttagcaccttcatacttaacagatccctccaaaatattcttgggcttaatcagcgctttagttgtcgtagaacctatcatcaaaccagctgtaccaatcaaatttgccatatgttcttttgaccatgcatttgtgggattgaatgctccctgaatcatgcccgatactccaaatgtaccgaaattgagcatgtcattccatgaatcgttttgtttagctgcccgttccatgtacccttgatacattcccttcggaaggccgtacgacatataatctaggaagctccagactgaatcaaattttttctcatatcgttctgaattagctgctacaaaatcctgcccaagctccgttaagctatccgccgatttttggagcgcatttcgtgtatctgcaacaggaactgtgcaagtattcggtggaggtggcaagcaacctgggtctagattcccatcctccatcatatctgttaatctaaacttatttgcatgctgccgtagttctctagcaatcgaatctgttagtgtaacaaagtcagccatattcttctgagatgtttggaatctataatagaattgctcctttgttatcccctcccaaaatcgttccataaacgaaatttgctgcgataactgactattcatttgcatcgccgtttgctgcgcaagctcaaatttcttagagacagttataagttgttcaggtgtcactttaattgttgtcataatttacctcggttgagttcattaagacataataacataattcaaatttatggaaaaccatctttattactaattgttatatgaattagaagacttaatccctacgacctctgacttatatattattaaacgttggtgccccttaatcacaatgtaaagccttttaactacacatttttttaactttaaagtactaggatctatcttagtttagatgatttttctatcaaatatttcaaccatcgtcaaagcaccagctttgtatccagaaatataatctgaggcggataatatagaaagcaaaacatcatttaaatcggatagttcttcaattaattcgtaatcttgttccgacagtcttgcttttagtgctttcatagaagcggatattttctgatggactagttcaagctcagggtttttaggtttggttcgttcgcttgggtaccattttccgtaatataaatcctctaagatactcatattcatcttctccttcatgatatagataaggttttgagttcgaatacagagtgcattttgttcctcaaaaacaaggatatctcagtaaaaaaatcaatactgatttttagcgaatatttcactaaggtaattgaggactaatgccgagtatctgaaatgtgaccagaggatttacacccattatgaacgcagtgaaaaagaatcacgtccacattgaggataatactgtatgggtggccggattcggtccggttgcctgagtaagtgctggacgaagtcagcccttcttggaaaataagtaggacttcatatcttctactcattaacgttagaagtcataacaagcgaattttttaaaaaagcctcactaattaccagattactgtggagggaacgaatgctttttgccaccccaagccacgagaagcgcaaggaataagagtatgaataatgcccatgaaaatgatcccgcaccaaaagtttcaagtaaaatacccccagccatcccgccgccggcgatagccagattccatacggtcgtgttaatcggcataaccatatccactttgctctcccctgcagcctgagcaagcgccgtttgcaacagcgttgctgcgccgccgaaagttaaaccccataccgtaacaatgatatagatcataaggacattggagttgctacagctcatggcaatagaaattaagacgaaggaaataagactaataaggacaagcttacgcagccaacggtcgatgaatacgccagttatccatatacctacgagagcagcaatgccaaagaaagccagcgccagacccactctctcccccatcccattggccgcaagaaatggagcaatataagtgtaaagaatattatgtgctgtcatccaggtcagtacaaccaatagtatgggccgaatccccggtgtaaggaaggctgcatagatcgaagcttgcttatcggaggactgtcccggatagtcaggcaccttccaaagcacccacgcgatcagtataacagtcagtagcgacatgattccaaaaacagaacgccaacccataaggttccccagaaacgttcccgccgggacaccaatagccaaggcgatgggcgttccaaccatggcaaccgccatacccctccccttcaatgtagcagagaccatgcggagagcgtaaccaccgatcatcccccatagaactccagccgaaactcctgccagcagacgggcagccagcgtcagtatgtagctggaggaaattgcggtgacactgttaaaaaccaggaacccgcagatagccagaagtaacagcggacgcctccgccattggcgggtaactatagctacagggatggcagccactaaagaaccgatggcatagacagtgaccagttgaccagccattgcctctgaaatataaagtcccttgcttatttgcggaagcaaaccagccggaatcgtttccgtcataatacagatgaatcctgtcatagccaaagcgagcaggccaagccagggaaagcgctcagaggagacggaagaagcaatctttacagtagtagaagagttattgctggacattagcgcagctccttaaaatcgatttcaaaacaagttcaagcgaaaaatcaagcacatataccaatgatttgccctccttttatttcatttatggatcaatcattccatattttaaagatgcctctcagtcttgtcaattacttttggatcgattagtatataagtacaagataaaaggaggcgactccatggttagaaccggaagaccacgtaaattcagtcgcgacgaagcgatctcccaagctatgatgttgttttgggagcatggatttgaatcaacctctttggctcagctcaaaaaggcgatgggcggcatctcctcagccagcttttatgcagcttttgaatcaaaagacgcattattcaaagaagcgctggaccagtatttggctacatacggacaagtatcgacaagccttacaaactattcactttcatcacgcacagctattgaattagccttaagaagttcagcaatcatgcagactgagcagacccatcccttgggttgtttagtcatattctctgcaaatacttgttcgccggaaaacactcatattcgagaactattgaccaggcaaagagcagtgactaggaacaagttccatgctcgtattgagcgagctaccaagaacggagaacttcaagaatccacaaatgttagcatgttaaccacactattcgttacctttctagaaggtatatctacggaagccagagatggtgtgcccctagacaacattgatgcagccataaccaaattgatggagctttgggatacttgtgcctgagactggctcagttttcatgaaataagggcatacaaatagaaaaggcaatcctcctaaaaaaggagattgcctttttattcagtaagattgcttctctcaaaaacggctttattcagcctatcctacacatcagtttgacttaattgggtatcgaagtgtgatttgaaatagaatcgattattaaatcccaatcgtcgtagtgaagttcatgtccagtaccttccaatgtcagtaaaaccgcacctggaatttcgttagcaagattgattccgtgttcataagggataatcggatcttcagtaccgtgtataaccagagcagggacggttatttcccttgtcctagacagataggattctccacctgacagcattgcgtgattgttcatgctggctatattgttgcttcttttccattcttcttttgctaatttataaacttttttctcatcgaaagcgtgttttgaacctactagaattcttgatctacctatcacaaaatcgaccaccgattgttcgttcgtccaatctattgctcccatattcgagaaatagtccataaccttttcctccatcggtggaagatcgggagcaaaattggacgttgatacgagggtaacggttagaactctgcctggatatcgcagagctatcatttgagtcagcatgccgcccatggacatgcccacaatatgcgcttgctcaatcttatacgcatccaatactcgaatagcatcatctgccatgtcttcgaaagtatagtccggttgcccaggttcataggttgtagaacgtccaacatctcggttgtcatagcgaacgacaaagcgacctgtctctgctaaacgctggcagaattcttcctcccaccagaccagtgaggattgagcccccataatcagtaatattgccgggttaacttgctttccgaaactgtcagtacaaattactattccatcgctttttatgagttgttcgttcatgtagaattcctcccctcaatgatatataaaacaaaaaaacacagaatattagtctgtgtttacagtaatcgaaaaataatttagaaatgaatgcgaattatcttcatcacttacctccataaagtactttcagttcctcttcttcatcgtaaatgtatgtttttcttcaggaaaacgtttatttttcacatcagcagtttaagcttgaatggactctaatataaacggattcaatgccctcctcctcaatttaaatgggacatatattcaaatgctgttgttccatatacacttttaaagtgtttatttaaatgggttaagtcaactaatccacattctgcaactgctgaataaatatctcacacaattggtttctttcacgctgtttgctatatcaaaattccccttatccaagagtttcttgttgtccgcagctatcttttaaaaattacttagcccgaatcctccaccgttaagatgtcatggaccttacgacaacaaacgaaattatggattattgtggtattattttggattattgttaatactacgtatctgaggagggtgaaaatgaagttacataccaaattttcaagacaattatgccggaatatcgatctcatttgtgacttcatgggaaacagttcggattttattgttcgtgaaatcacagctggccataaacacgccgctcttttttatttggacggaatgactgacatgcaaaaggtacaggacaatgtgatccgtccgttgcatgatcgtgtctcctctgacgagatcactttaccgttattgaaaaacgcaattttggacattggtgaagcaagctttgctcaaaactttgaagatgctttggaacagatcctctcaggtggtcttctcctactcctggacgatatggatgaaggattgatcatttctttgcctggatgggaagaacgcagcattacagattcgaagacacagcctgtggtcagaggtccgcaagagtcgtttacagaaactttacgtacgaatacgactatggttcgtcgaagggtgaaggatacaagagtacgtctaactaccataaaagttggcgaaaaaaccaagaccgatatatcggtcatgtatttgcatggggtcgctgacccaaaaaaggtgcaggacatgatatccaagttaaagaacatgcatgtagaaggtgtacttgaaagcgaatatttggaagaatgtctccaagaaaataaacaactcacgatatttccgatcttttataattctgatcgcccagactctattgcagcaggaattatggaggggaaaattgcgatatttgtggatggatctcccttcgccatccttgcacctgcggtgtttgtagactttcttcaatccgcagaagattattatcaatcctttatttacagtagtatcattcgaatattaaggtacatatgcctggcaatctgtatgttggctccggccatttatgtcgcattaacgacatttcatcaggatatgattccaacagttttgttattaagcttatccgcgcaacgtgaaggagttccgtttccagcatttattgaggcgatgatcatggaagtggtttttgaaattctgagggaggcaggtcttcgtatgccacggacggtcggtcaagccgtttctattgtcgggtcaatagtgatcggccaggctgctgtagaagcaaacatcgtttcggctgttatggtcattgttgttgcaataactgccatttcgagctttgtcattccctcgtacacctttgccattccaatccggatattacgtttcgctttcataggcatagccgctatgtttggtgtgtacggattgactgttggtattctcatgctctttgtgcatctcaatgggcttcattcattcggtgtaccgtatttaagtccctttgccaattacaaatcgtctgagcagagggacgccatattgcgttttccatatagaactaacaaaaaacatcgcaaaaactaaaggagtagaccatcatgaactcgtatcgatccaccattttattactgattatgtccatctggctaatggtgtttcttacgggttgctggaacagtaaggaattgagcgcaatttccgtcgtgatggctctgggcattgatgcagttgatgaccaatatgaagtcagtttacaagtggttgacccaacgaaaatgtctcagaattcccccatggaacggacgccaacgatcgttttttccaaacgcgccgataccatatttgaagctattcgaaaattaacaacggaatcgtcccgaaaaatgtatatgtctcacttaaagtttgtcatttttgatgaaaaaacggcaaaaaaaggaatcaaggagccgctggactttctgttccgtgatcatgaagttcggcctgatttctatttggccgttgtcagaggaaacacggcaaaggaggccgttacttttgtaactccaaccgaggtcttgcctgcaatggatatgtataaggcattaaggctttctgaaaaagcatgggctccaacttccgcggtcaatgtgaaagatattttacagagtttcacagatgatggcattgaaccggttctcaccggtattcgactgacaaacctagaaaaaggtctaactattgataatgtgacaaagtcgccccaacatgttaaatacttttttactggaattggtgttttcaagggagaccgacttatcaattggatggatgattcacaaagtaaagcctttacctatatatccaatcgtgtttccagcaccgtagcttccatcgattgtccgaattccaaaggaaaatttgttgttgaagtaatccgttccaaagtaaagatgcatccaaaaataatagaccatgagccgcacatttctcttattgtggatacagaatccaatatcggaacggtctcgtgcaatgccaaccttaagaatgaagagacatttagagatcttcaagaatcagctaaagagcatctggaacaatctttgaaggagggcatttcgtacgcacaacaaatcggttccgatatattcgggtttggagaagcttttcaccgcaagttcccacgtgaatggcataaatggaaagaggattggccacaaaaatttcaaacgcttaaagtcgatattcagctcaattatcgtttaatccggttcggagacattaccagtccaatcgatatgggaatacacaatcaggagtgaatgcaatgctttatgtgattctcgtaacttccattttaacatctttgtatgagtttaaaaaattcaaggagaaacaatatgtgcgtgaaattgtattcagcttgatattgttgattataggcgttatattgattatcctacggatcgccaacattaaactgccgactccactgaagggcattcaaatcctatttcaaccaataagtcggttacttacagaaatgttatcttaagggggggtattggaatgaactccaatttgacggttcgacaagctattttgtggtttgcattgtatcaaataggaagcgcatatctggtgctcccagcggtaattaccgctgtcgcaaaacaagatgcctggctctccatcccagtctccttaggtttccatctgttattgatacctttatatgcctccatcgctaggcaaatgcaggggaaatctttcgtagagcatctccgttgcctcttcggtcccttgggcgggacgatcagcatcgttttcatttttttctttccctttcttgtgttcattatgacacttcgaaatctgggcgactttatcacgatagctattatgccggaaactccctccgacgcgatatatttcatcatgcttatagtcatttattttgccgttcgatcaggccctgctgtaattggtcgttgtgcggaaatcctattttttttccttctggttctgtatctgttggtcaggtttacccttctttctgataccaccatagataatgtgctccctatttttgagtatggtttaaaccctatcgttctcgcttcgttcaatttgtttgcctttccctaccttgaggcaattctgtatcttttttttgcacagcacatccccgatccaaaaaagtggagaaagacagtgataacttgtgctttgattagcggcggcatgtattttttcatggttctacaaataatcgccgtgatgagtgaaggtgttgtatctaatttgacatttcctactttttttattaaccgaacaatcagtaacggagagtttcttcaacggtttgaaattttcgttgcagtgttctggtttgtcaccatttttttccgactcgcactgcttttatatgtttcagcgcaagggcttgcagatgcttttcgtcttcgaagcgctaactctctcttagttcctctgatcctaatcgcattggcaatggttcattctatttggccaaatatgcaatttttaatcaagtttttttcagtatggcctttttatgccatgattttcggtatcgtgtttcctattgtgctatggctggtgggtaaggtatcgttgaaattacgtaaaaagtatcactaaagttgcgttggctgtatgaacatactgttctcaaataaacttttgttgtactcattattgcaatttagcaagaagtagctccaattccgccttctcaagatgtctccattgtccacgctccagatgatccaaggtaatattcataattcgaacacgttccaactttagcaccctataccccaaggccttgcacattctgcgaatttgcaagttcagaccctgcgtcaaaataatgcggaactcgtattcgctcgtacgatcaaccttgcacggtttggtaatgacgttcaatatttcaacgccacaagacatggcctgcgtaaactcgtttgtaacaggttggtctacagtcactacatactccttctcatgaccatgttcggaacgcatcatttgattgacaatgcttccgtcgttcgttaatagaatgagtccctctgacgctttatccagcctgccgatggcaaaaatccgcgaaggataattgacataactaataatattgccagccacttgctccgctgcggtacaaacaatgcctatgggcttattcagagccaaatatacaggttcactggaattaagcggaatagcttccccatcaatcagcacgatatcctgtggctctacttctgcgcccgcttcacaaacatttccattaatcgtaattcgtcctgctgcaatcagcctgttggtttcccgacgtgagcaaaatcctgtctcactgatgtacttgttaattctcacgattcacctgcttctgattataatatgcgagtttaagtaaaataattaaaaaaacacctgattgttcttgcttaatcagatgttcgacgtttacgacaacttatactttcccggcttatttgctactgttgccgccgcttttattccttgttggtttggcagtgccgccttttgtgccacctgcggctttgcttcccggtgcgcttgtagaagcgctttttgtccttactggcttcgcagttttgttccagcgtgtccagcccttactacctgtacctctgccggtcccgccgcccttgctttttccacccatatgatcactccattactagtcgttcagatttaactaagctatcataccattactttgatcataatgcccatttcttttaaaaattgaacatgttaagccgcaaatactttcgcaaaacggatcttgttgtatttttgtttgtttgcaagtaaataatgattcttgaaggagtgaaacacatgtctgttgatgtttatcttaactttaatggaaattgtcgtgaagcagcggagttttacgcagaggcatttgggactgagaaaccacaaatcatgacgttcggtgaagcaccacccaatcccgattatcctctccctgaagaagccaaaaatttggtcatgcatacgcgccttcaaattgatggtagtaatgtcatgttctcagacgtttttcctggtatgcctttcgtagccggaaacaacatcagcctcgccatcgtcaataaggacgaagagaaaattcgatcgtactttcataagttaaaagaaggaggaaccgtaagcatggaacttcaagaaacattttggagtaaatgttacggtagccttaaagataagttcggaattgaatggcagttaagctatgataacggaatgaccgacagttagtctgttatattaacctacgacagttaagccctcacaagctattctgactgaatgctttgtgagggcttaatattagcttgaagttactttatacagcagccttagaattcttccaagaccttgaatttgtctccatgaatcttatccaagtgatcctctccccagtagcataaatggtctagcgcgggttttaatccccagccgtagtccgttaactcatactccactttaggagggacttcattataaacctttcgtgtaacgatctcatccttttctaggcctctgagctgagtagtcagcattttttgtgtaatgccgggtattaaccgacgaaactcagatgttcgtttccgtcctgtcatcagatggtagataatcaaaggcttccatttccctcccatcacctctaaagccgcttccactccaacttgatacttcttttgaaccctattttttatctgttcagtcatttcttaatcctcctttagaaggcttcgtttgctcagaacaaccatcacttcaattcattactcagatcagtttctagggaatctacctagggcacttccatgttcctatggcacctgtatcatcctatagaacttgaaagtgcgtacttccagattattttcctactgtatataatagcatctagcattgagcattcctagaagtaagctattgagaaaggtagtgaagaagcatgaaagtattaaccgttgtttcacacccgagaaaagattccttgacctttaaggttgctgatcgtttcgtacagggtcttgccgatgcaggccacgattatgagatattggatttgcatgagattggttttgatcctattttaaaaggagtcgatgaaccggatttgacagttgcggaacagtccttttcccctgaagtagaaatggaaatgaggcggatgaaggagcatgatgcattggcatttatttttcctctttggtggtggaatttgccagctatgctgaagggttatattgaccgtgtatggaacaatgggtttgcgtacggttcgaattacctgcatcatcagcatgtcttgtggattggcttggccggagtttcgaaggaacagatgaaaaagcgtaagtatgatgaaatgattactcatttgctgaatgtgggaattgcagattattgcggggtttccaattccaaggttgaattcttatatgagaccctgagttcaaattccgatcattttgaaatgctgctggaccaagcttatcacttgggtttgaattatgccaaggattaggctttatttacaatcctcacccttcaagacgaaggccggaaatcctaacagaatgtgagaaagaattgttttttccacaaggagacctaagtagtaacaaaaaaaagatactaacctagccattttttctatggacatgggttagcgtcttttcatttatttgcatttaactggctttcgacagcaagtaaaggaaataaggggtgaccagtatggtgataataattccggttggaatatctgccccaaaactaatcgtccgagtaagtgtgtcagcaatcaaaataacgagtgcaccaactaatgccgtcgtaggtagcaatagcttatgattgggccctactagcttgcgcgctagatgggggctgaccatgcctacaaaaaagaaatttccgccaagtgccacgctaccagaagcaagcgcaacggcagcaatcgtcaagccgataaactcccttttaattgctacgccgaggcccgatgctgtctgattccccaaattcaacgtattgagtgtgttagacctgtaaaaaacgtaaatacagatgataagcacccacgggagcagcaccataatatagctccagtcgtccccccacaggtctccagcctgccatctcaaagcaaagtcatactgttgcttgtctagccggagtgtcaacatcagagataatgcgctgtagccactgcccatagcgacaccagttaaaattaagcctgtaggcgagatgtctcttccccgcctgaaagcaaacataaaaatcaaaaatgctgccgtaaggccgcctgcaaaagccagcccaggaagaagaataggcgatagcaatccttcactagcgaacaacgtaatatacataagtacaaataaccctgagcctgagctgatgccgagtgttcccggactggccatgtcgtttttgagcaagctttgcataatacagcctgatatccccatgccaatacctaccaatatagaaagcacaatacgtggcagtcgaaagtcaaacacgattaggttctgtttgctcgttccttcgccaatgatgaccttgaaaacttcgagtggagttaggttcattttcccaacattcatactaagtacagccactagcagcgtcagcactactaacagtaaaataatgctaatccccctggtattacgggacagtttcaactaaactccctcctctgcttgcgcacaaggtagagaaaatagggtacgcccaccaaggcaaaaataatgccaaggggtgtttcgtgaggacgattgatcagacgtacgagtaaatccgccgccaacagaaagactgctccatacaaagctgaggccgggataatataccgataatccgttccgaccagatggcgcataatgtgtggcacgatcaaaccaacgaagccaacagggccgaccacaataaccgataaccccgttagaattaatacaattaaggttgaaaacagcttaatcctgtttgcacgaatacccaagcctgatgccacatcctccccgaagctcaaaatcgtaatcgagggagaaagcacgatggcacagatcaaacccactacaaacagtggcgcaatgaaagctaattcaccccacttggcactggctgtaccaccagcagaccagtaatcaagggcttggccaatctcatacttaatagcgataaacgtactaaacgcaccaaaaagcatggagatggacattcctgccagcaccagtcgctgaggcgtcattcctcgcttgcctatagatgcgatgtaatacgtaatgcctgtagtgattgctgcacctagacaagaatacagcatggtttctccgtaggtgcgaccaggcagaaaggccatacataacgcaatagcaaatgtcgagccagaacttatgccaatgagtcccgaatccgctagtggattacgagtggttccctgcataattgccccacacacagccaagctgcaccctacaatgatatctgccacggttcgtggaaaacgcaaggtgtgaataatctgatgttctgtaatgttgggatcaaactgaaatatagcaccccatgccagcttcaggctcatttccgcagcaccaaaggtaatagatgctgcggtaaccagcaggagcaggaacacgcccacgatcatgtagcttacaaaatgaaatattccttttttatttggctctttgtgagtagacatcgagtacacccttagttggtcaattatgcatcgttatttagtctgttccagcaatttgctaatcatataatctagctgtcccgtcatactagcaacgtccgaataatagaacagtcctgcatatttcgctggaatttcgatgatatgtccgtttttaacggctggaatactgctccagatttttgtcttcgcatattcagattccttgccttcctgcttaaaccaaaggacataatctccaaagtattctgcagctacctcgtaggataaagaaccccgactctctccagaatttttaaccaatgtgttgagcttttccggtttgtgaagtcccagataattgtaaagcaacgttcctccacgtgagcctgtttcataatatattccgtaagagccactgccccaatcctcgaaaatgctaaacgttttgtccttgaatatgtcggaatttagtttttctttggcctgactcagcttgctttcaaacagtgaaatcactttgtctgcttctgcttcatgtcctgtggcctgaccaaggaatttcaaacgttctatagaggtcattttatcctcaggtattacaagaacaggcgcaattttagacagcttatcataatcctttgtatcatatgtaatgatgagatcaggatcatacttcataatttcctcagtttcccacttttcaatattgggaatgtcgttaaacttatcgtaaaaaggcatcgtttcttgtttccaccccatgactgcggctggcttaatccctagtgtaaatacatcgccaacataccagttcacgactacccgttgaggattagcgggcaccttcacgtctccttttaccgtagagactgtacgcgtatcagaatcactgcttgcctcttccttcgcggacgacgcgggtttagcagatgaatcagaggaactgccagcattcccgcaacctgaaataacgaaaatcactacgaatagtgcacataaaatcatgtgaaacttcttattcatcatacgatgcatgttgtaaatctcctttgaaatatagtaagtgcaaaacatacttaaaatcagtgatattgataatcattatcactgatatcaaattgtaaattttacctcactgattgtcaactgtttctttaagttttatgtttaatgggttctccagctcccctcttctatttgcttcatgccattcctgatagattcctccaatttcataaaaagctttgttcattacagttgtcagctccttcatgatctccttggtatattttaaatgagtatttatgttatccactttatatttgcgaagcagatttagatgagcaatgatgtgaatcgtatcttcgataatccaataaatcacatcctctacatctttcgtaagcttgtttagcatctgtatgcctctttcatacatctggagcgtataaccccgcttgcctacttgcacatacggactaagatcatcataaaaatccgtacggaaaggtcgtcttacatattgctcatactgctcttcatatattgaagtttgttcaagcagcttaatagtcatatctatgatttcttgttcactgtatatttttttcatcagattttcccttgcctttctctactaaataaattcaagtcatagttaaattagaatcacaagtgatgcaataagaagtcaaactctttttttaccaaccattaacaattttgtttgatgcaaacgataattagaatagagggatttccctcaatatatccaactgaaggagacaggcgaatgaatagagtatggacgaaagcatcggctattttattggtagtaatatccctgatgttcaatggaacgtacgcgctcgcagcttcagcaacatcaacgtatatcgttacgtttcaacaagcaaccttggtatccaacgatcacgtaggcaacgaatgggccattgctgcccaggtggcgggccaatccattagtgaagacaacagcgtaaaggtaaaggtcaaatcagggggcagcattaagctctatgcgtatgccgaggaacaagacaaaattcctgatgaaggtgaagccaccaagaatgtaaaggtctcctctgtttctgccaaaggttctaccgttaagctaagagtgacggttactgaaaaccgtggacgttactcaggtcatcaagccgtttgggaatttacgtataagattaagaaacaataatagaaaaaatagaccgtcactcccaggaggggcggtcttcgcttttacaagtcgcggtaactgggcacataccatttcggtatataggtttgaaagtaatcatacgcttccaaaacctcttcagctcgttgcaccatatcgtccacctcttttttgccaaatggaatggcccagtgaaccgatgaaagctgattgcttgcaatatacagagccattaatctaaaaaataaatcaggtacatggttattaaaataaccgtggatacggcccgaagcgaataaaggacttaacgctgcacaccaggtaattctattgaattcctcccaaggatcaccataatccattctattaaaatcgatgatacccagttcaccggatggggtaaccaccatattgcccacatgataatccccatgctgaaaagtctggggacgattttctaatagctgacgattttgctcaataaagcttatggcttgatctgctccctttaggggaataccgcatgacttatagtttgtaatatatctgtttattttgccattataatgttcaccccatgggactcgatcttgctccgcatgaatctcatgcatttttttcaatgcatctcctgcttgaaccccgagttgatactgttgtgctgcggtcaacgtagggataatctcttcagcatctttcccttcgatccaggtgaacagggaatatacagattgaccatcatgacaaatcccaaattcaagcggccgggacatgaacagattctccacgtggttcagctttgttacagcttcaaactcgcgcttctttttatcataatgaaccatatccgctattcttagcagcaagtccctaccgtcagtggtttgaatataatatttcttgtcactggaccagcctctatgaatttcttccacgtggctccacctgctggcacccggtatttcactaaagagttgattcacgctcatccccccacgttaaaatagccttacttactatatatgctttccatagtttaccttcgtaatgacagaggaatcaatcctcttccaggaaaaactcaaacaaaaaaggctgaaaagacaagcagtctcttcaacctcaatattcactgagttgccatcgtgaacacccatcacttgtattgtcaaatcagtaagaataagaaaactcatgtttaaattcgtctacccgttgaatggttttcagaatatttcgaccttcacgtgtgccatcaataatacgtcgagcttgtttactatccccgatattaataacttctacttgatgttctttaccatattcgagcaagctgtccatcagtggactgtgtgaacgcatacccaagcatacgaatccaagatcaaaaggaatctcaaactcctgttctccatgctttactttgaagcggtcgctacacacttctgtcaaagctgtttccgtatggacgttcacttcccgctcctctaccattttcatcatggaaatccgagtaatcatatccaggtctttacccagtaacggcatcatctcaataatagaaacctcttgtgctccacgctctgcataatattcgacgacatccagtcccacggctccgccgccaactacagcaatgcgtttaccttcaaattcctggaatttctccatgttgtgcaaaagatcaaagatggagaacacttttgtacctggtttaccgagttgctcatgtaaacctgcaatgggcggaagaagtggtgtggcccccgtcgcattgacaataatatcaggattcagagcactaatcatcgccaaatcggctcgggtccctgttacaatgttcagattggttaactgtttggtgcgctgaatcagataatcagggaaatcattgatgcgtgttttgtctggcaggcgggcaatatcacgagccaagccgcccaactctggtttttcctcaaagagggttactttgcagcctacttcggctgccgtacatgcagcttccataccagcggtcccaccaccgatcacaacaacctgaacgttattttttacacgttgtttccggtattcagcttccttgaacagatccggatttaccgtacagcaaattggtttacttttggagatacgatgatctgcacaaccaatgttgcaagagatacattttctaagcaaatgttcgtagccgttttgcactttaagcacccagttcggttctgcaatcaagcctctacccatagccagaagatcagcgtcacctctctccaaaatatcctgcgcaacctgtgggctccgaatattacctgaggtcatcgtgaccttcccgaatttttctttgaccgctttggccatatatgagcgccaaccatccggcaggttcatcccgtcaatctggaactggatggaatcattcagagcagcagaaacgttcagaatatctacctcatcattaagatactccaataactcgagtgtatcttccagtgtgttcccaccttctgtgaactcttccgcgctaaaccgtaagcaaatagggaaaaatgggcccaccactgaacgaatttcatcaatgactaatctggcaaaacgggtacggttttctgcgctgccgccaaattcatccgtgcgtttattatacatcggcgaaagaaactgactcagcaagtaggagtgtcccgcatgaatttcaacacagtcaaatcctgctcgttgtgctcttcccgctgcttctccgtatttgcgcacaatggcgtaaatttcttctttttgcagaggtcttggaatcactccgccctttttagaaggaatattcgaagaagatacaggctgaactccgttcagtcgtcccgcataagccgaagcacccgcatggttaatttgtacagaaacacaagctccataagagtgcagggcttctgttaatctaaatagtccgggaataaactgatcgttatccatacgcagctgggttgttccgttcgtacccattgggaaatccagacaaacattttctactgttatcaagccggtaccacctttggcccgttgcacgtaatagtcaatatgatcctgaacaaagcttccgtccatggcagcaaagttagttcccatcgggggcataacaatccgatttttcaaggtcatgcgtcgtatggttagaggttcaaagatagcaggatagtggttcattgttcttcctccttgcgagtttacaaatttcatgttaaagcttccattaaagcattcacatatgtgatttttttcactttcgggaatatcgagatgttattgagtacgatcattccttatgatttgattttatatcatctaattcataaattctaatgctattttatgtagtgaatcatagtttcagtctatggattaactggattgagacataaaaaaggaacaaacctgtgaggaatgtcccttttgtgtgaaaaaatcatgcttttgaaaccgttgggcacacgctccaaaatcccctgcccgaaaagccggatgagtccaatgaaaggaaacacctcagcttgacgtcaagggagacttgtctatccgtatacagattatacttttaaatcaccatcataggtggcaatcatattgtacagttcaggacgacggtcacggaaaatgccccattcaatccgtcctatttccagctcatccagatcaaattcagcagtaagcacttcctcatcggtacgacccgcttctgcgatcttgttaccttgatgtccggcaataaaggaagaaccgtagaatgtaatactggagtcctcgtctgtttcagttccaatccgattggaagcaatgactggaatcagattggaagccgcatgacccagcatgcaggtctgccagtgatccttggaatcaatggcagagtcctgcggttccgagccaatagctgtcggatagaacaaaagttctgcgcccatgagcgccatacagcgggccgcctcagggtaccattgatcccagcacacgcctaccccaattttggcataacgtgtattccatactttaaaaccggtatcgcccggattaaaataaaatttttcctcatacccaggaccgtcagggatatggcttttgcggtatttacccaacacttcaccgtccgcgtcaatgacagcaagactgttgtagcgcgcgtagtttttcttttcataaaaactgatgggcagcacaacctgtaattccttggcgatcttcttaaaatggttaaccgccttgttgtgctccagctcagttgcatatgaataataatcagacttttccttctgacagaaatatggagtctcgaacaactcttgcagcaaaataatttgtgcgccctgcgctgccgcttcacgtactaacttctctgctttactaatattttcttcgatattggtagagcagctcatttgagttgcagccacttttacttttctcacgttagtcctccttttagatgttgtatcattcaacgctttacagcaggcatctgctgggtcgtacagtgcacgttaccgccttcacggatgaccgccataccgtctacagtacgaatggtgcgatctggaaatacatttgccagcacttgctcagctgcaagatcgctcttagcggcagtaccgccaaacaccggcaaaataatgccgccattcacaaagtagaagttaatatagctcagtgtcaatcggctatcttcataatccacgcgcggcggctgaccgatccgaatcacttccagcttacggccttgggcatccgttgcttgctccaaaatacgcagattttcctgcgtgatttcgtaattttcatcctcaggatcatcacatacttgcataatgaccttgccaggagctgcaaagcaagcaatattgtccacatggccatctgtttcgtcgccactaagaccacgttttagccatattattttctctacacctgtatactcacatacataccgttcaatttcttctctgcttaattccggatttcggttgggattgagcaaacactcttcggttgtaatcagtgtgccttcgccgtctacgtgcagtgagccgccttccatcacaagcggtgcatcaaaccgtggaactccaagttggtccaaaatttgcggcgcaacctggtcatctagatcccatggagcgtatttgccgccccaggcgttaaacttccagtttacacctgccaattgaccatgctcgtctgtgagaaaagtagggccgttgtcacgcagccacgcatcgctgtgctcaatcggcaggagttctacccgttccccaagttcaagcgccttaacgctctccagatcatccggatttacgaccacagtaactggttcaaattccgccatggcgcgtacaattccggcataccccttgcatacatcagcatgcatatctgggtaaaccattgaagattttacaggccaagaaatatacgtgcgttcatgtggcgcccattcaggcggcatcttataatgtgaatccttaatttgcatgtattgaagctctctttctttttcataatgtagactccgctcctatcatacaataatatgatctttgtctcaatcgaagcggaaaagttttaataatttacatttacattggaataaattactttgaaaacgtgattgctttcaccgtattcccatcaaaatccttcacagtgaattgtgctccctccagcacaccgtaagaggatggatagttttcttttggcagcgagatcgaaccggggttcagtataaagaccccattttccacatctgctaccggaatatgagtatgtccctggatgaacacatctcccgcttccagtggtggtaaatttccgatactaaagccatgtccgtgcgtgacatagattctccgtccttcatggtgcaacaaagcataatcacccatcataggaaactccagtagcatctggtccacctctgcatcacaatttccgcgcacagaaaccgcaatatgggacttgtacttattcagcagagctgccacttctgccggattatacccttctggtaacggattacgtggtccgtggtacatataatctccgagcagaacaagacgatcggctttctcctccctgtacttttccagtgccaattgcaaccagtgtaatgagccgtgaatatctgatataaacatcaatttcatgattgttttttcctttctgaataggctaaaaatattccacttaagcacattattgcattattccctgaacaaatctgtgcaaaattgttcttttgtttggtaacactctatcagttgtcttccccagtaaagttttgatgagtgtttctcgttcttcgatatttctaggatgaagctgattatattcgtggcagagacttttggcgtataaacgttcttcaatcaactcttcagaactggaaagctactcacattgaaatttccaccaaattaccttctggatctttaattacgctttcataatagccgtcacctgtcaatcttggctgacccacaacttcatatcctgcatgcatgagctgctctgtcttttcattcacccgtgctttacttccaacggaaaatgccacatgagcccagcccgtaatatttatctgtggtgaatgatctactcccgttttacgcataacctctaaccttgctccatcctcaaaggtgataaaataggactcaaatccttttgtagcgttataatatttatcgttagattttccatcaaaatattgttcgtaaaagcttttcatcttttctaagtccctcacccagatcgctacatgctcaatcttcattattttcctccttctgctgccctcatcattaaaaaatcattaatttatactggactcaatttttagcatagttattattaacgttttaataagtctcaatatatctcagtaattcatttttgtccaatctatttatcatcaattatcaataaataacgcttacgaatcattcatgaaagctctttcgtcttcagcttgtaactcggttgctaatacccctaaaaaattagcgaccgcttcgtaaaagagaagaaacggtcgctatctataagccttcattgtatatttaatacttaatcactggtttatttataaattaacgtttcaagctttcaccgttcgtagcaataacttctttgtaccaatgaaacgatttcttcggatatctttcaagtgtaccgctgccatcatcatgacggtctacgtaaatgtagccataacgttttttaagctgagcggtcgaagcgctgacaaggtcaatacatccccaagacgtatagcccaaaacctctactccgtcctcaatagcttctccaacttgaaccaaatgatcattcaggtagttgattcggtagtcatcctcaaccgttttttcgcctttttcattcgtgatcagttcatcaacggcgcccaggccattttcaacgatgaacaatggtttttggaagcgatcatagaacgtattcaggacataacgcagaccttgcggatcaatttgccagccccactcacttgcctcgagatgcggattgatgacaccaccaaggatgttaccttcacctttgacttttttagcttcgtcagctgtctcacaagtactcatataatagctgaacgagataaaatcaacggtatgcttcaaatcttcggcatcacctggttcaaagtgaatagaaattccgttttctttaaagaaacgtttcatgtaacctgggtattgacctcttgcgtgaatatcggcaaatgccatgtttctgtgatcaaattccatcgcagcaatcacatcgtctggattaggtgttagcggataagtaggcatactcagcaccatacagccaattttgaaatcagggttgatctgatgaccgatttttaccgctcttgcactcgctacaagctcatggtgaatagcttgataaagatcttgctcactaagttgatcttttggtgtgctaattcctccactcatgaatggtgcttcaagaatggagttgatttcattgaaagtcaaccagtatttaactttatctttgtagcgattaaatacagttgtagcatagcgctcataaaaatcaacaagcttacggtttacccaaccatcgtattctctggacaaatgtaaaggtgtttcatagtgagataatgtaacgagtggctcaattctatatttgtgaagttcatcaaacaaatcatcataaaattgcaagcctttttcgttaggctccagttcgtcacctttagggaagatacgtgaccatgcaatagaagtacggaatactttgaagcccatttccgcaaaaagtttgatatcttctttataatgatgataaaaatcaataccgatcaacttcatgttatcttctgttggtacatccgtaacgggcccccagccaccacgaggagttacatcctgaatggaccagccttttccatcttcttgataagcgccttcgagctgattagcagcaactgctccgccccacaggaaatcttttggaaactgtgtactcatattttctccgcctttgctgatgtttttcattaactagatagaaatacgttacctctatgctaatgtgttataagtacttctaaatgaatcttaaggtttgtaacgcgtttcatgtcaagtattattttaaaaacttctagagcttataactgtattatctccaataagtactcccctatttataactcttctattgttgagtaaaatggctattcttcaaatggcggatctacatgaatatctctatctggttcagtgcttacccagcgtgtaaagataacctgaaagccggctcgagtcggcgcacaggcaaaaggacccgcctgttgtcccgtttcataaggaaaacgtgctacacgtacggtgcgccatctttgattttcggttcgtgctctaatgataactgcatcctgtagctgtgaagcacgaatcgtgacatttttccctacccattcaggtacaggagctaatgaccaatcggaatagccatctgtaactacgacagctaattgaggaattccgtcatttaattcaatcccagctttaatccacttttgctgtccttgatacagcattataccggcctgatcatagagctccgtaaatgagcctaattgaaacgtgacttcgatggctgagccttcttcccagtctgtaagcagtgaatgtccgctactgcgttcaaatccatacaaagttttttcccagtagtcgcttccttctctggtttcaactttaagaaactggtcttcttctatggatgatacagggtgattagtccatgttcctgtagtccatgcaattgatttttgagtcattgatctcatcctctcatgctttattgaacgatgtcctatttccttttctccaccaattgcaaattgtacgtcagactttcaagggtcaccgaaatcaacccatacatatattcatcatgcgtatcgtttttcacaaaaatctcgggcatatgttctttgggtacatcttttagacagccgttataaatatcatccaacagagtcggcttggataactctccagtcaaagcgatagatacagggtctataattgcaataatggaagtaatcgtttggatcgccagaggaacaaatccctctgtgctatttaactgtttaagctgttcctctcttgttaaatcaaagggtaagaaggacacctcccccgcaaacttggtatttccttttaacaaatgtccgtcgacaataaaacccgctccggggaaattgtctttgggaaacgaaacaatagcaaaggttttatcctcatcataattctgcatgttataaaatccgtagactgtcaaatgcatatcattttcaatggtaacttctaatccgtatttatcttgaagccgtggacctacagggactcctatgagcaggtcgagatcgcaaacatcgataatcccttgatgaacaaccccaggtatgccaatcccaatggctttgacgtttccatagttattaatcagctctccaatttgggtttctatgacctcataatcaatatggggcactatggaagtattctcgatgatgatatcaccaagcaaattagcaacagcataagtaagagaatgtataccgccttccgttttcacatttaaacagataatatatgaataatcagcgttatatttgtaccgtctagctggacgtccgccgttcgattcttccaattccgtctctaatacttccccggtttgaagaagctcattcagaatatttccgcaggttgccacactaagacctgtgatactggctatggatgacttggttgcatattccttggatttcagtgtgtttttaactaactctacattaatttgtttaacccgaatggtattattggagactggttgtatttgaatacactccttttccagtatttattaaaaggtttataataagttgtaatataccgctctgcctgcaaaaagtcaatttgtacgcgtcttcctcttctcctctatcatcatgctatactataaataagaaacaaatttttagtgcgcatctttgcgatgaaactaagtgaattaggagggattctgttgtcagctattgagtatatagcaataatcgcgttgctcctctccgtcatactttttattaaggtctatagccttcaatcgcgtcttaatgacctgaaatccgacgtggagcgtcttgaaaatcgttcaggaatacaaggaacatcgctgtcaggtactattgctgccactcctacacatgttctagatgcaggagcttcagaagatatcaatgaaaagttgctcctgctaattagggaaggaaaaaagattcaagccataaaagagttgagaaccgctaaggatctttcccttaaggatgcaaaggattatgtcgatcaattggaaaaactctaaagaaaggaagaaataagatgagttccagcaaaacaaacgccatgcgcatattggatgggcaacacatacaatacaatattttgagttatgatcatcaagacggaaaaatagacgggatgaatgtggctgagaaaatagagagagccccagaaatggttttcaaaactttgattgcacacagcaaacaaaatctgtttgtttttgtaatccctgtacataaagagcttgatctcaaaaaagcagccaaatccgcgggagagaaaaaaattgaaatgcttccagttaaggatttgcaaaagtatacgggatatattcgcggtggctgttcccccataggaatgaaaaagctctaccccacttttatcgaccagcctgcattggaactggaagccatcgttgtgagcggtgggaaaattgggacccaactggagttgagtccacacgatttagctcaaatcattcaagcacagtttgcagatctgacgcatacagcataaaactcaccacatgatcataaaatctttatgcagattttctctaatcccttgcttcatcaagcttcaacttggagaggaagatctaatgatgcataatgattgcccgaaaaatgtaagaatcccccaacccatcagaagcgatggtgctgggggcatcgacaagggcccacgtgatgtgatgagggatctacaaaatcccgatatgctggttccccccgtaacggacaatggtctcattccgaatatgagattttctttttctgacgcccatatgcagcttaatcatggtgggtggtcaagagaagtaacggtaagagaattacctattgccacaacccttgccggggtgaatatgagtttgacgccgggaggtgtacgtgagcttcactggcatcagcaggcggaatggtcttatatgctgttgggaagtgctcgtattacggcagttgaccaaaatggacgtaattttattgctgatgtgggtcccggggatctctggtactttcctcctggcattccccactctatacaggggcttgaggatggctgtgaatttttgctggtttttgatgatggcagcttttccgatctgaacaccctatccatttcggattggttcgcacatactcccaaagacgtgctttctgcaaattttggtgtatcagaagctgattttgcagcaattcctcaagaacaagtatacatctatcaggattcaattcctggttcaattcaaagccaagcggttccctctccttacgggacgttgccccaatccttcaagcatgaattactagcccagcccccaatcaaaacaccgggcggaagcgtacgaatcgtcgactcctctaattttccgatttccaaaaccatcgcagccgcccttgttgagattgagcccggagccatgcgagaaatgcactggcatcccaataatgacgaatggcaatactatcttacagggcaaggacggatgactgtctttggtggtaatggcgctgcccgcacatttgattttagagccggagatgtcggatatgtgccctttgcttatggtcattacattcaaaatactggctctagctcattatggtttcttgaaatgtttaagagtgaccgttttgcggatgtttcactaaatcaatggatggctcttacccccacagaactgattcagagtaatttacatgtaggtgttgatgtaatctctaatttacgaaaggtaaaatggcctgtcgttaagtatcccgggtattcttatgaccctaaaaagaaataacgggaacaactttgtcatgattatttccagctatccccatggctcagaacaaactgctcgaatgatatcggacggcgcccagtgacacgctctacggtatgagtaacttgatcttcacttccattttcacgtatccttctatccaatcccgccagcatatctgcatattcttcaggcattccagctcgaaccatgcccgcttttagctcttcatcaggcaacgagatatgctggattgcttggcctgttaacttcccaataatcttaccgacttcgccataggttagtgactgaggtccagtgatgacatgagctatgttatgtggtttatcgtcaatcagagctcgtactcccacttctgcaatgtcatctgcactgacaaaacctactctcccttctcctgtcgcactataaatcgtgctggtgtttttgatggtacttacatgctgaccttctgtaaaattctccataaagtaggatggctgcaatacagcccactctggagctaatctacgtagtgcttgatgcacaggtccaaatactggtccgtcctcaggcacagatgcgctccctaacagcacaaacctttgcactccttctctcaaggccctctcaataaaaggaatcatcactttggcgggattgacatccagcacaggtactaccaaataaattttatctacattcatcagcgcctgtgcatgtgttgattcatcataccaatcaaaatatacataatctttcccttcccattcggcaggatgagcacgtcctgccaaacgtaccggatgctgaagttgcgtaagtctggcggctacacggctacctgttttgccgtttgctcctgtaatcaacgctatatttctgtctttcatgaaattcaactcctatttaaattttttgttttcgcctagatatccatatccctatgaggcttgaactctttcatttatgattccagggcttcaagagctactaaagggttccagtaatctttgtagtgaataatttttccgttcttcagcttaataacagaaatgtaggtttgattatacggtttacctgcgcctcacaggcgaactcggccacgaataaatccgggtccgttgtcgtatggataattggtgaagagaaatgctgaatccgaagtatattaggaaactccttaatgtactcgtaaattgctgctttgccctgaagcatttgtgcaaaatgcttaggtgcataagggaactcgaaaacagcgttatcatcaaataatgaaatccattgctccatattttcttctaacaggttgctcgtaaatttatgcatgactgcttgcgcttgctgttttacttcgtcagtattcggattgattgtcatggtagacacctcgcaaatatatttttagttcctgcttaaaaaacgaattcaagacgctaaaataaacataagcattctagattgaacagtctataatactcaaaaaaaatttgaccaatcagtctggaatgttcaaaaaataaacgctattaagcgttcataaagatcaatctaaaatcgacagcgttgtacgcacaatatctctaagcacctcagtgctcgcgcctgtcttggcggtaaatgtcaacgatagtcgggcatgatttagaaatctggcgattgacaatagctcagattccgtagcatgaatctccccttctttttgggcgcggactagggcgtcgtaaaaagcaagttcaagcttttctgtgttttcagaaataaaagctttgatctcatgatgatgcggagcctgttcaatagcactgttcataataaagcattccttggacatcctcttatccgtcaacactctaacagattcattaaaaatcatcgctattgcatccttaatgctcccaggttgactgagcagatgaactacggcttcggtcttgtcacgtatataaagctgaatagccgaaaaaaacaaatcatatttcgttccgtaggtatcataaagactctgccgcgctatacccaactgatccagtaaaattgtcagagaagttccctcatagccatgctctccaaatacagccatagcttttcgtagaacactttcagtatcaaattctttagctcttcccaaaccttatgttcacctccttgcctatgattataatttttgcagactgatcagtcaagaaaataaaattgattttttataagtttatttacaaaaaaaaccatcgtaccgaaatacgatggtttaggaatgtttattttatacaaacgctcagatgtaaatgatgcaatctgactattcgtcagagtctacattatggtaaacctgctgaacatcttccaaatcctctaatgcatcaatcaatttatcgaattgaccttgtgcatcttctggaagagaaatatcattttgagcaagcatggtgagctccgcaacggtaaactcagtcactcctgcttgtttgaaagcttcctgcacagcatggaattgatcaggctctgcatatacgatgacggcttcatcttcttcaatgatgtctcgcacctctacatctgcctccatcaacagctccagcacttcatctgcggttttacccaccagaccaataactgctgttgaatcaaacatgtaggctacagatccgctcacacccaggctaccgccatttttagtaaaagcagaacgcacatccgatgctgtacgattaacgttattggtcagtgcatctacaatgaccatggaaccgttcggtccgaaaccttcataacgaagctctacgtagttttcatcgccagcaccttttgctttttcaatggcacggtcaatgattgctttgggtacattgtacgtttttgcacgttctaaaacgactcttaatacccgattggattcaggatcaggttcgccctgtttggctgccacataaatttccacgccaaatttagcatatatacgactcgtattagcatccttggatgccttcttttctttaatgttattccacttacgtcccataatatcccgctctcttcctgtatgaatatacacaacgaacttcattatatccttgtatattatatctcctaaaggacatacgaacaagttcaaacaactccgttatggaaaaataaacaattctacctaattaggtatgcttgaaaatgtgaactttcaattctcctcatctatggacaatccccctatccatgtctaagatgaggaggaagtctgacttgaaggagatcatttaattggatgtcttgtacaaaaagttgagccataatcatgaaatcacagtatacgaaaccaccgagctgtacggtgaaaaaggattatttcgggtgatgcagttttcaaatacagccatccaaggcgcgctggacttgaatcatccgcaacgcattctgttcgaatatccgagagcaatcatccatctcatggaactgaacgatccgacatttgaagacgtgtttgttattgggcacggtataggtacaatagcgggccattttacagataaacgctttaggattgccgagctggatgcacaagtcgtagagttcagccgaacattctttggatacgatcaggataatgtaactgttggcgatggacgacgcattctggagaaggaagcgcctgatgcttatgactatattattctggacgccttcacagagcagggtacacccttgcatttagtatcctgggaatttttcaagatggccaaagaaaagctggattccgaaggctccctgatcatgaatttaatgggcaaaagtgaacacgaccacctgatcaatgccattcacacaacgttgcgtgaagaattcgcctatgtcacaactttctcgctcccctcggacggcgctgccgacattcaaaatatcattatggtaggtcgggacaagccaatccggtttcaggcacgtcagatggcggactttcatgagattacacttggagaaggccatattctacgggatacagatgcttagcgtagttccaatattcgtctctctacatcttcgatatgaatcgtctctttgttgcagctttttcgttccactaactctactttcccgtgttcggcatctttaccaacgacaatgcgcacgggaatacctactaaatcagagtctttgaatttaaccccgggccgttcctcccgatcgtccagcagcacctccacaccgtgatcctgcagttggttgtataatttctcggctaattgcatctgaagcctgtctttcacagaaatcggaatgatatgaacttgaaacggggccagcgcatgaggccatatcattccgttctgatcatgattttgctctacaatggcagaaaggattcgggaaacgccaatgccatagcagcccataatcatcgtttgctccgttccagatgtatccagaaaagtcgcacccagcttctcactatatttggtgctcagtttaaatacgtgtccgatctcaatcccacgataaagttttaattccccttcgtcacatcgaggacatctatccccttctatgacattccgcaagtcagccacatgccgaagatctatatcgtgccttggattcacatgtcgataatgataatccagctcattcgcgcctgcgataccgctggacatttggacaacggcgtaatctacccacacagggatcgtcaatccgcatgggcctatgaaccccgagggggttccagtcgcctttgacacggtgtctgcacttgctatttcgaatttttcactacctaaaatatgtttaactttcacttcgttaacctcatgatcacccctgacaactacagcaacaggttgatcgtcagccatataaatcagtgttttgatgatttcttcaggttctatgtgaagcgattcaaccagttgatctattgtacgtaggcctggagtatggaatttttccattttagctgtatcaaaagaaggatggctgacatgttcattttcatctgagactggagctatttctattttctccgtcgaccgcgccacggctttttcaagattagctgcatattcacagcaggtgcatgctacaatggtgtcctctccaatatcagctagagccataaattcatgggtttcaccttcgccaccaatggcacccgcatctgcttctactgcacgaaaatacaaaccgcagcgggtgaaaatgcgctgatatgcctggaacatagtccaataggtatgatctagtccttcccaatgtgcatcaaacgaataggcatccttcatcaagaattctctgctgcgaagcaggccaaatcgaggacgtcgttcatcccgaaatttggtttgaatttgatacagggttacaggcaatttgcgataagaattcacttcatttcgtattaaagacgtaataacctcttcatgtgtaggccccaatgcaaactctcgatcatgtcgatcttgcagacgcatcagctcaggaccgtaaacatcgtatctccctgattcttgccatagctccattggctgcaatacaggcatcagcaactccccagctccggcgcgatccatttcatctcgtatgatttgctctacttttctgagcacccgtctgcccaatggcatgtaggtgtacattccagctgccagttggcggataaatcctccccgcagcataagctgatgactgatcacttcggcctctgcgggtgcttcacgcaaggttgtcagtaataattggctttggcgcatgtgtagctacctccttgtatggacgataaaatgtacgcaaaaagacacatccgtcagggacgaatgtgtcgtggtaccacccttaatttgaccgtatccatacacggaacggtccttcatcagataacggcgtctagccggtgacggtttatcttacaaaccgctacagctcgcaaggcagggaaacgttcattcgcggcgagaaacctttcagcccatgagtttcttctctgtacagcgggtattgaacctttgatccttggtctacactattcctatatattacaattttcaccactttacacgaaatgtaatttctagtcaaggagataatcgtctatctgagatcagccagggacatgaacgatatttaattttcaagataattaaattccgttggttatcctattgcataatgagtggccagactttagaacggatacacctgcgaaaaccaagaacaaagcggacactaccaaagaacctccctttaaaagcaaataaaggaggcactgtggcagaaaaagaattacgtatttcacgctgtccatcagacaacatgctccttttaccaattattacttatgtatcttcctttttaaaatacacacccttgaaaaacacaaaattttgcgaatgtgtgccatatagctcctgaaacctagaatggagtttattcatagaaagggtctctgaaaccgtccgatccgtttgcagggtcaagtcgacacagctaattccaaattggcacacttgctccataggataaccttggatgattccataaatcatcccggcaataaaagcatcatctgcgcctgtgacatcaatgacctcttgaacgggatgcataggaatttgtccatgagttccatcctgagaggcgtacaaaactcgatcagcaccgcagataaaaatgacattttgaaccccaagtttgtgaaaaatccgggtggcatccaacatatgctgatcatctgtaagttctagccccaaataagcttcagcctccaccggtttacataccagccattccaccccatgcaaattccggggaagctttctcatcttggaggccgataccgaagaaacgacaatcggaacccgatgttcatggcagacatgtatggtggctgcaattacgttcatagagaaattagtgtccagcagaacgagtcgggacgaggcgattaaaggagtattttcataaattactgaaggacgaatctgatcataaatctccatttctgctgtcgctacaatcagttcaccacgctcattcagcaaggcagtataaaccccagttgacggttcacctttgacttgcagaggaaccacgtgcatgtaacggctggactgttcaataataaattcaccttccgcatcgtccccaaccgcagttagcaggctgacccgttggctcaacctccctaaattttcggctacatttcgtgctaccccaccgcaagattgcagccttgtactgcttggattggaggtatgaagctgaaatgtacctttaatcatgattttacgatccagattggcccccccgatgcatagtattggtttgctagagggccaaggctcgtcctgttcatttttgtggattttttttaatttcatgatttgactcctttctcgagtctattcgctagaatgatttaaatttgtacagaaataggcaccctataaaattaacacgttccaaatgtcaaattcccaagaataatgtcgagtccgttaaaatatccaaaagttacccatgcaaaaaaatcaccctatcgtaaagtttaccttccacttttacgatagggtgattgggttggaattgcagcatagttcttccttacattatgttattcaggatttttgcaaaatcctctatttcaaaataaatagagctgctccgtgaggaggtaaatctgcggacagttcttgtgttaaaacacctaaatctacatgattccacaaatctctggcatttgcctgtccttcaataccaaggtcttttaaggatacacgcacctttgaagcctgatctccagcattaaacaaagctgcgtatacatgaccttccccgttatgtgaagtccaaacgatatgttcatcctttctgtacacctgccgcgcattcaaaccgttgcgatgggcatttaacacttcttcattcgttaccaaggaaagggtccatgcatcattatcccgcagctctcccccgaacatcagtggagaccggaaaatgctccacaaggtcatcatcgttagctgctcatccttcgtaaagcgtgtccatcggtcatggctgccggaatccaccgaatctaccgaacgaatacccagatgacctagtggcagcatgtcgcaatccggccagtgacccggacctacatgttccgcccacttctcgcagcgctcaaacataccatacagtaaaggccatacatcccagaagtcatcagtcatacgccacatattcgcgtttgcaattaaatcagatgcatgctccagcggtgcaggaccaggtgatagactcagcaccaacggacgtccgcattgggcgatagcccgcctaatcaattcaatttccgccaaatgaataccatagagacgtgatgcagcaatgtcatctactttgacaaaatccacaccccattccgcatacaggtcaaacaacgaattatagtactcctgtgcgccttccttggatgcatctaccccatacatatctgtgttccagggacaaatagagttgggatgcgcaatttgtctcgccgtggctgtggttcccaaaatcggggtatcctggtgcaccgcctgacgggagatgcctctcatcatatgtataccaaatttcaatcccagactgtgtacatattccgcaagagcttggaagcctcgtccatctgctgccgaaggaaaacgattcaccgctggaataagacgtgaaaatgaatccatttccaatgggacgaacgggcgatactgtgaagaaactgctcctgactcataccactgaatatccaccacgacatattcccaaccatattccttcaggtgctccgccatatattgagcatttccccgtacttcctcttcccgtactgctgcaccgtagcaatcccagctattccaccccataggtggtgtatgcgctgtcaaaagatgtttcatttcattcatcctttcatctagtaaaactcaccctgctaccagaaatcccctcattactacgttactattataatgtaaacccttacttttgtcgctcgtcatcttttccatttccactttttatacatttaagttgactaacttaaagaatgtggtacatttaaaattgcttgttaaaaaactttgacttgaatcagagggtgattttacgtgtgtgaacatgcttatcgaattttgttgttttacaaatatgtcaacatagaagatcctgccacctttacggcagagcatctggcttactgcaaggagcttggcgtcaagggaagaatcttgattgctgcagaaggaatcaacggaacactgtctggtacagtagagcaaacggagcaatatatgcgtgatttgcgcgccaatccgaaattccacgatattgttattaaaatagatgagtctgacggtcatgcgttcaagaaaatatttgtacgccatcgtcaggagctagttacgctgcgtcatgaggatgaactggaccctaatgtaattagcggtaagcggctgtcaccaaaggagttttatgaacagcttcaagatgaagatgtagttgttctggacggacgtaatgattatgaatatgacatcggtcatttccgcggggctattcgccctgaagtcgaatcgttccgtgaatttccacaatggattcgcgacaatatgactcagttcaaagacaaaaaaatcctgacgtactgcaccggaggtatccgttgcgaaaagttgtccggtcttctgatcaaagaagggtttaacgatgtaggccagttggatggcggcattgtgacttacagcaaggacccggaagtacaaggacgtttgtttgacggtaaatgctacgtatttgacgaacgaatctccattccgatcaatcatacggatgaagacatcattgtcggcaagtgcttccattgtgaaacgccaagcgatcattatatcaactgcccggtgtgcaatctccagcatatcgtatgtccggattgcgaagaacagcatcagcactattgctctgatgattgccgaaccaaagcggaaaccgtcgctactgcataaatcggcagtatcattggttcattataataaaagggatgcccacagccatgataaacggctaatagggcatcccttttattgttttcacaataagtgtcgaaggcttcatagtatatacctatgaccttgattgtgttttcatcttggacgggctcgaaagtagcgccttataatggataatgtcattacagaaaggatgggtggaattcatgatacaaatcgtactttcaactctattatccgttatcgttccgctgtccattccagtgatcgccggatttttactcggaaaattcatgaagctggaaacgaaaccgctttcgactttgtatttatattttttaagtcccgccatgattctggacacgctactcaaagcacagctttcttggcatgatgtagcgcagactgccgctttttcaatactgaacctgctgctgttgtggggaattgcacaattagcggggaaaatctttagactgagcactccggaaacggctggacttaccttaatttccacgctgaccaatagtgcaaattatggcctgcctcttattttacttgcctttgggcagctcggtctggataaagcctccgtgtatgtcgtcatccagataatcatggtcaataccattggcgtttactttgcagcccgctctgaattttctgttcaaagtgctgttaagtcggtgttttcacttcctgcgatctatgcagctctactcgccatgggactgcggttgctggactggcatcttccctcagggattcagtcaggcgtctcgatgattgctgccgcttattctccggtcgtgctggcgattcttggtacccagatggcttatgtaaaaatattcaagctggagtcgtctattaaaaaagccagctacgccggactaacaattcggctactgatctccccgcttgcggcttgtcttgctatgctgatactgggaatttcaggccttttgttctccgttctcttcattctggcctcgatgccggttgctgtgaatgctgtcattttagcagaaaaatttaatgcatcgccaaaactggtttccacctgcatcctgtggagcacgcttgcctcattcctgatattgcctattttgattatgttggtagcaggttagcgagaaaaaaagactctctacaccatagagagccaagcacgattctgtctccattctacttgcacaggcgtttcaaaaaaagcactaagcgtttcactgcttagaatatcattcgttttacctttggcaaataccgtgccccggcggattagaatcgtatgcgtgtacatcggtagaatttcttcgatatgatgtgtaacatacagtaaattcggcgaagcctgcgactccgataactggcgaatgctatccagcaatgcttcccgggagaaaaagtccaaaccattacacgcctcgtccaaaatcagtagcttgggcgaggccattaatgcacgggcgataagcactttttgcttttctccctgtgagcatccctgatacaaccgatccacgagatgagcacaccccagttgcgtcataagctgaacggcctgttcatactctgtatccgtcgtctgatcataaagtccaatggaggcaaatttgccgctaatgacaacatcctgcgtacgctgactcccattaattctttcctgtaaagaggaactgacccaaccaatagatttgcgcagctccctcagatccacatctccaaaggtatgccccaatacaccgacactacctgtggttggccatatgtaaccgttaatcatattgagcatcgttgttttacctgatccattcaagccgagtacagcccagtgctccccctcagctacctgccaattgatttgatccagtatggtacggttatctctcttccagcttacattattaagttcaatgacagaattcatggctgtacaccctttctattcatcgtatcatcagatgtttatacgcatagtaaagatcatcgttagtacggctagctcctcttttatgtaagcatagcacagggtcacaggttgttcaattttaaatagcccactccattgttcctataggagtgggctcaacatgtactgctcatgtaaattctcttgctccatctactttttcttacgctcgcgaaaacggcgtacctttatcaaattaccacacatcttatcgtcgcaaaatcgctttgaccgatttcgggtatcatcgtaaaatacccatcggcaatcgatattatcgcaaatacgaattctagagccgccgctattgacaagtgcctgagcaaaatcggctacaacctctgccagcacttttttccaaccatttgccacgggttccagcacaatgctgaaatgctcatcctgttgctttaataagcgagtgaccggcccctcttccatcatctttcggttaatcatatctaccagatcagctgttatttgtccgccagaagtcaggtgctcagcgaagctacgtaattcccgccggagaatttgcatttcttcaatatcttccgcactggctgggaccgaagcggtaaattgccaccgcataagaaattcattttgccattcgggcttcaacaaacgatcttctgaacgtccgctccccctccaatcgtgccattcgctgtttacaaaatcagtccaaagtgtattcaaaagagttcctccaccgtctgtaaccactaaaatcattttaactggttgcaaatcttaatttgtcatgctacattgttaattgtaacgatttatcctatgtttagctagttacatacctacaaaaggagttgggttaggtgagccgagatcgagtaaatatgctggtattgcaaagagaaaattcatgggataaggaagaatggattgttcctcttgccgcagcacttcacggtgtgaatacacaggaggccacttggacaccaccaggtggaggaaacacgatttggcaaacggttcgtcacattaattattacaatgagcgtattttgagacgtttaactgaccgccctataagttcaactggaataagcaacgatgaaacattcgggccgccaggggatgctgaagaccatgaaggatggcaggagacgctgaaagaagcggaagctcttgtaaaccaactgcttgtcgccattactgctctgaatgatgctgatctggataagcctctcggctccgacactctcggtgctgaattatcgcggtggacgctgcacgatgcatatcatagcggacaaatcgtacttatacgcaaacaattggggacttggcgagtttaaaatgtaatcctaaataaaaaggatgaattatgaaagattcatccttttttttgtattagctgctggcaatgaagcaatctactggtcaagatattttttgttttttagaatctttaattacattcttatctttatttttacctttattcttgtctttatttttatctttatttgtatctttgcttgggacggtgaccttccttttttcattagctagtcgccaatagcttaacactttacggtacatggacttgtctgttaattggttaaaaatatatgggtccggcttcgtattcacctcaataatccacgggataaagcgatgatccagtccaatgtccacaccaatttgccggaatttcggatatgttttttgcagttgtttggcgatagtaagacccagttcatttagtttcttaaccagctccgcctgcttgctttgcgataaatgggattttagtaactgctccaaggccatcggcttaccaccactatgatagttggtcacgattttacggggatgaccaagacgtccaataattccggtagactcccatagccctttttcattacgctgcaccatgacccgaatatcaaaataacgcatttgatggcgtagtaaatggattcccttttgaatgagataacttttcttccccgtatgtttcgataggctgatatatagtgcatccaaatgtttgaattcttggcgcgtttcctcatattgataggcgaaacgctggccggtctcctgctctactctcattacacctttaccaaaggtacctcgctcgggttttacatagaccataccgtacttctccagcattgatttcaaatttgctttattatatttgcgagtttcaggtacatacggcttgatgctgccatgctggagcaacaattgggttttatgccatttgctgcgcaacgcctgcgcttgtgaagaattcacttgcccctctcctctctactctcaggtagaacgctcctgttaaaaaagatcaatctatcgtatgcgctaactccccattcgaagcttcatcagccctgtcctgcatagaaatggacgtttgaccttgcccggtcgaaagcgcctgtccaagcatacgatatggagagacgctgggagcgtatatttgcacatatagggagtgaatgacatgtcagcgcaatcggatgggccacggaagggttcccttacaatcgatgttctgattccagcaattgataaagatcttgccacactaccgctggtgattgacagtctgcgccgtcacgtgcagcaccgaattggaactatttatatcgtctcaccgcaaagcaccgggattcgccgtctgtgcgcaaacaagaaatgtacatttattgacgaaaaaacggtgctgcctatcaccaaaaaacatattcattacgggacaacgcgctgggaccgctcaggctggctgtatcaacaattactcaaaatgaatggcgacaaaatcagtaaagcctctttttttctcgtcattgacgcggacacgattttgattcgtccacatacgttccgtaaagacggaaaaacgattttttactaccgcagctggagccagcctgagtattttcgcacctaccacaagctgatgggcgttaaagcaccctcaccaaaatcctttgtcactcactatatgctttttgaaaaagcgcggctcacccagctcaagcaagttatcgaggcccgacatggaaaaccttggtacaatgcgattatccaaagtataaaccggacaaaacagtttgggttttccgaatatgaaacgtatgccaactatttatacagcaataagccttctcagatgattttgcgcaagtcattgaataaagcgcttcatagtcgggcttcttccctgtcgcaaaaacaattgggtgtcttggccaagagctatcgttccttatcttttcatcaacgcaaggtgtaccagcttgctccaaaaacaaagattgaatcatcgctaaaatagttcttaaaatcctgcaaaatgatgcaatccaaatggatctgcattgaaggaggaaacgtccgtgcgcatcgtattgttatgcggtggtgctggaaaacggctatggccactatccaacgaaatccggtcgaagctgtttctccagttgttgcccgcccctgacgggcgaaaggaatctatgctcggccgggtgtaccgtcagcttaccttagccgggctggattcctctgccctgcttctggctcatcgaagccaggtaaatctagcctttcgccatacagaaggtcgtctgcccgttttgggcgagcctgccaaacggggaaccttcaccgcggctgcactggcggctgcttattttcacaccagaggcatggggctggatgaagttctctgcattgctccagcggacatgtttgcaggggaggatttcttccatagcatagcagcgctctccggcttattgcttgagagcggagccgatttggctatgcttgggacaaggcccactcatccctccgaccaatacggctatgtcgttccgggtctgcaaatgatacgggaagggaaaccttcttatgcgcaagttgctcgcttcacagaaaagccggatcattccggggcacagcagcttattcatcagggtgcgctgtggaactgtggtatttacgcttttacattacggtatatgctctcctgtatggagcgaagttatttgccgctgaacgataaagcattatgcgcaatgtatgatggcctcccggttcgcagtttcgacgaggagattgcagagcgagccgaacatgccatcgtcctgccctacgatggcgaatggcacgacatcggcaactggcaggctctaacagagcagctaaatagccaagtgatcgggcgtggacagatcagtggccaaactcatggcacgtacatcgtcaatgagttgccctatccacttcatgtcattggtgtagaagatattattgcagctgcgagccccgacggcattctcatcgcttccaagagccatgctcacgcgatcaaggaccagctaggcaaacttcaactacatcccaagcatggcgaaacctcttggggcagttaccgattgctggacgaatttgatcatcggagtctgaacgatatactggccatacggctgacggtactgccagatcaccgcttgaatggccgtattcacggcagtggacttaaagtatggacgatcgtgtccggccggggagaggtcatgctgaacggagaacgttttgctgcagcaagcggttctgtatttagcattccggtcgatacgtatcacacgatccgtgccgatctggatacaccactggagctaattgaggtacgtctggggaacagcttagtgaacgccttctataaatcagaagcctgacaacacatagatataatatcagcacaccacggattctgaacgaaggtcgcacataaaaaatcgcttctgagcaaggtgaaaaaatccttgctccagaagcgattttattttgtggtgccatattttcttgaggtaaccgttctaaccttggcagataaatatacctcgttgtctttgactattccggcttcttttaaaaaatgctggacgatctccaactgatagtgtatgcgtactttcttgggcaggctccaactcgtctccacggtaaccgcgcgtgcacctaaaatacgggctgcagcagtgcgggaggaacctggaagctcatgcaaccgaatgttgaaatgtcggttgctcacctggatggagcgattcattcgcttaataatccgacgaaccgtaggaaccacgggattggccttattggagattagcgtttgaccaagcaccttggcatccttttgtgacaatccgttggcctcatgcaagtcgagataccattcaggttgatgcttttgtgttaatttgaatagagcagcggaaagtggttgtgttgccagctgcttttttttgcgcggaaaggttcgattaagatcaggtattcctctaatccgtttgcggtaagcctcttgatttacaatcggtacaattataagcttaccatggctaaatcgcagtttttgctgattcaaaagctttaccaatttctcagcagctcgtatgcttgctatttctttaccatgtattcccgccaccaccatcacacacggacctttctgtccccctgtaactatataataaggagttgcccaagagccctttccgagcatatatcgtttgacctgcatctccttcacctccgtataggctgccgttgtcctctcttctgttctcgccgacggatgatttcacggtataatcttaagtagttactggtcatctgtttgttggtaaatctttgagtcacatacaaacgcagcttcgctggtgacgggtagttcttttgctgtgcttttcgtgccatttggctaaccgatttgcaaatcaactgcggaaagcccgatagcacctcggggacggagccattttttaatgccagcaccggtgttccacaagccatggcttcaaccatgacaagtccgaatggctcttcccacagtatcggaaacaacagacattctgcatgtttcagcaacttctgtttctgatcgcctccaactgcccccacatagcgtatattcggattgcgctgaattcgtttctgaatctctttacggaaaaattctggtgctttgataggacctgcaataagcagtttttttcctgttcgttctgcaacctgaatggcctccaatacacctttatctcgaatgattctgcccatgaacagcaagtagccacgcttctcactgctgaactcgtattcatgtgtgttgataccgttatagatataaaaacctttgcccctgcccatcagctggcgcgctcgtttacttacatatactgggtttttaccgtgtctcttcactggaagatgaacggtgcaaactgatggacaaggcagcttcctacgccctacagaagaacgaaaggtatgatcatgaatgatatgtgtgtcggaaggcatatgccggagtacatattgggggatctgactatgtttcaaccccttgggatagggaatcaatcgcgcactgctcctgctcccacgggcggcaaaaagagatacatgatgtcctcgtctcaccaattcctccgttaattcatacacgaccttttccgttccgcccttgttggagggtaccggctgtgcatcgggatagttggaaatgacctgaacaatggttagacgtggttttttgagtgctttattctgctttgaagccatacgaattccccttcctgaccggaaatacggtgtgatccttacaatgtcaacgggaatcagaacatactcccgtacaggtaaattgtagtatataggtatgtatattttgcgtgattgcttgtgccaatcgactgcaagtcgatttttgtcatacgagcctatctataagtggaatctatacattttgtcaagccaaaattaaggaggaaattctcatcgttttctaataaatgaggacaaagcgttggggtaacaggtttgtaaccatgagtggtaaattccggacattttatttgtgttattgtcatttcaggacatcaacacaatacgaataacggaggaatttatatatgaaacgtacttctaaaaaattgtggatgggtatttgctttactatgactttggcattgagcgcagggagcttcgtcattggaccagccaccactcacgccgcttcggcaagtaaagctgatcggattatttctaaaggctcccagtatatgggcgtacgttatcaacatggagccccagctggcagtacaagctcttttgactgctcttcattcactcaatatgtatttgcacaaaatggcatcaagcttccgcgatcttccagacagcaatcaactgttggcactttcgtaccgcgtagccagctaaaaaaaggcgatttggtctttttctatgcgccaattcatcatgtagccatttacatggggaacggcaaaattctgcatacgtatggtaaaggcggcgtaacggttacagatctaaattcgggatggtggagtcgcaattatacaacagcacgtcgtgtcctttagcataaattttagataacttccatccaccgaatgcttaacttacaagtaacaataaaaaggctgttccgcgagtagatattctactggagggacagcctttcctgttgtctttggggcagcgtgacgatgactaccgttccttctccttctaagctctccatacgtatcgtaccctgatgggcgtctgtaattgccttggcaattggcaaccccagcccggttcctccggttttacgatgtctggagctatctacccgataaaatcgttcaaagacccgcttgatctcgccctcaggtattccgatcccataatccttaacctggatatagacatccttttcatctgtagataaccctatttcgatctcatccgagctgtattttaatgcattatccagcaggatcactagcaactgcttcattttcgtcaggttggcatccagccaaatttcgttctcttctgttaaaatagaaatttgacgatcatgtacaggcttgagatgcgctactacctgttgacaacaaccgatcatttcgatccgctcatgcggctcagggtctttctgctgtgaggaggcaagagtcagcaactgctgtgtcatcgtacgcattcgctgagtttcttcatagatcgattcaatggattccttacgaatcttctcgtcacgcgtgccccaccgccgcagcatgttggcatagccctcaataatcataagtgtcgtattcagctcatgtgaggcatctgaaacaaactgctgctgactctgaaagctttcttctaatctctccatcattcggttaaaagtagtggtcatttgggacaattcatcttgattgtgaccaccaacggggatttttttgaatttcaagcttctttctatttcctgcatcgtttgaatactacttgaaatcggtagcaatatcgcattcgccaaaatcgtgctccctaccaaacttagcaacatagcccctatagtggatgtgatgaggatcgtatttaaaatatcgagattggtttcgagtgcatcccatttttctacaatctccagggtccccttatgattaccctctggagaaagcacagggagatggattaccagaattttatgaccctgtacatctgtcagttgagaactttgtgaagtgttaaaacgtatatcgcccagcttaaatcgggactggcgacttacttcatacagaagtcgggattgccgatcaaacactctcagagtggtatctccagaaagctcatctttcagtttggggccccatgcattctttagaatcatcgtgggtcctgtttcggcaatgatttcagtccatttattttgcagcacttctctttcatttcgcgtagcgattttgacgaacaataggtgaactgtaacatccacaaacaggagtatcgacatcactaaaatagaactgagtagggttattttggtccgaagcttcactagtcttcctcccggatgcagtacccaacgccgcgcacggtttttatcaatttctttttgtatccatgatcaatttttttgcgaacataccggatatacacatctacgacattcgtatcaccgacaaaatcaaatccccacacgtcctgaatcatttgatcccgctgtaatacctgatttttgtgctccatcagataaagaagcagatcatattcttttggcgtcagttcgattcgattgccctcccgcaccactaaccgtgtcttgcgttccaacaccaagctatccacttgcagcctagacggcggcttatcctcttcctgtaaagcggtagctgttggctccatttgatgcctcatactggcccgcatccgcgctaataactcctcgatctcaaaaggcttcgtaatgtaatcattggcaccttcatccagacctgaaaccttatcaggagtcgtgttacgtgcagtgaccataattactggtgtatgattgtccacttttcgaatctgctttagcacctcgaccccgttcatctccggcagcattacatccagaatgatgatatcccatttaccagctagagctttttccaatccttctctgcccgtctgtgcgatttcaactgcatatccttcatgggataactccaactgaagcaatctggatatcttctcttcatcatcaataaccagcaccgacttttccattgcaaaaccacctattttctatagaaaaaacatatgagtaatggaaatgacattcattttttatttgattttaagcttttatccgtgtagtcgctctataatataactttgttattcaattttttgatgttaaggagtaatttattcatgttaattaatgtagactatgctttatttcactggatcaatgaactggctaattccctcgcctttttgaatggaatcatgcttttcttggcgcaatatgcaccgtatttattcggagtggctttgctgatttactggttcacttttaaaatgccgcatcggatgatggttttagaagccgtcataacggtttgtatcggctttgtaattagttggggccttggacatttgttttacagagatcggccttttgtcggacattcagtcattcagcttattcatcatgatcctaatgcttcattcccgagtaaccatgcccttggatcgtttgctctggctacaattttatggcttcatcatcaaaaatttcgtgtcctctgggttatcttggctgtactcatcgcagtatcccgcgtgtggaccggagtgcattatccctcggatattttggcaggtgcgcttattggtgcaggttgtgccgtcggctttcatcatttcattcgaagccggaagcttcctggcatcttcatgcaggcggctattatattttatgaaaaatgggagcagaagctggggctcaagcctggtgaacaggccagaactaagatgaatgagcacacttcctctgtccaaattaaaagcagacgctaaagcgtctgctcagattgtcgagaaagtctagaggacttttcgacacttctatttttatatggggagacgcatcttttaaaacaaaaatcgatttaaaacgatctgaggaccctagtttttagaccactaagacagttttaaaccccctgcaaaaaaacagggggtttctcgacagcctgagcagacgctaaagcgtctgcttttttataagctttattatttatgctacccgttatgctgtcgatttggagcgaagtggcagcattcgtcgttcttcgtaccgctgataaaaccaaatacaagccgccatccagcagccactcataaaatagccacccacaacgtcgctcggataatgtacgcccaaataaatgcggctcgtcccgattgctacaatcagcaggctgctgagtacaataagaaggatacgccccagcctagaaggaacatgcttccacactaaaaatgtcagcgccgcatacatgctaaaagctgtcatggaatgtccgcttggaaagctgtatccattctcttcaataatacggttaatctccggtctcgcacgctgaaaaagcaattttagtatcgtattcagcattaccgatcccaatacaccagccgccaaaaaaaacagttctctgcgatgtcccaatactctatagagcacgaacatggcaattaaaatgatgatcacaactggaatcccactgccgatcatggtaaaaaatttcattagacgggtcatggcgggcgactctagttgtccaatagccgaaataatttcctggtcaaaatgccgaacttgatggtcactcacccataatgcgactaagccaaaaccgaatgcacatactatacatgtgagcagagccaaggaaatgggcagctttgttgatgtttgcttcattttctatagttcctccataatattcattgcgtgataaaacaaagttcagcattagcttacatataggtcttactttgcccacttttctcttatcatttcattaaaagaattaggtgcgtatcattttataatataaggatttcatattgactacaaaatcgcaagcggagtgtagcgaaaaaagcagcatcaaaaaaggacgccattcaagccttataaacggctcgaatgacatcctatgattacacttgacaactacaagcgcaattcccaagttaaataaacatcatcttctaattaggttggtgtgacttctccaagtttaaccttactctctgcttcctctattggatagcgtctgcggaaccacagcgactgaagcagcaaaaaggtgccgcttaccgtccaatataatggcatagcagcaggggcattaaaggaaaagaccgccatcataatcggtgaaagataacccatgatcgcaaattgcttgcgctgttcaggcgtcatctgaaactgagaaagcttggcctgtgccaagtatacaactgcgacgacgattgccaaaatccagtccggctgtccgagccggaaccataggaaggagtgagacgccagctccggggttaagcggattgcagtatacataccgctcaagatcgggagctgaatgagaataggcagacaaccgatattaagcggattgaattgatgctctttgtaaagcgacatcatttcctgctgcatacactgctggctggcggcatcttttttgttttcatacttcttcttaattcggtccaaatcgggctgcatggcgctcatcttgcgcttcatcccctgctgggcacgtgtttgacgcatcataagcgggagtaaggccagccggacaatgaatgtcaaagtcataatcgccagcccaaagcttccaccaaaccattgcgccaattgctgaataagccaagaaagcgggaacaccacgtaatgattaaaaaatccgggtgtctgtgcatttatctccgcagcattcgcaccacaaccagacagcagcatgaccaccgccaacgctaccattaatccaaatatccgttcttttttaccccaaaaggtgaatcccttgaatcgtttcatatgttcctcctcgttgattggctgtgccatcgttcaacgagggagaacaatcggatgcatcttcatccggtgcttccttacgccggatatgtcgggccagccggacaggcatgtcctgtccacgggcagacatcggcatctgtggagaagcatgagatcttacgggcccgccttcgacccagcattcgggtacattgccgtgcaaatgagcgagatacgtataagtcactgtgcacagtaagccgattgtaaataaataagggagtaggtcctgaagctcaaacaagggattcacctccttcggttggttgccacaattatagcacgaaaactggacaagcgactaatctttaattagagatacaggttcgacacaagcaactgaatttaagttttacaggctcacgctccttcggtccaacgctcaaatccggtggaatgatatttattcaaagcggaaaccgtctgcttggcgtcaagctccctgcttctttaaaataaggccaaagatttcaagcagcattctcgctggaacagcaaaaggttaacggatagcaagcatacgattcaatgctagtacagcatcctgtctgatctgagcatccacacgaatcacacccacaggctcaccccgatcaaactgctccattgcccacagcaaatggggaagatcgatccggttcatggtcagacagggacacatatcgggattgagcgattcaatctgctgttcagggtactgctgcttgattcgttgcacgagattcatttctgtaccaacagcccattgagttcccggctctgccgcgcgaatggtatcgatgatgaattttgtggagcccgcgcaatctgcgagctgtacgacctcataagagcattcggggtgaacgatgacccggatgttcttatcacgctcgcggacattgcgaatgtgatctactgtaaacttttcatgaacagagcaatgtcctttccataaaataatttttacagttgccgggtcctgttcagtctcaagctgatcggtcattggattccacacggccatttcatttagcggaattccaagatcgtaagctgtattgcgacctaaatgctgatccggcagaaacaaaatacgttccttttgcttcagcgcccactccagcacttgcttagcattcgaagaagtcacggtagccccgccatgccgtcctacaaaggctttgatctctgctgtggaatttacatacgttaacggaatgatcgtatctcctaccaactcctgtaaatgcttccatgctcgttctgtctgctccacattcgccatatctgccatcgagcagcctgcacgcatatccggcaggacaacagtctgtcgatcagtagtcagcatatccgctgtctccgccataaaatgtaccccacaaaatacaataaactccgcttcctgattttgtgcagccaattgagcaagctgtagagaatctcctgttatatcagcaaactgaataacctcgtccttctgatagtgatggcccggtatgagcagcttcggtccccatttttgtttcagctcggccactcgctgctccatgtaagcaaccgtcagtgtcttataatgctctggaataagccctcgatttccttgtaaaacgtcaagcatagacattaaaatccctccatatcgatgcggctgatcgttcccgctctcacgaacagataaccgctctgtgtacatacatgtttacaagtgtcttgacacttatatttacacatgcctacaataatctcaagagtttttgaatggaattatttttaagcagggaggatttggtgtgatttatctggactatgccgcttccacacctatgtgtggcgaagctttaaatatgtataacgtattaaataaggaaatgttcggaaatgccagcagtctccatgatgcgggcggtcaagcagcctatacgctagattacagcaggcaacgaatagcaaatatgattggcgggcaaaaggaaggcatctattttacaacagggggaacagaatccaatatgttggttgtgcaatcgatcctgaacgggttgccgcagcataaaaagcattggatcatgagcgctttggaacaccactcgatgtacaaccttgctactttgctggaacgtcagggctatgaactgaccattgtgcaaccggatcgggaaggacgagtgacccgcgaaactcttttacctcacctgagagaagacaccggacttgtctccgtacaacacgctaattcggaaacgggactggttcaggaccttgctgccttatctcccctgctacgcgaacggggtattttgctgcacagtgatgcggtacagacatttgggaatattcgcgtagatgtagaatccatgggagtagatgcactcactgtatcaagccataaagtgtatggccccaaaggtgtcggtgctgcatatctcaaacccggaaccccgtggcgtcccgtgtaccctgatacactacatgaaaacggatttcgtcctggaacggttaatgttcccgggattgcagcctttgtcgcggcggcagaaatgatgaccgaacagatggagtcgcatcaggagcgatatactaccctgagaagacacttttttacgaaaattcaggaaagatccattccgttacgttgggccgtacaggaaagcgagaataaagcagtgcttcatcatatcgtaggatgtttttttcacggttacgagggacaatatgttatgctggaatgtaatcgcaaaggtgtctgtatatcaactggaagcgcatgtgctgccggacaccacgatccttcgcctgccttacaggcgcttggagcatccggccgtgaagcgttacaatttatccgtgtttctttcggaagaacgaccaccatcgaggaattgaatgtattggtagatattttgacagacctgacgcatcgaaaagaaaggagcttatcccgttgactgaatctttaaaacggtcaggtacggatcgccgcgaacagctactattgtggctcaagagcgaatcaccactgaccgggagcgaactggcgcgcagatcctccgtctcccgacaagtaattgtccaggatatttccctgttaaaagcaagccaagagcctatccttgcaacaagtcaaggatacatttatatggagcctgcgagtcaggcaactcccttagcctcacgtattattgtgtgtaaacatcgacctgaacagacagaagaggaactaaagctgattgtggactacggtgtaagtgtgcaggatgttattgttgagcatccagtatatggggatctgactgctccgatacgggttggcactcgcaaggaagtggacgattttatccgtaaaatcagctccacccaggccacttatttgtcccagctgacgggaggcatccacctgcataccttgaatgcctcggacgaagataaaattaatgatgcctgcgctgcattggagcaagcgggcttcctaatgacggactaacttagtgcgcttagcggagtaaagaaaatcctgtccagtatgtggagtgcaactgtgctccacatggacggtattgtaggtagcgagaaataaaaaatcccggccccctcatataagggaatcgggaatgaactatgtgagcttaatttcaagcagctcatatttaattacagccatgggtgcatccacatgaatgatactgcccacttcttttcccaaaagtgccttgcctaaaggactttcataggaaattttgttatcaagaacatccgcctcagcaggacttacaattttgtattccatcttctctgaaaattcgatgtcattcagaatgacagtcgatccgatactaacggttctaaggtctaaattactctcatccacgacccgggctttggtcagcatcttctccaatatgagaatgcgggtttccataaacgcttggtcgtccttggctgagtgatactcactattttctttcaaatcgccgtagctgatagccaacttaaggcgttcggctagctccttgcgttttacggtcttcagttccttaagctcatcctccagcttggccaatccctctttagttaacaatacttcttcattcgacatattttatctacaactcctatttcagcattttgcttaattccaattcaacgctcaaaaatacaataaacgaactaaaccgtttcagtctaaacattgctgattgaaaacgctcctgggatttatgcaaatgctcatttggcttgctttattgtagtttactctaaatcggaccaacatgcgaaataaattactggataacagtagccaactaccttcagccagggtgattcttatagtaaccaatgctctcttattcgcatatcgtatgatcataacgtatattgatgagcacatggagtgccgctgtccttgtctcgaattttgtgaaaaccaggcaggagcagtatatggcgggaggaagattcaatggcttccttaggaaagaatggtaatgggaacgggaatcgtaaatccaaatcccccctcaacggccaaaagaaaaatggattaaacagtaattcggctatcttttctgcgcttcaaggaaaaaatgtggaggtcctcgtggcagccctcctactaacaggaaaactaaacgtcgattccgtgactttatacagacaagcaacattgtttttagggctcacaggaaaatacaaaacactagcatccactccatccaatgtcgataatatggtgaaatttttaaatgataacgggaatatgacactggaccaggtgatacaagccttttcacagaaaataaataattaacaagtggcgaaaggagacttatgcggtgagtgagtttgatggagaatattttgcagaggttgtcattattgtgattctagttgccatgttcttctatggctcctcagatatagagggactttccgcttcgccaacccaatcctaaaatgataattaccgcttcgaaaaaaataaaaaagcatctatagactctcacgaggtcaatagatgctcttactttttaacggcccatcatttctacttaatgcccctttacttctacacttatcgtttgactagaaacttctcctgaagcattaactaactcggcccgatactcatatgtacccgacttttgattttggatgttggtgactgcgctttgggcctgcgggttctggcttggaagatcctgggcatcgatcagttctccattttcatataagttgtattttgtcgcattcgtgccccaccacatgttcattgtaagggtgtaggtgccgtcaccgtcccaattgtcatgagacagcactggaattccaggggaagcatcggtcacttcgacagttaacgaatcgctggtcgttttaccagaagcgttgatcagttctgcagtatacgtgtaggtaccattggtcttgcctgtaacaggaatgactgcatgctgtgctccaggggaagcggcttgcaacgattgggtgccaatcagcttgtcgttttcatacaacttgagttcatcaccattcgtaccccaccacagattcatggtgatgttgtagttgccatccttcagcccggtgtcctgcccgttatcatgcgacagcacaggcttacccggcacttcacctacagcagtcttatcgactctaacggttacaggattggatacgaccgttttaccgtccaaggtgacgctggctgtaatctccgcgctcccctcttttagggccttaagttctccatacgtatccagcgaaacggtttcatgactgctgatatactgaacagaagcgcggcttaattcagcttcgctgccatctgtcagcgtacccttgagatgtgtcgctgccgtatccccaatgttgagggtcgtttgatccagtgaaagctctacttcctgcaaagctgcgcctgcctgagctgaaaaatcatccagtccacgcggttttaactgataattccctttgaaaatcgccgaaattcccttcagcttcacttgctgtccttcttgatatggaaaagatgtccaagttaagcctgtacgtgcatcgacgcgcacatggtgacttacttcaccagatactgcatcaaattcaaacgaacctacgggagtggcgtctatcacattacgaatcattgccgtaggaagctcaaccaactgtccttggttcgcatcactgagttcggtgacttgtacagcttccggaagttgtccttctcccgttttttcaattgccactggatcggttaactctagctcactattatacagtgccaagcttgctgtaagctttactcgatccccttggtgaaagccgctttggttctgatatacataaataccgccactttcatcctgcatgtaaaaggcttgaccaccgaatgcacctggttctgtcgtcacaaccccctctaaggtcacgactttgccagccgggagattccgtgcttctgcgacactgatacgagctggaaccgtattgccttcctcaggcaacggctgggccgggacatcagccagcacgacggattgggtcagcagattgctgccgttttgcctcagtctaagattagctgaaccactggttcccggcttgatccgcaccgtcaagtccttataggcatggcctttgccgttggactccaggctaaatgttccgctatagccgtaagaggttggccagcttccatccggattttgaatttgggctacttgattgccgcctgcaacataaatacctgtgctgaatccgctaatcgtgctgttaggagccagttggtcggcagtaacccgaatttgaaaaggctgtgcattgggcagctgctcttgacgaacgatgctgtacactggttgcgcactggctgtagatccgccataggaccctgctttgaatgttcgctgatcccaccatttgtagccggctgcgggagcggaccaaggctcggcttgtggttccgtggaagtctgtggcccttcaaaaggcagtaatgccgtcggctggtccagctgtaagcttttcacttccgtcaggctggtatactcctccttcttggacaaccaatctacgatattgaccagtaacacagcgtcatcctgctccttaaagccgtcatacgttgtcttcttggttcctgtctcttcgcgcaaatattttggcgttgcatcttcgacaggagacgagtcccccatgaaagcagctttgcctagccctactttcgatacagctgcataaggtccttccggaatgccgcctccgttataaacgccctgatctaccgcgttgccccaagcctgattggttttaggaagatatacgattcccttggctttcgctgggtcgataattgcgagtgttgatcctgcatgcattgccacattgctcactccagctgtaatgccgaacgcctgcgctggctcgacaatctgattggccgtgatatcgcctaatgcattgtagcgaaagcgcacaccaaactggctgcccagccaatctgagctgactacgccctgcattgctgccgagcttttttcttccgcactcattcccttcgcagggtcttcccatgcaccacgacgatagccattaatgctctccgatccgtcccagcgattcttgttgcggtccgcgttataatgatctccaatgaaaaaaatactattgcctgcttttacatactgctccattgcagcctgttcgctctgtttaaaaggaatattcggctctgccgtaacaaatacatcataattctttagatcattgtaagtaataggcgtggattggcgaagctcgtgtacatcatagccattactcgcgagggcttggccgaagtctgaaaatccaccatcaatcacccaatctgctgcgccagctgtctgtccatgtgtattatcaaacagcacttttttaccagcgttctcattgaccactttcgctgcaatgaagggggctgggtccgccggaccttctgcccgtgccggttgcatgctgcccgcaacaccagcgtacaacgataaagtgaaaaccatagcagttgcgtatttgaagctacgggatgtaaaacgacgaaagattcccattattctcctcctgtttgttggtttaaaacccctctggggggcatcagatacaaattttagcattcatttatatttgaatatgcattgttttgtaaatctttaggaataatgaataggaaggaaattccaataaaaaagatacaccgtatgcagcaatgtgagtaccgcaaataggattttcccggcagcccgggttcttctttcccctgtaatcagctttgcgccattcacgattaatacccacactgcaatgagtgctgaaatgagtggcagcgtgcaaattccccagatataccacgcggaatagccatacacgatctgattgttaccatagatgacctgcaccccgagaaaaatcgtatttagtgacgcaatgaatgcaaggttggacgaaatgtgattattcgttttacggatatctctgatcacatatcttacgatccaaatcagcaaggtcgtgatgaaaaataaggaggcggcagcgtagctgacaagcagagtccaggtacggtgccaaagtgtcgtctgcttcatggtcttactatccggggcaaccatcatccacgtaccgttttcctgatacagcaaaattttaagctggccccccttttccacaaacaatccatcgcctgctgcttgaaaaactttgtctgttgcttcattctcatttgggtattttcctttaacaattaacgtatgatcatcttgaattcgcacggtgtatgtaatgtttcccagtatccgaatccattttccccacccatgaacaggattagaatccacctgatatacgccctcaatctctggcgaaagcttcacttgggtggaagaacgagctagtgactgcgaaacggccttcggctctgagggcagcatttgggctatcgcatggatgacttttccatgaagcagggtgtccgtgtcagctgaattaatgatcacaaaaataccgatcttttgcgacggaatcagtaccatttcggaaataaaatcatcaatttccccggtagcccacagcataggtactcccgtctccaaatgaccacggaaaaatccgtagcctacgccatccaggcgtgcatcgactgcaaattgctgcgcatgcatcacttttaccgtatgtggctggaacactactttgccctcatacttgccctggtttaaatgagtgatcagataatgggaaaactcgttgggtgtgacgttcaacgctcctgctcccggcagattgatatatgacaaaggctgtttcaaatacgctccatccttccactgatacgattgggccagtaccggatgatttaacggcaattccagcgtcgcgctgggcatattcatcggctggaacagatgtgtacggaggtaatcgttcagtccctgaccgcttacttgctccacgatattaccgatcagaccgtaggcgacattgctgtaatcatactgaattccaggtttgcggatgggaggctgattttgaaaatacgtgctgaggtactgctctgtgggcaaaacgcctgcccgagtcgagctgttaatgtcgtacagcgcttcatccaatcctgaggtatgtgtcaaaagctgatgcaaattgaaaggctgatcttggtattgcgtagttttatagctgtggagatagctgttcacgtcttcattcaaatcaagcttgttttgctcaaccagctgcatcgtggcgcttgcactaaatgatttggttagagagccgacacgaacaatggtcttcgctggatcgaatgccactttccgctccagatctgcatatccatagcctttactaaaaaggatttggttttcttgggtcacgacgaccgcagcccccggaatatgcaattttcccaattctgtattcatgatatcgtctactgttttttccaatgaatcaggtgttatgctgtctgttgcccatgccgaagcaatgagcaggttccagagaaacaacgctgctaaaaatgcggataggtagcaaatgcctttattcttcatattgaagtaccatccttacgtatgaagttgattttacgtatgaagttgatttaatgatttgaaccgtgcggtgattgcatagcgagcagatatttatactccgtatggaagccatcagcatggcgctatggaatcatcgcacttcccatcgcgggagtgcacatgataaaagcgaatcctgatcgaatcgtgtaagcagaaggcttcttacctgtcgatcaggattcatgtgttacagattaaaaattagtgataccgttcgttacatcatcgaccatagatgttcaagatttatgatgtgccaaatcttgtgtcatgtctttgtccgtgttccgagttatcttttgtattgtggcacggatactttttacattttcttcgataaatccgggttccagtagttcataatgattaccaatcaagctatgctcttcatagctaccttgtgtagcgtctttccataaaagtcgattatctcctgtacccctcaccgtttccgatccaacggcgacaaagccgtgaatattcgcctgaacgctctctgtattcacaagctggttgccatacaccgcgtaagcgatcattttacgttggtacgtttcattcaacagctcacggtaggagtcgggaacctgttccagcatgtcatgaatttcatgctctgtttcttcagctgtgaagggcagggcttccgcccttttgaccgaatcgagcataaaaatatcggatacagcatggccttgacgttccagtatgtcagcaaccttatgcgccagattaccacctatggaataaccaagcagcacatacggaccttgcgcttgcgtgctgacgatcaaatcaacgtaacgtgccagcatggcctgctcatccgcagcatcatccacgaactccaatccatacacgactgcgtcctgatccagttgtttcgccagctccgcgaacgacagcccgtatccaagcataggaggaaagcagaagatggagatcggaccgtgttcattcaatcgaatgattggactatcggccttgtattccagatcggctttcaataatgtgagcgcctgctcttctatagtcgggaagtccattacactacggatgggaagctcaatgtctgtggcaaggtgaactttgcgtataagctccagtactttcaaggaatgtccacccaacgtgaaaaagtcatcatggatacccacttgtggaatttcaagcacttcctgccaaatggatgccagcaactgctccacatcggttcgcggtgcgacatattctatacccgtgtgcagccctttgtccggcacaggtaaagctttgcggtcgattttgccgtttgtcgtcagcggaaaccgatccagctgtacaaatgcggatggaatcatatagctcggcagactggccgacatcgcagctcgaatctcacggatggtcagctgttcatcagcagtaaagtaagcacataattgctgctgacctgctccatcccgcaaagcaataaccacgctatcccgcacggacggtacacttgccagccgcgcctccacctcacccagctcaatccggtaaccgcgaattttaacctgttgatcaatccgtccagcgtattccagtatgccgtcttcacgccagcgaacaaggtctcccgtacagtacaggcgatctccgtccctccacgggttagcaagaaatctctcagccgtcagctcaggacgatttagataaccacgtgcaactccgtctccgccgacgaccagctcaccccaagctccgaccggttgcaggttaaatgacgaatctacaacatacgccgtcgaattgcagatgggccgtccgatcggcacagaatccagctgttcttccgtaatgtgatacgtcgtcgaaaaggttgtgttttccgttggcccatagccgttaatgatgttcatgtctggattatcgcgcaggacccggttaatatggggtgcagacaaaacatcaccaccaaccagcaaatacttcacatcgccgaaaagtttactatcctgctgtgaaagctgattaaataacggtgtggtcagccacatcatggtgacgtgatgatcccgtatcgtctctttaagcttggccgcgtccaatagatcatccttatgcacaagaacaagctgaccaccattcagtagcgcaccccaaatttcaaacgtagatacatcaaatacaaacgcgcaagtctgcagcattcgagtcgattcatcaaatggcacataatccgtattgcggacaaggcgcacgacactttgatgctcaactatgacacccttaggcttacctgttgaacctgaggtataaatgacataagcagcatgattacccgctccatctatacccagattggaagcatctgcactgtaggacgtatcctcattcagattgacaatctgtccgtcgaaatagcaacgatccagtaaatcctgctgagccagcagcagcttagctcccgagtcctccagcatataacggatacggtcctccggatattgagggtctaccggcacatacgcgcctccagccttcaaaatagcgagtgttcccgtaatcatgtccagtgagcgctccgtcaaaatgccaacaggttcatcggatttcacccctgcatcacgcagcgtatgcgctaaacggttggctgtctcattgagttcccgataggtcaatgattgatgacccaaagttacagcaatatgatccggcgtgcgctctgcctgctcctcaaacagtttttggatcgtgtgattgcttggatatgcagaggcagtgtcattaaactctcctgtaatttgttgtttttccgccgctgtaaccagttccagctcttctacgcaaacattcgggttaagcaaaacttgctccaacagattcacaaaatgcccatgcagacgcttaatgcctgtttgatcataacttaacgcattatacataaaacgaatcttgatgcattctcccggcataacgactaagctcagatcatagttagtctgctctgcagccaccacgttggaaatcgggaatgtatcctgcccgtcacttcccaattcttcgacctgctcatctaccggataattttcaaacaccataatatggttaattaaatcctgtttctggtcggtcaatgcctgaatctcaaacagtggatacgtatcatacgcatgagaagccagcgcctgctcctgtgttttcttcataacttctgcaaaggattcccctgcctcactaagaatgcgaactggaatggtattaatgaacaagccgataatatcctctaccccgataatatccgatggacggcctgagacgacactaccaaatacgacatcactgtggttgttatatttttgcagcacaatcccccagacggtttgtaataacgtattcatggtcacctgatatcgcttagccgtctcctccacccggagggtcaactcacgttccaaaaccgtcacccaatcactagccgtgttgcctccactcttgcgaccggattttacagctggtaatgctgtttgctgctcatatccggataaatagctgctccagtagtcagttgccgccttggcatcctgtgcttccagccattcaataaagcggctgtacggcactgccggtgccagctctggtactctgccctcctgaagtgctgcatagctttcaaacacttctttatttataagggacaggcaccagccgtccatgacgatatgatggaagctccatacaaaatgatagctgtcttctccggtacgtaaaatcgctacacgtagcaggacatcccgacgcagatcaaagccccgtgctttatcttgtagcttgaaatttttcaccctggtatctatttcatcctcatccagatggtgtaaatcttcatattgaaagccgcaatcccgatttcgatacaccacctgcaacggttccgtatctctgccaaaataaaaatgtgtacgcagcgcctcatgtcgccgaaccagaatattcaggctttctgcaaaagcccgaatgtccatctgacctcgcatatcataagaaacctgctcaaaatatgcgtcattcgcagctgcttgacgatctagctggctgtgaaacagcatccctttctgcatgggggtcagtgcatatacattgtcgatctcgcccgcagcacccatttcagataagaggctgtccaagccctccacactcattcctttgtaagaaatatcacttggggtaagctccgggtgttctttatggatgcaatgcgccaaaatttcacgcaggctcgattccaggaatttcgccaatcgctcgatggtctccggtctatagctggtacgactatagctaatcgtcagacccagttggcctcccgaaataatgccgccaaaatccagcgtatacgttcgagccatggtcgggctcagcggcatcccaccttcatatgaggatgattgcaagtcgttccctttcatatcctgatcgaactgtcccaaatagttaaagctgatttcgggatctgtcgtaaatatggctggagatgcctccggtgcctgtgtctgacggtcggataaatatttcagtacaccgtagccaatccctttttgcggaatgccgcgcagcccttccttcacacgcttaatccgttgcgaaagtgccagttcttccggcatatcgagcaaaacaggatattggcttgtaaaccaccctatcgttcgagtaatgtccacctctggtaaaatggcttcacgtccatgtccctctagatttatcaggaaacgatcatttccactccatgcttgcaatgccattcctaccgccgtcaacaacaggtcattaatttctgtacggtaggcacgattggcctgcttgagcagctgctctgtctctgcatgtgtccacaaagcagtaaccgactcactatcgccaatcaatggcttttcgtgctcgttatgcccataatcctgcggcaaagaagccagttccgcttgtgcaagtttcccccaatacgctcgctcatgttccatagctggactgttggcataagcgtgcagttgctcggcccatgtttggaacgaatctgttttatgaggcagctgaatcacctgttcacccttggaggcttgatcataagcagtcgccaaatcctcgaataaaatgcgccaggataccccgtctacaaccaaatgatgaatcacgaccagcagatgatctccatctgggcaacggaacagccccagtctcatcagcggaccttcgcttagggaaataccagattgaatttcattacatttcgcttcaattatcttcgccaaatcttgcttgtttacatcgctgtcattatagtcaaagcattccagatggtacggttcgccttcctctacattgcggttccatgctgtacatccgttctccgacaaactaaaaaccatacgcaatgcatcatggtgcgaagtaatctgatggagcgcccgccgtagtgcctgttcgtcatagccttcctgacgatagagcatgacagattggttaaaatagtgtggttcttccgtcggctgttcaaaaaaccagcgctgaatcggtgtaagctctacatttcctgtaacctcgccctgctcggctattcggttaacaggctgaatatatgtgcttagtcccgcaattgtcgggtatttgaacaagtccttcatttccagcttgtatccagcctgaaacaagcgggacgatacttggatggccttgatggagtcaccacccaaatggaaaaagttatcctgtattccgactttcgggataccaagaatggctccccaagccgtagccagtgcctgttggacatccgtctcgggtgccacataatccatacctgtatcgagattgtgctcaggtgcgggcagtgccctacggtctactttgccattcagcgtcaaaggcagtctggatagctgcacaaagtaggacggcaccatatagccaggcagatcctgcgacaaaatgttacgtaagtcgctggcgctcaattcactgtctgttgcaaaataggcacacagctgtttttgtccgtgatcgtcctgccgcacggtaacaaccgattccttcacacctggaatcgtggacaaacgggtttcaatttcacccagttcgatgcggtagccgcgaattttgacctgttcatccattcttcccttgtactccagtacaccatcagcacgccaacgcactaagtctcctgtacgatagcaatattctccagaccggaatggactttcaataaatttttccgccgtaagctcgggccgattcagatatcctcgcccaacaccgtcgccaccgacgatcagctctccccaggccccgataggttgcagcttcaacgaacgattgaccacataagcggtcgagtgatcaattggacgtccaatgggaatagcctgggtttgcggttctgtaatgtcatagatggtggaaaaggtggtgttctccgtcggaccataaatattggccaggcgaagctgcgggtactccttcaacacacgattgacgtgtggcacagacaacacatcaccacccacgagcaactccttcaaggacgcaaacactccgatttcttgctgcgaatactgattgaataaagccgtagtcatgaacatcgtgttaacacgatacttgtcaattgcttgtttgagcttggaggcatccagaatagtgtcatggcttaccacatacagttgtcccccgttcagcagcgttccccagatttcaaatgtggaggcatcgaacacaactgcgcccaattgcagcatacgtgtattttcattaagcatggcatagcttttgtttttcactaggcgcacgacattacggtgctcaatcatcacgcccttcggcttgcctgtcgtaccagaggtgtagatcacatacgcaagatcggaagaagatccccctgttgtaatcgcaattgttccatccgtctgagcgtcacattcagatttgctattgcatcgctgtacatcactcaaatcgatgaccggaatgccgggttcaaaaggcatctgctcacgtcgctgtaacagtaacagccccgcactggaatcctccagtaaataacggatacgctcttcaggataatcaggatcaatgggaacgtaagcccctccgaccttcaaaatcgccagcataccgacgaccatttcaatggagcgtccagccataatccctactcgctgtgtctctggctcggacccgcgctgtatcccatgggaagcgagtatgcgtgccagacggtcggcacgttcattcagctcgcggtaggtaagctgcatgtccgcaaaggtgatggccagccgatctggtgattgcgctacctgttcctcgaacagcacatgcagtgcttgatctcgtggatacggatagtctgctaccgtatcattgaatctctgcacaagcagctctttttcttgggccgaaaccatttctatagccgaaagagcgatatccggctgttttataaccgcattgataagctgctgcaaatgttcagtcagtcgttcaatggtttcccgtttgtacagccgagttccgtattgaagagcacaggaaatttgttctccatcctccactgcgaacagactcaaatcaaatttggccgtcgtttgctcacttggataagatgccaattgcagccccgccagctgctgctctttttgctctatgttttgtagtgcaaacatggtatcaaataacggattacggcttaaatctcgatctacgcccagcttctccaccagctcttcaaacggataatcctgatgttcaaaagcctttaacgcgttttccttgacctccaacacataatcgcggaacgttttcccgccttctggataattacggattgccagtgtattcacgaacatcccgatcagactgccaagatccgcatggggccgccctgcaattggcgaaccgacaataatatcttcctgcccgctatagtggctaagcaaagccgaataggcagccaacagcaccatatataatgtcgattccgtctgcaccgcaatgctttttaagccttcgctttgtcgttggtcaagcgtaaattccagcacatctccttcaaagcttctcaccgctgggcgtggataatcagtcggtagatcaagcacaggtagctctcctgcgaaggtattgagccagtagttttcctgttcccggtagcgttcactttgctgctgcttctgttgccaagcggcgtagtctttatactgaatgcgtagcgatggcagcgtgtcgcctgaatataaatgaataaagtcctgaattagtacatttatagaggtgccgtccgaaatgatatgatgcatgtccatgagcaaaatataatgctctgggtctgtttcaatcaaaccaactcggaataacggggcctgccccagatcgaatggttggaaaaagttacgtaccagctcatccgtttcctttggggcagctccgtgagcataggtcaattccatgcaaaaaggaacctcgtcatgtactcgctggacaggttcaccgttcatggtctcaaaacttgtgcgcaatgtttcatggcggtcaataagctgacggaacgcgttatccagtgccttgtgatcaagtgaaccggtcagagtcagggcaccaggtatgttatagctaattcccgctccatcaagctgattgaggatatacatccgtttttgagctgaagaaaccgcataaaatggcttattctccgtaacagggatggattcataggtggtttgctccagtgcttcaataacctgcgccagctgttcaattgttggatgctggaacagatcctttagctgcacatttttatgcaattccttatagatgagtgatatgacatgtgtcgcccgcagggaatgtcctcctgcctcaaaaaagttatccttaatcccaatgcgctcaagctccagcacatctttccagatgctagccagttgtgcttgtaattgattttgaggaggtacatattctgcgcctgagcttacacctccctctggttgtggcagcgctcggcgatccaccttgccattgggcgtcagtggcaattgctccagctgcacaaaatacgacggtaccatgtagcccggtagctcctggctcaaagcactacgcagctcacttgtcgctacttccgcatgggtgaccacatatgcgcagagcagcttttgcccctgctcatcttcatgtgcaattacaacagcttctcggactgcctccagcttcaacagctgtgcttccacctcgcccagctcaatccggtagcctcgaattttcacctgcgcgtcgattcgtcccttatattccagcgtcccgtccgcattccaacgcaccaggtcccctgttcgatagcagcgttcgccgccacggaacggactgtcaatgaacttttcggtcgtcagttctgggcggtttcggtatccgcgagccaccccgtcaccaccgacgatcagttctccccacgctccaacaggctggagctgcatcgaaccgtccacgacatatgccgtcgagttatggatcgggctaccaatgggcacagatgccgattgaacgccggtaatggcatgtgtggtggaaaaggtcgtattttccgtcggaccgtagccgttaatgatatgtagattcggatgggcctccaatacccggttaatatgtggtacggacagcacatcaccaccaaccaatagctcccgcatcccctcaaatagttccaagtcctgctgggatagctgattaaagagtggtgcggtcagccacatcgtggtaatgccgtgattgcgaacaacttccttgagcttgggcgcgtccaaaataacatcctgactcaccagcaccagctgtccaccgttcaataatgcaccccaaatttcgaaggtggacgcgtcaaagacaacagacccggtctgcaaaatgcgcgtgtcggcattcaagcgtgcataatttgtgtttgtcaccaaacgcacgacattacggtgctccaccataacccctttgggctggccagtagtccctgaggtgtacataatataggccaagcgaccagctgcgctcgctttcggttgttcttcagctgcataagcgtgctgtatttgttttgcttgttctgattgcgtagctttgggttgcatgttttctggttgtatggttgtcgtagaagcaagttcgggactggcggaaatggagtagaacggatctaggcagtccacgtatcccggatcagtattcgttccgtgatcatttggcaaaatgggatcgtaacgatcagcatcatccgttccataaattgcagcatcgctaaggtcaagcaccattcccttaaaatcagtgggccgatgttccattcgctgcacgagcagtatgtccgcaccggaatccttcagcaaatagcgtacacgctcatccgggtaatcagaatcaatgggtacatatgctccacctgctttgagaattccgagcataccgacaatcatctcaatcgagcgttcagctacaatgccgaccgtctgctcggtgcggattccctgcttacgtaaagaatgagccagtcggttggccttttcattcaattctgcataggttaggctatcttgcccacacactaccgccacctgctgtggtgtctgcttcacctgtttctcgaacaattcatgaatagacgcatgacgtggataatccacatttgtatcgttgtaggtatggagtagctgctctacttcttgctctgacagcacttgtgctgtggaaatcgccaactctggctgctgcaaaacaatagtgtacagccgcagaagctgctcaacaaagtgctcaatcgtcgtctcgctataacggtcgctattatactttacgttcagggagaccgcttcatgttcccattgaaactggaaatctagttcagattgtacgtgattcaaaaaatcagaaatatgaatgttttgcaaggatactgtggtgtgaataagaggctttccatcctcattacgttgaatgtcaagtaattcagaatagttccaaaaaggaatgttttgatgttcaatagcttcgccgacagaggttttgatttgagacagcaaggctttgaaggttgtgctggaatccagcgtatttttcaataaaagcagatggttgatcggctttgtagcaccgttgctagacttggctaccggaatgcccagtagcacacgttcctcacatgtgtatttatgcaataagctctctactccagcaagcaggaccataaacacggcccatggagcgccacctgttatagatgatattctttgggaaatttcagttggaaatgtgagcgtgtacgtatgggaatttaaactcgttacagttgtatttctggacacatggttggtgtatggtaggcagatgatatgatcctcagattccaatttatgactccagtaatttttttccttctcaaataaggctttcaatgacatccctcctgcttctcggggcctgttccccccggttggatggtgcgttgttacatacatgagcgttgtgtcagaaaaagaatactttgcaggcaagggcagtcggacaagccgccgccctctgcacacgcaaagtgaattcattgcatttagaaaacggatttagaaaacaaagtcgatggaatccggcgagaagccttccggttgctcgtccgagttcacctgaatatcgcttaacagcaaatctggattgatcccaacctgggacaggatcgctatcaaatctctggttaatctctcaatagcgtcggctccaaacagcttcgtgcaatattcaaaggaacccttgatttccccgtcttcatcactcatagacaaggtcaaatcgaatttggagatgctgtgctcctgaacatatggactgaaggacagcgtttctagcttcgcttcctgtgactccgtattttgcagtacaaacatagtgtcaaataatgggttacggcttgcatcccgtgctacatccagcttttccaccaactcttccagtggataatcctgatgctcaaaggcttgcagcgtacgatctctggcttctagcaagtagctgtggaacgtttggttgcccttcggctgatgccggatggctagcgtgttgacgaacattccgatcagtggctccagctcaggcaacaagcgtcctgctactggcgtaccgatgatcaaatcgtcctgaccgctgtatttggacagcagaacggtgtaggcgcttaataacaccatgtacagcgtacttccggtctgtgccgcaattcggtgcagttgctcggatacatttgcgtccactgtaaattcatacatcgcaccctcgaagctgcgaacagcaggtctaggataagcaattggcaaatccagtaccggcaattctccggctaaatgctccagccagaagtgttcccggcgttggtatgactcacgctgcgtctcctgctgctgccatacggcgtagtctttgtactgaatttgcagcggctccaattcctgtccctcgtacagttgtaccagctcctgcacgatattgttagacgatacaccgtctgaaataatatggtgcatgtcgtacatcaggagatggcgctctggtccagtttgaataagacggacacgcagcagtggtgcctggcgaagatcaaagctgcgtacaaaggactcgatataagcttcggcttcggactccctagcctgcaggtgctctactgcaaactccacttgatcgtaaacccgctgaacgacctcgccttccaccatttcaaaggaagtccgcagcgtttcatggcggactattaactgacggaacgcatcttccagccgatcggcctgaagcggcccctccacggttaatacacccggcatattgtagctgagatccccaccttccagatggctcaaaatgtacagtcgtttttgagccgaggaaaccgggtagtacgcctgttgcgccgccgcagggatcaccgtataggtgtctgtcccgtgcgttgcgatgagctgggcttgctgctcaatcgtaaagtgttggaacacctcacgcagcgtaatccggctgtccagttcctgatggattttggccaccagcgtcgttgcccgcagggagtgcccacccacgtcaaagaatgagtcggtgactcctacgctggatagcttcaagacatcctgccagatttgggctagcttggcttccagcggcgtccgcggtgcaacgtactccaggcctccttcgagacgtgcttccggtgccggcaacgccttgcggtcgattttcccgttcggtgtcagcgggaaacgatccagttgtaccacatacgtcgggatcatgtaatccggcagcttcggctgcagcgcattgcgcagctccggcaaactcagggactctgaagctatgatgtaggcacacaggtccttgtgcccgtcttcgttttcccatgctgtgaccacggctttctgaatgccatccacggtcagcaactgtgcttccacctcgcccagctcgatccggtaccctcggattttcacttggtggtcgatccggcccaaatactcaatgctgccgtctggcaaccaccgtgccaggtcgcccgtccggtacatccggtttgcgtgagtgctgtccgcttgatcggctgccgccgcatcagcaaacggattcaggacgaacttctctgccgtcagctccggcaggttcaggtatcctcgtcccacacccgcacccccgatataaagctcaccagcgataccgatcggcaccagctgttgctggttgttcaagatgtatacagactggttcgctatcggcgttccgatggataccgtgtgctcccctttttccatcagtacgttcagggactctacatcttcaatcgtataagcagtcgcatctaccgtggtttcggtcggaccgtacacgttggtaatgaccggacgatacccggaccacttgtgcaagaacacatttaccagctgcacggataatgcttcgccaccgatcaggtaatgcttcacttccggcgcttccgtcacattgacgctttcgttcaaaatatgcagatgcgcaggtgtgccgtccgacagatcaatccggtgcgtgcggtagtaggcgatcaaatgctctccgctcagactgacgtcacgggacaccacgtgcagggtgtggcctaacagcaagctggcaaagacttgcttcactgaagcgtcaaatacaaatgccgacagccatgcgacatgaagcggctgttcataacggctgtatactcgctccaataaagcatctaccagattgctaacactgccctgctcgatcatgacccctttcggctggccggtggtacctgacgtgtaaatcatataggccaggttatgtgggcgggcgacagggattaaattgctcgcatcctgtgctcccagttgagcttgaacgtcctcgtcatccaagactacagctcgaactgtggatggcaagctaagcgacaggttggcaactctacttgtaatcacgaccttggccccactgtcttggagcatgtagtcgatgcgctcctgtggatacatcgtatccattggtacatatgcgcctccggccttaagtacccccagaatgctcaccagaatatccgcagaacgttccagcaatacgccaaccggttgatcagcttcgaccccttccgcttgtaacacacgagccaattggttcgcacgctcattcagctcagtgtaggtcagcgcggtggccccagacacaactgctatccgctcagggttgcacttcgcttgctcttcaaagcgttcgctgagcgaacggccttgcaatgctccaagcaggctgtacgcattcgaatcattgaacaccttcagaatctgctcggtttcttctgccgtaatcagttccagctcactcagcttcgcatccgggttcgccgccacggcttcggccaaacgaataaagtggcgtgtcatccgttctaccgtttcgcgctcgtacaacacggttgcatattgcaatccgaactggatacctgcctcttcctctctggcttccagcgtcaaatcaaacttcgctggcgtttgttccaaaccgtatggacggaagctcagatctgccagttgcagttcgccttcttcggtggtttgtagggtaaacatcgtatcgaacagcggatggcggctcatatcccgcttcacatttagcttttccaccagttcctcaaatgggtagtcctgatgttcataggcttgcagagcacaaactttcacttcttccacgtagctacggaaggtatgttccgctgtcggatagtttcgcaatgccaacgtaccgacgaacatcccgaggatcggttccaaatctgcatgcggtcgtcctgcaatcggtgtgccgactacgatgtcctcttgcccgctgtattggtgtaagagcgcggtgtacgctgccagcagcaccatatacaatgtcgagcctgtgtgcgccgccagttctttcagacgttcgctgacttcacgttccagcccgaacaccaccgtatcgcctgccgtacttcgtaccgacggacgggcaaagtctgtcggtagatccagcacaggcagttcgccccggaaggtgtcgagccagtacgcttcctgacgttgcatccactcttgatgggctttgctttgctgccataccgcataatccttgtactgtattcgcaatggcgaaagctcttcaccgtcgtataagcggacaaattcatcggtcagtactcccatggacacaccatccgagacgatatggtgcatatcgagcatgagcaaatgctgcggttcctgctcggttccttgtacacccaaatctaccaagcctacccgcagcagcggagcggcttgcagatcgaacggacgtacaaactgctgcacccgttcttgtgcttcctggctgaccatcgtatccgcagtcgcaccctctacctgtaccttcgtatactccacctcgaacggcacggtgtcctcaatccattgcaccggctcactgtccaccagctcaaagcaggtacgcaacgttgcatggcgggcgatcagttgacggaacgcgtcttctacccgtttcacatccagcggtccgctcacttgcagcaccgacggcatgttgtagttcacatcattcgggtcaaactgatgcagcacatacagtcgtttttgcgccgaagataatgggtagaagttgcgttcttccgttaccggaatggacgcatatgttacttgatccagaccttccatgaccgctgccagttcttcaatcgttggagcttcaaaaatactgcgcagtggaagcggcttgttcagctccttgtgaattttcgaggccagcgtcgtcgcccgcagcgagtgtccgccaatctcaaagaagttttccttcacaccgacctgcgccagacccagcacatcctgccaaatttgcgccagcttcacttccacccatgtccgcggtgctacataatcggctccgctttgcaggttaccttccggtgttggcagtgccttgcggtcgattttaccattcggtgtcaacggcatctgctccagctgcaccaaatacgaaggcaccatgtagtttggaagctcctcgcccagtaagctgcgcagctcaccagcgctcacttcccgttcagcaacatagtacgccaccagttggttttgcccctgttcgtccgcttgtgccagtacgatgacctcttgtacgtcctccaccttcaaaatttgtgcctcgacctcgcccagctcgatccgatagccccggattttcacctgatggtcgatccggcccaaatattcgatgttgccgtctggcatccatctcgccaagtcacccgtacggtacattcgttcatagccggcttcgccagccgcaaacgggttcggtacaaatttctcagccgtcagctctgggcgatccagataaccccgggccagacccggaccggacacgcacagctcacccgctacgcctaccggagccaaatgtccatgcacatccaccatgtacacccgatgattcggcatagggcgtccgatggaaatgagttgtccggctctctcatcctcggataccggccagatggacgtcgccaccgagttttcggttggaccgtagccgttgtagtacgccacctgatccttccacttgtataccaattctgttgaggatgctgaacccgcagtgaacagaatacgcaggtttggcatccgtcccggctccagatacaccgcataggtcggtggcaacgtcgccaccgtaatctgatgttctgtcatataatgttcgaatctctcatagtccaaaatcgtctctgacgttggcacatacaacgtggctccgcagaacagcgcctggaagatttcccagcaagccgcatcaaacgaatagctagcgaacagcaacgtatgatccgacgtgcggatcttgagcgtctgatcaaaatacgttttcagattgcatagaccgcgatgctccaacataacacccttcggctgccccgtcgtacccgacgtataaatgacataggccagatcgttcggaccagacaacgattccaaattggaactatcctcgtgatacacgccctgtgccccattcagcaccagcacgttaccgtcgaaagccactttatccaccagatggctttgcgttaataacagcttcgcacccgagtcgtccagcatgtagcggatacgctcctctggatacgtcggatcgatggggacatatgcacccccggcttttaaaatcccgaagatgcccacgatcatgtctaccgaacgctcggtcatcagacccaccagtcgatccttcgtcacgccttgactgcgtaaggtacgagccagacgattcgcacgttcattcagctcgcgataggtcaactgctctccttcgaagaacaacgctggctgttccggtgtctgcgccgtttgtgtctcgaacaagccatggatcgtttgcccgctcggatactcggcagctgtatctccccatacgctgagaatttgcttgcgctcctgcgtggttaccatatccagctcatacacgcgaatgtccggcttcgccaccacctgctccaacagctgtatcagatggccctgagtccgttcaacggcttcccgatcatataacttcgcattgtattcaaatcggattttcatcgcttcctgcggcatgacaaccagattgaaatcatagttggtttgttcaatcatgcctgcattgcgaatttcaaaatccgactctgcaccttcgccaagttgctcgacctgctcctccaccggatagttttcaaacacgataatgtggttgatcagatcttgcttttgctcgctcaaggcttgaatttcatatagcggatacgtttcataatcttgagaagtcagcgcctgctgctgattcgttctgatcatgtcagcaaaggtgtcctcagccccactgcggatacgtattggaatggtgttaatgaacaagcccaccatattttcgatccccgtaatatccgctggacgaccagacactacaccgccaaaaacagcgtcgtcactaccgttgtacttttggagcagcaatccccaggctgtttgcagcaatgtattcggggtcacgtgatgctgcttggccaccatttccatacgtctggtcaagtccttgcccagatcgcacaggatatgctcaaattgtgcatcgtccgctttcacgcctacttttccggtcggaatcgaagtttgctgatcatagccgagcaaataatccttccagtacgcagctgccgcctctacatcctgtgcttcaagccactcaatatactgactgtatggagtcacgagggcaagcttcggctgtctatgctccacggctgcaaaataagcctcaaacacctcatccgtgactaacgccacacaccagccatccatcaagatgtgatgagagctccacacaaaataataatcctcgtcgcctgttcgtaaaatcgccacgcgcatcaacgcatcccgggacaaatcgaacccggctgccttgtccttgcgaataaattccttcacatacgcgtcacgctcctgctcattcagatgacgcaaatcttcacatctgaaaccaacatccttacggcggaaaatgacctgcacaggctcatcctgccaaccgctgatgaaattagctctaaatatttcatgccgctgcgccaaatgattcaagctatcttggaaaatatccgcttggaagcgtccgtgcaaatcaaaggtcgtttgttcaaaataagcacctgactctgcatccatcagactatggaacaacatgcctttctgcatcggcgtcaacgcatagacattttccagttcccccatgtcacgagtccgttctaccaattgatccaactcggccatggttacatttttcagcatgacatcgcttggcgtcagctcttgctgtttgcggcctgtgcaatgcgcaatgatttcctgcaaactgattctgaactgttcggctaactgctctatcgtttcacgacgatattcctgcttgctgtagctgatcgtcaattgcagttcgccttccgaaatcagtccgttcatatccagcgtgtgcgatctggctgcatgggcgctaagctctgcaccgctagcgtaaggagatacaccaatggattgattttgcatatcttggtcaaattgtcccagatagttaaagctgatttc

SEQ ID NO: 46 - DNA, 60261 bp, Unknown
  Kingdom: Bacteria, Phylum: Firmicutes, Class: Bacilli, Order: Bacillales, Family: Paenibacillaceae, Genus: Paenibacillus
gcactgagctgggtcagaggcatactgccggtatcccttacggtccgtcgttcggtagggcagttcctgttgggctgagcaaatatacacattgcgcttggcatcgtattcaaacttccatttcgggaacaatccttgcttcggatggaatcttcggtgggcaatcacagcaaaaatcttacggctttgcaaaccacggcaaatcggcgttgtcaaataacccgaatccagggcgacggcttccacctgaaaaccaaaacgctctctttggcggtccaaacgcgacaaataagggacggaatcatgtacattccccggcgtcacgtgcacgtcggtaatcacattgtatttggtatccaccgtgcggtggtccaggtaaaaaaagccttcaggtttgccgtcacgaatcatatagccactatcgggatcggttttgctcactttaacctctttttcttcgttcacttcctctcgggattttagcgcttttttccatggtttctccggtcttccgtcaccgctgcattgagctcgtccatgtagtccttggtattttgcagtacctgttctttggtgtactggtgtttgttcgcattcgcttttacgtgcgtcgaatcggtcaccagaacgcgtccgcccaccatccggtgtgagatcgcctgcaggacaatttcatcgaaaatatcctgaaagatcgtggtgtccttaaaacgggtccggcgattccagctgatggtcgtatggtccggaactttatcggttaaacccagccccaaaaaccagcgataagccaagttcgtctgaatttctcgctcgagttgccgttctgagcgaatgccatagaaataaccgagaaagatcattttaaacaacacggtaggatcgatggcaggacgaccgttgtccgcacaatacagcgggcttaccttctcatgaataaaggaaaagtctatatatttatccactttgcgaagcaaatgatcttgcggtaccagtttttccagggaaacgaattcaaaggattgttgtttgtctcgatgagatcgcagcatacgaacaccgtccgttctatacaatagttacctatattatacaacattaacgcggtgtcgtcttaaacaaaatcaacataaaaaagctgtcgagactttctcgacagcctggcagccctgtaggggctgcttttttgatgatgcattgattcagccatgttccggacataaagaaaagaagcataatttcctgatctgaaatccaattcgcgacatcatttctttgccaaagcgactgagaaattttgaatacatagctatttgcataaaaagtacagcggagaagctctgcttcctaaacctcttatttcaattccccattttttaaactttctttagaactatatgcatagattactcataaattttcgttaagaattttaaggtacgccgagtacattgcgttcctccgttccagttgtccggtagactgtgcttgcacttgttgaactaccaatacggtcccttgcgatacgccaataatctgtgagaactgaattcgattgagtttattcgttttccgaatactctttatttttccccctatatcttcattgttccacctacttatctataaaaaaataaaaacagtcccgatataaaaactttccattgagactgtttgagttaaggtactgtattttcttgtaggtaatatttcaaattaagaatggtgttgtatttataatgaaaaaaagtgtcaggtgataaacgcgaaaaataaaaagtctgaaaccaccacaaattaccgtaaaaagaaagttggaaacttgtactattacgataatataattctcataaccatttcctcaatatactgaatgtcgcatataacgtgcttaaatgatcaattttctttttcaaagaattatctctaataatctgtccatctttagtccattgtccatatatttgaactaaccgccctgtagttcgtgagagttcaagaattactgtgccattatatctctagctagttattaattctctttttttgtttgaatgatagcttgattttacttcattctttaaatagtgaacttatggaatggtttgattcttagtataccaaaggtaaactacgatttctgttgtgttttgtcgattttccaatattgaaatagttactcagcggcacttgacgtcagattcctgtggtgggtttttccctttcatttggaaaaaaacacccggcaggatgcgtaccgagagaaatacggcatacacccaagccgggtaagggattagaaaataatatcaatggcctctagcacatcttgctcctgttcggattgcccgttcaaggaaatatccttcaacagcaccgaaggctgttcgcaaatttgggtgatgatcacgagcaggtcctgagcgaaattgtcgatcagattgcgcgtaaacaacttggtggcatattcaaactgcccgttcattccctcatccagcaacgaaatgaccaaggtaagatcaaattgagaaaccgtatgagtttccggataagattcgatcttgatatccccgaagctttgaacattatcttccttggtttccagaacaaacatgacatcgaatacaggattgcggctttgatctcgcggcgcctgcagctttttcacaagctcctcgaacggataatcctggtggtcataggcccccagcatcgtttctttgacttcgttcaagtaagcgaggaacatcttctccccggacggataatggcgaatcgccaaagtgttgacaaacattccgatgagcggctccaggtcggcatgtgtgcggcccgaaaccggtatccctacaatgaagtcttcttgtcctgagtacttgctgagcaggattgaataggccgccaataacaccatataaagggtggcaccgttctcattggcgatgcgctgcaagctgtcggtcatctgcttgtcgatgctgaaaggcagcacatctccctcaaagctgcgagcgacaggtctgacaaagtccgtaggcagttcaagcgtcggcagttcgccttccagcatgtccagccagtaggcttcctgacgtttcagccgctcttttacaggttcggactgctgccaagcggcgaattccttgtattgaatccgaagcggttccatagtctcgccgttatacagacgcagcagctcttcgacgaagatgcccatcgacatgccatccgtgacgatatgatgaatgtccagcatgagcagatgccgttccgcttcccattcgactaagcccacacgcagcagcggcggccgctctaaatcaaagacgcgcacaaagccgtctacgatgctcttcgtttcactttccgtcgctttcgtatactcgacggcaaacttcaagtccggataaatccgttgtaccggttcgccgtcgaccatttcgaagccggttcgcaaaatttcgtgacgagctatcaatcctttgagcgccgcctcgaattgattccgttccaagcgcccgacgagaaccgtcatgccggacatgttgtagctaagctcggcgccttccatctgctgctggatgtacagccgtttttgcacggaggaaagcggatagtaatccctcttatccagaaccggaatggagaggtgttcctgccgttccaattggctgatcgcttcggccatcgcttcgatggtcgagtgccggaacacatcgcgcagcggcaggtccacgctcagctccttgtgcaccttgctgaccagcgtcgtcgcccgcagggagtgcccgccgaggtcgaagaagttgtccgtcacgccaatcgtgaccggtccaagcacgtcctgccagatggcgaccagtttcgcctccagttcggtgcgcggcgccacgtattcgcggcctgcgcttgctcccccttccggcgccggcagcgccttccggtcgattttcccgttcggcgtcagaggcaggcgctccagctcgacgaagtacgacgggatcatgtaacccggcagctcgctggcaatcgcccgtttcaggtcagccgccgtcagttcgccatccgttgtgtagtacgcgcacagcgctttctgcccgttcgcatcacttcgaaccagcaccaccgcttcgcgcacgccttccacccgcagcagttgcgactcgatctcgcccgtctcgatccggtagccccggattttcgcctggttgtcgatccggccgatgaagtccacgttgccgtcttccatccaccgcgccaagtctcccgtgcggtacagccgctcgcccgcggcgaacggactgtctacgaacttctcttctgtcagctccggacggttcaagtacccgcgcgccactccgactccgccgatgaccagctcgcccagcaccccgaccggcaccgggttcagatgcgcatccacgatgtagaatttcgcattcagccacgctttgccgatcggcacattgcctgtctgcggcagcttcgccagctcctcgtcgtagaaactggagtcgatcgccgcttccgtcacaccgtatgcgttgatgatccggaacaacgagccgaagcgttcctgcaaggttcggtaatccgccacgctgcagctgtccgagctcgtgatcaacagctccatccagctcatatccagcccctgctcgtgcacgtactccaggaacggcacgatcagcgctggcgtcgattcgaagatggtgacccgctcccgctcaatccagtagtgcagacgagacggatcgatccggtcgtccttcggcacaatcaccatcgtgcctccgttgtacagcgtccgcgcgatatctcccacgaacacgtcaaacgagaagcttgcgagctgcagcagccgcaccgggaactgatccaacccgtattcccgccggtagcccgccgctgtgttcaccaggctgcggtgctcgatcatcacgcccttcggcttgcccgtcgttcccgacgtgtagatcacgtacgccaggtcctctggacgggcttcatggaagctgtcggcattcgcccgctcgtcgctgtacgacgcttcgtcgtcgaggtacagcaccgccgccagcgccagctcctcttcgccgagccaggcttcggcacgctctcgcagcggcgtttgcgtcagcagtaccttcgctccgctgtcttcgagcatgaaccgcacgcgctccgccgggtaatccgggtcgagcggcacatacgccccgcccgctttccagacagccagcacggccaccagcaagtccaccgaacgctcggcgagaatgccgacgatcgtctcccggccgatgccgcttgcgcgcagcgtagccgccaagcagttcgcccgctcgttcagctccgcatacgtcagccggtcgttctcgtacacgacggccgccgcttccggcgtgcgctccgcctgttcctcaaacagccggtggaacgcggccgcaggagccgcttccggctgcgccgggttaaacgcgccaagaatttgctctttttccgccggtgtcaaaatgcccagctcggcaatagtcgccgacgggttgcggagaatggattcaagcagctgcaagtagtgagcggccaatttctccaccgtttcggttttataaagagcagtggcgtattcaaacagatattccaagccttcctcgatctccgtgacgtccaagctgagatcgaatttagaaacaatttcttcgctggtatacgtcgacaaatggagtccgggaagctggatttccaaattctctgtattctgcaaagcaaacatcgtatcgaacagcggattgcggcttaaatcgcgagccacattcaccttatccaccagttcctcaaacggataattctgatgttcaaaagcgcccagcgtcgtctccttgatttccttcaagtaatcaaggaacgtcttaccggcagccggataactgcggatggccagggtattgacgaacatcccgatcagcggctgaacgtcgctgtgatttcttcccgcaatcggcgtaccgaccaccacgtcttcttgtcctgtatatttatgcaataatattgtataaccagcaagcagaaccatgtaaagtgttgcgccgttctcggctgcaagccgtttcagaccctcgcttttctcgctatgcataaacaattgcagcgtacggccctcgtagctctgcatagccgggcgcggatagtccgtcggcaattccaaaaccggcagctcaccgcggaacatgtcgagccagtaggcttcctgcttggcaagctgagctttctgctcgtccgattgctgccataccgcataatctttgtactgaatgcggagcggctccaactgctccccgctgtacaagcggacgaactcttcgatcagtacgtcaatcgaaacgccgtcagatacgatatgatgcgtatcgaacattagaatgtgccggtccggcgccagttcggcaaggcctacccgcagaagtggcggcttcgctagatcaaacggacgaacgaattggcgcaccgtttcttccgcctgctccccgctgatctgcacatattccacctggaagacggcttcttcgtaaatccgctgaaccgcttcgccttttaccatctcaaagccggtacgcagcgtttcatgacgagctacgagcccgcggaacgcttcttcaaaccgctgccggtcgagctccccttcgagcagcatagctcccggtatgttgtagctcagctcggctccttccagctggttcaagatatagagacgtttctgagcggaagagagcggataatactcgctaggttccgtagccggaatagccgtgaacgagccgatctccagccgctccatagccgcggccatttcctcaaccgtcgagtagcggaatacgtcgcgaagcgggaattcaatgcctagctccttatgcattttgctgacaagcgtcgtcgcccgcagggagtgtccgccgaggtcgaagaagttgtccgttacgcctaccgccttctcccgaacaagcacatcctgccaaatggcggccagcttcgcctcaagttcggtgcgcggcgccacgtattcgcggcctccgcctgctcccccttccggtgccggcagcgccttccggtcgatctttccgttcggcgtcagaggcaggcgctccagctccacgaagtacgacgggatcatgtaccccggcagctcgctggcaatcgcccgcttcaggtccgccgccgtcaagccttcttccgctgtataataagcgcacaaagctttctgaccttcttgatcttccctgacgacgacgaccgcttccgtcacgccacctacactcagcagcttcgcttcgacttcgcccgtctcaatccggtacccccggattttcgcctggttgtcgatccggccgataaagtccacgttgccgtcctccatccaccgcgccaagtctcccgtgcggtacagccgctcgcccgcggcgaacgggctgtctacgaacttctcttccgtcagctctggacggttcaagtacccgcgcgccactccgactccgccaatgaccagctcgcccagcaccccgaccggcaccgggttcagatgcgcgtccacgatgtagaatttcgcattcagccacgctttgccgatcggcacattgcctgtctgcggcagcttcgccagctcctcgtcgtagaaactggagtcgatcgccgcttccgtcacaccgtatgcgttgatgatccggaacaacgagccgaagcgttcctgcaaggtccggtaatccgccacgctgcagctgtccgagctcgtgatcaacagctccacccggctcatgtccagttgctgctcgtgcacgtactccaggaacggcacgatcagcgccggcgtcgattcgaagatggtgacccgctcccgctccatccagtggtgcagacgagacggatcgatccggtcgtccttcggcacaatcaccatcgtgcctccgttgtacagcgtccgcgcgatatctcccacgaacacgtcaaacgagaagcttgcgagctgcagcagccgcaccgggaactcatccaaccggtattcccgccggtagcccgccgccgtgttcgccaggctgcggtgctcgatcatcacgcccttcggcttgcccgtcgttcccgacgtatagatcacgtacgccaggtcctctggacgggcttcatggaagctgtcggcattcgcccgctcgtcgctgtacgacgcttcgtcgtcgaggtacagcaccgccgccagcgccagctcctcttcgccgagccaggcttcggcacgctctcgcagcggcgtttgcgtcaacagcaccttcgctccgctgtcttcgagcatgaaccgcacgcgctccgccgggtaatccgggtcgagcggcacatacgccccgcccgctttccagacggccagcacggctaccagcaagtccaccgaacgctcggcgagaatgccgacgatcgtctcccggccgatgccgcttgcgcgcagcgtggccgccaagcgattcgcccgctcgttcagctccgcatacgtcagccggtcattctcgtacacgacagctgccgcttccggcgtgcgttccgcctgttcctcgaacagccggtgaaacgcggccacaggagccgcttccggctgcaccgggttaaacgcgccaagaatttgctctttttccgccgccgtcaaaagctccaactgattcacgcggatgttcggattagtcgcaaccttctccagtgcccgggcaaaatgaccgtggatcagcctgatgtcttcctctctgaacgtcagcccattgtacgtaaaccgcagtaaaatatgctcttccggaatgacggtaatgtccaggtcgtagttcgtttgctccggcgactggatattagcgattttcagcgcttctttgtctccgccgacgacctgttcaatctgttcttccatcggataattttcaaagaccatgatatggttgatcaagtcgcgcttttgctcgctcagcgactgaatttcgaacagcgggaacgtttcgtaagctcccgatgccagcgcttgatcctgggtttttctcaagatatcggctaccgtctcctcggctttgccttgaatacggaccgggatcgtattaataaacaggccgatcatgctttcgatgcccggaatttctgccggacgcccggatacgacggagccgaatacgacatcctcgctgttgttgtatacctgcagaaccagtccccatacggtctgcatgaacgtattgagcgtcacctgctgctggcgcgccacccgctcgatttgcccggtcagttccttgctgagttccacatcgatttcagctgcttcaaaagcgccctgcttcagctgcgttttctcctggggcagcttggtctgctgatcgtaacccgccaaatactcggaccagtaacgcgaagctttcgcggcatcttgagcttccagccattcgatataccgggagtacgaggtaaccggaggaagctccagcgtccgcttctcttggaacgcgaagtaggtgtcgaacacttccttgatcatgaaggacatgcaccagccgtccatcaaaatgtgatggtgactccagatcacatggtaggactcgtcgcccgtgcgcaaaactgtcacgcgcataagagagcctcgggccaaatcgaacttgttcgctttatccgcgctgacgaaatcggctatcgtcttctccgggtcttcatcgcttaccgagcgaatatcttcaaagtacacttcacacttccgctcgcggaataccacttgaattggctcgtctctccagccggtaataaagttggtccgcagcgcctcattccgctgcaccagcgtatccaatccttgggtgaaggcttcgacattcaggcttccgtacagatcgaaggtcacctgttcgaagtaagcttccgaatcgacatccagcaggctgtggaacaacatccctttttgcagcggagtcagggtgtatacattctccagttcgccgagcgacgccgtatgttcggccagccgctccagttcctccaacgtcacatcttgaagcagtacgtcgctaggcgtaagctccggtcgctctttcgatacgcaatggctgatgacttcacgcaagctcgaatgaagcagggtgcccaggcgctctaccgtttcccgtttatactgggtttccccataacggatcgtgagttcctgcactccttccgacaccataccgttgatatcgaggacataatccatcactgcattcgggcttgaatcggagcccgggctgaacggagacggcctcgagccgctgctttcgtaatcctggtcgaactgacccaaatagttaaagctgatctccggctccaaagcgaagcgctcgccgtcacgcggcgccgacaaataacgcaggatgccgtagccgattcctttgttaggaatgcggcgcaagctttctttaacctgtttcacctgatgaccgagcgcctgggcgtgacccggctccagaacgacagggaattggcttgtaaaccaacctaccgtgcgcgtaatgtccacatccggcaaaatctcttcccggccgtggccttcgagattcaccagcacacgttcccgaccgctccaagcttgtaccgcgaggccaagcgcggcaagcagcaaatcgttcatttccgtatggtaagcacggtgtgcctgcttcagcagctgttcggtttcctccgccgtccagcgaacggtcacgagcccgctgtccttcagcttggatctgccttgttcaaaatctttcggaagcggctcataggtcaattgctcgatatgctgccaatactctctctcgctttccatcgccggaccgttcgcataatcagcgagctgtttcgcccacgtttggaatgaatccgttttgagcggcagacggatcggctgcccttgcagcgcctgctcatagccggcagcaaaatcctcaagcagaatccgccaggatacgccgtctacgaccaagtgatggatcgcgatgagcaggtggtcgccgtcgtcgcagcggaacaagccgagcttcaccagcggaccgttttccagatcgatgctcgcttgaatgtcattcgccttagcctctaccgcttccttcacgtcgccgactcccttgaaatcgacaacttccagatcgaacagcgcttcgttctccccggcgccgcggttccaggcggtatagccgttctcggtttggcggtaaaccgtacggagagcatcgtgatgcacgacaagctgacgcaccgcttggcgtaaagcttcttcgtcaaagccttgcttggagaactgcatgaacgcctggttgctgtgatgcacgtcggcctgattttgttcaaagaaccagcgctgaatcggggtcaagatgacctctcccgtcacttcggcctggcttgccgttctctccgccgtttgcagctgcaaactaagggcggaaatcgtcgggtaatggaacaaatctttcatgaccagcttgtaccccgtttgcaaaagacgggacgatacctgcaaggccttgatcgaatcgccgccgagcgcaaagaaattgtccatcgtgccgacctgatccacgcccagcaccgactgccagaccgacgcaagtgcttgctcggcaggagtacgaggcgccgtgtatgcagcctcggcacgaatgcttccttccggtacaggcagcgctttacggtcgatcttcccgttcggcgtaagcggcatttgatccaggcgcatgatgcgcgaaggcaccatatgggaaggcagcgcggcgtccagattggccacaagcccttcaagatcgaagctggaatccgctacgacatacccgcacaaatatttctgctcccgctcgtccgtccggtcgatgacaagtgcttgacgcacgccggcaaaatttttcatggccgcttcaatctcaccaagctcgatccgatagccgcgaattttcacctggttgtcgatccggccgatgaagtccacgttgccgtccggcatccagcgcgccaggtcgcctgtccggtacagccgctccccagcggcgaacgggctgtctacgaatttctccgccgtcaaatccgggcggttcaagtaaccgcgggccacacccgctccgccgataaccagctcgcccaacaccccgatcggcaccggcttcagattcgcatccacgatgtagaacttggcgttcagccacgctttcccgatcggcacgctgcccgtcttcggcagcttctccagcggctcgtcatagaagctggagtcaatcgccgcttccgttacgccgtagctgttaataatacggaactgcgagccgaagcgctcctgcaaggtgcggtaatccgctacgctgcacgcatccgagcttgtgagcagcagctgcatcgagctgaggtccagaccctcggcatgcacatgctccatgaacggcacgatcagcgccggagtcgattcgaacaccgtcacggcgtagtcgcgaatccagccgtagaggcgggttggatcaatccggtcgtccttcggcacgatgaccatggtgccgccgttgtacagcgtccgcgcaatgtcgccgacgaacacgtcgaacgagaagctggcgagctgcagcagccggatcgggaactgatccaggcggtattcccgccggtagcccaccgccgtgttcaccaggctgcggtgctcgatcatcacgcccttcggcttgcccgtcgtaccggaggtgtagatgacgtaagccaaatcgcgcggcttgttcacattcgccggattcgatgcgagatccgccgctagtacgttcttctcggcttctgccgtggcggacgtttcggcagcagccgcttccgccgctccgaggctgtacgtcgcggcgtcgtcaagcgcaagcaccgtttgcagcactagagctccgtcgctgcgccaagcttccgcctgctccagcaggcgggtctgtgtgagcagcaccgacgccccgctgtccgcgagcatatactcaatccgctccgccggatagtccgggtcgagcggcacataagcgccgcccgctttccatacggcgagcaccccgatcaacagctccgccgaacggccggccagaatgccgaccacctgctccggcttcaccccgcgcgcccgcagtgcatacgccagacgattcgctttagcgttcagctccgcatacgtcagcttgctgtcttcgtagacaaccgccagcgctcccggagtgcgctccgcctgctcctcgaacagctcgtggaacgttctctctccccacgactcatccgcttccaaacctgtaccctctgcggcgggttgcttcgcaagagccgaagacgacacgtcaaacccgaccagcaaatcatgtttttcgctgtccgtcaagatatccaaatcggaaatccgcgcacccggctgagccaggatcgacgccaaaagctgctcgtaatgacccgccagccgtaccatcgtttcctgtctaaacaacgaggtagcgtactcgatcttgcaaaccagcacgttatcgacttccacgatatcaaggctaagatcaaactttgccgtcttttcctcgatgtcgaacagtgaccattgcaagccttccagggttaaatccaagctttcgtgcttttgcaaagaaaacatggtgtcaaacagaggattccggcttaaatcccggctcacctgaagagcttccaccagctcctcgaacggatagtcctggtgctcgtaggctccaagcatcgtttccttcacttcctgcaagtaatccaggaacgtccgctccgccgccggacccaagcgaagggccagcgtattgacgaacatgccgataatcggctgcaggtcggcgtgagaacgggcggcaatcggagtgccgaccactatatcttcctgtcccgcgtatttatgaagcaatacggagtacgcagccagcagaagcatatacagcgtcgcccccgaatcgccggcaagccggttgagagcttcgcttttctccgcatccagcgtaaacgtgagcgtttgaccgtcaaactgctggacggccgggcgggagaagtcgagaggcagctcaagaaccggaagctcggagctgaataccccgcgccagtattccccctgccgtttgatgcgctggcgctgctcctcggattgctgccaaacggcgtaatccttgtattgaatccgcagctccggcaattcttccccattgtaaagccgcacgaattcgcgcagcagcacgtccatggaaaggccgtcggaaccaatatgatgaatatccagcgcgagcaggaatttctctttctccagttcgatcagcagggcgcgcagcaaaggcggctgggtcaagtcaaaaggctgaatgaagccttcaagaatggccgcaacctgatcttcgcttgcttgaaacttctcgaccttgaaagctacgagcggataaatacgctgaaccggctccccattcacgatttcaaaaccggtgcgcagcatatcgtgccgggccaccaaagtagtcagcgccttttccactttggcctcgttcaaagcccctcccaattgcaaggcgcttgggaggttgtaattcagctccgagccatccagctggtgcaggacgtacagccttttttgcgcggaggaaaccggatagtacgctttctcttccgctttcggaatcgagctgtgccgcgtttcttccaagctggcaatagccccggccatcgactctaccgtcgtatagcggaacacatcacgcagcggaagttcgacgttcatttccttctgaatcttgctgacaagattcgtcgcccgcaaggagtggcctccgagctcgaagaaattgtccaggactccaataccggagtagcctagcacttcctcccagatcttcacaagctgggactccgtccggttacgcggcgctacgtattcgacgcctgtttgcaagccgccttgcggctccggcagcgctttgcggtccacttttccgttggacgtcagcggcatgcactccagctgcacgaagtacgacgggatcatgtaccccggcatttcctgggccagcgaggttctcatttcgctgaccgtcagcgtccggtccgccacaaagtaggcgacaagcgccttctcgcccccgccgtcctgacgggcgagcaccaccgcttcttctacgccctcaacgttcagtagctgcgtctcgatttcgtccagctcgatccggtagccgcggattttcacctggtggtcgatccggcccaggtattcgatgttgccgtccggcagccaagccgccaagtcgcccgagcggtacagtttctccccctccgcaaacggggaatcgacgaacttctccgccgtcagatctggacggttcaggtatcctctcgcaaggccttccccggccacgtacatttcgcccgctacgccgatcggcacagggcggcggttttcatcaaggacgtacacgctcagcgtcgggatcggcttgccgatattgctcttcgccgcctcaatctcgacccacgtaatttccttatacgtaacgtgaaccgtcgtctcggtaatgccgtacatattaatcagcttcgtctccgggtacttcgtcttgaagcccttgagcagcagcggactgagcgcttcgcccccgaagatgacgttgcgaatccgcagatcgtacggatggtccgccaagaccttacgcagcagctggtagaagtacgttggcgtctggttcaaaatcgtgacctgttcgcggcccagcagcgccaggaaatcggccggatttttcgccgtgagcggcggtacgatgaccagcttgcctccgtacagcagcgctccgtacatttcccagacggagaaatcgaagcagaacgagtggaacagcgtccacgtgtcggacggcccgaagtcaaacaggttcttgtcgttgaacaggaggcgcacgacgttcttatgctcgatcagcgttcctttcggtctgccggtcgttcccgacgtgtagatgacataagccaggttggccggcccggaaatcggctccaggttcgaagcgtccagcgcatcggcggagtccgcccctctgtcgccccaaacgaaatcgtccaattcgaggcgcgttcctgcgaagtcggtcttctcgtgcagatgcttttgaatcagcaataacggcgcgcccgaatcctcgatcatgaagcggatgcgctcctccgggtagtcgggatcgacaggcacgtatgctccgcccgctttgagaatcgccagaatgccgacaaccatatcgagcgagcgttcggccagaatcgctaccagctggtccgcttttactcccgtctcccgcagcttccgcgcaaggcggttggatcgctcgttcagctcgcggtaggtcagctgccgctcgttcatgacggcggccacgttgtccgggtaaagctccgcctgttcttcgaacaagccgtaaatcgtctgctgccgcgggtagtccgcctccgaatcgttgaaaccgcgcaccagctcgtagatttcctcctccgtgagcatttccagcgaggcaatatcctcgtccggcgttgctgcgatggtttcgagcagcttgtcataatgtctggcgaaccgctccgcggtctcttgtttatacagagccgtagcgtactccaaccggcattcgagctgaccgtccagctccgaaatatccaggagcagctcgaacttggatgtttggttttccagtggataaaacgattgctccagcccctcgatgacaatttgctcgttctccgtattttgtagggagaagaacgtgtcaaagagcggattccggccggtcgcgcgcggaatgtgaagactttctaccaagtcttcgaacaaataattttggtgttcgaaagccccgagcgtgatgtccttgatttcttccaggtacgaaaggtacggcttggaacgctccggacggctgcgaatggccagcgtgttgataaacatccctacgatcggccgcacttcttcatgcgttcttcctgcaatcggcgtgcctacgatcagatcttcctgacccgaatatttatgcataaggatggtgtaagccgacagcagcaccatgtacagggtcgtccctgtccgtgccgccagctctttcagcttctccgtccgatctttctcgatataaaacttcacggttcggccgtcaaagctttgcaccgcaggccgcgggaagtccgtcggcagctccaagaccggcagctcgcccgacagctgttccagccaatactccttctgcggctggagcatctgcccgtaagcttcggaatgctgccaaacggcataatctttgtattgaatgcgcagcggggccagctcctcgccccgatacaggcggctgaactcgtcgaagagcagcgctgtcgaaatgccgtccgagacgatatggtgcatatcgaacagcagaatgtggcgatcctcggcgacttcgatcaggccgatgcggagaagtggcggcttggtcagatcaaacgggtgatagtaagcttccaccacttgctccacttcccgctcgctcgcttggaaataatctacagcaaactccacctcgtcatagatgcgctggacaagctcgccttgaacctgctcgatcccggtacgcagcgtctcatggcgctgaatcagcgcccggaacgcgtgctgggcgcgtgtgcggtccagcttgccttcgagaagaagcgccgccgacatattgtagctgcgctcggccccgtcaagctggcgcaggacgtacagacgcttttgctcggatgaaaccggatagtactcggcctcagccgcctttgtaatctcatacgtctcctgctgccttaaaccgccgattctttgggctagctgttcgatcgtggtgtaacggaaaacttcccgcagcgaaacctcgacttgcagctctttcctaatcttggaaacaagcgtagaggcccgcaaggaatgaccacccaagtcaaagaaatcgtcttggactccaactcgcgcaatacccagcacctgctgccaaatgagagcaagtcttgtttccagcgttgtgcgaggagccacatactcacggcctgcttctacctctccggtcggttcaggcagcgctttacggtcaattttgccgttcggcgtgagcggaagcttatcaagagacaccagccgggccgggaccatatgggccggcagctcttgcttcaattgggacagcagatcgctcagctgcaaggaagcatccgccgcgacgtagccgcacaaatacttttgcccctgctcatccgtacggtcggtcaccacagcctgcttgacgcccgggaaacgcagcagggccgtttcaatttcgccgagttcgatccggaacccgcgaattttcacttgatagtcgatccggccgatgaagtcgacgttgccgtcttccagccagcgggccaaatcgcctgtccggtacagacgttcgcccggcacaaacgggctgtccgcaaacttctcggcggttaggtccggacggttccagtacccgcgcgccaccccggcgccgccgatgacaagctcgcccggaacccctacaggaaccggctttaacgcggcatcgacaatgtaaaaccgggcgttcagccaagctttgccgatcggcacatgccccgacggcggcagcttatccagcggctcaccgtaaaagctgctgtcaatggccgcttcggtaacgccatagctgttgatgatgcggaattgtccgccgaatctttcctgcagcaatcggtaatcggtgacactgcaagcatccgagctggtaatcagcaactgcatggagctaacgttcagcccttcctcataaatatactgcatgaacggcaggatgagcgcaggcgtcgattcgaataccgtaatgttttggtcccgaatccagccgtataagaggttcggatcaatccggtcatccttcggcacaatcaccatcgtgcctccgttatacagcgtccgtgcgatgtctccgacgaacacgtcaaacgagaagctggccagctggagcagccgcaccggaaactgatccaaccggtactcgcgacggtacgcatctgccgtattcacgagactaccgtgctcgatcatgacgcctttcgggcgtcccgtcgtacccgaggtgtaaatcacataagccaagtcttgcggggcgctgtcggcagattcaaattccacggctaaggcatccccgttataaatctgttcatcgtccatggcatagacagcttgaagcttcagccggtcatcggccaaccaacctccggcccgctccaacagatgacgctgcgtaagcagcaccgatgcatcgctatcgctgagcatgtactcaatccgctccgccggataatcggggtccagcggtacataggctccgccggctttccaaacggcgagcaccccgaccaacagttccaccgaacgctccgcccagatccccgtaatcgtctctcttcccacgccctgttcgcgaaggagagaagccagcagctcggcgcgttcgttcaattcgccgtaggtcagctgtttgtccatgtagacgactgccggatggtccggaatttcccgggcaaacttttcaacataccgatgaaacgcttctccctcgctcagccctgccatcggcgggttaaaaacgttgagaatgcggtgtctctcctcatcgctcagcagagaaatctcgcgtaccggcagttcgggagtctgaaggaactggtccagaacggttacatactgttccataatccgatcaatctcggccgtctcgaacaggccggtacgataggaagcatggagaattacatggccttcattcagcatatggtcgaagcgcagcagcaaatcgtccatctcgtgcctagcgaagtgagcctccaggcgtaccttgatttcttcgtactccacgattttcaaaggcagatattccagagacgtgcggaacagccccgaaagatcgttgcggccgtgttgttcgcgtaaatcctggatcaattgattataagggtatttctgataccgcagatccgccgtattttccttggaaaccgtttggatcaaggaaagcacgtgcccgtctggattcagacgaatccgcgtagccacggtgctgacgaacatgccgatcgtttctttttccttcttgctggtgcgattggcgaaaaccgtgccgaccggaacatcggtgctgtcggtcagcttgtacaataaggcgtacatggcggacagaaataacgtatataagctgacctgatattgttcgctgaaggccagaatgcgttcataccgagaaccgtccaaagtgatggccagtttattggattcgctgccgatcgagaatggcggatacgatttaatgccggtcgtttcaggcaaagtgttgtacttcgtcagccagtattccttgcctttttgataacgctgcgattgctcatattcacgctccgcggaaatataatccagataggtaggggcctggtaactgctggagatgcctttgcgcagttccaggtatttttccatcaccgcatgcagcaaagcattgacggacaagccgtcggcgataatatgatttaccgtcaaattgagccatacttggccgttcgcaaaatggataatcgtaaattggtagaggtgttcgtcgaacacgctggccggtttttcgcttacttctttcacccaagcatagaattgttcggttgtgcctatttcgaggcggcttatcctagcttggacattctccggctcttcgaaccactgcgttggattttgcaaatccccgctaatgcggattcggaaaacgtcataggttttgacgatctctgccgccgcttgctccagaagctgtgtgttgatctcgcccgtaatctggtaggtcgcggaaagcatcgtgatggacgttcccggattcataatttccatgaaccatattcggcgctgggcttgcgttaatccatattgctcgttggtattctctctcacatcgacacactcccggtttagagattctttatagataggctttgtacctagatgtcacttagtcactcttagaagaaccgcgcagccattcccggaacggctccttcggactctgtcccctttttcgtgttctggtaactaccggttataaagtcataccttggattactaaaagactctgtcgcattcgcaagcaggaagccgcccgccgtaaagcgggtctagccgtacagccgggcgtaataaccctcgagcgccagcaggtcctgatggcggccccgctcaacgaccgtcccttggttcatgacggtaatcaaatccgcatgttccacggtgctgagacggtgggcgatcagaatggtggtgcgccccttcatcaatacgttcagggcctgctgtacccaatgctgggattcgttatccagcgcggaagtcgcttcgtccagcagcagaatcggggcgtttttgagaatcgcccgggcgatcgcaattcgctgcctttgtccgcccgacaacgacgctcctctctctcccaccggcgttttatactgttcaggaagttcctgaatgaaatggtgagcgtacgccgctttggccgcttcgatcacttcttcatccgttgcatccgggttgccgtagcggatgttttcctcaatcgtgccggtaaacaagaacggctcctgcggaacgtatgcaatctgcctgcggatttcgtccagcgtgtaatggccgaacggtttgccttggagcaggatttctccgctgtccacaggataaaagccgagcagcagcttgatcagcgtacttttgccgctgccgctggcccccacgatagcggcgacctggccgggaaacacctgcatggagatgtcgacaagcacctttttatccgcctgataggaaaattccacatcgcgaaactccaccgcagcctccgacacgagctcgctgtgaggagatcccaaacgctccggttcctcttcctctcttagtacctcttgaatccggtgagcgcccgcgatcgaattttgggtcatcgacagaaccatccccaagttcaacaaggcgtgcgtcagatttacttgcagaaccgccagggcagcgacgcttcccattcccatcagtccgtaagcataaagaagactgccgatgacgatgatgccgcagaacgtgacgtagctgataaaatgattcaccgcagcctgcatgccgttcttctgcgcggtttgccgaagcgtctgcgtcatttgttcgttcaacgcctcgtactggccgtaaatcgtgcggatgcggaacagcttcacaatttgaatgccgcccataaaatctttaaatttttcggtcattttaccgagcgtttgcaagccttgttcggacaaggcgcgaatatcccgcgcaaatttcaggctgaccacggaggacagcagcagaatgacgaaggatacgccggcaaaccgccaatcgatcaacaccatggagacaatggagccgatgcaaaagacaacttgaagcagcaaaacgaagtaaacctgcgagaatgtaaactcaacggtcgttacgtcgttgttcacccgcgacagcaaatccccatggtgcgtctgctccaggaatctcggccgcacccggcacagcttatcataaagacgttcgcggatattcagcacagtcagctcaacactgcgctgatataagtaaatgaaccagggagaaatcacattttccaggaacaaggccgcgcccaaaataataaaggcttccaccatcagggacgtatctcgggacacggcgaaatcaaccaagttatgtacgaccaagctgaaggcgatcaagaacaatgtctgggtgagcgccgtcacggctaggccaatggcgtactgggttttgcgcttgcggttcataaacatcagcaagtagccgagttctttcacttgcgagagccatccggcctttttcatgtgtacgccacctccctgcgttcggcagactcggtaaattcctgatagtacgactgggcgtacagtcccttcatcttcagcaattgttcatgagtgcccttttcaacaatactcccctgttccatgacccaaatttcgtcggcgttttgtactgtagaaagccggtgggcaataaccatcgtcgttctctgcttcatcaatacgcccagcgcttcctgaaccgcgctttccgactccggatcaagagctgacgttggttcgtccagcagcagaacgggagcattctttagaaaagcccgggccattgcaatgcgctggcgctgcccgccggacaaaaagcctccgcgctctccgacatacgtctggtagccgtcgggaagctgcataatgaaggaatgcgcctgagcggctttggcggcttcgataatctcgtccatcgacgctacttcccgcccgtagccgatattttcagcgatcgtgccgctaaacaaatatgaatcctgggttaccacggaaaaatgcgaccgaagctgctccggatcggcgccgtggatcaggctgccgaacacgcggatttcaccatggtcctccggaagcggataaaagccgcatacaagcttaaacaccgtgctcttccctccgccgctcgctccgacaagcgcgatcgtcttcccttccggcaccgagaagctaacattccgcaggatcggggagctctcctcatacccgaaggttacgttctgaaactcgatgggggcggcgctcgctttcggaagcggacggccattttccgtttcggtcggctgctcgacgatttcggagacccttctcagggcaccggccatttcgaacgtccgcgtgataagctcgggaatatgctccagcggctccagacagagattcagcaagtacaggaaggcgatcagctctcccgcgcctagctgctctttgtagatcaaatagcttccgtaactgacggcgaaaatgatcgggctgatcatcagcgtggaaagcagcgggttgacccaggcttcccgctttttcaccgccagctttttttgggccgtcaattgcagcagcacttggtaggagcgagataacatgccggatagcaggtagctttttacaataggcatacccccaagcgtatcctggaggttgacgttcattcggcccatgttcgcctgggcttcctccgtcaaccgctccaactgcttgccgatccattgggaaaccagcagcgctacgggaaataacagcaggctgtacagcatcagctcccattggaggtagatcaaataagcgaaacagccgatgaacaccagcggatgataaaaccactgggcgaggtcccgaatcataaactgctggatcagctgcaggtcgttgttgatccgcgacaatacgtcgccggagtgctgcttttccaagtaggagaccgggagtttgccgacatgacgcatgacatggttgcggatatcctgcaccgcagaggcgctgcttcgctccacgccgaagctcatgaaaaacttcgccgggacaccgatcaagatgaccacaaagaccgtgtacacgatttgcagaacgattggccctgcccccttctcggcctgggtggtcagctgctcgatcaaacttcccatccatatctcaataacggcggcggcaatcgcggacaagataccgacgatcatccagcctttgtgacggcttacataggacatcagccagcggaacgctttccaggcggcgtaagcggtttggcgcttggaaggcgccgctgtgccttgttctagaacagacggctggcggtcagcttccatgcagtaccccggcctccgcttcgatctgccgcttgacttgctctaagatgtcccggatgacgacggccgtttcttccacgcgcgcgagttccagcaattcctcgtgcgcgccctccagccggtaatcggcgtaagctcgcgtcgttgccccccgccaggaaggcaattggtgcttcaagcggaacgcttcgctgtccttcgcaatcatttcgtaaatccgggccgggatcgtgccggaattaataagctgcgcttcgtacgccaaggtcgctttgaccttccgatgaacccgctcccgcacgagcgggttgctcattaattccttctcttcttcgtcgaaatcggcaagcgtttcttcaagctctttctccgacgtttcggaaggcgtcagcgtgtccttaatccacgagtccaccatgagcacgtccgttacggaataccctcttttctccatcgttttggctacctcgaacgtcaggttgcctccgaagcagtagccgagcagcacgtaaggtccttccggctggatgcggacgatctcgtccacataacggttcagcatggcctcgtaatcgacggcatcgtcgataaaatcaatgccgtagagcacgaaccagccgtcgagcctgcttgcgagctctcggtaaccgatgccgaagccgctgcccggagggaagcagaacacgttcagatctcctgctttattcagcttaatgaaggagtctccccctttatccaggcccagatccccctctcccaaagccatggctccaactgttaaattgtggaattggcggttcagcggtatctcgaggcccgtttcatcgtaaacggcttgaacgagcctcatcagacttaacgaattgccacccaactcaaaaaagttatcctttacgccgacctgcggaacgccaagcgtatcctgccagacgcgggcgatcttcatttcgagcagcgttctcggcgcgacatattccgctcctccagccgcggcttcctccggcgcgggcagcgctttgcggtcgattttcccgttcggggtcagcggcatccgcgaaagctgcacgaggtgcgaaggaatcatataccccggaagctgcttggcgagctcctccttgagttcattcgccgccagcctcgtttccgcgacgtaataagcgacaagctgcttatggccgttcgcgtcgtggcggtcgagcaccttggcttcttgcacggcggcgatcttcagcagctgcgtctcgatttcgtccagctcgatccggtacccgcggattttcacctgatgatcgatccggcccaggtattcgatgttgccgtccggcagccaagctgccaagtcgcccgagcggtacagcttctccccctccgcaaacggggaatcgacgaacttctccgccgtcagatccggacggttcaggtatcctctcgcaaggccttccccggccacgtacatttcgcccgctactccaatcggcacagggcggcggttttcatcaaggacgtacaccctcagtgtcgggatcggcttgccgatattgctcttcgccgtctccatttcgacccacgtgatttccttatacgtcacgtgaaccgtcgtctcggtaatgccgtacatattgatcagcttcgtctccgggtacttcgtcttgaagcccttgagcagcagcggactcagcgcttcgcccccgaagatgacgttgcgaatccgcagatcgtacggatggtccgccaagaccttacgcagcagctgatagaagtacgttggtgtctggttcaaaatcgtgacctgttcgcggcccagcagcgccaggaaatcggccggatttttcgccgtgagcggcggtacgatgaccagcttgcctccgtacagcagcgctccgtacatttcccagacggagaaatcgaagcagaacgagtggaacagcgtccacgtgtcggacggcccgaagtcgaacaggttcttgtcgttaaacaggaggcgcacgacgttcttatgctcgatcagcgttcctttcggtctgccggtcgttcccgacgtgtagatgacataggccaggttgcccggcccggaaatcggctccaggttcgaagcgtccagcgcatcggcggagtccgcccctctgtcaccccaaacgaaatcatccaattcgaggcgcgttcctgcgaagtcggtcttctcgtgcagatgcttttgaatcagcaataacggcgcgcccgaatcctcgatcatgaagcggatgcgctcctccgggtagtcgggatcgacaggcacgtatgctccgcccgctttgagaatcgccagaatgccgacaaccatatcgagcgagcgttcggccagaatcgctaccaactggtccgcttctactcccgtctcccgcagcttccgcgcaaggcggttggatcgctcgttcagctcgcggtaggtcagctgccgctcgttcatgacggcggccacgttgtccgggtaaagctccgcctgttcttcgaacaagccgtaaatcgttttcccccgctcgaacccggtttcggtgtcattaaatcgcttcagcagcgtctccctctcgtctggggacagcacatcagcttgtccgagctccagatccggctgaaataaaagcacggacagcacccgaacaagatggtcagccgcctgttccacaaatgcccgctcgtaccgctgcttgtcaaagcttatttccatctcgatggagtggttttgacggtcgaagcaaaaaaccgtatcggccgccacccggttacccagcggttccggatgaatcggggcgaaggatgcgacggtgttgacgaccgggaggccgtcccccgtatagtccagatggagcggctccaccattttccgaaaaggcaggtgctgatgctccagcgcctcgccgatggaggctttgatgcccccgagcagcgttttcagcgtagtctggcggcttacggacgtcttgatcaccaagatgtcatgcggcggcggagtcccgtcggggtctgcgctataagaaggcatgccgaccagcaattggtcccgcccggtatatttgaacagcaggctttttactcctgccaaaacaatcatgtacaaagccaaatccgaaccgttggcgaggcaaatgattctctccgagagttcactcggcagagtacggtgaagcaagcccggctcggccgcagcttccccgtcggcggataatttggaggattgactgtagggaaggaagctcaggctgtcatcggcgtcaaacttgccgctccagtactgttcttccttttcaaacaaagatttcatttgtacctcccctaaaaatgaagtgaccgcatgccccggcgcaggtccgaaaaagcttgctttcggcctgcgcgtttacgggcttggacgttgttcgccgtcttccttgggatgcgcgccgctttcgcttgacggcggaggcgcgcttgtaggattagaacgcgaattcgattgtatcgacggcactctttgcgcctgccgcccgtttatgacattcaatccggcttagctcgagttgcggattttccgcaatttgagacagtacccgcaggtaatcctcggtcaaggtgcggatcatcgcttctttgaacagcttggtagcgtagaagaagcccccgctcagcgccccgttgttttcatacataaacagcgtcagatcgaacttcgcttcttccaaatggtcaagctcgtaagtcttcaggctgaccccttccagctctgcgtctcgttcttcgatattttgcaagtcgaaaacggcatcgaacagcgggaagcggcccggctcccgcttcacattcaaacgctccacgagctcctcgaatggataatcctggttctcgaaagcacccaaagccgtttccttcacttcttccaggtaggacaagaacgttttgtcgcccgacggacgattgcggatcgccagcgtattgacaaacatcccgatgaccggttccaaatcggcgttcgttcttcccgccaccggggtacccacgaccaagtcctcctgcccgctgtacttggacagcagcacggtataagccgcaagcagcaccatgaacagcgtgctttcacgctcggccgccaattcgcgcagctgcgcagagagagaagcttcgacgtcgaactccagatgcgcgccttcgtagctgcgagccgcagaccgttcgtagtccatcggcagatccgccgtcggcagctcgccttcgaaggtttgcagccagtacgcttcctgccgcccgatccgctctcggtgggccttcgactgctgccaaacggcataatccttgtattgaatgcgcagtggcggcagttcttccccggcgtagaaactcgagaactcatcgatcacaatcgccatcgatacgccgtcggacaccatatgatgcatgtcaaaaaggagaatatgcaggttcggctccagctcgatgaccccggcgcgcagcagcggcggcttgccgagatcaaacggacgaacgaagctacggacgatctgctcgatttgagccgcatcctctttatccgcttgatgatgctcgatagcaaaatcgacctgcgggtaaatccgctgaaccgcttcggccttcacgatttcaaaaccggtgcgcagcgattcatgccgtgttatcaatttccgcaaggcggcttccaaccggtctaaatcaaactcgccttccacctgcaccagctccggcatgttgtaaagctgatccgctccatccagcgtgtgctgaatgaacagccgtttctgcgcggaggacagagggtagtactctctctcctccgcttgaggaatggcctcatgctcccgccgttccatccgggcgatcgcctcggccatcgccgcaatcgtcgagtgacggaatacgtcgcgcagtggcaggttgacgtttaattccttaaataccttgcccgccagcgtcgtcgctcgcagggagtggccgccgatgtcgaagaagttgtcgtgaacgccaacctccttcgcaagccccagcacctcctgccaaatcgccgccagcttcgtttccagctcattgcgcggtgcgacgtactccgttccacttcccgctttcccttccggcgccggcagcgccttccggtcaatctttccgttcggcgtcagaggcaggcgctccaactccacgaagtacgacgggatcatgtagcccggcagctcctgcgccagcgcgctgcgcaaatcgttcaccgccagcttcgctccggtatccggcgtgtaatacgcgcatagcgccttctgcccgttcgcgtcacttcgaaccagcactaccgcttcgcgcacgccttccacccgcagcagctgcgactcgatctcgcccgtctcgatccggtaccctcggattttcgcctggttgtcgatccggccgatgaagtccacgttgccgtcttccatccaccgcgccaagtctcccgtgcggtacagccgctcgcccgcggcgaacgggctgtctacgaacttctcttccgtcagctccggacggttcaagtacccgcgcgccactccgactccgccgatgaccagctcgcccagcaccccgaccggcaccgggttcagatgcgcgtccacgatgtagaatttcgcattcagccacgctttgccgatcggcacattgcctgtctgcggcagcttcgccagctcctcgtcgtagaagctggagtcgatcgccgcttccgtcacaccgtatgcattgatgatccggaacaacgagccgaagcgttcctgcaaggtccggtaatccgccacgctgcagctgtccgagctcgtgatcaacagctccaaccggctcatgtccagttgctgctcgtgcacgtactccaggaacggcacgatcagcgccggcgtcgattcgaagatggtcacccgctcccgctcaatccagtggtgcagacgagacggatcgatccggtcgtccttcggcacaattaccatcgtgcctccgttatacagcgtccgcgcgatatctcccacgaacacgtcaaacgagaagcttgcgagctgcagcagccgcaccgggaactgatccaaccggtattcccgccggtagcccgccgccgtgttcaccaggctgcggtgctcgatcatcacacccttcggcttgcccgtcgttcccgacgtatagatcacgtacgccaggtcctccggacgggcttcatggaagctgtcggtgccgacattctgatggctctcatcgccgtcgtccacagcatccggcagcttgccggagaccatgccggagacaatcggcgcattcgcccgctcctcgctgtacgacgcttcgtcgtccaggtacagcaccgccgccagcgccagctcctcttcgtcgagccaggcttcagcacgctctcggagcgccgtttgcgtcagcagtaccttcgctccgctgtcttcgagcatgaaacgcacgcgctccgccggataatccgggtcgagcggcacatacgccccgcccgctttccagacggccagcacggccaccagcaagtccaccgaacgctcggcgagaatgccgacgatcgtctcccggccgatgccgcttgcacgcagcgtagccgccaagcggttcgcccgctcgttcagctccgcatacgtcagccggtcgttctcgtacacgacggccgccgcttccggcgtgcgctccgcctgttcctcgaacagccgatggaacgcggccgcaggagccgcttccggctgcgccgggttgaacgcgccgagaatttgtcctttttcctctgccgtcagcaagttcagctcggcgatcttcgcatccggacggcttacgatcgttacgagcagctgctcgtaatgttttgccagccgttcgatcgtctcccttttgtagagagccgtcgcatattcgaagctgtaatccaagccgccgttctcctcgcccacatccaaactgatatcaaacttcgcggtatccagtgcgctcggataaggaatcaggcgaagcccttccagctcaaattcctcgttctccgtattctgcatcgtaaacagcgtgtcgaagagcggattgcggcttaaatcacgggtgacttgcaccttgtccaccaattcttcgaacggatagttttgatgctcgaaggcgtggagggtcgtttctttgacttcgttcaggtatgacaggaatgtcttctccgaagccggataactgcggatagccagcgtgtttaagaaaatcccgatcaacggctgcacatctccatgattccttccggcaatcggcgtaccgacgatcacgtcttcctgacctgaatatttatgcagaaggacgttatacgccgcaagcagcaccataaacagcgtcgtgcccgtttccgaggccaactgcttcaggccgtcggttttcgaagcgtcaaagaaaaactccagcgtttggccttcgtagctctgcacggccggacgcggatagtcggtcggcatttccagcaccggaagctcgccttggaacatgtccagccagtacgcctcctgacgctgaagccgttccttctgctcctgcgaatgctgccaaacggtgtagtctttgtactgaatgcgcagaggctccaattgctcgccgccgtacaagcggacgaattcttcaacaaagatttccatcgagacgccgtcggaaataatatgatgcatgtcgtacattagaatatggcgttccggagccagctcgacaaggcctatcctcagcagcggaggcttcgccaagtcaaacggacggacgaaacggcgaaccgtctcttcggcctcttgctcatccgctcgatagaactccacggcaaaattcacgtcctggtaaatccgctgcgatgcttcgccatccaccatttcgaacccggtgcgcagcgtttcatgccgcgccacgagcttacggaacgcttcttcgaaccttgcccggtctaaagtaccctccagcagcatcgcttccggcatgttgtagctaagctccgcgccttccagttgattcaggataaagagacgtttttgagcaaaagattgcgggtacacctctccgtcatccgccactggaatggcaacgaatgtctgctcatccagccgggaaatggcggccgccatgctctcgatcgtggaatggcggaacacgtcgcgcagcggcagatccacgttcaactctttatgaatcttgctgaccagcgtcgtcgcccgcagggagtggccgccgatgtcgaagaagttgtcgtgaacgccaatctccttcgcaagccccagcacctcctgccaaatcgccgccagcttcgtttccagctcattgcgcggtgcgacgtactccgttccgcttcccgcttccccttccggcgctggcagcgccttccggtcaatctttccgttcggcgtcagaggcaggcgctccagctccacgaagtacgacgggatcatatagcccggcagctcctgcgccagcgcgctgcgcaaatcgttcaccgccagctccgctccggtatccggcgtgtaatacgcgcatagcgccttctgcccgttcgcgtcacttcgaaccagcaccaccgcttcgcgcacgccttccacccgcagcagctgcgactcgatctcgcccgtctcgatccggtagccccggattttcgcctggttgtcgatccggccgatgaagtccacgttgccgtcctccatccaccgcgccaagtctcccgtgcggtacagccgctcgcccgcggcgaacggactgtctacgaacttctcttctgtcagctctggacggttcaagtacccgcgcgccactccgactccgccgatgaccagctcgcccagcaccccgaccggcaccgggttcagatgcgcgtccacgatgtagaatttcgcattcagccacgctttgccgatcggcacattgcctgtctgcggcagcttcgccagctcctcgtcgtagaagcttgagtcgatcgctgcttccgtcacgccgtatgcgttgatgatccggaacaacgagccgaagcgttcctgcaaggtccggtaatccgccacgctgcagctgtccgagctcgtgatcaacagctccatccagctcatatccagcccctgctcgtgcacgtactccaggaacggcacgatcagcgccggcgtcgattcgaagatggtgacccgctcccgctcaatccagtggtgcagacgagacggatcgatccggtcgtccttcggcacaatcaccatcgtgcctccgttgtacagcgtccgcgcgatatctcccacgaacacgtcgaacgaaaagcttgcgagctgcagcagccgcaccgggaactcatccaaccggtattcccgccggtagcccgccgccgtgttcaccaggctgcggtgctcgatcaccacgcccttcggcttgcccgtcgttcccgacgtatagatcacgtacgctaggtcctccggacgggcttcatggaagctgtcggtgccaacattctgatggctctcatcgccgtcgtccacagcatccgtcagcttgccggagacaatgccggagacaaccgacgcattcgcccgctcctcgctatacgaagtttcgtcgtcgaggtacagcacagccgccagcgccagctcctcttcgtcgagccaggcttcggcacgctctcgcagcggcgtttgcgtcagcagcaccttcgctccgctgtcttcgagcatgaaccgcacgcgctccgccgggtaatccgggtcgagcggcacatacaccccgcccgctttccagacggccagcacggccaccagcaagtccaccgaacgctcggcgagaatgccgacgatcgtctcccggccgatgccgcttgcacgcagcgtggccgccaagcggttcgcccgctcgttcagctccgcatacgtcagccggtcgttctcgtacacgacggccgcctcttccggcgtgcgctccgcctgttcctcgaacagccggtggaacgcggccgcaggagccgcttccggctgcgccgggtggaacgcgccgagaatttgttctttttcctctgccgtcagcaagttcagctcggcaatcttcgcatccggacggcttacgatcgccgcaagcaaatgtccgaaatgagtcgacagccgccggatcgtgctttctttataaagagccgttgcgaattcaaagctgcactccaggccgccgttttcttccgtaacatccacactcaggtcgaacttggccgtgccgtattcgctaggatacggggacaatttcagcccttccaactcaaactctttatcctccaagttttgcagggagaacatcgtgtcaaacagcgggttgcggctcaaatcccggctgacctgcactttatcaacgagctcttcgaacggataattctgatgctcataagcgcctaaggtcgtttctttcacttcttccagatacgacaggaaggtcttctccgaagccggataattgcggagcgccagcgtattgacgaacattccgatcaaaggctgcgtgtctccgtgcgttctgcccgcaatcgacgttccgacgatcaaatcgtcctgacctgtgtatttttgcaaaagcacggtatatgccgcaagcagcaccatatacagcgtcgttcctctttgagcggccagctgcttcaagccttcgttcgttgcctcgtccacaaaggacgtcagcgtttgtccctcaaagctctgcacggcaggacgcggatagtccgtcggcatttccagaaccggcagctcgccccggtaacggtccagccagtaagcttcctcgcgtttcaactgcactttttgctcgtccgactgctgccataccgcatagtccttgtattgaatgcgcaaaggctctaatgactcgccgccgtacatacgaacgagttcctcgactaacacgtccatcgaaaccccgtcggagacgatatggtgcatgtcgaacatcagcaaataacgttcggctgccagctctacgagctccgcccgcagcagcggaggcttcgccaagtcgaaaggccggatgaaggcctgcacgacttcgggcgcttcttcctcgctcacatgacggtactcgacggcaaagtcgacgctctcgtaaatgcgctgtacagcttcgccttgtacgatctcaaagccggttcgcagcgtttcgtgccgtgcgatcagtccgcggaaagccttctccagcaggctccggtcaatcgatccttccagcagcagcacgcccggcatgttgtagctctgatcggccccttccagctgattcaggataaacagccgcttctgagctgaggaaagcggataatatgctcttgcgcccgccagcggaatcgacgagaacgactgctctccgatccgggagatggcgagagccatctcttcgatcgtcgagtagcggaatacgtcgcgcagtggcagctcgacgttcagctcctgatgcaccttgctcaccagtgtcgtcgcccgcagggaatggccgcccaggtcgaagaagttgtcatgaaccccgatgtgctccagtccgagcacgcttttccaaattcccgccaagctggcttccagcggagtccgaggcggagtacgttcttcgcccggttgcaagctctcctccggcgccgggagtgatcggcggtcgaccttgccgttcgtcgtcagcgggagcctctccaactggatcaggtacgccggaatcatataggccggcagttcctgggaaagcacgctcttcagctcggccgccggaagctcgcggtccgcttcataataggcgcaaagctgcttctcgccggaggcgtcttccctcgcgaatactgtcgctttccgaattccctccactttctgaagctgagcttcgatctcgcccagctcaatgcggaagccgcggattttcacttggtcgtccgtccgtcccacgtattcgatcgtgccgtccggcagccatttcgccaaatcccccgtccggtacatgcgctctcccagcacaaacggattgtccacaaatttctccgccgtcagctccggccggttattgtagccccgtaccaagccttctccgccgacgcaaagctccccggccacgccgatcggcagaagcttattccggctgtcgacgatatacaccttcgtattactgatcggccgtccgatgggtacggtaaccgccgactcatcgacgaagtcgaccggaaggtacgtggtataaaccgtgctttccgacgggccgtacaggtggttgagcctgcccggtccgatatgggcgagcgctttacgcacatgtccgaccgacactcgctctcctccgaacaaaatcgcccggacatcccgcaggcaatcgacgttcacatctacaaggacgttgaagaaagccgtcgtaatcagcatgaccgagatgcgctcacgctggatgagatccgccagccagacgatttccagcaaagtctcgcggggaaccagcaccagccgcgccccgttggtcaaagcgccgaaaatatcgaaaatcgctccgtcgaacgaatagctcgaaagctggaggacatgatcccgttcggtgatgtcgatataattcgtatttcgcacgatccgcacgatgttgcggtgcgaaacaaggttgcctttcggcttgcccgtcgtgcctgacgtatagatgacgcaggccagatccgtcgcttcggtgcccggatttagatttgtgccgtcctcgtgataaaaggactcgtcatccagtaagatcacggagtccgaacccgccaggcgctcgcgcaagcggctttgcgtcagcatgacctgcgctcccgaatcctcaatcaagaaacggatacgctcctcgggatattccgggtcaatcggtacgtaagccgctccggctttgtgtgccgccagcatgcccaccaccatttcgatcgaacgctcagccataatggcgaccagacggcctttggatatcccgtagctacgcaaggtacgggcaaggcggttgacgcgatcgttcagctcgcggtaggtcagctcttgctcattcaaggagatagcggctgcatccgggatgcgctccgcctgctcttcgaacaattgaatgagcgtcttcccgcgcggaaattccgtggtggtgtcgttaaaacgtccgagaaggtcggccttttccgcctccgtcacaagttccagctcgcccacggtaatttccgggttatccgtcacctgctccagcagatggacgagatgccccttgagccgttcgatgctgtctttatcgaacacttcggcgttaaagtcgaatcgaatttcgatctcgactcccggcaccacagtcacgttgaagttatagttcgtctgctcctccatctgaacgtcagcgatcgtcaggtcgccgtgctgctggtcgcccgcctgctccatctgctcgtccaccggatagttctcgaaagcgatgatatggttgatcaggttctgcttttgcacgctgcgggcttgaatttcatacagcggatagtaatcataacgcccggactccagcgcccgctcttggagcttcgccatcaggtcggcgaacacggtgtccgcttcgctcgtgacgcggaccggcaccgtattgatgaacagcccgatcatggactcgatgctcgggatttccgccggtcttccagccacgacgctgccgaatacggcatcgtttgttccgttatatttttgcagcatcacgccccaagcggcttgcagcagcgtattgaccgtaaccaggcgctgtttcgccacccggtccatccgctcgctcaagtccttgcccagctcagcggtgacgtgatcagccgtaaatctgccgtttggcgccggttccttttgtcccgggagtacggtttgcccttcataacctgccaggaatgccgtccaatagccggatgccgcctgatcgtcctgtttctccaaccattcgatataagcgccataatccgatcccttatctcccgctggctgcttgccggatgccaaggccgagtacgtctcaaacagctcctgcgtcagctgcggcaggcaccagccgtccatcaaaatatgctggaaactccacagcacatgatagctttgctcttcggtgcgcaggatcgtaacccgaacgagcgcgtcatgttccatgtcgaagccgcgaagcttgtcatcctcggcctttttatccaaatacgcttgtttctcgtccgcctgcaaatgaagcagctcttcatattcaaagccgaccggcttgtcgcggtatatgatttgcagcggctcgcccgccggtcctttcacaaaattcgcccgcagcaccagatgacgtttcgcaagctccatccagctcctctcgaaaagctggacgtcgagcgctccccgcatcgtaaaccgcgtctgctcgaagtaagcggccgtttgccggtcaagcgcgctgtggaaccacatgcccttctgcatcggcgtaagcgagtaaatattttcaatttccccgagatggcccgagcgctgggcgatttgctccaattccgcgatggtcaagcctttaaattgcacgtcgctcggcgtcaattcggtgttttctttgcctgcgcagtgggtaatgagctctcggagactttgctcaagccgctgagcgaaggcttccatcgtttccttgcgatactgcttccggctgtagctgagatcgagcgataaagcgccgtccagcaccatgccgttgatatccagcacaaagctgcgggcctgccggtcgctggccgggctgccgctggaataagaagatatgccgatctcgtcctgattgacatcatcgtcgaactggccgaggtagttaaaattaatttccggctctgcgccccaaacaaagccatcctccgattgggagagatagcggcatacgccgtacccaagccccttgttcggaatgcggcgcaagctttccttgacctgtttaatctgataggccaaatcctggtcggtttccggctccaggacgaccggaaacttggtcgtaaaccagccgactgtgcgcgtgatgtcgatatccgttccgatcgattcgcgtccgtgtccttcgagattgatccgcacccgttcgtgtcccgtccacttgcgaacggctatgccgagcgccgttaccaaaatatcgttcatttcggtgttgtaggcccggtgaacccgcttcagcagcagctccgtttcttcgggagtcaaacggacgaacagcgattcgctgtcctgctgcgtcgtaacctctgcctccaaatccttcggcacggccggaaccgcaatttgttccacggcctgccaataggcccgttccttcgccatctccggactttgcgcgtaagcggccaactgctcggaccaagtgcggtacgcatccgttttcgcagggaaacgaatttcctcgcttttgccggcctgctcgtaacccagagcgaaatcctccatcaaaatgcgccaagacacgccgtccaccacggcatgatgaaccgcgagcagcaaatggtcgccgtccgcgcaccggaacagtcccgccttcacgaggggcccgttctcgagatcgatacccgcttgaatgtccgttgccttcgcttccacaacctgcgcggtattctccgcatccttgaagtcgaacacgtccagcgtgaacagcccgccttcctgaatcgcgcggttccgcgcgctaaacccttgttccgtcttgcggaacaccatccgcaaggcgtcatgatgctcggccagcttttgcagcacctgacgtaccgtctcttcgtcgaagcgttccttccggtacagcatcaccgactggctgaaatgatgcgggtccgcaaaggagctctcgaaaaaccaatgctgaatcggcgtcagcgccgtttcacccgttatttcgccttgatcgatagtacgtccgatcggtttcacatgcaggctgagctgtgagatagtcggatatttgaacaaatcccggatttccagcttgtacccggcttgatgaagccgcgaagatacttgaatggacttgatcgagtctccgcccagctcgaagaaatgatccgttaccccaacgcgatcggcgttcaataccgcctgccacacatcggcaagcgtccgctccgcttcattgcggggagctacgtacgcgccgccggtcagtgcgtttccttccggggcgggcaaagccttgcggtcgattttgtcgttcggcgtgagcggcatccgcggaagctgaacaaaatgcgccggaatcatgtaattcggcaatttttgcgccagctcgcttctcagctcgccgagcgtaagcgggcggcccgcgaccaggtaagcgcacagttcttgcccgcttttgccttcccgcgcgattacgatcgtctcctgcacggagtcgatcttcagaagctgctcttcaatttcaccgatctcaatccgaaatccacggattttcacctgatggtcgatccggcccaagtactcaatatttccgtccggcagccagcgggccaagtcgcccgtccggtacagtctctctccgggctcaaacgggtgttcaatgaatttctccgccgtcagatccggccggttccaatatccccgggcgaggccgacgcccgcgatgcataattctccctccactccgataggcgccaactgattctgtgcgcccagtatatacaagcgatggttccagatcggacgtccgatcggtatcgctctgcgttcggtgtcatgcgtagacgccgcccacacggatgtggcgatcgaggcttccgtcggaccgtacgcattatagtactgtaccttgtctttccactgctgcacgaattcggctgaaacggcggagcccgccgtgatgagcctgctcagactcggcaggcggtctgaattcaaataagccgcataagttggcggcaaagtggcgatcgtaattgcatgctcgttcatgaaacgttcgaacagctgatcatccaaaaccgtctcggttgacggtatatataaggtcgccccgaaatacagagcgttgaacatctcccaacacgacgcatcgaacgataggctggcgaattgcagcactcgatcctgttcggtcgtgtgaagcgtatgggcaaacgtcagtttcaggctgaccagcccgcgatgctccagcatgacccctttgggtttgcccgtcgtacctgatgtatagatgacataagccagatcgttcggaccgctggccggctccaggttcgagccatcgtcgctgtaggcctgctcgtcatccagcgccaccacggtcccttcgaacggcacctgctgcaacagctccctttgagtcagcagcagctgcgcgttcgagttctccagaatgtagcggatgcgttcttccgggtattccgagtcgatcggcacgtaggcaccgccagctttcagaaccgccagaatgccaacgaccgtctccagcgatctcctggccatcaagcctaccagctgattgggcagcacgccgaccgatcgcagcgtccgcgccagccgattcgcccgttcgttcagctccgcgtacgaaagccgccgcccctcaaagacaaccgccgtcgcttcgggcacccgcttcacctgctcctccacgagctgatgaatcgtccgatcacggggatagtccttctcggtatcgttaaagctttgcagcaattgaaatttctcgtcctccgacagcatgtccgcccgcacgatgtccagctccaactcgtgaagccccacggccagcaggcgattcagatggccgacgacccgagtcatgaactcggagtcatataagtgctcgttatatgacagcgctagctgtatcgtcccgccggttaagctgaattcaaaggaacaatccgtgaccacgttttgcccgatttcgtccagatgcagctccttaagggatactagcgtatggacgacgggtatcccgtctgcatattgcaggtccagcttctccgtcattttcaagaacggaatatgttgatgctgaatcgcttccggcaaggaagtcctcagctcgctcagaagcgttttaaaagtcgcacccgccgaaagcgagtttttcaaaatgatcgtatgattaacggatcggcgcgtctccgtcggtttccgtacaaccggcatgccgaccagaatgtcagaagcgcctgtatatttatgcaagagcgactgaacaccggcgagcaaaatcataaaagtggccagcggagcgcccttgctcatttgaaggacgcgctgcgccacttcctccgaaagcgtcccgccgacggttgtcataatgggcgtcagggagcttggagctttgctgtaaggcagccgcgtcaaggtataatcgtcgctaccgaatttttcgttccaaaacaacgtttctttttcaaaagccatctggatcgttcccctctcttcatcggtaaaagcaatccggcggagcatatgccgcagcaacgctcgccgccttttcaaacatgtgacaacaatgtcaatggctttcgccaggtcaccgcttcgcttgcccggttgatcgcatgcggcaatcctctgcctagcacctgtcccgctcggctcccatgcgtgaaagacaacaaagagcatcgttctacgcaagaaatgcggctgcttccggctcctctgcttcaatatgcttgctgcggacgtgccgcctgaagacggtctttggtttaacattgggttcggaattggatttgggggtggacaagggatgttcctcccatcgatgtagggcttgctgtagggttccggccggccagcaggaagtcgaccgtacctccagattcggcaccggagctgcctttgtcgaagcctatgtttaagggatattgatacactctatgtacgatttgtatattcccccgcctggtgtggataagtaaagatccgactgcggggtagtgagcttttcctgacgattagatgtgacgatggtgctgcatgagggtgaaagcgttatcttaacatcagggccgcacggccccggaaggcacttccgtgcctcttgccggggcggccaccggcttggccgagcttaggtcgttaccagcaaatcctgggtctcctgagagatcacctgctgcatactggacttgataatgtcgcagccggcggccagatgctccatcgagacggtcagcggagggatgatctttagtacgcggtctcctctgccggctctttcaatgatgagcccgttctcgaagctgatctccgtcatccacttcgccccggtttcatccgtgaagcccgagacgtcaatgccccagatcaggccaagtccgcggatggcgatggacggatgcaggggcttgatttctttgtcaaagaacgagcgcacaaactcctccttctgcttcacctgggcttccagggcggctctgtcccggaactcgagagcggcattgccgcccggcttgtcgattccagagtgcgaatcagtcaggatattctcgatatagccgagcgtatccatttctgcgaaagccccgttcgggtgcggcatgaacgtaactccgcccagaggaagccccgccccttccctcatggacttggagcttgtcgccgacaggctgccgatcgacatgccgtggaagccgcccatgaatgcgtatcccggttctcttcttcgccttgcgtgcgagcttaaggtccgcttccaccgcgctcgtccccgtcggaccgcagacttgaagcttgtaattcagcttcttcggctccaggatccgctccgagaagctcttgaagaattcgcgcttagccattgtatacatatccagaccgtgcataatccggtcggaggtcaagtaatcgagaacccggtccttgatataatcgttgttatgaccgtaattcagtgccccggcacctgcaaaaaaatcaatatatgctcttccgtcctcagaatataacaggtccccaccttctgacgtcatggatcaacatattctcggctgtcattttccacaattgtcggtctccgcatgccggcttgctgggtagccagtggactggtctctcgcacacagcttggataggtataaaaaccatccaattctattttctatcataattggaaagttgacctaggtagaattatatcaaaatttcaaataatgtatagtaaaacttcagttaaatttggtcaacacggtgttaatattttgcctaaaaagagcgaatggagaagaaacgctgggaatggtttgccatcaatcgaggaattcgacgcgtgtcgacattcaggcggggtgccggccgatttggaatatcttccctgtaaacattctctgccggtgctccggatccttgcgctttgcgataacttaacatgattacctgacgaatttctggaagcctggctggaaacgctactggatgtcagctggatattctgctggaaaatccgttggatactcgcgtttaggtcgggtgtaacgttaactccagacgttccattatcgttcgaatgatctcgtatgcccgatccgcatccttcttggggatatattggcgctttacgggttgcggaatgtgcaataaattttatactttcttcttgttttactgtaagtaacatatctgtagtcataatgatgggaagcttattcttggggtcagttggatgtttaatgcctaacttttgtgcaatatagagggttttatctaggggtaataaaggaaattgttcgcgaatatcaatctcttgctctgaccactccatttggtaatgatgtgccaattcaaagtgttcagacagataatggtgaagtcgaccacttttccaaccaagaattcgagtaactatccctattgaaggtacatcatgtacagtcaaccaaggtttatattccgaaaagtggccttgacctcttccttctttgattttccgttgaatagatgctatagatttacttgatcgaattttgttcattattcaccttctttttagaactactaaatcagagtaaagttcagttatctttttctactcctaagatatattttagtttacttcaaaatacaaatgtagaatataacaactcacagctttatacaatagcaaagcaatattttttagctatattttactttgtatcctattcatagctactcgtagagtacagtagggtatgaaaagctataatatgggctataagtaggtataattagtaagcagatgggtcgggttaaaacctatttgatattctcaatagaggtgaactcatgaatactttgggacagccatgtagaaatttaagactactccataaatggacacaagaggaacttgctaataaaatcggggtaaccaaacacgttgtttctaattgggagcgaaatgtagcacgacctgaaattaatcatttaatatctttagcagaggtttttgatgttacaaccgattatttactttgtattgctaatcaaatgacgttcccctactgtgtggactcaatgatacaattcattcggaccttaataacgagaaaatcaaaaaatcctttgatcttttagcatttctaaattctggttttcgaattgaattaaatgggcaggtattagaacaagaagatttgaatctaatcggtaaaaatattaccttttaatggagcattttgtctctcctttaaagaaaagatatagtaaatagaaaattttagtacccattagttcacttaaagaagtagcgcctcacaccttcttttacaatttaattaactatgtgttagctgaagttttacttttagggataatctttcaatatttcttttgcaagtttcattagttgcacactctgtaaatagatctctatgttaagaccttgcaatgattcttttaccaccaatctacattcttcataatcttcaaatccatttcttatgtaaattgattttagatcagttggggatctaatgctgaggttccaaccgccttctttcaaagctctttcaaaccatttctcacatttttaatttttttatgcataaatgccatgaataatcggtatacggataattcgtgacttttatgtaccaaaattaaaatgagtaattctaagacatattattaaggaactcccgcgaaagattagtaccgaacaatcttcagttttataaaatcaataatttcatctctatcttctttagtaagttctcgaaacaaagaaataagttctaattcctgagcttcaatggctaaattaaaaatagtgttctttgatacaggcgtatcttcaaagattaaccactctatatgagaagtgaagttttctttaattgctataattatatcaagagagggtatgtatttatcttactccagctcactcaacgttccttgagaaattccaattatatttgcaaactttatttgattcaagttgtttgtttttctaatatttcaaattcgttgcctattgtagacataattaccctcctaagctaaaaagatcccgatatatcatcgggatctttcttgatgtttgtaaaatgactagttccagactttttttactggttccacacttttttatcaccagacaattagttagcgttttactaaagcttattctacagtaacacttttcgccaggttacgtggtttatcaacatcatgacccagggcaagagaagcgtagtaagccaataattggagagatacaactgaaattgcagcagacagaattggaagtgtcttcggaatggcaaatacctgatccacggacttcagcaactcaactgcgtgctcttcgtacgtaatcgcaagaacatctgcaccacgagccttgacttccttaatgttgctcacggttttctccaacacggattcctgtgttaccaaagcgataaccggaatgccgtcttcaatcaatgccagtgtaccatgcttcaattcacccgcagcataagcctcggaatgaatgtaggaaatttccttgagcttcagagagccttcctgtactacagcatagtcctgaccgcgaccaataaagaacaggtgcttgtggcttgcaatttgctcagcataggctttgatcgcatctgctttacccagcatctcttccacttgctctggcagagattccatagcagccagcacatgagctacttgctcatctgtttgtgtgccacgcacttgagcgagatacaaaccaaacagatagaacgcaatcaactgtgaagaatatgctttagtggaggctacggcaatttccggtcctgccagtgtaaccaacacatcatctgcatcacgggcgatggagctaccgactacgtttgtaatcgccagtacatgagcgccatttgcttgtgcttcacgcagggctgccaacgtgtcagcagtttcaccggattggctcaccacgatcaccaatgtctctggtgttacgataggtgaacgataacgatattcggaagccacatcattttctaccggtatacgagccagactttcaataactgtacgaccaatcaaaccagcattgtaagctgtaccacacgcaacaatttgaatgttgcggatatttttaatttgttcttctgtcagcttcagctcaggaagaacaacttttttagtatctttatcgatacggcccaacattgtgtcacgataagccttaggctgctcgtgaatttctttcaacatgaaatgctcatagccgcctttttccgctgttacagcatcccattcgacatgaatcatttcccgagaaataaattgaccttcgattgtcattaattcgacagcatcactggtcaaaacagccatttcgccatcgttcaaaataaatacattgcgtgtatatttcagaatagccggaatgtcggaaccgataaagttctcgccttctcccacaccaataaccagcgggctagcttgacgaacagcaaccagcttattaggctcgtgctctgtcagcacacccagtgcaaaagcaccgcgcataaaggtaattgctttttgtactgctttaacgatatcccctttatattcacgcgcaaccagatgagaaataatttccgtgtccgtttcggaaataaaggtatgaccttcgctgatcagctgctccttcagctccagatagttctcaataattccgttgtgaactacagagaacttttggctctcatccaaatgtggatgggagttttcatcagaaggcttaccgtgcgttgcccaacgtgtatgtccgatacctgcatggcctaccaacggcgtaccatccagtttagcttccagattcgccagacgacctttagccttggctacttgcaatcctgaatctgtaaacacggcaatacccgcagagtcataaccgcgatactccagcttcttcaatccgtcaatcaatacctcttgcgtattctgattaccaatatatcctacaatgccacacatattcgttatcctcccgatcatcatttcacaagacgactcatcacaggactaacgtgtgcggtagattgtggaataaagttcattcatctatgaagttgtcaatgataactatagaatttacaggcatctcttcacgaatgtaacgaaattcccaaaccgcgcacgccaatgatgatggccgcacattcatgaaatgaatcttataatttaggttataaaataataaaggcatctaccggtgcgttgtgtaaacagttgcctgttcattttccgctgccggtttacggctcgatgcttcaccggaaggtccccgccgaatgtttcgaacaccttcacctcgtcagcttgttttgtcgtgaaccgatttgcgagcaactttatctcaactgaatccgttgcttctccaccaagttcccccgcacaaaatcaagctctggcgcttgtattacgttaccttacaaccctcgctttctctatctgagtcacagcatccctatattatattcagctaagtatcatttggcaatgacactttattcataattacaccatgaaggccataaaacgttagtaaataaccgcaaacgccgttgcctgcttctttttcacaggcaaccgacgtttacaaaattttaaactaattctttcttcacgacatctacgatctgaccgacaaattgctccagttcgtccttatccgggccttcggccatcacacgaataagtgattctgtgcctgaagcacggaccaatacacgcccattatcgcccaattgttgttccacctgctcaattgcttctgcaatggcaggattcccttcgtaattgcgtttgtcctgcacacgcacatttacgagcacttgcggatactgtttcatgagcgattttagctcactcattttcttgccggaagctttcaaggtatctaccagctgaatcccagtcagcatgccatcgcctgtcgtattgtgatccaggaaaataacatgaccagactgctcaccgcctaggttaaatccaccccgacgcatttcttccatcacataacggtccccgaccgcagtttttgcagtcttgagtgccagcttttcagtagctttataaaaaccgatattactcatcactgtcgatacaatggtgctgtccttgagttttcccgcacggttcattgcatctccgcaaatgcagagaatatagtcgccgtctacctcttccccgttctcatcaatcgcgattagacggtcggcatcgccgtcaaaggccaaaccaatatctgctttcaagcggcgtacttcctctttcagcttttcaggatgagtcgagccgcaatgatcattgatgttcaaaccgttcggctcggcaccaatggtgtgtacctcagctcccagttctgcaaaaagcttcggtgccagctcataagctgctccattagcacaatccagtacaatttttaacccttcaaaagaatggctaattgttgttttcaagaactccagataatcgtagcgagaatgctcgtctacaacaaccgttcccaatccgccgccaatcggacgaggcagttggtcttcttttgcatccatgagctcttcaattttcaattccgtttcgtctgtcaatttaaaaccgtcaccgccaaaaaacttaatgccgttgtcttcaactggattgtgtgatgctgagatcattaccccagcgtcagctttcaattgacgtgtgagatatgccaccccaggtgtcgaaacaatacctagacgaaccacattagccccaatggacagcaaaccggctacaagagccgattccagcatcagtccggatatccgtgtatccataccaataacaactgtcggtttctctacattacctgctaaaacatatccgccgcagcggccaatgctatatgccagttcggctgtaagttcctgattagcaacgcctcgtacaccatctgtaccaaaatatttccccatgtaaaatgactccctttttttgtctaataaatcttgattattttgattatttactacagataaaacatgttatggctgactgttctccgaggttccattcgcagaagaatctgcgccgttatgaggatttgttttatcctccgcagctgcgttgtccccggtcttagcgtcagagtccccaccttgactgccttgcccctcctgtggcctctcctgccccttttcgccactaccagaggggtttgattcattctcactattcggattcgttacagcaggcgtagaagggctctcaatgttgaccgttgcctttagttggtcagcatttccggcttgcgtaatatatttaggcaagcctactttcagagtaacctcgtgttgaccagccgcgaggccacttacatctgccaccaaactaatatcatcattggttaaattatttaccatatcctgcgggcccttcacagtaacatccatcgtcttacctacgggtgctgtaacagtcgtagtcgctttatctcctgcaccttgtaaaacgattgggatgcctgacagcgtccgttccgtatctgtgacttcattggaagggacgacggtcacctgaatttgtattgaccctggctcgattttatcagaacctgagggggctgccaaattagcttgaactgtacgagtccccgcttccgtgaattgacttaaatccaatgtagctgtgacgtaagaactgaggctgctcaatacatcctgcgatgcatacaccgccgcttccttcacgtttgcattgactttagaaagcgccaatccgtctggcaactctccagcatagacaatcttaacaggcacagatttcgcctgctgagttaccggaatttcaacggacacagtggatggctcaatgaccgctcctgtaagttcctgtccctttttgttataagccttcagttttacacgcttctgttcaaacttttctgagataccatccgtattaacagccccttgaacggcagtaacggtactcaactggcttttaggcaaggtaaccttcacggtttgaggagcaattacaggcttgccaagctgcagtcccccatctgggtttcctttaggaactatagatacattaaatgatttcgtttgtttttcctcaatcgtcactgtaacacggttaggagtcatagacaccaactccactccatccggcaagtccggttcgagtgacaatgttttagtacctgctcctaagccgtttaagtttagctttgcctgataattatccgcgaaaaaagaagtcagcacagagcgctgtcctctaacctccatcttaacatggtcagtatccatggtagacaatacatattttgaatcatccagaccactagcctgaatgcccacattatcaatcactttattattataagaaacggtcagcgtagatgaaggtgtacctgtatctagatggaccattccccacagcaggacagcaaccgcaagcgccaatatcttggaaatcgtattattgttaatccatttgtccatcatgaatttccacggcctcccctccgattccagaatgagccgcgtttttctttcaaggacggtgttggccgcaactcctcatacagcttggagattagggattcttccttaatgtcgcgcacgacctgtccattaatggccaaagaaatttgccctgtttcctccgataccacgacagttacggcatccgttacctcactcaccccaatcgcagcccggtgacgggttcccaactccttgctgatgaacggattttccgataatggcaaataacaggccgcagaagcaatctgtttattttgaataatcaccgcaccatcatgcaaaggcgtattaggaatgaagatgttaattagcagttcagaactgactacggcctgtgtcttgataccagactccgtatattcgtttagccctgtctcgcgctcaaatacaaccaaagctcctattttcctacgtgatagataattcagcgccttaatcatttctccgattaacttgttaatctcttcatcatccgcagacgaacgcccaaataattttccacgccccaactgctccagtgcacgacgcaactcaggctgaaaaataataaagatagccaccacaccaaaggtgaacatctggttcatcaaccacttgagcgtatacaaatcaaaccaggtgctgaccgcccaaatgacaactagaaacagaatccctttcaacaattgaactgcacgcgttccgcgaacaagtaaaataagctgatacataatataggttacgatcaaaatgtcgataatatctttaatggactctttccaagtcaggtccgcaaaataatccaacatgcgcatgcccccgcaattttctgtagtgagtgggtgtaatatgtacacagtatgctctctctatctaggttataacgatcaggctcacgttgcaagctgtgtgacaaaagaaccgctaaaatcagtaaaatacagtacaattcgccagcttcatatacaaaaaaacgccttttccagcggaaagaggcgctcgatattgtccttgccatttcaagcttcttttatggagaagagggtcccccgaataaatcagtaaccttgtaccaaatccaatccaaggtttgatcgatacttttaacctgtcctgcaatatgggcggttgaagcttgatagtaagagccgtcaatcacagtaagatttccttccacatcaccgtatacacgggcctcaccattttgtactgttaaatctccggcaatggatttcccttcaggtacaattacagtatcgccctgaataacaacttgatctagattgcttcctttgactaccaattgatggtccgtgctagaaaagctgaccatacttgagcatatcacaataaggaagaaggcggcagctgttacagcgggatgcctcttcacccaagttagcataggcaccgcaggctgtcttttatgcggcggcaaagcattcataatgcgaaatgtcagctcatccgatacacacggcacttgatgatagcgtgtaccgtaaagcatcgcatccgtccgctccagctctttaaaacgcatgcggcattccgggcagtctaacaagtgttgttccaactcatgtttgtcctgctcagacaggtcgccatctagatagtcatgcataaaagagacggcttgtttgcaatccatatgagccaatcctttctaatattcttccgtgtttctcaacataacatgctccggcttagaaactttgctcatcttacatacgttacaacgagcattatgtttcataaaacatctatgcagactcttttcctagaatctatgcgtatgatctatagcttgtgctccagttttttgcgcagaaaatcccgccccctgtgtactcttgtcttaatagtggtaactgggagattgagcacatcgctgatttcctgtaaggaaagctcctgcaagtaccgtaaaaccataatcgttctgtatttatctggaaggctgtcaatggcgtcatgaatcaaagcctgcgtttcggacagaagcgtactcccctcaggggtaagctcttcactggcgagcatggcgtacccatcgacaccttcctgatcattcatttcagcatcaagtgagtatgtaggttttctccttcgcagacgatcaatgcacagatttgtagcaattcgataaatccaggttgagaacttctgcccatgatcatatttttccaaattacgatacacacgcaaaaaagtttcctgcaccagatcctccgcctcatggcgattacctagcatccggtaggaaagatgaaaaatccgatctttatataactcgactaactccgcaaaagctcgctgatcgcctttctgtaccagccttaccaagcggctttccatattatccactctatactcccccagacttgctgatgggttacttattacatgtttatgattattcatcgtagtttaattttatccagaaatcaactgtagccttgttactaactgcaagcacgcctaccatcaatatacaaacagcacaatcgggcaccccatgagtacccgattgcctgttttcgtacaaccgtactatatcagcccgtatttcttaagcctgctgcaattccgttaattgtcaacaatacctcacgcagcatttcagtgtcatcaccgttctgatccctcagctcccgtagctcacttagcaattgaacctgcaagtaacttaacggatcgacataaggattacgcaaccggatagattcctgaataaccggcacgtcgtccaaaatctcggattgtccggttattttcaaaatcaactcagatgtcagcttgaactccgctgaaatctgcccgaaaatacgttgccgggcctcttctttatccgacatcccagcgtactcttctgcaatcagtaaatccgctttagcgattgccattttcagtgtatcaataagtgaccggaagaaagcagagtccctaaacatcgtttgcaacactttaagattatcctcattgttttgatagaagctttgcaagcctgttccagccgcataccatgcaggtaacaagtaacggctttgtgtccatgcgaaaacccacggaatggcgcgcaagtcctcaaaacgttcgctgttcttacgcttggagggacgagatccgatattcagttcccccacctcgggcaacggtgtagattctttgaagaagttgaagaaatccggatcccggaaaatcaaatcctgatacttatccagtgatacttgggaaatgcgggcgataatctcctcccagctatcctcaaacacttccttcttcccggaacgatgatatgccacagctgtaatcagcgccgatgttgcctgctccaagctccggtacgcaatgcctctaagcgagtatcgggacgatagtacttcgccttgctccgtgatttttattccgcctccaatcgtatgaggaggttgagccaaaatactgcgattaagtggcattcctccacgtccgagcgcacctccacgtccgtggaaaaacttcacttttacgccaaactcattaactacttcggtaattctattcatagcgacccgaagttcccagttcgctgtaactacaccgccatctttattactgtccgagtatcccagcataatctcctgaaggtggtccatcgcagccacagattgtcgatatacaggcaagttcatcaatcttctcataatatcaggtgcagcgtgtagatcatctattgtttcgaacaaaggaacggattgcagcgtacagataacagtgccatccttctcgatgcggaacaggcccacctctttggataagaccataacctccagtacgtcactcgctccctcagccatactgatcaagtagcttgtaatggactgcttgccgaattcctcctgagctaaataaatcgtacgatatacgtcaagacattcctgtgtgctatcgctatatcttaaatatggcgaagtaatcggacgaggttcattcagcagcttttccagcagatttattttttcttcttctgacagcttactgtaatccgacacaatattcattttagaaagaatttcagtcatcgcactttcatgttcttgactatgctgacgcacatccagtgtagctgtatggaatccaaacaactctacctggcgaatcatcttttgaatatatgtgtttgccacataatcggcaaaatgatgacgcaggctgttgtcaataacatttaggtctgcaatgagctcttccgcagaattataacgctcatgggtaccctgtttgctttcatccaggatgttgttcactttagcaatcatatatgccagtttaatgcggtaaggctctttttcgttatgccatacttccatctttttaagtgtaatatgagtacggtcttcttcaatagaagccagtagatcatcggaaactcgcacaatgctggtgctgaaactcaagtaacccatgagttcctttaacgtgtgctgatattctctcaaagccaacttgcgctgcatacgtaacgtttcccaagtcacatgagctgtcacagacggattgccgtcccggtctccaccgatccaggaaccaaatctcagataagtgggtatgtgccatttttgttcgggataatatttgtccaaacatcgttccaattcttggtacacatctggcagtacatgaaacaaggtctcgtgaaaataatacattccatttcttacttcatctaatacagttggcttgcgatcacgcaactcatctgtctgccaaagcgtaattacttcgtttagcagattctcccgtacctgttcccgctcacgtaaggtaagcatcggattatccagcagcatgacgtcctcggaaatgcgcttgtggatatcaagtattactcgtcgtgtcgcttctgtaggatgtgcggtcatgaccagctccaaagagagctcattcagcaagttgctaacgtcctcggcggagaagcccccttgtttaagctcctgaacggaactttcaatggaaccaggttgaacatcttcaccagcggaatgctcataatcccgcttacgacgaatacgatggttttgctcagcgatattcaccaactgaaaataaatcgcaaacgcgcgaataacctggtgacgaatatccgtatccagtccgctgaccatttgtttgaaatcctcatacaactccggttgatacccggcacgtaacgatttacttgtctcacgtattttctccacgatatccaaaagttcgttgccaccctgatgaaccaaaacctcaccaagaatattccctagaaaacgaacgtcccgccgcagcagattgttggattggtttttgttagcggttaacgtaagctcagtcatgcttttccccccatctgatctgttccacaccatatacagttgtagcaaaggtacgtatacatacgaaatttgacactttcttaacatcatacaataaaaccgcatgaaaagctgcaaaatttacagtaaaaaatcatgtttttgaaatacttcttttgagaaaatattggattgttatgcaaaaagatgaaattaataatagaaatgaatgtatacactagtgatgcgtgaaacattatgcacagtctcttataaagagtgtggttttaaaggtgcaaattcatgcaacatgatgtgtatatgtttattaattgttgacaaagtcaaccccattatccctctatccacaaagatatacacaaattagccatttccttagtgtttctagggcatttcctctttaagacttcgcttttacccacataaataaaagggaatgtgcacaacgcaagagcagatgcagagttatcaccatgaattcgtaccataatagctataggattcctatattcaaaggatttgatcacgaaattagccttactgcaggagaaaaggggtacgctagaggggaaattcgggatctagatgtcataagaacaagagcctatgtacaatatgcacaagtcatccccaactgtgcatgacaggagacataactgcattaacttatatacatagaagtaaatgtaatgtggacaaaataaaaagaagcctttcggcttctaggtgatcggtaagcgggtgatgggaatcgaacccacgctatcagcttggaaggctgaagttctaccattgaactacacccgcaaattagtatcgggatgacacgatttgaacatgcgaccccctggtcccaaaccaggtgctctaccaagctgagctacatcccgatattatacttttttaaatatggcgcgccctgagagattcgaactcccggccttttgattcgtagtcaaacgctctatccagctgagctaagggcgcaaatatggagcggacgacgggaatcgaacccgcgaccctcgccttggcaaggcgatgctctaccgctgagccacgtccgcaaaaacaagatgcgcgtggagggacttgaacccccacgtcaaagacgctagatcctaagtctagtgcgtctgccaattccgccacacgcgcatgtaatacaatggtgagccatgaaggactcgaaccttcgacaccctgattaaaagtcaggtgctctaccaactgagctaatggctcttaatggctggggatataggatttgaacctatgcatgacggagtcaaagtccgttgccttaccgcttggctaatccccaatatgcatatgattcacaattccccaagatttcatccaggtaagaggatgaaaaatggtggaggctgaggggctcgaacccccgaccctctgcttgtaaggcagatgctctcccagctgagctaagcctccatactatcctatgacccgtaggggattcgaacccctgttacctccgtgaaagggaggtgtcttaaccccttgaccaacgggccatcctataacaagctctcaaccgggttcgaaccggtgacctcatccttaccatggatgcactctacctgctgagctatgagagcaaatggctccccgaacaggactcgaacctgtgacaactcgattaacagtcgagtgctctaccaactgagctatcagggaatattaatcataaagctctgcttggcgacgtcctactctcccaggaccctgcggtccaagtaccatcggcgctggagggcttaacggtcgtgttcgggatgggtacgtgtggaacccctccgctatcgccaccaaacatgaatttacatcgtaaattcttccgtatggttattcggttcatcacttatcgtgtgaatgaatagccatgcgcttgttgtatgtatttctacatacattcaaggttacaccctgaaaactggatccgaaactcatttgcgttttattttaggataagccctcgaccgattagtattggtcagctccatgcattactgcacttccacccccaacctatctacctcgtcgtcttcaaggggtcttacaaattgggaaatctcatcttgaggggggcttcacgcttagatgctttcagcgcttatcccttccgtacatagctacccagcggtgctcctggcggaacaactggtacaccagcggtacgtccatt

SEQ ID NO: 47 - DNA, 129143 bp, Unknown
  Kingdom: Bacteria, Phylum: Firmicutes, Class: Bacilli, Order: Bacillales, Family: Paenibacillaceae, Genus: Paenibacillus
aaattcatgtattaaaagagaaatggttcaaggaagaggaggtcgaagtttttctatagagagggaattatattttatataacaatgtcttcttaatttttaatagaagaagcatatattctcaagagtttttaaatattagattaaaaattgaggttggtgacttattataattagtatcaaagattttttatatgaaagaaatgtggcatcttattgtttgaaaaccttgattatttttacaggtacatcgataatttaccttttaatttccaaatccccatttctatttgaaagtaatatactatcaatcagcgtatttttattgcttctgttttttattttaaaatctaagaagagagaaagagccggagttttttttagtatttttatgtttagtttttttatcgtttttcttcccttatttatatatatgcaaagcttcaatgttattaatttagttaagccatctcttttttatgagtacgcttcaaaaggacaagtcaaaaaagaaattatttttacaaaagaaaatttagaaaacaatgggttaaaaaaaattataacggacatagcgaaaaaaacatcagacaacaataaaaaactctctgatagtagatctgtctatatgttactaaatgagaactatgatattacattccaagagtttgagagaaatgctaaaattcaaaaaaaattttctgaaattaagtggagcactgccgatgtaatggaatatattaaacggttagcatccctagattttgttctctttaaaacatcgttttatatttcattattactaatgggattatacgggctccataaatttaacgtaagatttgaattatatatatgtgctggagttatttatactgtatcaactttagggatactatctaacgatttaacgtcaattatttttttccctggggcatcaaagcaacaaatttctgataatgctgaatttttaaatgttataaaggaatctatattaacacttattatatttgatacccttagagagatcataaaggcaagaagtgaagaaccaaaagcagtagccataaattctagtgaacgaagaaataaaagaatttgtattggaaattttccacatggtaaaagaacaagaagaaaacgtgttgcacctaaaaattataaataaagtacaatgtgatgtagaagtttcatgacctagcaaacaatgctgggtcttttcggcatcatttcacgtactattctaaacatgaagcccacatccttaaaaacaaattttcgaacttaactcttgaaatacgaacgtatattcggtataatggaaaacgaacgtttgtttctgtttatgcagatacatgcaccaccaagtatgaaacgttcacaaccatatcactcaaaccaacaaacaggaggccaaaatttgtccagtaatccaacacgaaaacaataccaaatcaagttgttccactttaacgaaatcactcatgtaggtgaccaacttaacgcaccacaatttagcactcgactcatcaccgtatcgaacagtatctatctcgatcaactcaaacgagtagtagcagaatgtgatccttctaccgatgttaacgaagtgatctttatgctcaaagctgatcaaattgacgaagacgatccataccaacttgctctatttgaacgtatgctgcgagacggcatctactataatggaaggaaatatgtccgttcgattaagtcacctgcgatggggcgtacacaacgaacagaatttatccaagaaaaatatgttgctgatctatatcgatacattacactcggcaaaataccaccactcaccaatatccacaaatgggaagcagcacttggtgtaagccgttcagcggcacaaccagttccgtatatccctcgtattgtcgtcattcccgattatgaaaaggatacaatcatcgaagatgtatggaaagtggaaaagtgtactgatgatttggagcagcagaagttgatattcgaggaaaagacgaagcaacgtgaatatttcaaaacgaagaaagaattgaagccatctaaggaacaattacataagttagaacgtataccgaataaaacgatctcgtggaatggtcatacaaagtctgatcctgatcaaaatgaatataaaactttcaatgggtgggataaagtaaatcgtcgtgtgaagctagaagcaattcctattcctgctcgttcggttatgtatgatgacgaactatacccttgttattccatcgagcaaacggaagaaatcccaatcatagcaatcaatgaagagtccatcggattcaagcgagtggagtatccacaatataaaaataagaatgttcagtttttcgatggtcaaggtttaatgagcttccagtttgcagagcgcatcggacagcacctgagcctatcctactcacccaatgcagttcagggaagacttccatatattaaaggcaactttatccgattcgatctgatgaaatggttcaaggaaaatagcatcacagagataaaagatgtttttggagaattacagcctgtcatcgacaaacagggtcgtcctatcgatctcatcctcaccaaatcctgcttcaaagcatggcatcaatacagtgagggagaagctaagcctaagtgtttgtttgaaaatataacggaatatgaagaattactgaaagtacataatcataacaatttttgggtcgccaattatgcgaagccagcataccagatgaacgcctatacaccactgacataccaatatattcatgcgttgaatcttacactgaacgatttatatcaattagctacgcctctaatggatgttatcaaacatgtactacatgggcaaaagaatggcgcccatggaaagtggcttcgagatattgcttatacgaaagcattcctacatatgctagtccaagaagatgatgaacccaaagatgtagatgaggaacccgatgaacatgaagacgaaatagaacggggtcagaagaaacaatttataaatgaaattatccaagctatcgatttgaatgaactaatgctgtatgacggaaacgtccgcaaatttatcgtgaagcaagccatgctgaaagtacatgatatgttgaaaggtcgtatcccgattcgaggtagctacttttatttgaccaatgatccgattgcattcatggaacatgcaagcggaaaaccagtgataggtgtgctgaagaagaaccaggcttttatgaatcggaaacagggtattcacgcgctattccgatcaccactaacgatatttaatgaagtggctaaactagattttgtacaagtacataaccgatatatgcgtcatttagacaatgtgattgttctgaactgttgtgatctgagtctgatgagacttggaggagcagatgtcgatggggacacggctctctgtacgaatgatccgaccatactctcagcagtgatcgaagcgcctacgatcatcaatgaagatgataaaaaagtagctgcccctgtaccgaataatatggatagtatcatcaagatggagctaaagagtctacataacctgacgggtagatgtacgaatgtgaatacgtattttcagaatatggctttagaagaggggaatctgcaagcgcgggttttggaaaactctgtccttaaattccttcaaggtcaaatcattgatgccacgaaaaatgggctagaggtagagattccttatgtgctagatcgtctggctatccaaatgccgtatttctttcgttttgcaaagggtggtaaagccgaggattatcagcactcgatgaaatcgccatttaatcaattttgtgtcaaggcagaaaagtacatagatgacaagttccagatgaaagatgggaaactggatcagtctattttgggcatcgaaagcacgagacaactgttacaggatatgagcaaagttagccagcccaagtttctgagctatctagctcgcattgagccactgtataaagaatacaacgagcagataaaaccaatcaatcatcgccaaaaagaatttaacgaactaaaaaaatgggaacgggataatgatacccgcaaagcaattagcacggaatacgctaggttacgagaggaatacaaaactcagtgtgaagagatctgcccttatccttcggtacttgcgagtgttgctgttgagatcgcatatcaaaactacagaacgcactcctttgcatggctgtttgtagatggactgttggaaaatctaaagcagcgtgaaaatgtatcgaagaaggaagtacgaaaagtgaaccgactcacgaatcgaaatgtagaaggcaaagagcttaccgttcacgctggcatcgctaccatagatgattgggagtttccattgttgaatgtgccggacggtgtttattcgttatttgaaattatggggcagttcttcatatggtatgaagctgaacgggaaactgtagtacaaaccagccatacgccttctttgcaggatggaaaaagtacaagacgaacattgaggaattattcgcttggcttcagcactttaaaaaagtcggaggaagaatcgcagttgatagctgacgatgtattgggtaagaaattgcaaattcaggtggtcgagtaccgatatgctcatattgtggatgagcaggggaaagtgaagtgtatcattccgagggatcaggtcattcgtcgagatgaggggttatccttctttgattttgatggtacagcaattgaatttttatctatcgagaaagtcacgaaatcaagctttaaggcgatagtccatatcgactaaattaaatcataggtctgtcatgataggcgcctgttaacactggcgcttgggtggcatctgttaaaaggatgcgatccacaaatgagaggagtaaatctaaatgagctacttttattgttacgatatccatttgtttaattttttgacgaagaaggggttttcatttataacgaaggcacggcactataagacgaatgttttattttccatgtatctgaaaacgccagaattatctgtagccattgatgaatgggaagcaacgaatcattaaaatgtagatgttagaaatcatgtgaggagcatttgatgagaattgatgattataagccaaagcaaaatgtaactgggaagataaacggggaggaggttgaatggaaaaatggagatatcgttttaattagcagtgggacggcatcgggtaaatcctattttattcgaaacaagctggaacaactagcggatcaggaaaatgtaaacatacttttattagtcaatcggaagaatctgtacgatcagaataaagaagctatcgacaattcaatattctcaagaatcaaagtggaattatatcaaacgattgaaaatcagcttaacgaagggaaagagtacgatttttctccttataaatatattgtgtgtgatgagtcgcattactttactacggacagtggatttaatgataatgccgatgattcccttcaagctatactcggcttacagtctcaaattagaatttttatgtccgcaactggtcatgtgttattctcttatatcaaggatcaatatagacgtaatctcaaacaaaaaggtaataaaatatggacgtactccattccaataaaattcaatcagattgcatcgttatccttctacacagacttttattcaatagaaaaatggattgagtgcaaattcaataaagctaacgataaaattatatattttgcagacacgatccaaaaggcttttgagcttcatatgaagtatgacgattcactattcgtatgtagtaagagtagcaaaaataaaaaatatctcaaaaatgtagatgatgatcaagtggagtccatgatcaagcaaaataggtttgactgtaaatatctattcaccacgacggtgcttgataatggttttgatttgaaggatgagcaaattagattaattgtgtgcgatatatttgatgtggatacgatgctacagtgtattgggcgaaagagattcaagaatgaccaggataaggtacatgtagtgttactgaatcgaagcaatcgagatttgaataattacttgagatcagtccagaagaaactggatgaagcagatgcttttattcatggtggggttgaagaatggaaaaagctagtgggtaaattttcgaggcaatctaattacatcattaaagacaacgcaacaagtgatggcaaatataaatcgaagaagacagtttctagagttaaatatcttcaagctgtagctacgagagatcggattaaagcaatgctggatcagaacagggaaacgaatgaatatagagaaaaaacgggaggaaaaaaggaaagcgatgcctatatgatgtacatttcgaacttattacataaaaataaaatcacgttgattgagaagatgtttgatcaagaagaattatgtagctatttagacacgatagtcggtaaaagaatatacaaagagggtcaaaaacaagtcattgaaaaatttgatatcaaggattatcgaggtagattacaaaaggatattagccaattacagtcctacctccaatctaatcaattaaaatatgcgattggtagttttccagataaccgaaagaagttagaagatggaagcaacaatccccataaagggaagcgatattggttggttagcaaatttaaaggatagtcggttgtaacaaaaaaaatcaagtttttctcattttcgatactgtcaaaaaggtagtacatataaggatttttttaatcttggacagcatattgtggagtaatgctatatataacatatatccatgatttgctgtccagatgatagaaaaggcaatgaaatcaaccgtttttgaattaaggaaagttagaaaattatgaacaaagtatttataatatgccgcaaaggggttgggtgtgggaggggaaatggtggcaggcgatactaccgtttacgaagcgtagcgaagtggttttatcgcggttttagtttcccctatcccacgagtagatcatacatagacttggtaggattcatggacaattcagagtcatattattaattggctgtatttatcgctttaaaattttcgtatttcatattgaattttaccttgttgaatactgactgctatttgcaaattttaaactacacgaattgaggacttgagtaaaatgtgtcacgtgacacaatgagcagatttacaagtatagaatcataacatgggaactctggctatgagctagggttcctttttcatttagagaggagcaacaagaatgctattaatgttacaagcaataattatagaaatattacgatttattactgtagttggtgtggtttacacctggatgtggattgcagcctttttaaaaatgaaggtagaaagggggatgaaatggattgcaaatcaaattcgtaaacgtagaaatgttaattccgtacataaaaaacgccagaaataatgagaaagctgtagacataaaggagcaagtgatataaatgaaatggatgaaattgaagatcaatcaactggtacatgccgaatataatccaaggaaggatttaaaagcgggtgatccagagtttgaaaagatcaggaatagtgttatcgaattcggttattgtgaaccgattatatgtaatagcgattataccatcgtgggaggccaccaacgtgccaaagtgttaaaggcactcggatacgatgaagtcgattgtgttatcgtcgatgtgaacaagtcaaaagagaaagccctgaacatagcgcttaacaagattacaggggagtgggactttgaagcattggctgcattgttagatgagttgaaagaaacagattataacattgagctaactggctttgattggtctgaagcggagaaattgctggatacattgcacgaggaaactgtagatgatgaggatgattttaatgtagaagaagcattacctgaacatccgatcactcgtaaaggtgacatttggctacttggtaagcataggctcatatgcggtaactcgactaatccgcaggatatcgcaacattgatggatggtaagaaggctcagcttattgtaactgatccaccttacaatgtggattatacaggtaaaaccaaggatgcattgaaaatagagaacgataaaatggacaatcaccagttttataatttcctattggcagcctatactcgaatgtttgaagtagcagatgacggagcaagtatttatgtgttccacgccgatagtgaaggtttaaattttagaaaggcttttatcgaagccggatttaaactggcacaatgctgcatatgggcaaagcaagcaatggtaatgggtagacaagattatcactggatgcacgaacccgtattatatggttggaagccgacaagtggacactattggaatagtgatcgtaagcagactacattatggcaatttgatcgtcccttccggaatgaatatcatcccacgatgaagccgattcctttgattagctatccaattaaaaattccagtaagcttggtgatattgtgtttgatccatttggtggttctggttcaactttgattgcttgtgaggaaacggatcggctctgctatacctgcgagcttgatcccaaatatgtagatgtgattgtgaagcgatatattgcccacgttggtagcgataacggcgtttatctgattcgagatggagtgaagctaggctattcagaagttgttgctgatctagaattagtgaacatgtaaggagtttataaggtgtatagcatcacaaaaattataaacaaggaaacaccaaaattggctattgccgcaaacatacgctttgctttaagttctgaaataccagaaaataaaagcatgagtccaagaaaaagttgattgagcatagtgaagcgttgattgtcgttaggataagcgaatgatagagaggcacatatgagaacaaccaaagcacatattaaagttgctatttgatacatacccatttttttaagcataggtaaattccccctttccatttagtttattatacgatgaaatcctattatataatattattccactattaattaaaaatgataaacaatatgtttttcaagaagttgttgctgagtcggcaaggtcagaggtatcatgtgctgactaaaccgaaagggtgactcaattgggtaaggcaaaaatgaatatggtgattcgattcctgaaggacatgcaagtcgaaaaggtaaatgtgcttggggctgaggaagcttgtgaggatatcgagttgttttacgaggctgagttagaaggataagccagaatatatataggtaattagctctgttatatatgttttggcactaaatttatgaataggaatagaccctatataattgtgcaggaattgtcggatggatacattcaactactgttattctattgatgaaggaggtcatatagtggatttgcttaagagcatgaatgaagcaatcaagtatattgaagaaaacctgactaacgaaattgactttaaagaggtagcaaggttggcttactgctctgaatttcattttaaaaggatgttttcttttcttgcaggtactacgttatcagaatacatccgccgcagacgcctcactcttgcagcatttgagcttaaagatggcaatgtaaaggtcattgatatcgcgattaaatacgggtataattcaccagattcttttgcaagagcttttcaaaatttacatggcttaacgccgtctgaagccagaattaatggccgttcacttaaagcatatccacgaatgactttccagttatcaattaaagggggaagtgaaatgaactatcgaattgaagaaaaaggggcatttcgcatcgttggtatccaaaaaagagttcccattattttcaacggagtcaatccagagattgccgcgatgtgggaaagtttagatggtgaaacgatcaataatcttaaaagaatttctaatgtcgagcctatgggaatgcttagtgcatccacgaacttttctgaaggtagaatgaaggaaaaaggggagcttgaccactatattggcgttgcaacaacaaaggagtgtccacataacctaacacagcttgaagttgctgcctcaacatgggcagtattcgaagcaatcggatcatttcctgatgcgctacaagatgtgtggggccgtatttattccgaatggtttccatcctcaaactatgaacaaatagaaggcccggaaatcttgtggaatgagaataaggatataacctcaccgactttcaaaagtgaaatatggataccaatcttgaaaaagtaaaataatgcgtgtgattatgaagtatcccttgagctgtttcggcagctctttttttattttgcttttctcaactaaataaatcggttttatccatgtatcactctgttgagattaaaaggagaagtatgttatgagcagattctttgagttgttcaactaacagaaacgataattgaatcatggtagcgccactctatgacttcatttagacaactggaggtgaaagatgagcaaaaataatgaaaaacccaaaagaaacaagccaaagatactgaccaagtatgatcaatttgttgtaccaagactgaaggacattcccgtttgggtacgtgaaggagccacagatgaagagattgctaagcggctaaatattcatatctggacattaggcgattatcgtaggaaacatcctaaatttgctgaagcattggaacgtccaaccaagtgggaaacccatgtatatcctcggctagcggaaatccagcaatggttcgaagaaggcgtgaatgcagaggatattatcaagaaactcgatataggtaaaacgacttggtacgagtatatagataaacatccgatgctagctgaactagtcaaatggagcagatctgtccctatttcacacgtggaaaattcacttttgaaagctgctacgggctatgaatatgaagaaattaaaacaatcattgaagaggataaaaatggaaaaaagaagacgcgcatcgagaaagtgaaacgatatcagcctcccaatccgacagcgatgatcttctacttaaagaaccgcgcacccaatgagtggaatgatcgacgtgagctggtggtcaatacgaaggcactggaacaggaacggaagcagctatttctggatatgatcgaagccgatgtggtggatgccgattatgaagctattgaggaatcggttgagatggaggaaggatacatagagccggataattcgcagtcataacgttatgtcgttagtatttatatagataaacgccagtttcagcccgaaatttgccccaaaagtagccagaatcaatgcataagataagttatgtatggagtggacttttccccacatcaacggtatgatgtgacacacaaagcgaagggtggggcgaatatggagcatattcaagggtttgaagcgcatttacggagcaaggatcggagtgaaaatacggtttcctgttatattcgggatgtattacagttcatagcttggtatcggggcaagacggaatatggactggacaagtggattgaacaggatggggtagaatacaagaaatatctgcaaagcaccaatcaagcgatactcaccatcaaccgcaagatcgccagcgtaaacgtatttgcacagtggatgcatcagcaaggatatattaaggaagaaatacatatcgaagcggtcagaaacaaggttgttcggcagtataagggtcttgaggaaaaggatttgtggaagctgagaaatgaaattcaccgtatgggtaatcgtatgcacatttgtatgattgaattgttgctgggaacagggatacgggtaagcgaattggttggtatcaagctgaaagatattgaaatcagtgaacgcaaagggttattgaaggtattcggtaaagggaattcctttcgtaccattccattgaataaggatgtacgaaaagccattactcggtatcttgaagtcaggtcacaggttgattcggaatatctatgtatggggcagcgtggagcattggaacgaaatgcgatcaacctgattctggataaatatggaggtcgggtcaacataaaggtcacaccccatatgctgagacatacacttggctataagttggtaaaaacgactcctttgacgaccatccaacaaatccttggacatgatcatgtagcgacaaccaatatctataccctaacaacacagcaggatatgaccgaagccttggcaaatatcgagtggtgagaagccactctttttgtcgtggagggaggggttcttctatgtagataaacggagccgccagctaagggtgcagaaatttttgtgatgattttatagtggatttgagaaaggagctataccgattgaaacaataaagcaagaagaacagcgacaggctgagctgcttaagcagtatatggagaagcatttcaagccgcccaaaatgaaacaattgatcgaaacgttctctttctctgaactacgcaagcttattggtgagatggacattgagtttttcgccttagcctatttccctaaatattttgatcgagcatttggcaagtttcatcgtgagttattcgcggaattaaaacatatgcttgcaaatacaggactgattacggcttttggactcccaagggagcatggaaagtcaacgatcagttcttttttatttccactatatgcaactttatatgataaatcacagtttacgctgatcatatctgccacagagcaaattgcattgccgttcctcgatatgatcaaagatgagttggaaaccaatcagatgctgattgaggattttgggattcgtaaaggaagccgctggaacaacaatgaaatatggctaaagagtaaaggtggactggactcatgtattatgattcgcgggattgacggttcacttcgaggcattcattataagcatcatcgtcccacactagttctgatggatgatttgctcaaggaggatacggctcgatccgaagccaaacgagaacaaattaaaaatacatttacggatgtcattttgcctattggcacaagggatacgaatattctgatctgtggaacgattttgaacgaagaagatattatggccgatctgctcaaaggtaaaatccctggtgtgcgaagtgtccgtaaagcagccgtgcttcaattttcagaacgggatgatctatggtcagagtgggaacgacaatataataacttgcaggatgaggacaggatcaatacggctttgtctttttttatggcgaatgaggaggaaatgctggagggtacgaaaatcctgtggagtgagtatttggactactattatctcatgtgcaagaaacaagccatgggtgaaaagtcattttataaagaattacaaaacgatcctcgttcaacagacgaatacatatttcagaatctgatgtattgggacaggttacctgagtttggggacatggaactcgccatgtacattgatccggccattaaagcagggaagaaaaacgattattctgctatttcgattattgggcagcatcggaagacgaagcagatgtacgtgatcgatggaaatatttataaactgctgccggatgatttatttcaagtggctattgaaaaaataaagctttatcctgtagataagcttggttttgaagttaatcaggcacagagttatatgaagcaaaagtttgaagaagagttatggaaggcgaagatacatacacccgtagaaagtgttcattccaaggggcaaaagtatgaacgcattattagcctggagccagaaatcaagaaggggcatattctgttcaatgcagataatctcagatacaaccatcaagtgaaggattataatcgaaattgtacatacgacgatgcgccagatagtttatatggggctgttcaattgattcagtcggtcaagagtttaaagttttatgatcgcagtttgttgttttgagggttctgctagatgctcattttttattttgatccaatctcgttaagctaatgggcagggaagtgcaacaaattttatccagctgcgtcttaatatgggggaaagttactgtgcaacgaatttaaccaaaaaaggagctatcatttatgaaaaaagcattctttggggtttttcttgcaatctttttatttattttatcgtcaactacgtatgcagcagaaaatcaaatcaaagttgacggtgttgctattgcatccgatgtgaagcctgaaatgaagaacaaacgtacaatggtacctttacgtgttattagtgaaaatttgggggctagcgtcgaatggtccaattccggggttattctcgctaaaagcgatatgaaagttatattaacactgaacagtagtacagcggagaagaatggtgaaaagatgctgcttgatgttaaaccatacatgaagaataatcgtatatttgttccacttcgttttattgcagagacgtttggatgccatgtcaattacaacaactttgtagtgactgttgatactgaaccattgtttatagacggtgtacaagtaaaagcattgcaacatgaataccatatgactatgggcggcgtagttcagcgaattaatggaaatgcatataacaaaacgatctataatattttggtgaaaaacaaaggtaaaaagatcgaagcacctgcaaactactcttggagaggtactattgacacacttgggtcctattataaaaatgcgcaatatgattttctagacccaaaagggaacagcttagttcgttttgatgtttattctttaattcgttcttttccatctgaatctttaacaggatatcccgagattttgattcatgacgtatctaaagatgagtggtacttgtttagcgataccgcaaatcgatccattgaagagttaatttataccgctaaaaagaacggttttctgaaggttataagtaatacagttgtataaagtgattttttcttattacactaattggaacgatagttgacgagcttgtaatagtatatcgatgccaatagatgcttgttataatccccgtttgcttaatcacgggtatgtaaggaggttaatattctatgaacggctggaatgaggagaaggctctggaacagagtgatattcatcaattgagtggtgagatctatcagatcctacacgagagaattgacaagctaggtgtagcatatggcatcgttagcgaatttagttataaccctgaggaaccaccgttctggactattactatcgaggactatgaaaccgtgcttacctcggccatcttgttccaatatataaaagagcatagaaatttgaaggatgcattaactcattttatccgcgatcacttcccatacttcacttaagcagagtattagcgttgaaagaatactcaattacgagagttcaactaactgatcggcagtctttcagctaacgggcagtaaacagaaacaaacttctttttcgttcgtaagggcattcagggttaaggaggtgctgacttgacgtttactttaatggctttattgctatttttgggggttataggtgttatcatgccattagcacaaagtattagaattagattttcaccgaaatttatgagtcttactagacggacacgatatacactttcagtattagtgatttgttctttgctgtacgaattaagctttctgtttgtctacctgactaaccatttatataaattcccgagaccctggggggatatatattgggtaagcactggattgagtggaattatttttggcatgcttggggttaactgccctccaagattaatatggatgttttccatattgcaatttattataggattaggtcttttgggtttattagttttagcgataggcatcacatcgatgtgatcaatatgctaacggaaacattggtttaacaaggaactatcttattaaaggtggttcttttatttatttaagcaacaattactttatctattttgaaaggaagaacctatttgcaaataaccgagtccatcataattgaatgtctaaatgaactccaattggctgcattagccaaacagaaatatgcagattactatgatggtcagcatgctattctcaagaactatgcgatgcaagaaagtcgaagtaatcaaaagcttatttttaatttccctcgtaagtttgtagataacgaagtgggttatctgcttggtaagccagtaaactatgtgtccaagtcagatcaggatgaggctatacataacattgacgtacatatgagtcattgggacaaagagcataatctacagcttcggaaacaatccgaaatctttggtgagagctttgaattgaactatatcgactcggatggacagttttcagccacggtattatctcctttaaatgcgtatgtgttggaagacggaacagcagaacgaaatgtattacttggcctacataaatttacgagacgttttgatgagcaagtgtatttagacgtgtatactgaccatgagattctacactatacaattagtagtgataataaaaataatcaaatgaagcagaaccaagcacctgaattgaaatatatcggcaaacataatcacatctttggaagagtcccgcttatctcttgtccagccaatacggagagaaaaagcggcttccaggatgtgatttctttatttgatgcctataacgctttgaactctgatttggtcaatgaaattgcagatcaccgtaacgcctatctggtgattgagaatgcaaagctggaagctgaggacttattgaatatgaagaagatgggcattattcaggttccggctggaggaaaggtaagctggcttacgaaggagattaatgattcctttgtgaaaaacgagttggataacattgaacgcaaaattttcgacatgatggatcaggttaattttaatgaaaactgggccagtaatacctcctccttggcgttgagaaataagctgctgaatttggagaatcgagtggcaatgagggaagctttgatggaaaaggcaatcaagcagcgtttacgaaatttctttacctttctgcacattaaagaaggcgtgcaatatgattaccgtgatatcgcggtgaagtttactcgtaacttgccgacagatttggtggggatggcagatgtgattgtcaaattgcagcaagtggtatctcaggaaacattgctgacgttgcttccgtttgttgagaatccaaagttggaattcaataaatttcatggggagcagcaacgattagcagatacggctgaggagaaatcggatgcagaataaaaataggttcaagcggttggtgaagaataattgtgcatgctatcttggagtaaaacacggtatctccaattattgctgcttacaagatggcccatgtgtatttttcgctccagatgattctttgccccgttgtagctattttgaaaatggggttttacccatagatgaaaagttagaacgagaatataagtctgagcggaatatagaatctgaatttaaaacagcgcaaccgagggtgaactgtcagaaatgtaaggctactttttcagtgaattcgaatcggcagaaatattgtgagaagtgtaaggataagaatgcaaacgaaaagtcgaaattacggatgcgtcagatgaggaaaaaacaggcttgatgttacgatttagaggtttaaaaagtcaaataaactaaggatgaaaaacaacccaaaatgaggagttggtatgtttgtacctatttctcgtttttacgttttctaatgcgtaacattattgtatcagatatgacgttaaacgaattcaacatacatatgcgtgttcgaaagctcgaatcccaacaggttcagtgttacgctttaggctatccaaaatcagcataaacaaagggtgaaaaacaggcaaaagtgaggagtgggtatgtttgtaccttttcctcgtttttgtgatttctaaagcgttacattgctgtcctgagcatgacattaaacggctccatacatatataagcgtgttcggttctgcgtagtcgaatgggcaataaaggagattatcaaaaatgaatttagaacaaatgaagcagttaattgaagaaaaccaaatgaatgaggaatggcaaacgtatcttcagggtttgaatccgtataacgtggaagggatagagcaatacatccaatccaataaggatgcgaaaagttggctcgatagcacggtagacaaacgatccgctaaatcgctggaaacgtggaaaatcaatcatctagaggatttactgaatgctgaaatcaagaagcgattcccggctaaggatgaaaaagatatcgaggtcgagaagctacgagccgaagtcgaaaatatgaagttagagaagcaacgtgaacggttaaccagtcaagcgatcaaaattgcatccgaaaagaaacttccacttccgttagtggatttttttattggtgcagatgaagaagcgacgacagcgaatttagctatgttggaacaatcactacaacaggctatacaacatcaagtcgagcaacggcttaaaggggatggatatacccctccggctggttcaacaggtagcacatttacattggattcgatcaaaggaatgtcgccaaatgagattaatcagcattgggatcaagtcaaacaagtattacaaaacaaataataataaacgaacaggatagggtgaatagatatgtcagtacagaattttattcctacgatttggagcgcacgtttaaatgagagtttgaaaaaaaatctggtgtatggcaatgtggtcaacaccgattatgaaggggaaattcaaggccaaggttccacagtgaaaatcaattccattggggcagtaacgattggcaattatgacaagatagcaggtatcggtaacccgcaggaactggatgctacgcaaaagacgctggtgattgatcaggccaagtatttcaattttcaggtggatgatgtagatgctgcgcaagcgaatgtgaatttgctagatggtggaatcgtggaagcttcctatggactcgccaatgtagtggatcagtatcttgctggattctatacggaggttaaagctgagaatacgctgggtaatgatacaacgcctatggttccaacgaaagatacagcctatgatttgctgattgatttaggcgtgctgctggatgagaacaatgtgcctgaaagcgagcgttttgtagtggttcctgcatggtactatggcttgctcttgaaagatgctcgtttcaccaaagacccgaatattatccgcacaggttatgtaggggatattgatggcatgaccatttacaaatccaacaatgtgccgaataccacaggagccaagtataaaatcatcgcaggtcataagagtgcgatttcgtttgcggggcaagtggattcagtggaagccttcagaccagagaaacaattttcggatgcagtgaaaggattgcaggtattcggtgctaaatgtatcaagccggaagccctcgctatactcacagccaataagtcttaattgaaaataggatgatatgagaacacattataatagaagaaacacgtttagggtgtctgctttggatgcccttattttcatttttggagggtgataagatgtggtttttgaatcaagaaacaggatgtatatgggaagtaacagatcaggagttggtattgaggttacaggctgatacacattatgagcaagtggatgagccaaaaccagatgagactggggaagatgaatctgtaacgaaagttcaagctgctaaaaacatgaagcgtaccgagaaggcacaggtaaaggaagaacaggagccagaacatgaatgaaccaatggatttgataaaacgattattaggcatagagccaacagatatatccaaggatgatatcctgatccactatttgaataaagccaagggtaatattcttgggtattgcaatgcggcgacactgcctgtggaatacgatcatgtcatggtcgattatgccgtgtatctatataaaaatagggattcgattggcctaatgaataagcaggaaggtgaacgctcagccacctatgaaacaggcattccgacaagtatccggcttgctcttcctttacctaaaatcaaggtcggaacagattaatgttctatgatacgaagctggagattttggatgttacttacttcaaccctgtgctgttgatgatggcagatgtacaaccttatcgcaaaagtttttcatttgaagatggttacatactagagacgacatatcgagctttctgtccattggaatcctcattgcaattaaacggctatgttcaaatctacacgagtatctttattattttggacatcaaggaatggagcgattatatggaattgtatctatttcgctgcaagccagattttgcactggaggtgaaggaatgacaaggagtctagagccgatgatagatttcttcctgcgagagaaaggcgaacttgtacacataaacggtgtaagacagcttggtctgattcgagatgcgacaaataatatccaaaacactgatgaaaaggtaatccatgcagcaacacctttacatacaggagatatcgtggattatcgttatgaacggtatctgatcaccagtcaggtggatcgaaatgaacagtcttgtcgaggcagaatgaaaaagtgtaatcaacgactagctctaaactggaatggacaagtgaaatggtttgatgctgtggtggaagccagaacgttttcaacggaaacaggtaaagttatctccatgccagagggcaacattctggttagcctacaggacaacgcagatacgaagggcattacattaagtcaacgattttatatgactcatcagccgtttaaaatagttggaatggatcgcacgatgaatggcataatccagttaagctgcacattagatagcataaatacagcttatgatgacgtggaaaataacattgcagaccgatggaagtacgaaattgctcatacatacgcattacatatacaccagggaacgatagctcatgtacctctaaacgaaacaatacagttgaatgtgactgctacggataatggaaatgagatagccaatccggcgattacctatatatccagtgatccgaatgtgattagtgtagatcagcaaggtcgggttatgggcatcgctttgggccaagtaagtatcaccgtaaaattaacatatcaccctacgatactgagtacgattgaaatgagagttgtcgaaacgggaacgcatatctattcgatagccattactggtattcccatcctcaaaacaggccaaagctcctcatacgttagtcatatttatgaccatggtactgaagtgttcgaccagtcggtagaatggagcctacggaatcaagatggttcaactccgatcatgggaagcataacagcgagtacaggaaatagtgtgacggtgaaagctggaagcagtagtggagcggacaataaagcccttgtactgactgccactttagtaagcgatcctagcattaccacagaaaagaacattagtcttaagaatttattctaagctttgtatctatcggcttgccttcgtggtgagccatttttatttcaaaggagcacatacatatgcaacgaaaatctattgattatctactgagtctaagcctattgaagcaattgagattacaacatgtcattacagaagaagagtttatagcgattgatgagctgaataaaaagtctttcaaatagctataacatggtcagaaatggacttgatgatgtgccgtaagcattataccatgtgaccgtataaagaagatatcgaaaggagaaacacctatggcacaagccgcaaccgccaaaaaagtcgtgatcgttcccattaaaacgttggatatcgtagagggaattcaatcgattcaaaagaagaaagtcgctgcctattgccgggtcagtaccgattccgaggagcaaaaggaaagctacaccaatcaggtgaatcactatactcaatacattcaaaacaacttagaatgggaaatggctgatatttacgcagatgaaggcattagtggaaccaacactaaaaatagaacgcattttaatcggatgatacaggatgctcgaaacggtaaactggatctcattctggtcaagtcgatttcaagatttgccagaaacaccttggatttattgaaatatgtacgggaactcaaaagtcttggagtggctgtattctttgaacgggagaatattaatacactggataccacaggtgaagtattgctgaccatcctgagttcccttgcccaagacgagagtcgaaacatttctgaaaacagtcgatggggcatattacgaggcttccaaaacggcaaagtcttctgcaacaccactcgcttcctcggctatgataaggatgaacatggtgaattggtgattaacgagccagaagcagagattgtgcggcgcatatatgaggaatatctagacggaaaaagctatcaggcgatagccagaggcttgatgcgagatcacattaaaacagtcacgggtggcgatacgtggtgggattcctccattaccttaattctgaccaatgagaaatattacggagctttgcttcagcaaaagacggtaacggtagattttctaacccataaacggatcaagaataagggacaagagcagcaatattttatagaggataaccacgaaccgattgtatccaaggaaatatttgaagcggtgcaaaaggagaagaaacggagagcccagctgaaagggagtgtgatgggggagagtaaaagatactccagcaaatatgcactgagcagtaaagtatattgtggatgctgtggagccatttttaaacgccgaacctggaacagcaataatccatccaagaaggtcgtatggcaatgtcgaaccaatgtcaatgaaggtaaagcagcatgtgctgctaaagcagtcgatgaacaagttgtacattctgcgtttgtacgattgttcaaccggatgtatgagaacaaggaaagattgattaaaacgctgaaaggaaatattgtatcggtactttccagcagagtagagcaagaaacactattggacattgaaggaaagatgcaacaattgaaatccgacttgaaggaattagtgaatctcaagctacggaatcaaattgatgagactatatatgatgaagaaacgaacagactttccagtgagctaaacgagctacggcaacagctgctgatattagaggaggaagaggatcgaaaggaaaaagttaaggaacgagtcgatgaaatcattcaagtactaagctcacggcaagatatactggaacaatttgatgataacctattcaatgcgttggtggagaagataaccattctctcaccagcgcattttgtttttaccttgaaaagtggaatgagcatagatgaaattatcgaagattaatagagtgttgttacatgaatttaggaactagagaaactatagctaaaacgatcaaaagctaacgagtaactgtggggtgtatgacgggaagaatcaatcgaatcccgtcttttactccttccatatagatggattgtttgtcttggcttaactgatagcctatgctttcttcccattcggatagcagatgttgaatatcttcagtttggttgattttgaattgatccatttgagtgaatagatttttgtcctcagatgagcatgaagcgttttgttcgccagcgagttctagttgataaaatcgttggcgtaatgcttcgagaaaccattctggccaatttgacataaatacattctccctcccgttgttgaagtgtgtgtatgttaactctgatggggagggatggcaagtcattgttttagtgcagtaagtggcttgctatgttacttagttactaatcttgaacagataaaagacttatccaccttataaatcaagttggaatgagcctttaggagtataataattttgaaagcaattttcttactcaacaagacccgtgaattgggtaatcaaatatatgtgctcaattagtttgactttttctagattttccaccttttcggaaccgcctaatcctagaagtggaacataaccaaagcattcatcaaatgctggttttccgtatttttcaatggcatcaggatatggtagccaatctagatcgttttgtagggatgaatcatcctccaggtcagagaaaaaaaattcaaacccagatgatatgccatgcatctttcctcttctaaaattaagtaaaagtaaatatttattatcttcccaaataagtagatctcccatggaagtagtaaataaaaccagagcctctttgcttctcacatacacctcttctagcaaagaatgaaattcatctgggtttactatttttaaatatccatttaggatactaccaaagccatactgtttccaaacttctattaattgctcaggtactttaccttcaaatttattaatcagtttttcagaagccttttcatgtagctcaaaatcattaaaaattccaatatccatcctgatctccctctgttaatttgttagtttaatatttaaatgagttgactttctttctgcctcggtcatagattcagcagctgatcttacatgttcatctattttacccgccctttttttccattgggagccaagagaagagttaatccttctatcccccactccactgacatgttctggtatacctccagcaatttgatcaggattatgtaatgccgcctgaccatctagccatttactagcttgtttttttgcttcttctttatccactccttcttttcttaactcagtaaccttatccaagtatgctttttctctcgcagctttttgcgcagtatcaccttcgggtgctcgtccttcttttaaatatctatctctatttttgataaactcatcaacggttaaggaattaagtccttcctcttgagcctttagctgtctttcaaattctactttatcatgttttggattccttttgaaattgacttcaacttcagagattcggggaattttttttagattagctttacccgtcccctcagttttagtttgactcgatttcggctcattcgttggcttcaagggttttggttctggaacatctttggaattatgatgtgtcccttttccaccttttatttttcccttacccagaagagagctaattagcatcccagctaatgtctcaccctccatgtaactttggcccttctctaacatccgtttatcgtcttcttttaaacctttgagatactcatctctggcattttcctgatccaaaatataatttttagcaaataccaaatctccctttgcctcttcatattggcccgacactatagtacttatagtatccacaggatgctcgataagagcatcttttaactgtttcaagccttcaacgttcgcttgaactgtttcctccatgccctggaaaaagagtgtggtttcctcgccaaagctttttttagggggttcgggacgattagcttcccagtcacgaatactttgcgcatactttcttgctctctgtaatttttcttcttctggggaaagcggcttaggaggaggttgttgcttcatataatccctaatccatttttcacgaacacttttaggaacctgctgatacgcatgaaccatcatcttagactctttcagcaagttttgaaccagctccaatgttccaccggaatgagccacatgacgagcacttgtatacactttccccgaaatccacttgttataataggcttcctgagctcgctcatactcgtattgactgaccagtccctgcattgttaaaccagccaagtattttaacggatgaattctggttcccttaccgcctcctccaacggtaggggtccctttgctccgaacagggatcgctgcggttgctttcagaatgacacccgaagcaggcccacttagtgctcctataacagcaccagccacttttcccatcaccggaatggagcctaaaagcttagataccgtactcatcaaggctttggcctgttgaagggctaccggacttgtcacttttgcggtaggagtgttgctggatggagctttggctgttactgcagtttgagccgcttcataggctttaatactcatcaatggaggctcaggtacaggaggaaggtcagctacgaaaactggagcttttaccgtaccttcttgataaatcactggggctttggtgtctgtctcaccatccaataccatgctgctggctccaccttttaagtatagcgccgttccagcttccagtgatagttcctcacctgcatcgagcttcacatgaccaccctgaatctgcacattccccggactgttaacggtaatgccaccatcttcatttagtgtaattgaaaatccatccgaggtggacagggtcagttcttgctcagacatttctatgctgcttccttgcacgtgttgccacaccttcatatcgggctgtccattcgcgtggcgttgttgtcgtaatgaatctgtcacataggcatcctgttcgtgatgtgtaggcagatataactcgacttgttccccgatctcaggcatatcgtaccagccactatgttcttcagctacatatcgagttgctacaggaaaccagcaggctttggcaggatcttgctttgggtcgatgtccagttgaagctgtacaaaatcatgctgtaccttcagcaccgttcctgtcagcgaaatcccggtcgcctgatcgttctcataccgtgcatagcgaatatcctgttcagcttgaagatcataacgagtacgcagtaagccatctgctaacgttgttactgcccgaaccacgaccagttcttttccttgtccgatgggtaacgtaatgaggtcgccgagcgcatagtattgcagactttcaatcatataggtgatatacgagccagcacgttgttctcctaatttttcggcatccagttcatgaaacgttttacgtactcgataaaatacatctcgctccaccttatgctgcttgccttccggcattccgaagaaaaccttgggcgaggctgcggttacctctggcacaagtacggagccgaagcgagaagcgaggcgttttaaaaacgcccaatcggtctcatcatattgtaaaacaaatgtctccaatttggcatggttgcttaccgtgtcaatggcatctccatactgatactttcgaaccagcgcagtgaccagatcatcataggtacggtgaatatcttgataggagcgccttttacgcttaatatccatctggtatgaatgggaagcggcctccaattcaaacgtatacacgcctcgcacgcagtgtacggacatatgcgtaacaatcccgtggaacagtcttcttagcgattgtccttgatcatccaactgacgaatcacaatcggctcttgctccatattttgtccgatgcatgcggctccctgttcttcggagagcataccactgatatgtaaaaaagtatgatcattaatggtacgtgttatttgaagttgatcgatgtgttgcggctgaaaggggccataaaagcgtaggctttcatacccgatccaatctgataatatgctcaagtgagttcatgactcctttctagatttgatggctgattacaaaagtaaagtgcagcatttttaattcgagtctgactaatagaggaaatggatgaatacaactttgagtcaagacctatatgtatcactgagtttgttgggtataaagttacgagatgtgatatttaaataaaagtccagcatatgtatttatcggttaaaagagagatttagtttacagaatgacccattggttggtgtatttactatgtgtatttttggaagggagaggcatggaaagagaggaagctaacagtaattttgagcaattgccttccaaagtcaggaacggggataatttaattgtgattaaggattcgggtaaattaaatacaggctcatatggaactagtgggatcgatagaagtgaagggagaacgggcatcatctagaaaaaggagtgttgtgaggaggaatagtttttgatattataggtaatatatataacaaaaaggaatatatcccttttttagtctcgacacatgtggagtgcgtagtagtaatatatcgaaatgatatgtagaagcacacaaagtcatctcaaagcataaacagtcgtactaaagcataaacagccatgttacgagccgagtgagaaaggggttccgttcctgttttcctcggctctttttcctatttccaccgcaatacatagaaagttcgcccaaatctccgctaatcattgaacagaggcggtttttctcctgttttttttcgatcatttccttcgattttcttttgccctatccccatatttttcctgtcatttcccctactcttagttcgactttaattgcttttttgaccccgatttttcccgttccgactcagaaattcctctgtttcttcttacgactattattgcaggcagaaattgggtgggagcgtgagtgagaggctgtgaagccttgtggctgtaaggcggagcagcggtggggcgaaggtgacatggatgatacgactatttagaaaatgcacataagaagcagtgatgtacagggtttaagaacaactttatgttcctgcatttagaaaatcgctttaaggttgagtgcgggaacatattttatttacaatggcatgtgaagtgtacagtgttgctggtacggaggggcaactaatttggagatataatggcggaaatagtaggaggggcggcgctcttcctttttttgcgagtcttttggggagtctgctcctctcttgggtatgatatactcatttagatgcctatgcttaacatatactgccgtttgaactacgttgcttaaacatgttatatgtgaagaagaagcaaggacatggacaggttagctttaccattttgggaccaaagatttgtcctggtatttatagaggagtttttgatatgacgaataatttttggcgtgatttgccacgacctttttttatactggcaccgatggaagatgtgacggatgttgtgtttcgccatgtcgtaagtgaagcagccagaccggatgtgttttttacggagtttgcgaatacagagagttattgtcacccggaggggaacaaaagtgtacgcgggcgtttgacttttacagcggatgaacagcccatggtggcccatatctggggagataagccggaatattttcgtgaaatgagcatcggtatggcgaaagaaggcttcaaaggcatcgatattaatatgggttgtcctgtagcgaatgtagccgagaatgggaagggaagcggcctaatctgccgtcccgaaatcgcagcggatatcattcaggccgccaaagccgggggactgcccgtcagtgtaaaaacaaggctcggtttcactaccgtagacgaatggcgcgactggttgacccatattttgaaacaagacattgtgaatttgtccattcatctgcggacaagagaggaaatgagcaaagtagacgctcactggggactaattccggagattaagaaacttcgtgatgaggtggcaccagatacactgctaaccattaacggagatattccggaccgtcagaccggcttgaagctcgctgagcaatatggagtggatggcattatgattgggcgtggtattttccagaatccatttgcgtttgagaaggagccgaaggaacacagcagtgaggaattgcttgaactgctacggcttcatctagatcttcatgatcattattcagcgcaggagccacgttcgttcagccctctcgcccgcttcttcaaaatatatgtccgtggattccgaggggcaagtgaactcagaaacagcttaatgaacgccaaatcaacaagtgaagtgcgtacattgcttgatgagtttggaagcaaggagcatgatgaggtagaagaacgtggaaattaaattgccaagttgggggacgggctgttagtaggcattgaaaacataggaggatatatgtcctggagtaaattgaagcaacaactggagagcttcctctctcctgcgttagacggaagggtcgaataccgagcgaccagttaccgttattttcctgataaatctggaatttgttatataactgtagataagaagaacatactcaatatgaatgatatcactagtccaatccaatggtatcagacggagttggaaatcaagaatgatccagatatccaagttcctatcagcaatgaagaaattgaagcggtcagaaaagatactaatgggaatgttccggaggatcgtctacaagtaattgcaagaggtagaaaaatatcagagcatgcaaaggagcttttgtcagcacaggcctcattaagcaagtctaattttaatgttgtagctaataaatttttaactacttctatagaggacagcttagagagtaatgatatcttattgaatattctagctttagtggacagacgagtaggaaaaaagcgaattttaaacatgaccgagaagatgaagttaaagcatcccagtgtgcagtatttttatgaactacgacgtagtacattatgaaaataaataactttcaatgatgggggcacgtcgtgtcagtcagggttgtcctcactgcaatttgaaaaatgtatgggagaaacagtaaaaaggggcgacaagcccctcttaattgtgtgatgctgataattttcgtttatttacagaaatcgtagcaattagtttcaaaatttttcatcgcaaaaaaacttttttctcatttaatgatcttgctatattcgataaaagctgaattgtatttcttatctcatgttccgtagtgtctgggtgaattgcacagattctgagaacagtttttccattgagttgtgtcgtaagcacagtggcatatccattcgccaccatttcttgggagatccttttgttgagtgaatctaattcctgatccgatagcccagttggcgcatatcgaaaattaacaatcgctaatttagcgggggttacaatttcccaatgattatgttttttgatttcatcttcagcccattctgcgagttgaactccatgctctataacttcactgacagcattcgttcctaaagcttgcagtgtcacccatagtttcaaacttcgagcaggccgggttaactcaggacccagatcccaataattcatatgttcttcatcagtctcggcatctttcaaatactctggatgggtgctgaagcaattttcgaggtgctgcttttctttggctaaaaccacactacaggaataggtctgcattagccatttgtgtgcatcccaggtgatactatctgaacgtgatatcccgctcaaaagagacttatatttcgaagaagccaaaatcgacgcaccgtaagctccatccacgtgtaaccaaatattatgtttttcacataggtcagcaatttcgtttaatgggtcaatgcttcccgtattggttgtgcctgccgtggcaatgattgcaaaaggcttcatcccagccgcttgatcatccattatttttttttctaaggctgaaacatccatacgaaaatttgtatcacttggaaccttcctgatttgatcactgcggaatccgaggatgcgtaaccctttggcgaccgatgaatgagtttgatctgaaacataagcagttccaatggcatattcctgctcggataactttgcattgcgtgcagctgctaaagcggtcaaattcgatagcgatccgcccgacagaaataagcccccagcagtatcgggatatcctgcttggtcacacatccaccggatcacttccccctctaaaaggcttgcgctcgaactcagcatccagcttccggcatgggtattataggcgctggtcatgatatctcctaaccacgagtaaagagacattggaccaggaaccaatgcgaaaaagcgagggtgttgcatgaaggtttggtgaggatagacgtttttcctcatttcatcgacgacctcttgtatcggtcttccttttttcggaaaaccaattccccttaaatgagctatcgtatcctcatctgcaatgttgattactttttgagatcgaatgttattattttctgctattaatgaatgtatgaactgctcaataatctcgcctaattgctgatttggttcttgattcatcataagcatctccatctcctttgtttaacttcaaccaaagtataatataacatctgttgtcatattgtgagattcaccgatttcatcattacgtttatttttaggcactttgctattacataaattaattttcaaggtcgaagatggctatatgacggggcttgctggaatggagttgttaaaagatttgaattttatgctttttctagatccattgcaaaatgtgattaatcatataaagcagaaaatggctagtttgatatccagaatattgagttcgttttatcaagtttatttctgctgtaatgctaaacccaccccgtaaactccagtatagacgcttttgcagattgcgcttcggattgtgctcctttacgccattctttgggcggctttcccataagcctggaaaagcaacggttgaagctggaaatggagtgaaaaccgacttgttcggagatcgaaagaatagaatcctccgtgctttttaattgcttgcaagcctcttcgattcgggtgctgtttaggaaatcgagaggcgacgtccccataatttcatggaattttcttcggaaatgagttgtacttaaatggcacagatcggccaaaaaatccatggtaatggggttcatatagtttttcgtgatgtactccagaactggagaaatgacaaaatcgcttttcaggctatgctctgtttcttgatctgccaacagttcattcctggaatgaattctaaggagttctatgtaaagtgatagcaataaaccgtaggtactttcctgatagtaaggattctgctgttttaattcctctacgattgaagtcgcaagtgtataaaccttgggatgttgctccttattcaatatacagttcattcccttcaccacccacaaattcggctcgaagttgctgtaagcacttttaaatgaatgttgaaagaggtcctctggcgaaaaaaagatataagaccaaagactggctgtattgggcgaactatacgtggtatgaggaagatacctggggatgaaggtcacatcgcccgctttgaagggtacagattctcctttgatctccatgatgccgctatctgaatagcatataccaatctccaaatggttatggaaatggagatgctcacttttaatatctgaaatcttccaacgatcaccgcttaatagcaagacagggaaatttataggcaagctgtagtgccgatattctataacgggcttcttttttctgggcatattcaatacccccatgactttgattttaaccagcagatatacatcaggattttgaaaaattcgattccaatcgctccaagattcaatatatagacgaactagaccatttcgatctatatattgtttattggaagtcgcttattggatttttgcaaaatcctcacataaatgattagaattgcgcagttttgttgcgaatatgcttagatggagactattttactgcgtacaatggaataagtaaagcgtttccaaaacagtgacgaacagctctcaagcgcccttgggggcgtgtgcgataggagaggggaataacgatgcttcaattgaattatgagaaggaagagatattaaaagttatcgacaaagttgccagaaaaacaatggcgatggatttgacgtgggattggccttgcggtgtggcttattatggtgtatccacggcctatacaaaaacaggtaataaagactatttgaatatgcttaagcagtgggcggatgaatatatcgagctgggtctgccgcactggacggtaaacacatgtgctatgggccatatgctgatcacattgtatgaagaaacaggggaccagaaatattgggatattgtgatgagcaaggtggattatattcggaaccatgctctcaggttcggagaccatgttctgcagcatacggtatctgttgctaatgattttccagaacaggcctgggcggacacgttgtttatggcggcattttttctgctccgtgtaggaaccaaattaaaggatgaggaaatgatccaggacgccttaaaccaatattactggcatatcaaatacctgcaagaccctagtagcggtttctggtaccatggctacaataatgtcaagcaagaccatatgtccggatttttctgggggagagcgaatgcttggggagcatataccatgtcgcaagttaaaattcatttgaaagactggtatttatatccgcagtgcatggacgtggagtgttcgcttcgggatcaactggcggcactgaagggggttcaaacggagaacggcctgtggcggacggtactggatgacgaggattcctacgaagaagtgtctgcatcttgcggaatcgcggcagccatgatcaataacggcaatccgctgcataccaaatacgtgcaaaaggcattggagggcatcttgaaccatattagcgaggacggacgggtactaggtgtgtcgggcggcacagcggttatgaaagatcgggatgggtatcggaatattccaaaagactggattcagggctggggtcaaggcctggcattggcctttctgtctgatatgttgaattaggagggaaccaagttgtccaaacaaactacggggaactttacactaccgggagaatccggttatgaggcgctgaccctaaaattagctgaacggtggggtgccgatgtcatccgtgatagtgacggcacgcaattgtccgatgagattattaacgctgggtacggcatatattcgacaatctgtatcatcagagatcataatgagtgggcgtcccaccatctggataagctgcagcagtgttttttaattacaaatccgaaggtagctgtacaagattatgtatccatctatctgatggaggatttttttgctgaacaattcaaagttaatgattccaaagaggcgtttaactattggcaggtttttgacagaacgaccggagaggaagttccaagagaacagtggaattatgaaagggaatccggaaatgtggtcattaccggaattgttccttggcataaatacacggtaagctttatggcctaccggatctgggaagagatttccatgtacaatcacacaacgaatcattgggacaaagagcatttgatgcagattgatcccatctatgcagaaacgcaaaaatatctgctggattggatggaagattggtgtctccatcataaggaaaccacggttgttcggtttacctccttattttataatttcgcctggatctggggcagtaatgagcgcaatcgccatctgttctctgactggggttcatatgattttacggtaagttcaagagcgcttgatctgtttgccaagaaatacgggtattcgatgactgccgaggattttgtgaatggcgggaaataccgcgtcagtcatatcccggctgagcagcgcaagctggattggatggcatttatcaatgattttgtaatcgaatttggcaagaaattaattgacattgtgcataggtacgagaagctggcctatgttttctatgatgacagttgggttggcatggagccttacaatgaccgttttcaagagtttggatttgacgggttgattaaatgtgtattctcaggttatgaggcgaggctttgttcaggtgtaaaagtgaatacgcatgagattcggctgcatccatacttatttccagttggtttaggcgggcttcctacctttatggaagggggaaaccccacgctggatgccaaaaagtattggattaatatccggcgcgccttgctgcgggagcctattgaccggattgggctgggcggatatttacatcttgtagagccttacccggatttttgcgattacatcgaaaagattgccaatgaattcagagaaattaaggaactgcaccatgaaggccaaccctatcacatgaagacgaaggtagctattctgcatagctggggaaaattaaaatcgtggacattgtccggccatttccatgaaacgtatatgcatgatttgatgcatgtcaatgaagctttatccggattgccgattgaagtgcagttcattgattttgaagatatccgtcagggaattctacaggattgtgatgtagtgataaatgccggctctgctggttcagcatggagtggtggggagcactggaatgacaacaagtgtgtggacttactgacccaatgggtttatgagggtggtgcctttattggtatcaaccagccttctgcggttgaaggccacgacagctttttcagaatggcacatgttcttggactggatgaggatacaggcttcagagtaggtcatggaaaatgggtttatgaggttagggatgagcatggtttggtgcctgaaggagccagtataacgccaaagaatagcatttatcttaccgatgggtcagctgcggtagtggaggaaacgagtggtatgatagcattgtctactcatgccttcggtaaaggaaaggggatctaccttccttctttcgaattcagctgggaaaacacaaggttgctgctgaatataattcggtttgcaggcaatgagttacatgaaacgaagtacattacagataacctatatacagagtgtgcttattatccagaaagtaaaatgttggttgttattaacaatagcgatcaacttcaaagaacgacgattgaaacggaatacggcaaacaaaccatggaattagatccgtatgacaccatgatcacccatatcggcttaacaaaatcggtataggaacggaaaataatgagaagtagcggtatcaagccctcctttattttaaggaagggctttttgtttcagcacctccagaaaatcaagctaatttaccggggattttgtccattcaaaagtatctaccccatcattaactataagtagaacaattaaggagatgatttctttgagaaaggcaaccttaatgaaaattaaaaatgcggaagcaaagttgggaagaaagctaaagaaaagaagtcacgtggttatgaatcttaaaaaagccattcgtgtaactcaacttggagatggattcgcacgcttcactttcgctccgatcactatttctcctaatagctttagaagcactacgattaacggtaacgcctacaatctgattagcggtgcatggactttctctggaaatgaacaagggtttcttctcaataattattccgcggccgaagacagatgggtatttactgcatggaatccaactggattcacaagaacggtatcctatgctgttatcgccaaacggaagccataattcaaatgtcatcgttagcaaggaaaaggagcgtgagccttcttttccttgctaaaatgtagagggaattttgaacaaaccttcgatgatcttataatttttgatagtggtttaagaggtgctcaactctatctttaataatctgttttaaagattctggcttcactgatcgtacataatgaccatatctcataaaataatgagcgataaactcctcttctccaggattataaaatcccttaatgactgtcttatcaccattttctattttcattgaaggataatgttctttataaaaaatatccttggcttgttctacaatctctacttcaaagtcaatgctcttctcagattgatacatttctaatgaacgattaaggagttcatctatagaaaagcgagaattgttctcctcttcttctacaaaggtgattcgatcacatctgaaaactctatatttattcgtatgtaactctattccagtagcataccattggccaaacttagcggaaattttgaaaaattgaacatagtaacttttgttctgattattttttacatatttaactttacacatactctcattaagaatgcttgttagaattttatctaaatagcgactaacatgattatgctgatatatttcaaattgtagaacctttttcattttatgaatctggtttatttgtattttagaaagacagtgttcaaacttttcattgagttgattaacacttaagtgaaagggggtggattgataagcttctaacgtcaacattgcaaagtacagagcatatacttcatccatcgtaaaaatgatgggggataacaatctattttttaggataccatatcgtccatgtctgccatgttccgaaaaaataggcatacctaattgttccaatgaactaatatcacgtagagctgtactttttgaaatatggtatttatccattaggtcatttaaattaaagaattctcgactgtttaagtatctgatcatatcatttaatctttctgatttcttcatctaaatctccttataaaggtgtcatatattgatacctttttatatgataataagttcaagggaatagatcaaattcataagatatctacacatataaaaggagattgataccatgagtacaacactggaagtagctattttcttatccatgaacggaaaggcaaaagaagctatacatttctacaaaaaacacttcagcgcagaggaattgtttcttgttacctatcaagacatggcccaacgtgacagctccatacagcttactgatgaaaataaaaattatatttctcattcagtcttagcaatcggaaaaacaaaagttatgatagcagaagatacaatgaatcccagtgaagaatatacagtagggaataatacttctttatgtattcaaagtgctgacctagaagaaattaaacatttttataatagcttgattacagatgatcgtgtgaaaattatggtgcctttatctaataatgtgtttagccaagcctacggtattattgaagacccgttcggtattcaaatacaattaatgtttgataatcgattataataaaaaagcatgttccttgtttaataattggataataaatggacagaagtaaaaactaaaatgggaaaacccaagataccgcagcagaaaaggagacactatgacggagaaaaaagaaatagcagatcaaatagggtggaacttcgacaacagttattctcgtttgccggaatcattgtttacaaagctcaacctgactcctgtccgctcacccaagctgatcatacttaatcatccgttggcagcatcactggggttaaatgccagggcgctgcaaagaaatgatggcgtagcggagctggccggcaaccaggttcctgaaggggctgcacctcttgctcaagcctacgcagggcatcaatttgggcattttaacatgttaggagatgggcgtgctctgctgcttggcgaacagatcactcccttgggtgaacgggttgatattcagcttaagggctcagggagaacgccatactcccgtggtggtgacggccgtgcggcacttggtccgatgcttcgcgaatacatcatcagtgaggcgatgcatgcgctgggtattgctaccacccgcagcttggcggtggtatccacgggtgagtcgatcatccgggaaaccgagcagcccggagccattctgacccgtgtggctgccagtcatcttcgcgtcggcacctttcaatacgtctcagcatggggcacgtcccaagatctccgtgctctggctgattatacattggaaagacactacccggaagttgccaatgacgaaaaccgttacctttcactgcttcaggaagtgattaagcgtcaagccgagctgattgccaaatggcagctggttggttttattcatggggtgatgaacaccgacaatatgacccttagcggagaaaccattgattatggtccttgcgcgttcatggatacctatgatcctgagacggtgttcagttccatcgacaggcagggacgctatgcttatgccaatcagccgcatattgctgcgtggaatctcgcgagatttgctgagacgctcttgccactgctgcatgacaacagggagcaggctgttacactggctgaggatgcaatttcagattttgtaaaaatgtttcaccatcattggcttgcaggaatgcgggcgaagctggggatctttaacgaagagcaggaggatgaatctcttattgaggagcttctgagtatcatgcagaagcatcgtgccgactacaccaataccttccgtgccctaactttgaacaagctggaggatacggttctgttcagcactgcggaattcacccagtggcaagagcagtggcaggcgaggctaggcagacagcaggaatcacaagcctcctcgcgtcagctgatgggtagcagtaatcctgcaatcatcccgcgcaaccaccgggtagaagaagcactagaagctgcggtggaacgagaagactaccgtgtgatggaacagcttcttgaagttctttcgaacccttatgcctactctaccgaacaggaaatgtactctacattgcctgaggaatccacctgtccttaccgaaccttttgtggtacctgatgcagagcgaacgatttgaagataatctatatcatgcgttggtggagaagatggccattctctcaccagcgcattttgtttttttagaggtaggttgcaactgattaatccagctcctgaccgtcattttcgatctgtatgtgcccgcaataaagacattgatgcgtacagttctgcgtaagagcaggctggccttcgatgcgcatgtcgctttttccgttcaaccaaggcatcgtaaggacaggaatacacggagcctttttcactccataaatatcaaccatctcactggcttgcacagccgggttcagcggactggagcaattcccaaaagattttatgttcactccaggtacataatctccaatattcatctgtgctttatttttaacatacaccccgtggctaaaagggcgcttcaaacgcgtaggctgtgtaccgtaactacagcttaaaatcgcacctgccacgacatagctttttttcgcacctgttccaggctgcacacttgcttcttccatacggattattcctcctttgtggccatctccactttttgcacacgaacacctgtaaatggacgacgcagcagactttccgctaccgcgagattgatatagatatgtgcttccaacaagccggcaatccgaaatatagatggttcgattttcccgtacttaagtaccagttgcttcaaggtatggtcgggataccactcggtttgtgaggaaagacagtccaccacaggtggacgcagtacccagtacacatcctgcctggcttgctgaaaatcggtaagtatagcggccttccattccagctctggcatgtatttttccaacagggctttcatggagtctgaaaccagcggcaaagggaactccagaaaatccggatatacggttcgtggatctgtatgtactgctaaaaataggggagtgtcctctgtctgaatggtatgacccgaaaggatatcttccacctgcaagggagctaggggcgcagtctccacccgatgctttacgcgctcgtccaccatgagtcggtaatacctcatgacatccactcccctttactcactgcatctgttatctgtgtagccagtggcgtttctacaacagaaaggccaatagcttggcttagttggtcatctgtaaagattacccggtgtagttttgctcctgtaaaattagcttttactaaacatgcacctataaacgaagcgtcagtaacatcggctcctacaaagcaggcacctgttagatccgcgccgttaaataaagctctttgcagcgcggcatcttggaaagcagctccttgaagctgtgcatgttgaaaactagctccctgtaaattagctcttgtaaaattcactccatccaatcctaacggttcccaatccagccaagcatccgatccatattcgctattgcttataacttcgtccagtacagcctcttgcagagaacagccactgaaatcggctccgtgaagcaggctgtgcgaaaagtcggttccatctagctgagcttcttgccataccgtgcctacgaggatacagtgatgcaatcgactttgttgcatcccgatctggcgaaagactgtatagcgaaaatccaaggaactgtaatctccatccgacagttgaacttgagacagtgcttggtagctgtaggccgattcttctttttcctccagccaagactttattatgtttgcatccatgggccttcgatcttcccggtacacggagacactatgatccatatactctccgacgcgaatctcaaaagcttcttcacgatccaacgtctcaaactctggtaggtcgactgcttgcttcatagcctgacgaaccagactaacgatcatcgtatgaagatatcccgctgcttccagcatgatctgttccagttcaagttcggaaagggagacttgttgcttcaaagtttcagccccaagctgttcacgtaattgagtccaatagagaaaaatccaacttgcatcgtactccaactgaacgggctcagcatcaagcatccataaggcatccgtagcttcaacaagataaacgggtttctgttcaagccatgtggtacgcagcatagagtaggtgatgtaaccaatatgacctttacgacctgtgagttgtttttgccgaaccagctcacaaaaggcgcgaaaatgttctactatatgctgtaatctttgtgtttgtgttgatttacatttcaacgcccattctttgcgaatgaaagaccaagcctgatgaagagccgcttgttgctgatctaacacatctgtttgcttttccatttctaatcatccttaattcgacttcacttcgctgcctttcatgtctgccgacccacttaattcgatatgactgccattacaatccatacggagctgactacctgcggacaggctcattgtcttccccgcagataggctgagattgcctcccgccgtaatattcacctgtttgctgctcgcaatatgaatgccttctttatcgtccagtttgatataaatggcgccgtccttacctgtaacgaccagttcatccggtcccagtcgaatttccttgccatgcggggtacgccatattttcatttgcggattggaaaaatggttatgcgtactcttgcgatctgcccgtctcacggcactacctgctacgccgtcttcttcccgactaccggggaaatagagggaaactgaatcgcctttttctggcatgacgtaccaaccggtatgaccaccgccactgtacacggtagaatagttgaaccagtgtgcttggttagtgtcctgttgttcatcacaatccagatgaatgcgcacttgatcctgacgtacgtccagcacaataccgcttaatgaagctcctgccagcttatcctggtagtagcttttttgccgaaatccctggtaagaacctaacacatactgatgccgcagcagtccttgactcatggcggtgtaggcttccatcacatacaggttatgcccctgaaaattcaactgagcgcccaagtcgagtacctcatccgtttctacctcataaaaaataaaatcatgttcactgagtttggtctgttcattctcctgaaaataacgaaaaggaagcaattgcttacgtacggtataacgggtatgatccagtatcgcctgtgcagggctgtcctcaataccaaaataaaatttgggactgtcaaaacgggctacaggcatcagactcgtatgataacgtgaagctatgcgtcttaaaaatgcccagtctgtctcctgatactgaatggcaagccgcccgatggcttctccgccagtagccccgtcgatcacatccagcccttcatagtccttaccaatgtgctccagcatttgaggaatcgtcattttcgtatactgaaaagaacgagtacgctgcttcatgtccatccggtacgtatgggaaatggcttccacctccagatagtacacacctcgcacgacttttacctcaactgagagggcaatcccactaaatagcggcttgcttgcgccagattcatcttgttggctgacttcaatgatggtatttttttctgtcgtttccacgtaactgtcttgcaagtcttcggggataacacctgtaaaataaagccgagtatgctcgttaacttttttcgttaaggtgagctcttctagatcaatttgttcataagggtgaatttgaatttgatcgtatcccagactcatggtgtagtcattcctttctcatttgtagaataggcggagggtggaaggacagaaagggattgaacccagtattctgctacaggtaaccagacttcgagatctgcctccagacagctaaaggaacctatgacaactcgtccattgtggataaagagcagcatttcgttgtatagattaccgtcgatccccgccgccacaaaacgaatctgtccaactgaaagtccggaacagttggtgaccatttcggtacctaaccagttgcgaatcggttgtacagaccgtagaatatccgccatttgctctacaaaatcgggcagttcttccgcttccagagcggtatctgtaggattaaaagtgatattgatggtctcctcagatgaggtataaatgacctttggtcgatgctctgaaggatatttgattatagcttgctccattggcataggagtaaaggacttggggatgtagaaaccaatctctccgtgtagtattgtaatgggctccaacgtgagataatcattttcaacatgaagtagctttgtttcttcaaacatggaaccgtcctgttccgatttctgagtttgagctgggatggatttcacattatcgttattagctgtcttctgatccaccattttagctttgaggctaagtatatgctcgtctagatagttcatagaaagcccccttttaggaaaaatacgcgtttgtactttgaatatgtaaagatgagaggagatatttaagtacagaaccaacatatgtatttatcggttaaaagagagatttagtttacaaaatgaaccattcgttgggggagcattgttcgatattagattctatttcattccataacgcctttttgtcgtaacaattcggttgtagtactccaaagtaggcgttgcatcttgatatccccaccaggatatgtcggcacaatcggcttaccagtaccgacattaaaatatccgcctgtcacttcttgatattgggattctgttgctaaacgaataatgatgtccgctcctctccgtgggtctccgatatgcaaagcgttcaatatctttgcaagtatcgaagaaaaccctaactcgcgaccaaggccggtaacgttaaagcctggattaagtgcattaactacgattccagttccatccagttgacgtccaagttcttctgtaaacatgatattaagaagcttggtctttccgtatattttagatgaacctcttgcggtaaatgcagatgtatctgttaaatcctccggtaattttaattcaccatggttgcgtgatgcttcagaagccacattgacgatcctagcatttgtggattccattagtgacttgagtagtgtatgcgttaaaagccacggggcaagatagtttacggctatcatttctgccaaaccctctgaggttattcgctgttcaaatccatgtaatccagcattgttcactaatacatcaatctttggataattagctttaatttcatctcccatacgtttgacatctttcataagagacaggtctccgaaaaaaaagtccacctttgtattgggcgccagatcttttaaaatatttttagtcgtttcagcacgtttttcatttctggctgttaagactagatgtgccccacgtttggctaattcaattgctacccattgtccaagaccgttagtagcaccagtgattacaataatcgggtatgtcgacatatagatcatcctccaaattcttgatccaattacatccatattcatgtctacgctttacggttgtggacgctttatactgtagatcttctgcttgacacttaccaaagttgaaaatatgattgatatatatcaagtatatgtattttgattgatatatgtcaaatatatattcgaactcattcaaataaggtggagacatatggataataaaattcaacatccagattctacaagagagcaattagaactgaatcttggtgaacaacttaatgcacttataagcgcgtcgcatgcactcaatgtaaaaactgcggcacttttcgatccatcattacaacctgcagcttttctgattgtacgttgtctcctgtcacacggtccggcaagcgctacatttttggcggaatccaccgctatggatcgaagctctgtcagtcggcttgttactcagcttaaacacttgaattatgtaaaaagtgaaactcatcctgaggatcgtcggggagtgttgatatccctgacagccaatggtcgtgaaaaagccttggaagctttaaaagaaaaagaaaaagagttttatcaacgtatttcaacatgggaggattccaaacttgaagcgtttatcgagatgctgaagtgttttaacgggtatgattgcgaggattaatgattcaacatcaagcatcgtatgatgaaaaaaggaggcatttcaaaagtgaaagaaaaaaatgttagggaaattcgatcagtgggggaagtcccatggattttccgggatcaaactgttatctcatccaagtcggatacaggctcacaggttctacgaacgacgtggctatatgtttaccaaggatcaaaaaaattttataaaaaatctcaaataaatacatattcactatttatatcacaaggcaatgtttgaaatgttgctctttcattcggatttcatgttttccactgatgaatacagatttcaaataggcttaatatcgtgatatttatcattgaagaaatatgtatgtttagcactctaatgcattgcattaaattgaccattgttcagaaaatatgaatagccttcctttccatttcatgcctaaaaatgtctgctaattagcagttgtatttaggcgttttttgtcatacaatgcatctaatgctacggactcggtcttagaaacagtaaggtttggacggtaaataggacgtggtttccttgtatatttacgaatcgtggaactactttgtagtcgttcactcacgaccacgtcagtctgaaaaattaataatgtttgaggacagttttccggatcattagcgtttgatgatgaacatatacgaaggggagcgttcttttggaatcgaaacaattaacgagagggctaaagccacggcacgttgagttgattgcgcttggaggtacgattggcgtcggtttgtttatggggtcggcaagtacgataaaatgggcaggtccctcagtgctgttggcttatctcttagctgggattattatgttttttgtcatgcggatcatgggggaaatgctgattcttgaaccggtgacaggctcattcgctacatttgctcataaatatatcagccctttagccggtttcttgaccgcctggagctattggtttttatgggttaccgtagggatggcagaagtcactgcgattggggtatatgtgggctactggttcccagatatcccgcaatggttgccggctttggcaggtgtaattattattgcattggccaatttggcggctgtgaaattttatggggaatttgagttttggtttgcgatgattaaaattgtcgccattatcttcatgctagtagttggtacagggatgatcttctttggactcggtaacggtggacaaccgataggtctatccaatctgtacagccagggaggcttctttgcaggtggtttgaaagggtttctatttgcactctgcattgtaacagcggcttaccaagggatagagatggtaggtattacggcaggtgaagctgaaaatccgaagatgacactgcgaaaagccattaaaaacatcatctggcgtattttgattttctacgtgggtgcaatctttgtcattgttacgatttatccttggaaccaaataggcgagatcggcagcccatttgttctgacttttgccaaggtaggaattgtggctgctgcgggtatcattaactttgttgtacttacagctgcgatgtctggttgtaacagtggtatttacagtgcgggcagaatgttatatacactggctaagaacggacaagctcctaagttctttgggaaagtttctccaagcggcgtccctagaaatagtataataacgaccatttccttgttgctggtaggggtgttatttaactatttaatgcctgattccaaactgtttctgtatatttacagcgccagtgttcttccaggcatggtaccgtggtttgcattagccatcagtcaatttaaattcaggaaaaagtggaaggacgaaatgaaggatcacacctttaagtctcgtttttttccgatcagtaactacatcaccattgtctttttgttgctggtgatcgttggaatgtggtttaatccagacacacgcttgtcgttgattgtcggggcaacatttatggcgatcgtcgttgttggatattttgtctttggcataggaaagcggcagagaattgaagaattagaggaaaactaaaagattgctaaatacgtaacatttgccgagcgcaattcagatgatcctgagttcgctcggcttttcttttatatgacgaggaggggctacggaagggttgttactgaggtatagaaccgtgtggttatcctgttcgcactacaagtgtaaatacaaatacaaaaaaagtaagaacgaaaatggagaagttgattattgctatactctttcggttagccttaagctctgtaattccagaaaataaaaatataaaccctagaaaaaattgcacgattttgtatgagtccctataggtgtctgggtatgcgagtgataaaaaggaagagatcataacaactacagcaaatattaaagtgaggcgctcgttaggtaaagagcgcatgcggtaacttcaagaagcaaagtgaaggtgaatctgcaaccggaatacgagacaggccaatataatgctactgcgagcaatactgcagaccaagccacaagagagaatgcgcatacgtttcatgtccaagtgtttatgtttgaatttatatttttctaatatttaactgttaatagaattattgaaaagctataatgctaataatgatttgagtgtatttggagaaagaggttgagggtatgttgttgaaaaaatggccattattattgatgataggtattctcatggtggcatctgtgggctggaacggtggagtatcttatgcagctacagaatatacttgggataagtacaaggggactgaggtcaagacatatagattgactacagtacctggaagagtcgaatatatggatcaggaaaggttttttgcagctttaagccaaaccccaaatgtgtatggagatttcagcggctataaaacgggcaaaacaactggagttgtaatcgagagtataacggatgatgtgtacaaatttacagttactgattttcttcgcgatcaagagcctgaggttgtagagtatataaatcctagaggcggaattcctcatagatggaatggaactagtgatattcagatttttatgagagggtcagaagcggcttctttgtctgagctgttttatgaggggacacccagtgaaggacgctttcaatttaatgctaacgatatatatttagttacattctggtccagtaccgtaagacttatcagtgggatgtctgctgaatcgttaatagaggaaggtcctcacacgtttaacaatcgggagcttgtaggtcaagtaaccagcgaagatcctacagcttatccgcaagatgggatttcagaaggttattattatgtttttaagggtactgggaacaaagaatcaactgatgatggagatagccaataaaaacaaaagaagagataacattgtgtagggtgctttatacatgatgttatcttttttattgtgatgctcgcattagaaaatttagtaataaaagaatgttggaaatttaattcccaatgaaaaccattttaaaagatcgggatatatgcctttaaaataatgacaatattacggatagaaccgtaatctataattactttttttgctgtctttattcaatcctagggatattattccgataattcaagtatatacagtttggtgttaatagaaatgaaattcgtttgaaaccaaaagaaataattttcaaaattcacacagaagtccaggtgcaagtaacctgatgctatattgtaaaggaggtgcaagaatccaaaataatatgaaatatgaaaaaaagttaaaacaaattaggcagtacatcgctgctatactggctgtttggttgttctgtatacatactgtgcctgtttttgcaaacagggcctttaacgatattgaacattcctacgcagctgatgcaattgaagccatggctgctcaagggtatgttacgggttatcaggatggtagttttcgacctgtacattttatttcgcgacaggagtgggcgagtattttcgctaaaacgttaaagcgaacttcggttaacaaaagcgttgctccttttagtgatgtgtcaccatgggctctaccctatgtgcagaccttgcaagcagagaacattaccaaaggaattagtgatcagttatttggtgcaaagcacaatatgactcgtcaggatatggcagtgtggtatgccaggtattttggtgtctctgaagatacccgcgcttccgatagatccagttttgtggatcagtctgatatatcagactatgcacaaacgagcgtatggctgatggaacatttggagctgatcgagggggatacgaatcattatttccatcccaaagagtctgtgagacggcaggatgctacactggtagcatatcggatatggctaggtggcgacggtctgagagaacgtgccaagcgtttgttggagtcattaggaagtggagctgcaacgatgaatcagccagccagtccaccggatgcgaagaagatcgtggtcgacctggcgccagaaattagtcaccagcgtgcgaatccggaaatcgaagagcctaaaagccacagcccaagacccgatccaccggtatctccggtaacacctactgagcctaacccggaaccgccagttgtacgaccagatcctgggctcaaaccaccagtgacaccacctgtgaatccgtcagaaccaccggaccattcttcggattttctagtggatgaggtcgtaatcaaggcgcccgagttggtaaatcaaccagaaacgtatccttcgtatcagctgtcctttgatctctacaataaagggcacttggtaagcattcccgatgttagcgtcacaagtgttacttacacatttagtgatacattaggtgtatttgatgaacatgggaaaattgcgcattccgaaaatatacctgctgctgatgattacattcctgtagagatggaagtcatcattgctaaaccccatcaggtgcttaaagcacagaccaagctgatcgtgaaagggaagactcctccggtagaggaaccgagtgtaatcaggtccgtatacttggcgacgtactccatttcacaggcggcgactctagaccctaatgcctggagcatgccctatgtatttcaaaatgcaaagggagaggtcataccgtccggtctattgccgtcagacttgaagcttcggattgaggattccagagggatatttgacgaggatggacatattgccaatctgcatctgatacctgcattgaactctgtcattccattcaagattgaggttgagtcaccctctcagggaattcacttcatatccgatgcggagttaactgtagtaccaggggcacgcaaaaagcaatattttgctatctccatgatgctgcagggaaaagatgcgggcagtacgaccacgatagagcaaattgagcagtcacgtcaattgctgatggatcactttggtcccaacgtaaaagtgacgtgggccatggaaaatagatttatttttgtggaatcaaatcgtccgcagcttaaaaaggttttggaatatgtggatcagtatggcgatgaagtcgggattttggatgggtatccgaataatctgtttggtctccctgaatgggaagcacagatgaacgagtggttgtatatgtatcgttataatgcactcaatgagctgcaccaatctggttcgttaggatcaccttcggtgtttgaaagcatggatacagaccaatatcggaagtatctgcctaaatcattaactggctttacggtgaatcctgagcaggcccaatggcttaaggatcactttaagatcacctcagcgatgggttggtcggctacacagtataatgtgaacaacatgtatggtgagggttcacctttgatgccttactggtcccataaggataatccgattgttccggcacaggggcttacaaataatagcggtatcgtatttatgaactcgattacgattgatccgattggatcacgttataccaaagattcctcacgctggactctccatccgggcgatccatatgtgaccgaaacggatgcggcaccacaactgtatatagcgcagcagtatttagataacccgtatcaacgtttgaatacagtaaactacatgtccattattttggatgtcaactggcttgccaaaaaccataacatgtctcaaatatgggagaactttgtgaatcacttccctgttgaccgtgaggttgagattgtaggcgtggacgggctgaaacagatttatgaatcggtagctggattgagtaatgatcatacggagttttcgctcatgtttagaggctcaggctttaaggcagttatggactccaataattcaccagccaatctgcgttacttgtggactgaaaacgcctcacagcggattattttatccaaggaggatggagatgcggcatggtccattattgactttactgactatacccgaagtccggttccgaagatggcatacaatctggataagaacacggatgtaagctatgtcactggaaggaactttaagctgcatcctacagctccgttaacagcagatgaaattcagcgcgtaaaggatcgtttgaaggagatttactttgcagaagaagtaaactatcagtaaggattttgaatgacagattttttataagacttgagattttatgaaaaaggggcgcccatagccatggaaatggctgtgggacgcctctttgttttagagtaaaggttttacacccattcaataacctgatctacagagcgccgggttttgccgcgcggctcgttcagacggtatccaaatgccaccatacaggaaataccgaaatgctcggcatccatgatgccttcttcggagaggatgcgttcaatttcctgtttattaaaaccttcgataggacaggaatcaatgccgatttgagctgcggcagtcatcatgttacccagtgcgatgtaggtttgtcggcagccccattcgaacaaggctcttttattttcctccagcccaaaatcagattttagaaaggcgtcatacactttctctctgccttgaatcacttcagcgggtaattgctgcacgttctccatcatactcttgatataatcggaggaggctaccatatcttctggaagtctagagaggatgagtacaaaatggctggctgttggcagttgtttttgcgccccccaagaataaggcagcagcttctcacgcattgctttactctgaactataacaaatttccaaggttcaaagccaaatgagcttggagataaacgaccggtttcaagaataaaatcaaaatcggaatcgctaattttcttatgactgtcaaattccttcgttgcatgtctgaactcgtatgcagataagatttgatctttagtagtagttaaggtttccatcgttattccactccttatgatgtgattaaaattgacgcttaccaagtgacatgcttaatattagaatatacatgatcgtttttgaagtacgcacattaatgtgctgtagtatataaaatgataccaaggaggagaaaagcctatgcgcaatcggaaaggcggctttggggaatgtaccgctggaaatgatcaggcgtgtccagttgagttcacgctggacgtgattgggggcaaatggaaagggattattctatatcatcttatgtatgggactaagcgatttagtgattttcggcggatctgtccgggaattactcagcgtatgctgacactccaattgcgcgagctggaagaggacggagtcgttcaccgtgaagtctaccaacaggttcctcctaaggtcgaatactctctaactgaatttggaaaaacgctgatcccgattattaacctgatgaaggattggggagaagaatataaaacaaaacagcgatcatcagaaagcagccttcagcagcctagccccaatgtgtaggtttttgagatggctccacgaaaaaagacctggccatcattttttggcaggtcttttgttttttaaagtgaaatgatgcaaagttcgttttcagttgacagcaaggacgacacttgatatatttcttacgatattgataatcattatcatctgttttagagatcatctccacaatatatagggggctaatcagttgaaaagaaaatcgtattttatgatgacagctatgttacttgtattgtctgtattcatcagcgcttgcggcggaaataataatggaagtagtccggcttcatcttcagaagataagcaagagtcggctactactggagagactagaagctttaaaacggttaaaggggatattcaaattcctgcaaagccacagcgcattgtaacggatttttacggcggagaattgctgtccgtgggtgctaacgtggtgggtgtggagccgactgcgtttcaaaatccttttctgaccgatttgctgaaggaaaaaggaaccaaagaggtgggtgatccgaccaatttggaaaagacgctggaactcaaacccgatctgatcgtggttatgaaggatacgaattatgaggctttgtctaaaatcgcacctaccctgtacattccttacggtacgacgactaatatctatgatacggtcaagctgttcggcgatatcactggggaaaaggagaaggccgagcaatttattactgcatttgataaaaaggccgctgaaggtcgcgcacgtcttaaaggtgtgattgacgaaaaggcaactttcggtttgtatgagctgacggacaagcacgcactttggatctttggcgacaatgcggggcgcggcggccaagctgtatacaatgcgcttaaactgaacatgccaaagaaaacagtgaactccaaggaacaaacggtgcagctttcgatggaggtattgccacagtatgacgcagattatatgttcctgactacgtatgaccccgagaaaaagggtgacgcgctcaaacaactaaagtcgtccgctgtgtgggggaatcttccagcggtgaagaacaatagagtgttctttaacgattttgatacgtattatcgttatgatccaatcgctattaccgggcaaattgatatgatcgtagatatgctggtcgaaagagaaaaagagaataaagctaaacaatagatctgaaattctgcgttgtaatgaattgcccaaaacagataggaattcgcatattatacgcagtatatagcattaaaaaccagtccaacatgaatcatatatggactggtttttaatttactattttgtcgtaatttcaatagtatcttctttttgtatccaatctactttggcccctagcgtttcgctgagtagccttaatggaagataaccaataccattcaccatgaagggcggattggtgagctttacagctttatcgttcacttttgtttggctggttttgaaatttacttctagagagacaggatggtcttctgtcttagactgattcattttcgctattttgctgttgaaatcataagcgatctcggcccccagtttgtcaaaaacagaacgaaggggaataaacgcctgcccgttgcgggtaatgacaccattactcagagagacaggcgaaccattgagacggacaagaatcggtttttgtacaggaactggtgaactatacagaaactcatagtcccctataccgagctgcgcgtgtttgttgacaccccagccccatagggagccatctgttttttgcatgattacgtgccgtggacctgctttgatgctttgaatatttttagcaagtaatgtaaagggtgcattggatggtaacttttcaccatctagagacgcaacatatacattcccagctgtggtgagggcaagtatggagcgttcggcgaaaaaggcgtctttaacatcctttactcctgttaatagtacaggggtattttcgttgtgataggttgtattatctgagtaacccgtaactgtagcaccccagaaccatagccgaccttgctgatcaattgcgagattggaatacctattggccttgattgtcttgatatccgataaggcttgaatttgcgatacggatagagtttcggacggagttgcatttttatcaaattctttgggccacgtccacacggtgccatctttttttaaggctatgtttttagcgattgacgtaatatcctttaatgatgaaataggttcgaagccctgcaaggcttttgtatttttccatacactgccgtctttttttagaaatatccagcgttcctcataatccggtctttcctcatagtaactatcaatattggcaatctcgtcgatgccagatagggtttgaaaaggactagagatgtttccattgtcgagccgttcagcggaagatatgctgccttcgctgctcagagcgagcacatgatcattcaaattacttacagctgcgaggttctgtaatccttctagaggaacgaatttcacggattcagcaatattatttctaggcacataccaagcagagtggtcttgtaaggtaaataccagatcgccctcgttgatgatattagaaaatgtttttacaacgtccggcttaccctctacacgagtcggtacggattgattataaccccacagccacaagcttccatcagactgaatcagactcccggaatcataggcgcgaatatgggatgtggagttatctccggccgcccatacactgggactgagcagcaataacgtgattatactgagtaatagagcccgtcttttcatacgattttcctcatttcttgatcaatgtatccccctatccatagacgtagattatatagaaaagttttccaaaatgtatgaatttcaataaaataacctccaaacccacgattagagatggatttggaggctattttttaatgagtaagcagaatatgttggttcgaacaggttaaacacggttatgagcaatctaattcgctattcgactgcgcaccatcaacaaggtttgttctttgatctgtccgatttcacggatgagtgcggctgtcttggtctcataggagtatttgacatccaaatctttcagcgaagcaaggttaatgtcgacggtaagcagggcagattgagctgcggcttcgaacaagatcgcgccgatgccaagatccgaaatcacatttttattggacatttccacaatgttgtaggcttgcgacaatccgtcccggcatacttccagcaggcgcatgggtacctcaatggcagcgatcaccgcagtctgtaaggaatgagtacgatagcgcttttcttcgtctgtttccttgggcaaacgcagcgcggtcatgtactgttcaaaggattggatgtctgcggccatcagttcctcacaatgcgtagacaatctttccatgctgctaatgacgtccgtgatttgttcatggatatgcgcatatttttctccttgtgaaaggttggcggtcatggaggtcatagccgcacctagtgccgcagccagtgcggatacacttcctccgccgggggtaggcgctgcacttgcagcctctttcagaaaatgtccgatggaatgattccacgacagttcactcatgaatagaccacctctctggagtagtgttgcagatgtattgctttgagcagatttttgtataaaatcgcagttgttaaggtgccaacaccgccgggaaccggagaaatggcatggaccttttccccaacgtctaaagcggcatcccccactatttttccctctagcgtctcattaattcctgcatctaccaaaatcagaccgggatgaaccatatcctgtgtaatcacatcagggcatccgactgcgacgaaggcaatgtctgcatggctcagatgctctgcaatatcacgtgttcctgcatgacaggcggtaacggtggcattttctctttgcaacatgtggaaaaggggaagtcccactgtctgtccgatgcccacgagagtgacatttttgcctgccaatgtgtgaccgtaatgcttgagcagctcgatacaggcttgaggtgttgcgggatatagtccggcgtcacctgttacggtagccagcttgttatcaggtgtaatcccatcaatatctttgtagggggcgatggattgtttaataacggaggcggaaagatgttggggaagcgggagttccagcataatgccatgtacatggggtgcatcgttcagactgccgatcaggtgcagtagctcggtttcgctaacatgacgatcaaaagtatggagatgaaatgagatgcccagcttctccgctattttttgcttggtccgggcatagtaggcagatgccggatcaccttctaccaataatgtcgccagatggggacggtgtccttgctgcatcatttcttctacctgtgaacggatcgttgcatatacttgctcagctgcttctttggatttcatgataatagccatagtccgagcctcctctgaatttatcgcgtgatttatcaacagggtgtcatggtcttgtaaacgaaaaaaagtatttgcacaaggtcgtcaagacagacgaatcctctgcaaatacttctcccaggcgaacggtacgctttttttgtatgctccctcgtggttcattccactgacttcgccagtcacatacagcgttattatgtcttatattttaacaaataatcctcagaaaagaaacccgcgaacatttggaaaaggggttatgttacttgtctatatgacaaatgtcatatacccgagctgacgtttatgactacagcgtctacagtcttcaccttatactgagattagatcaacatgtacgcctaacaggatcaaggtataggcgtcattttaaaggaggatcataatgagtatgacacaactcccattagctcaattgaaaaaaaatatggctccctacgagaaaataaacacgaaatccagcgttctgcaactcatcaatactttgggtccactgatcctattgtggtatgctgcttatcttagcctgtcggtttcgtactggctgacgcttcccattgccattgttgcatcggggtttgtggtacggacgtttattatttttcatgattgtggtcatcaatcctttttcaaaagccgcaagctgaacgacattgtgggaacgattacaggtattattacgctctgtccttatcatcaatggaaaaatagtcatgcgatccaccatgcaaccagcagtaatctggataaaagaggcacaggtgacatgtgggtgctcacggtagaagagtacacagaggcttccacatggacacggctggcctatcgcatatatcgaaatccttgggttatgttcggactaggtccgatctacacttttttgatttcctatcgctttaatatcaagacagccaaacgcaaggaaaaaatgaacactcatgtgacgaatatatccatcgttgcattgtatgcactgttgtgctgggctattggatggcaggccttccttctggtacaggcacctatcttttttgtatccggtatgttgggcatctggttgttctatgtacaacatcaatttgaggattcgtattttgagcacgatgaagagtggagttatattaatgcagccgtagaaggcagttcttactacaagcttcctaaagtattgcaatggattacggggaatatcggatttcatcacgttcatcatttgagccccaaagtgccaaattataatttggaaaaagcgcatgaagcgacaccgttacttcaaaaggcgaccacgatcacagtaagtagcagtctgcaatcattgaagttccgactttgggatgaaaatacgaaaacctttttgacctttaaacaagtgaagccgctcctcagcaaacgtgttgcagttacgaaacccatccctacacctgttgtaagcacagaaagaaaataactttgtacaaaacttggtatgatatgataagagatataagtcaagtgaagtagaagagggtggcaggatgcaaaaatggtatcagatttttcaaagaaatactggacttagcccttatgtgtgggtcgtcttttatatcctgcccttttactactttagctcttcatctacaagtcatattattctgggtactgctattattttagtgttttttgcatgttatgtattggcttttgtctcgaaaggctggctcatatacttttggaccagtgtacaaattgccatatcgattaccatgacactgctgtttagctatatgtatttttccatatttatcgcctatctgatcggtaatattaaaagtaaggctgcatttacgacgctgtatattattttaatggttattacaattggattgatcaattacggttttgtttctcagaatcccgtttttattaaacagattccttttatcctgctcaatctgatcggtgtgattctccttccgattacgaattttaatcgcaacaaaagcgatcggctccaagtccaattggaggatgccaataagaaaatatcggaattgattaagttggaggaacggcaaagaattgcgcgtgacctgcacgataccttaggtcagaagctgtcactcattgggctgaagagcgatttggcgggaaaactgatggatcagtacccggagcgggctcatgtcgaaattaacgatgttcgtctcacggcgagaagtgcgttaaaagaggtgcgggaaatggttactcaaatgcgtggtatgcgactagaggatgaactgctacgtattcggcagattttaaaggctgctcacattgaattgactctagagggcgacccgaagctggagcatacatcattaatgaatgaaaatgtacttagtatgtgtatgaaggaagcagtgacaaatgtggttaagcacagtggagccaccgcttgttccatcaccattgagccgtctcgtaaggaattaactcttcggattcaggataatggagtcggcgctacgggggaaaatggggcctttcgtggaaacggcctgaaaggtatgaaagaaaggctcgaattcgtgaacggatgtatggagctgcgttcagatcagggaacgaccctggttattaaagtgcccaatatcactgaaaagccgaatgaggaggtggggccatgattcgaattgtcattgcggaggaccagcgtatgctgctgggtgctctagcctccctgctggacttggaagaggacatgaaagtagtcggaaaagcaagcaacggggaagaagctttagagctggtgaagctgcatcagcccgatatatgcattatggacatcgaaatgccgatcaagagcggattggatgcggctgagaaactcaaaggcttgaactgcaaggtgctgattttaactacgtttgcccgccccgggtattttgaacgagcgatcaaggcggggacacacggttatttgctcaaggacagtcctagtgaagagctggcttcctccattcgaagtattatggcaggtcggcgtatctatgccccggaactggtcgatgatgcttatgccgaagtcaacccgctaacagagcgtgaaaagaccgttttagcgctcatcgctgacggaaagaacacaaaagagattgctggtgaactgtatttaacgacagggacggtgcgcaattatatttcagtcattctcgataagctgggtgtcagtaaccggattgaggcaattacacgttttaatgaaaaaggttggtttaaatgagaaacagggacgctatgaagcaaaatgtagcgctctgttttttttgttttatccatagatttggtatgcctttagcgtactaccttgtgatacaataggatagttgtccacaggatggactggagtacaaggaggagcagaaccccatgaaacaagccccatttatagccgttgaagggccgatcggagcaggtaaaacgacgttagcttcgatgctttcaaccgagctacatttgccgatgatcaaagagattgtcgaggagaacccatttctcgataaattttatcaaaatatagatgagtggagttttcagctggaaatgttctttctctgcaatcggtacaagcagctggaggataccggtctgcaatatatcgagaaagctcagcccgttatttctgattaccatatctacaagaatttaatttttgccgaacgtacgcttaagggtgtgaagctcgaaaaatatcgtcaaatctatcatttgctcacagatgatatgcctaagccggacattatcatttatattagagcagatttggataccttgctggggagaattcgcaagcgtgcacgctcttttgaacaggagatggaccccgcctatctggagcaattgatcatagattatgataaaggcatgcagtttctcgctgaacagtccccttcccctcgtatattgaccgtgaacgggaatgaaattgattttgtagaaaatcaggcacaatttaaacaaattgtttccgatgtaaaggagcttatatagtgaataattacaacattcctgcgaatgccctgattacggtagcgggcacagtgggtgtaggcaaatctacgctgactggtgctttggccggacgtcttggttttaaaacctctttggagcaggttgatcataatccctatctggagaaattttatcacgatttcgaaagatggagctttcatttgcaaatttattttctcgcggaacgcttcaaggaacaaaagaatattttcttgtctggtggaggttttgtacaggatcgttctatttatgaggacacaggcatttttgcgaaaatgcatgccgatcagggaacgatgaaccctaccgattacgaaacgtatactagcctgtttgaggcgatggtgatgacaccgtttttcccgcaccctgatgtgttgatctatttggaaggcagcttgccctccatactgagtcggattgaggagcgtggtcgcgagatggagatccagaccgagcgatcctattgggagcaaatgcatcgcagatattccaattggatcaacgaatttgatgcctgtcctgtactgcgtctgaatattgatgagtatgatgtacacgacccagcttccatggatgccattttggaagaagtaggaaaagtgatatcaaaaaaatagagatataaccccaaataaatgacagggactgtggtgcaatcagtataaattatgctgataggctacagtctttttttgtcgaatgaacatgttgaggcatgagatatgaataacggtatagtggacaagtttaggctggaatgcgagaataggtacatatgaattgtaatgactcacgggaaggatgggatactgtgatgcgttttggtattgttggaaccaactggataacagagaggtttattcaagctgcgatggagacggacgaattttccctgacggcggtatactcacgcacagaggataagggcaaagcttttgctgacaaatataacagccagccggaggtttttacagacctggcgcaaatggccgcaagtgatcaggtcgatgccgtatatattgccagccccaattccttacatgcggagcaggcgatcttatgtatgaatcacggaaagcacgtgttgtgtgagaaaccctttgcgtctaatgcagcagaggtgaagagcatgatcgaagccgcgcgcaacaacgatgttctgctgatggaggccgttaaatccacactgatgcctaactttaaaataataaaggatcatatgtataaaataggccgggttcggcgttattttgcaagctattgtcaatactcctcacgctttgatgcttttaagcaaggtaaggtattgaatgcgtttaatccggccttttccaatggttccttgatggaccttggagtgtattgtttgtatcctatggtgactttgttcggcaaacctgaggaggttcgggcggttggtgtacttttatcctctggtgtcgatggcgagggcagtatcgtgatgaagtatcctgatatggatgctatcgtcatgtattccaaaattacagattcttatctgcctgctgaaattcagggtgagaatggaacgatggtgatcgacaaaatcagccagccctatgaggtgaaaattcattatcgggacggcacaattgaggatctaaccaaagctcagacgcgtgagccaatgtattatgaaattcaggaatttattgatttgatcaagagtggtgaacgcaacagttccattaactccttggagtgttcacttacagtcgctgaagtgatggaggaggcaagacaacaattcggccttcgttatgaagcagatttgaaaaatacttcctcacattagttggttagcgatttaacaaatcccttaataactttctaagactccgtcactgcttcttatatggggtcagtctaatattatatgtcaagagcacctagaacaggaagaagggctgccggtttcgcaaactttgcaaacatccggtaggccttttttggtttatatacctaaagcataatcttcggtgatcaaagtaggataaaaacacactcataacttcatttttacaaagtactatatttccaaaaacaacgtattaacaattgattgttatgatcataattataacttttacatatttaaccgcaaagaggagtgtacacatgtttaagaagtttcaaaaatggtcagcaacatctatgtctattgctcttatgctaggtttgattactggtccgtctgcttcggctgtctatgctgaatcatcagggaacacagatggtattagtaaaattacagctacattttatggagacacaaaaggctccaaagggtttacctggtatacttcaaaactgctcacgaacagcactgttcaagtaataaagaaaacggattcagaagctgattttacgaaagctatcgcatttgaaggcacttcctctccatcgaccaattctgcagaagagcttatccataaagccgtagctacaggtcttcaagcggacacagcttattattatcgtgtgggtgatgcagcgcgcgggatatggagcgaaacaggtacgtttcaaacggctcctaagagcggtgaatttaccttcattgatctagctgatacacaagcaaaaagcgaagatgaagccatattgtcttcacagacgctcgaaaaagcacttcaaactgtaggtaatgctcagtttgtagtccacaacggagatatcgtagacaccggtaccaaagaagagcagtgggactggttgttgggacattcacaaaaaagtcttttgaatacaaccattgttccttcagcaggtaatcacgaggatgagaactacgctttttatgatcactttaatattaatgaaccagctggttctgctactaaaacaggagcgtactactcctttgattacagcaatgctcactttatcgtactgaactccaatgaggactcagagaaatatgccaatttttctgaagatcaagttgaatggttaaagaaagatgctgcggcagctaaaagggcaggtgcaaagtggatcattgttaacattcataaaggtccctataccacctctaatcatgcaacagactctgacatcatagataataacggagttcgtaaccagatcgcaccattaatggccgagctggatatcgactttgttgtgcaagggcacgatcatatttatgcacgtacgaaaccaatcaatcaagagggtaaagcaacaacgccaacaaaagtaaaagatacattaaatgaaaagacgattgaatacagtgtgaatccagacggaagtatctatgtcatcccagcaaccgctggccccaaagtttactacaagaacccaagcgaaaaacttggagataagtactataatctctttgaactagctgaagagaatcatgcggcagtatatggcccagatccgagtgacaatcgtagacctacacgaggacaggtacagaattttgttggcatcaccatagacggaaacaaacttacagccgtaacgtatgaaattgatcaaaacaaaaatgatgccaaaccttttattgtggatcaattcggaatcatcaaaaaagattggtataattgatttcatagtttctaaatgattataaaaggatatcctacagtctggttggctgcatgggtatcctttttcattttcttaggggatatctactattgtacttgtaatacttacgccctgttcggaagctggtaaaacgtacataatgcaattaacgactttacaagtttaatcatggagtgacttacaggaggatgaaacgacgatggcttatcaagaaatcaatagagtacgagtttggggagcacctgatccaggggcattatctcaagcccgtacatgtgccgaaaacggcaatgtgattcaggcgctgctgatggcagatcatcataaaggctacagtcagccgattggcggtgtgatggtgtatgacggacaaatttcgccttcaggtgtcgggtatgatatcggttgcgggaataaggcggtaagaacgaagctgtttgcagcagatattatgccgcgtatttcagccgtgatggatgagattgcacatcatatttcgtttggcgtaggtcgtgtgaatgcgattcaggtagaccatgagctgttcgatgacccggattgggcagtatatgcggcgattgggaaacaagaacacgacaaattgaagtccttggcgagagaacagctgggtacagtagggagtggcaatcattttgttgatgtattcgtagaggaagcgacagggcgggtctgggttgccaatcatttcggcagtcggggctttggacacaaaacagcaagtgggtttctaaacttggccgctggacgagagtttctcggaaaggcgccgggagagcatatggatcagccgcctgtgctgctggatatgaacagtgagctgggggacatgtactatcgtgcgatgcgtcttgccggacgctatgcgtatgcgggacgtgactatgtgatagaacaagtgcttggtattatggggaccgaagcagactttactgtgcataaccaccataattacgcatggaaagaacagcatgatgggcgtgacaccattgtggtccgcaaaggcgctactccctcggcacctggccagatgggctttattggaggaagcatgggcgatatttcggtaattgtgcgtggaagagatacggtagaaaatcgggattcctactatagtacagtccatggcgcaggtcgtattatgagtcgtacccaggcagccggtaaaatgaattggaaaactcgcacacggagtggtggacaaatcacaggcgtacagatgaatgaggccgttcggaactatggtgtcgagctgcgcggagccggtacagatgaaagcccgttcgtctaccgtaaactgcgcgaggtactggacgctcattccgagactgtagaagttatgcatgaactgaagcctattggggtatgcatggctggggccaatgaatttgacccttataaggattaatcaaaagactatgcccggcagaagtgttcattcgccgagcatagtcttttgattacatgcatgagtatataatagaaggaattcattgcttagtgcacttgttagcagctctatgtctacagctgatcagcaaaaagctgttctttaatataagcgactggcatctcttggcctgtccacagttcgaaggccaatgcgccctgccacagcatcatgcccagaccattaatggcggttgcacctacggattctgcttgctccatcagcttggatttagctgggctgtacactacatcggttacgatcaggtcggaacgaagcatggacacatcttcaatcacacttttgccttccagcggtttcataccaacacctgtaccgttagcgagaatatgacttgtgcggatctcttcacgtagctgttcttgattttccaatggatagatgttcgccttgacttggttgtgtttcatatcttcattaataatacggacattctcttctgcacgagcaaagaactgatcgttacgggcaaagattgaaatttcagccagacctgcttgagccgcttcaatagcaatcggtgtagctgcgccgccagagccgacaagtgtcattttcttaccttttaggtcaatgccgtgttcacgcaagttgcgaacataaccagatccgtctgtactgtagcctttcagtttaccatctgtgttcacgacggtgttgacggcacctgtaaatttagcgctgtcgtccagttcgtcaagatactgtagaatagctgttttgttaggcatggacacgttataaccgcgtatgttcagagcgcgcatcccccgtaccacttcttcaagttgttcatttcctacttcaaaagccatatacgcgttatttagacccagcttttcaaacgcaagattatgcatagccggggacaaagagtgtccgattggtgtagcaagcagtccgattaattgtgttcttccgtcaatacgtccagcatttttcataatataagcctccaagtaatctgtgtggtttaatgaaacacttttttatatcgataagcaacaaacacggccagcaaaatactgactacagcaatcgcaatatccagaatgaataccgaggtaattcccaaacttttggacatgcccccggtagccaaaggcatcaggatgaacgaaagactggctgctatgttcacgaaagaagtcgtagtgcctttgttcttgcggaaaaattccgtcataaccgtgagggcaatttggaatatgcctgcggtagacaagccaatcaggaatgaactgatcaaagtagcgacaggattgtgccatgtaattaaagccaacaaagaaagcagggcaataagcggatatacaatcatgacagtaatcggtttaatgaatctaccaagtaccacagctaacagaataacggaaaccaatgaacctatactatagtagctcagcagtttaatggcactggctttgtccatgcccagggcctcttgtccaaaggtaggcagccatagctgcacgatcatgaacaatacagtagaagtaaaaccaataataatcagagataaaccttcttgccaaaacttaggctcgctgcggaaagtatctgtggattgtgcagcctcggttgaagccttttgttcctctgctttgtggttggggaaagctgtcatcgacaagaagataccgttcagcagataaatccctgctggaataaagaaggaataaccatagaacatgtcgtgattaataaagaaagcaatcatgaatggaatcacaatggcaccgattgagatggatgctttgaccagtaccgttgcagacccggccttttttccaaagctttcaattaatgcaggatacgttcctgcatccatcatagagttgcaaaaccctgcgataatagcaaacacgaatgccaacgtatagttgggcgcaagcggaatgccgatcaggaagattaaataagcaaatgatgcaataacaatgagtggttttcttccgtatttgtctgacatttttccggctaccccgagagcgagcagcttaccgatcccaatcgcggacaccagatagccgatggctgctttatccgtgttcaattgaacggtcaggaagctcatattcgacgatagaataacattgatcatacccagaagaaaatagttgatgtaaagccctgctgccattctgatataaggatttttcataagtgtaactcccaacttaaattttagatcaatggcctaggtaggcatcgtcagctgcattacattacgcctacagataagtgaaattattcacattctttctatgtcattattatataaggagtgttattataaatccaatgcatattttcatcgtttttcatagtttgggtctataatttaaaatatgaattaaagaaggagagtacatcattatgaacctgaagcacttacaatattttcgtgtacttgcggagatggagcattttacccaggcagctgtgcggctatgtattactcaacccagtttaagtcatgcgatttcagaattagaaaaagatttgggagttcatctgttcgagaagcaggggagaaatattcggttaaacaaatacggacgatttttcctaaagtatgtggagcacgcgatggatgaattagaaaagggagagcataatttacgagagttagtgagtccaagccatggaaatatagatttggcgttcatttacacgttaggctcacacttcattccagcgatcattcaagccttttcagctctggatgcccataaagatatctccttttcttttcaccaagggaatacgaacgatattatccaggggctaaagcaggaacattatgatgtggcgttctgctctcacatggaaaatgaaccggatgtggagtttattccgttggctcagcaggaactggttgtcattgtttcgcctgatcatccactggcgtctctagaccaaattgatcttaaggatacggcagattatccggtgatcttcttcaacaaaaagagtggggtccggcccataattgaaaatttgttcgccaaagcgggtgttacgccacagattatttgcgagattgaagaggatacagcaatggcaggactggtgtctgtcaattacggaattggggttatgcctcgcatttcatcgttagattattttaacgtcaaaacattgcctattgtaaatccagaatacgagcgttttatctacctagccagcatcaaaaatagatatttatccccggcagtagtggactttcggaactttgcactaagttacggcaaggagttctatctgaaaacgcatcagcgcgtctaggctgagctcccgcaatatttaaacttgataaatcttaaaatgtgttctatacttcatcatcgacacaggtaatgtgaaatgattcacatttttaatactacaagacttacttacaaaagcaggtgaattcatgatgaaacgttcttcttttccagtggcgacaggcctttatgtaaactatcttttgttcggcatgtttaatattatgctagcgtcccacatgtcttttttaacaaagcatttgcatacagatcaggcgggcatcagtctcttggtttctgcgatgggatttggcaggctgtttacgctgtacatatccggcgtgctctccgaccgttatggtcgtaagccttttattgtggcagcagggctactgatggctgtattcttggtcggtataccgctgagtcccagctttgagatggcgatcgtactcgcagtgctggcaggtgtagcgaattcttttcttgattcaggtacttatccagcgctgatcgaagctttcccccaatcctctggttcggctacagtgttggtgcgaggttttatatccgtgggggcggcatttttgccgttaatgattatcttttttatgaatcatgatattttctatgggttctctttctttttaccagccctcatatttgctttaaatgcaatttacttgttcaagatgaagttcccagacatgcgggttcagtcaccccaggagccagttggtgatacttctgtatcaagcgttgagcaaacgggaaaattggagacaaatgaccggagtaagccgcggttttggcaggaggggctatgtctcatcttgctcggatttacgggacctaccttgctttatattgtgcaattatggctgcctacttttggacaacagtttatcggtatgaccgaatcagagtctctcagattattagtttattacaatgtcggttcgctgatttccgtgtttgtattggtaattgtgttaagaaaatgggttaaacctgttcacattattcttatttatccatgtatttccctgttggcttttggagcgcttcttcttttcaagtcaggggcggcggccattatttgtgcgagtgtcattgggttttcaatatcaggtgtactccagctgacattaaccgtaatgagtgaattttttagtcaacgaaaaggacagattaccgggtttgtttatacagcaacctcgctgtcatacacggtcattcctgtgtttacaggctttcttttgaagcattatcagatatcgagtgtttttatgctagctattattgtgaatgtgcttgggatcgtactggcggtgtttgttaattttcggtacagtttagtttttccagcaagtcgcaaattgtcccctaaaatcgtactggataccaaataaatgacgactggacctaatcatctgcatgcttattcagaatgcgttatactatgaattattgtagatgttcgacttgaaactgtaatttgggagtgagatagagatggcgaaaatcgtaaaggtgaaagatgttctgatcggtgaaggagcgccaaaaatttgtgtgcccatggtgggagaaacgttggagcagttgaaggaagaagccacttatttgcgtacgctcgacctggatatcgtggagtggagagtcgattttttcgagcatgtggaggatttggaaaaggtgaaagctgccttacatgaaattcggtctattttagcaaatattccgctcgtatttacgttccgtagcgctcgggaaggcggagaaaaggaaatcagtgcggcgagttatgtggaattgaaccgtacagtagccgaaacgggacaagttgaacttattgatgtagagctttttaatgaggaagctgatgtgaagacgctggtagaagcagcacataagcataacgtatatgtgattatatctaatcatgattttcataagacgccgtcgaaggaggagattgtgtcccggttacgcaaggcgcaggaattgggaggcgatctgcctaagatagcagtgatgccgaccaatacagccgatgttctcactttgctggatgccacacgtaccatggcagaagagcatgcagatcggccgattattacgatgtcgatggcggggaaaggtgtcgtgagccgcctgaccggagaactgtttggttcggctctgacctttggtgctgctaagaaagcttccgctccggggcagattcctgtcactgaactgagagagatattgacggtgctgcatagccattcttaaaagatggatagcattactcgccagtcagtaatatatccgtagtgaaccaaaaaggagggtcccatgcggtaagcatgctggagccctcctttttggtgtaactcttaattcaatccccgagtaggttcatataactcccaacctagattcagcgtttgaataatatagtctgcgacttcttccgcatccaactgatccgtatcgatcttggagtgattcaccgcgtaaatgtcctgtctggaacggaaaagatcctcaatttcccctaaagtcttgttttgtagattggggcgggtgtcaatcagcatcttgagccgatctttccaggaatcccaattcaaatccaagaagaaaacaatcgatgaagccaaacaagcttgcttcacctcttcctgtaaaaatgcaccaccgccaacggaaatgattttaaggcgtgtgttgctacacagcttcaaaatatgctctttttcaatctcacggaaacgtttctctccataagttttgaaaatctcggttgttggcatgttgtactcttgttcaatctcctggtcaatatccacgaaatcgcgatacagcttgcgcgctagatgggaaccgattgttgttttacctacacccataaagccaatgagcacaatattttgttcttttaacggaatctcactattgttttgcacgataaccactcttttctcaccagtaatgttgagatgtaacgcttcaaagcactaaatacattatacgttcatcaaacgtgtcattcaatagtatagatcacatcaaaaataaggtataggagggaaaagagcttgtgaatacctttatagtgatctagagtaagtcaacgagactagatattcaagtcttctgatgcgtaaatcactgaaaaacaactttgtacaagtataaaaaaggcaaaattgtgtacttaattgaaaaatagcacatattttgccgaaaaatatattgaaattactggaagtaggattataatagaattatacaaattgtaaatgtaatcgctctatttacaatttgtgtgcacctgaatttatagaatgaatttactttgaaccaaaaaccaagtatacatatgtaaatagtataataatgctttatagacatgtatcggttaatgggttcattgtacgaaggtggtgatacggtctacgcgttctagtcaacgaagaattggaacaataaaaaatatctacgagagggatgaattgaaatgaaaacaaacacagctaaagtattgaaaaagggaatcagtctcgctttatcaggaatgttggtcgctttatttgtcggcaattattctgcacatgcagcaccagaagtcgttcataagaccatacttgttaaagctggagaagtatacgatggtaaaggcaagactgtagtggctgatcccgataccttgggagacggaagccagaaagaggctcaaaagcctattttcaagcttgaaaataatgcaacactaaaaaatgtgaccatcgctgcccctgctgcggatggtgtgcatgtatatggcaacggaactatttccaacgtaacgtgggaggatgtaggtgaagatgccttgacgcttaaagaaccaggcacggtaaacattacgggcggtggagcgttccatgcgtacgataaagtattccaaattaatgccgaaggcacgattaacattaaaaactttagagccgatgatatcggaaagttggttcgccaacttgggggttctacattcagagtgaatatgactttggataactcggatatttccaatgtaaaggactcgatcctgagatcggatggtcctaacagcaaagctaaaattacgaacactcgttatcacaatgtgaaacaattgttcaaaggctttaagtctggtaatacgagcgagtccggcaatactcaatattaatcggtatagaatagagtaaggataggagtatggatgtgataaggggctgccaacaggtcgcgtgatctgcttgggcaagcccctttttgggtgcagcgagttaccccaagatgatctgggcttcgttcggaacgaggactgtgatatgatcgtgctattacattttatacaaaaaagttgggtggctatgaatccttttcatcaatatgtgaatgttgacggtaccttaaatgatacgctggtgcggaatcgtgaaattttatatacaggtacgaatggccggcatgtggaacgtttttacgtgtcatcctctgaaagttatatatttaaaccgctaaccaacgatggtcaggaggggcgtgagagatgggtgtatgagcatgtgcttcctgcgttatcaccgatctatcctcgattgctagcctggtctgatgcaggtgcggatggcggaggagaatggatggtttttgaggaccttggttcgttacatcatctacacgcagacgaaactttattgcgagctgttggccttgttgcatggtggcatgctttgccgatggatcgttttgctgggatgccgttacggggacccaagccacttattcaggagatggtttccgagctatatacgcgcaagccggatgtgttaaagctttgcagctcactgggtttatctaagcaacagatgctgcgtatatatgtacagctggagcatgtatctttttcacagcaggttgtactgtctcatggtgatcttcatccggggaactatgcgctgagcggggaacggcttatggtattggattgggagcatgctcatctgaacacaccgctgtgggatgtatatcacctgatcgatatgtcccatccgttgtttccccgacgcatgacgtccgaattgcgtattcgtatgctggacacatacgtggagcagctggagctgttagggaaaagagtggatcgaacggcatttatgctggaatatggcatgtttgcggtggtattttcgctctggatgctgttgttaatcacaagtgatttgcaaaggattggaacgaacctgcatagaaacgccgacaaatggtcaaaagagcaattagagtcccagttggatgaaacgttagcctgtttgaaccaatgtgcagcaatgatggattggggacaagcccaacaatgtagatagtagcttaagacatagactgtgtttagttagccaaagaaggtagggaatatattcatgaaaaaagtcggtttagtcatgagaaaaatacaatttgctgaagcgcagggtccacgtatttttgcagaacgcctgaagcagatcgggttggaattgggggtggacatcgtatttgtatcaccggagcgccatgtgagcagccatgactggcttccgggctatgagcacgaaaagggagacctggtcaactatgacatcgtactggaccaactccatgagcagcagattgagcacgttatttatacggtatctggctttacctatttgaacatgttttttaaaaacagcgtgctttttccgcatagttttcctgatccggcgcttacaggctatgagatgatgaagcctttttatcagatcgtggacaaggctattgtacagactgcgtttctcaagcaggagatggcttcgaagtttggcgttaccgatgtgacagtcatcccgatcggatttaatgagcgtctggtggaaaagcattttgatccctcgcaagtggtagagaaccgggtgatgtggattggtagagatgaggagaaccgacgtccggatttggtgctggagtatgcgaggcataatcctgacaaggatgtctatatggtatttggcggtgaacgctacaaggaaagtatgaagaagtacgatatcccggacaatgttaaacttcaatttgcgttgacgcaagatgaggtatttgcactgatgaacacggcgaaggtgtattggagctgctctaaattcgatacattcgcaatgccgctgaccgaagcgctcgctatggggaaaattgtcgtgaagccagagcatccttgctatggacatatcagctctacgcattctttttcagggaatgagaaaaactggttcgagctggtcaatatggctgccgcctcaccgcgtcgggtttctacagaaaatcaggcatatgccatggaacagttttcaagtcaggtgatgaagcagggctatcgggacttttttgatcattggttaagctgaacggcgaggcaaaatactatggttgcaacaagcgtctgagtatccagagtgaaataaaaataacccgcaaggtggtcactttttttaaaaaatgtccatcttgcgggttacggttcattgtgttttttcaaaggggctttgtagtgtttgcaaccaggttgcgccttttattggcgaattctttgacttatcgtttggactttactggaactggggttccttttttaaatcgagtcggtcttctcggaattctgttaatgccggagtcctccgatttggaaggtaacgctctacgagttgtctttgttgacagtaagctttggttggttctgctaaactcaacagtgtaattgtctacagatgaatcaatggcaagtcggcgcatccccactcgtctggatgatcctctgctctcgttccaacaccaatgaaaatcatggctagtatttctcggaagccgtgtgcggtacgtgccacgccatgtatttctggagtgatcttcagcataataatagaatgtggttccccctacagacccgctccatatttctctcgtatcaccaggctctagccgataccagcccattttagaataattcatgcgatgacagtcggaatcaggataagcataggcagcatagatggtgttactcgtgttgtttgtaaaaaaaaggctcatcatatacacttctttcctcgtaaatttgtattgcaatgcatactatgaggaatttagaagaagagagtggacaatatctctcaatctatgaaaaatgaaccaatcgtttacgtccaacttgctgtttttagagatatgccgccatttattgttctccggttgataactgtacactgtccaacaaacagaacgattctatgactgtatctccgctgttgctttagtatgagccgtcttacgatccacaatgtagctaactatcatgagtagcaggccgccgacagtgattagcgatgcaacccatggaatagcggctagccccatttgattaataacgactccaccgataaaagcgccgcctgcgttacccagattcaatgcggaatggctggaggtagaggcaagcagaggagcctcataggccagattcatgatgcgaacctgaatacccggcatgatgccgaacgcagcaatgccccagataaagacggtaatgacggccaataccttgctttgaagcgtaaatgtcagaatggccaaaataatagctagtacagcatagtttgcgatcagagatggaagtagtctccaatccgcaagcttgccaccaacgatattgccgatcgttacccctaggccaaacaggacgagaatccaggtaatgctatgttcggcaaagccactgatgtccgtaagcaaaggcgtaatgtacgtaaagacagtgaacagactaccacaaccgactgcacctgtgagcagcatcagcagcacttttggattaaacaggcttttgacttcttgttggagactggaaggcttgtcctggtgaattaccggaatgtaacgaatgataccaaagagagaaatcaagccgatgaccacaatagctccaaaggaagcacgccagccgagttgttgtccgataaaggttccaaagggcacaccaataatgttcgccacggtcaaaccggtcagcaccatagaaatggcacccgcgcgcttgtcaggacgaaccagtcgggcagcgatcagggaaccggctcccaaaaaggttccgtgcgataatgcagtagccatacgggccgcaatcagaaattcgtaattgggagcaatgacggaaaaaagattgcctaaaatgaatatggtcatgagtaggcatagcagctttttctgcggaaccttatgggttaatacagtaagcacaggcgcaccaatggctacaccaagcgcataactggtgattaactgcccggcttgcggaatcgtaacatgaagatcatgggctacattgggcagtagtcccataatgacgaattcggtcatgccgatggcgaaggcaccaagggtcaaccatagcaaggaggggggaaagcgatttgctgtcatattttcttgattactcataagtgtcttgtatcctcctggaaaaatagtaatgcgagtatatcattacaggcgatatctggcgacccattatgcaagaattttacatactaagttgataagttttatgtaatttacaaaagcgacaggtaggaaggagccaagtatgttattttggtagtatgatattaagatcgtaaataacgctgtaaggaacgatctaaggaggatacaacgatggcacctaaagtggtacatagtattacagatttaataggagatacaccttgtgtaagactccaacggctcacagggccgcaggatgcggaagtgtatgtgaagctggagtattttaatccaagcggcagtgttaaagatcgggcggcggggaacctgattgccgaggctgaaaaggcaggacatctaaagccgggaggcaccattattgagccgacgagtggcaacacgggaattggtcttgcgatgaatgcggcagctcgaggttaccgtgcgattttggtgatgccctcgaatatgacgaaggaacggatcaatattttgaaagcctacggggctgaggtcgtgctgacaccagcggaagaacggatgccaggagcgattcgcaaggcactcgaactgggggctgaaattgaagggggctttatcccgcatcaatttgaaaatgaggcaaatccggacatccaccgtacgacgacggcactggaaattttggaacagacggaagggaagctggatgtattcgtcgcttcttcgggaacgggcggtaccattacgggaacaggtgaagtgctgcgtcagcatttgccggatctgcggattgttgtagttgagccgaagggttcgccagtgctatctggaggaaaacccggtccacataagctggttggcaccagtccaggctttgttcccaccgtgctgaatacggaagtgtatgacgaaatcgtgcaggtttccgatgaggatgcgattgcaatgacacgagcgattgctgcccaggaagggattctggttggtccctctagcggagctacgatatggacggcgattcaggaagcgcggcgtttgggagcaggcaaacgggtactttgcattgccccggataccggagaacgttatctgagcatggggatattcggataaaaagatgtggaatgagggcaaagagattcgactcatttatatgtaagatccagcctcattaagcgaagtaacaaaagtgattggcgatatggcaatcaagaatacacaagtataacaggatgactcctgaagcgcctacttcttcactagcctattatagctcgaccttgaaatattatctttgaaagaataaaggatgatgggagcgatatagtagattctttttcaatggaggaacatagacattgaatacatccttgtcataatttataggttaatttcactcctgacaattaataagccacaatccataaggttgtggcttattaattgtcgattatagcttatattcgtgagaatttaaaaagtcttacggttcatattccgttcttcgatcttatttgtctcttcagcctgacgatcatttatatgatgttgaagacccataagccttacattggaggcgggtcagagggatattactgcgcaacagtagaggcggtaaccgaagaaatgaaaaactatattgtaatcaattcacagaggaaaagaacgaaagtttcagaattgagaacgggttttagtcggagttccagtacgattgtgcatatagagtttcaaaagaacttgaatcttacgttacgactttagtcgtcgacattttgtctaaatctacatgctttgagcaggtgccttttatcaatgactacaatttaggaggtttggaatacctttcaggaataaagtataaaaaacgggagaattagatatattctttattcatcgacagcaagatatgacatacggtcactcacaataaacgtgatttaggggtaccactgaaatcatgtttattagaatttaattcagagaggaagaggaaaatgaaagtagatcaaatgtttgaccttgatttaagaaagagctatgaggccagtgagcttagcccacaagcttcaatcatcaagacaaccattaaggtatccaaagcagtatgtaaaactcttacctgtatctgtactggttcttgttccaattgtaaataattcataagcgattcgtaagtcaggggtagtgaaatgggctacccctacttacattatggagattgcatgataaaacctaatatatacaattggcatgtagcccggctgaccgatcattttagttatggtgcaactgttggtcagccgcttactatcctgtttattgatacaggcgtcgataaatcccactcagagatccaaggtaatttagttgaggcagaatgcaagtcatttgtaccttatgagccttgtctaagcgattacgtcgggcatggtacacaaatggttagctctgttaccggcaaatatatattgaaggggatatgccctttcgctcaggttgttgtctacaaaattacggacaaaaaaggaataagcaagcttgaatggttgtatagagcactggaagagggtattgctaaaggatatccgattatcaacatcagctatcgtacagaatatgaggtcgacttattcgagttcaatcggtttcaggctttggttgactgcgccaatgcgcaaggcatctgggtagtctgttccgcaggaaacgatggacgcgatattacacaggagtacagagtgcctgcgaatttaaagggagtatacccaattggatcaactaataagaacggggatatctccgggttcagcaatacgctcagcggccaattttttgcgccgagtggtgatgagtatgaaatcaattacaacaatgattgggtaatggttgccaaatcaagcttcgacacagaggattatttatacgaagtgctgggatttgacaaagcatacacagtaggtatcggtacgagtattgccagcgccttattcagcggagttgttgcctctcttagcggagagcttatcgcgcaggggatgaatgccgggcgcacagaaatggagtgtctgctccgtcaaggcgcgagactgattgatgttcagcggaattattatgaagtaagccttgccggttcaattcgtgctttaagacagatgagaggttgattgcatgttggaaaactttgaaatctcggaaaattacatgtaccggaagacgttgcttggcatggagtattatacgcggatatttgatcatgaacaactagatgatgatgaatatcttgacagacttgtacggttcgttcagcagcaggggttgatggattccatttatgtctccagcccctcgacctacgctgcactgcaaagcctggaacaaggcagaacattgaagtccaaaaaaaagcggaatcttatcctcagtctaagcaagttcatttcgcgggcaatttgtagaccaacaccgtttggactgttcgcgggagtaggcatttcccgatttggaaacacgggaggcgctggagaacatgtcgtctgggcaactccggattatagcctaatttaccgcttaatagggcttttccatggggatgcggatgtccgcaatgaattgagactgagtgtaaataacacctcttacattgaccatcacaggctcgtcatctcttatcagactctgtttgcagcagatcaggaggaacgaagcactgaaaatatatctattcacaaaaccccggtcatagatttcatcatgaagatccttgataaagagcagcagacttttctgcagcttatgcaagctataaaagatgccttcggcgtggatgacacgatcagcacagattttttgcagcaattgatagaacaaggctttttggtgagtgagatgattcccaatcctcgggatagcgctcctctggagcatctgatccgtacactaaagctgcttgctgctcccaaggcagcatattacgcagatattttggagagagttggacatgccattcaggacatcacagttgctgaggtcaaacgcgaaggcattgaggctgtccgaaaactagtccagcttatcctccccaattttcagggcgacttggtcaaaatagacgtaaggctgaatcaggcaaatgaaattcacttgtcggacagcgataggcaagcgttggcccaagtagcttcaatattgagcatgctttctacgtacaggaaagaggatacactttccgactatcgtcagcaatttactgagaagtacggagtatatgaagaagttcccttattgcagttgttcagtaagacgttggggctcggcaaacctgaagagtacaagagccactaccagaacggagataagtacaggcataaggatgaaggcaggttccgacagctcaaggcgctaattgcggagtggcagactgaagcgcttgccaatcattcggatatcgtgcttgacgaggccaaaatccaacagctttctgaattgagtctggagaatgtctatgtctcgttcgatttgtattattcctgcatggagaatgagcaaggtgaagttacgttttatttaaacaacagagccggatcattggaagcgtgtcagagcttcggaagatttgcctacatgtttgacaaggatagccgtgatgaaatcttccgttttgtcaggaacccgaaggatcagaaagcaggggagagcgccgctgaaatctcattttacccattcagccccaaaataactaatattatgacggcaggcccaacaccggatcaatccatggatatggccacgttccccaagaatcggaatttggacatttcccaactactggtaggggtggaggattcgggatacttttatctgaagcacagggaaacaggcgaactggtatttcccaaactaagcagcatgtacaatacagagctggcgccttatctgatccggtttctgaatgatattaatctacagtatcagaccggatggtcccatctggaggagtatctctatgattcttcttttacaccgagagtaacctataaaaatatcatcatctgccctaaaaaatggacattatatgcggataaacggctccagagcgaagaacagtttttggcctttctggaggattggatcataaagtataacattccgcgatatgtatatttggtggagctggacaataagctgttgctggatttggatcgccatcatcatcgaaagcttttgcacaaagaatatacccggaatccggaaggcaaggcggctgttattatggagacggagaaagaactgttcgcttccgttaaccggtatatggaggagtgcgtatttttttgcaaaagcccgatgtttcagtacttgccgatagacagattgtctgcacaggctaccgataaaagcttaaataaagtgctgagttcttcggtgaatgccgtttattatccaggttcggattggatatccctgcaggtgtattacaatcaggaactgctaaccgatttgctgggcagtgcatttaagacattcatggacaatagcgtcgagtacttcattgaccaggtattttttgtccagtatgcagataaggagccgcatatcaggctaaggtgcaaaatgtcgggaagcgtacagcatcagcgtttcacggccttgaactatgtttttgatttcctgaatactgtaacctcgtccggattggttagttcctattcggttgttccttaccggcctgaaattttgcggtatggcggcgcagccttcattgaacaagcggagaggttatttgctatcgattcttatctagtttcaggctattatgcaggcaagaggtcaattaatgcaaccgatcagatgttattttgctgcaccggactttttgaggttgtgaactgctcgtatccgctggcagaagatcaattgaaggctatggctgcgattattgatccgaagaaattcaggcaggagtatcgggaacacaaagaagcgctattccaaaggattcaacagacccgttccatatccttgccagcaagcgataaagacgacaggttgcggcaatacgctgcatatttcaccgctatccgggaagctgacgacagaaccaattactacgatgatattatgttcagcatcatgcacatgttctgcaacagagtgttcggcctggaccgggaaaaagaagagcttgccctacacctgtgctactacagtttggaagattatttacaggtaagcaaatatcatgttgcctattgaggaggagtttatggcggtcaaacaagtcccgggaaatttatctgaaatagtcaggcaaagcgcagaaatttacaaagatatagatactgtaaccctgctaatcaagaagcacgccatgcatgattaccctgaaatggagctgatatcgctggcttcaggataccccggaatcagccttcttctggataaactagatgaagtttacccgggggaagggtgggctgcgcttgctttcaagtacaatcaggagattgtgcgtttaatcggtaatataccgttccattcattgtcactgtataccggattagcaggcgttatttatctgttcaacgagtgttcaagaggttcaacaagatatacgaatgtgctctcgcagacgctggatatgtttcttagcagctacggggaattctatgaggagacaagggggaaattggaagactctttgattgaggatagcgacttggatttgatttcaggctggacggggattgcagctgcattaatggaggttaaggaacgccaggacagatacgctgggaagctggatgcagtgctccttaagatccttcaactgattacggatgctgtaggcaagctgagacatttcggggaacttcccgaacagaccatttattataatcttggcatggcgcacggaattacaggagccattaatctgctggccgttgcacatctccgccgctacccgttaaacggattgagagaagtactggaagttggcaagacttttctgctcggaagtatcagggagtggaacggcacccttgtcatacctaatatgttcacaccggatgaatccgcagagactagtcggaatccaggttatcacagagatgcatggtgttacggcacaccgggagcttctgtggctatgttccggctgggattggccctgaaggacaaagcgctgcagctgcaggctctgcaattgttcaataccgtctactccagaccagattcgctaagaaaggtaatttcaccgacgatctgtcacggctatgcaggcttggtcctgattcagcaccatttcagccgtgcggcagccatgccgtttaaggatgaatttttgcatcgtttgttatcatatcgaaatactggtgaggaagtatcttttatagaccttgagggaagcgtcgatgatccgttatctctcgataaagtagggctgctcgatggatgtgcaggtgtattgctgacactgctgacctgtgataatgagaacttgagtacatggaagcagatgctggtatttagctaacaggaggagacggtaatgttcattttattaaaagaaattattacagtcatggtgggactgattaccgattttctctcttttcaactggatgcatatttttatatttggtttctggtcctgtttatttcaagcttggcagcgaccctggttcaacgaagcgaagggactattacctacagcacagccgaatgtgtcggaatcaatgtgctagttgtcgtattatacctagtaatcggtacaattttggccagatactttgcaagttttgaggatcagcagattgttgctgaagataagattatgctgtataaaatttcttttatgcttacatccgctgtaattattgtggatattatacttgataggttgaagagagggcggaaattctcctactctttggagtttcttgccggaagcgccgtgtgcttcttactgttccagttaagcaatcaaacggactggataggaaccaagctgtcgctctcctatattgtcatggtagcgatagccgcaggtgtctatacaatggcaatgaagtttttgctagaatacgaaaatcacaaagagaaataggtgattaagccataatggaattgaatatggagagcacggcatataaaaagatcggtgaagaacaacaaacggcccattccttgctggagttaatcaaaattgcgagatggcccaagcttgcgcttgcttggagcatcatatttacactgatttccgccgctttttcattagtattgccgatcattacaggtaagcttgtcgataagatctcagctatggagctgacgatccagaccgcagctgtgcttatttcgctgtttctggccggagggattttaaacgccgtgtcttctctgctcctcagatatgtggggagcaagttttttcaggagctgcgactgaaaatttgggaaaaaattatccatttgccggttaattattttgataacaacgagaacggcaaaatcatcagcagaatgacgaacgaccttgctattgtaagtaattttctggctatcactctgccttctattctggctgatgtcctgatggtcactggttgcatcatcatgttatttgtgttggattggagattaatgagtgtactcattgctctgattcctataacggcgctactgatctatcccattggaagaaggatgaatagggtagcggttgaggcacaggatgcagccgcagatttttccggtgagttagccaaaattctctataacatcagattcattaaagcgacgacgtcggaacagcttgaaatgaaatatactcgagagatactgggacgtatctttcgcttgaacatcaaagagggaatattgtcagctgtcattgagccgattgtcacaattgtcatcatgctagctttggtaggaatgttttggtatggaagcgccggcattgccgctgggcatatcactacaggtactctggtatccatgatcttttatttgtttacaatggtttcgcctctgacccagctcagcagttttttctcgcagtatcagaaggccaagggagcaagcaaggaaattcataccatatataaccagcaggatgagaagcaagaagaattaggcaatgtgccggacatgaaaagtcatgatcagaattcggatatcctgcattttgccaatgtttctttctcgtacaaccagggccaaccggtattatccaacgtggagttagccttcagaggctgtaccactacagcgatcgtagggccttccggctcgggaaaaacaacaatattttctttaatagagaaattttactcagaatataatggagaaatctattacaataatgtatatttggataagattaggacggaagaatggcgtcgcaaaatatcctatgttatgcaggatagtgacttactggtaggatcagtgagagacaatctggtatatggcctaaacagagacgcggatgaccatgagatttatgcggctcttgatacagtaggcttgaaggaggtaattcatcaattaccggatggtttggatacctttgttggagaaaggggagtcaaattatcggggggacagaagcagcgaatccagattgccagatgcttgctttcagaccatgagattctgctgtttgatgaagctaccgccaacctggatagcgagtcagagcagcttgtccatgatgtaatcaagcttctctccaagaataaaatgaccattgttatcgctcatcgtttgtcaaccatctacaaagccgaccagattatctttttggataaaggagaagtaacgggggtaggcacgcatcacgaattaatgagctggcatgataaatatcgtgattatgttcaattccagcttcccgcacaattaagttagggaggggcggtggcgttgtatcatcaattgtcaacgtggatcgttgataaatactttcaagacgaagaattggaagcggagaagcgtgcttatgtgctttattatctggagaacatactagctggtacagaaaaaatacttcttgtattggtcagtgcctgtttgctcagtgtattagccgaaacggctgcgattctgctttcctatacagtggtccgacgaaagtcctttggctggcatgctcgcaagtcgcatcattgcacctgggtcagtctactgacctttgtgtttgttccctggctcttaaaggaagtagaatggaaccgcatttttttggcgacgctctgtctgctttctatcattctgattgccagatacgctccggccgatacggagtgcaatccattggtggatccgaagttcagaagagcatgcagattacaagctatctttttaagtatggtgtttgttttcgtggccatcgcactagatttttatccttggttaatattcgggctgtttcttgaagcagttgtcatcacaccagtattctattccataatgagaaggagttatgccaattatgaacaatatcaagaatattaaagaaaacagaaacaaccatacccagagactcaaggctaagctactggagcatatgagtaaaagaggtgaaggaggagggatttgtttcgggttgttctatgaaccagtcaatccaaaagttcggaaattgatcaaaaaatgattacatccggcatttattttttgcaatacaccagctatcttgtaatatatcatatggtcagcggcaatggtctaagcgttttccgtatgaattataagctgctgctgtttttggtcatgtattattttatcggaataacagctctggataacttcggactgattgtttacctatttctatttgtgctactggcattatacgggtggttgaccgacaaatatgaatccttgtgggtcataggcttctacgccatccttaccatctttattacgacactgctgggttatttcataacggtgatcagctatgcggttccttatgaatataaaaacaaatggacggcgcccttcctaaccgcttgttcacctccgctgatctacttggcgctccgaaagcttgtgtcttatttgtttcctactccggcggtcaggcttttgaagctatatcggattaagcttatcgtcggagcttctttaatcttggtcttggggatcatcggactcggactcattatctattcggagtgtgaaagcaacaatccgtatccaagcagattaaagattgtgttgatgctgatcggcttgacctccatcttcctgatgacgatcaattggctgtatcgcttcctgcgtgaacgtgagctagagaagaacaagacggaacaatacctgcagctggaggcttatattatggagattgaaaaaatgtacgaagacatccgcggcttcagacatgactataccaatatcctgttaatgctggacgaggggatcagaactggggatttggcaatgatcaggcggatatatgagagttctatccaacctactgcttcacagttgaacggatattcctatagtctggataacctgattaatctggacgtaagtgagctcaagagtattattacatccaagatgctggtggcaaagaagcgtggagttgacgtgaaactggaaattgagagcggtatcagtgaaatgtatatggatattatagacctttgcagagtaatctcttgtttcctggacaatgcaatcgatgcggcactagagacctgcaatccgtccataactattgtgctgatccatgaagacgatattcagacggtgacgatacgaaactcttataatcagtctgcacttgacgggattaaggtgaatgatctctacaaacgaaacttttcaacgaaagcggacaatcggggtcttggcttgtacaatatagcaaaggtgctgcgcagcaacaagtatgtcactttggataccaaaaaggaaccggattttttcacgcaaacattaattataaagagagcgacatcatgaatatttttatcctggaagatcagtttatccagcagcgcataatggaaaagatggtccgtaaaagctgcgaggaacttggcatctgctgcagcaatctcattgtcaccagtaagccggatctcctgctttttgaatcaaaagcttgtgcgaataacttgtatttccttgatattgaaatctcgggttgccagatgaagggactggaagttgcccaggaaatcagaaaatatgatatgtatgggcatattgtctttgttactacccacggtcatctgtctccgcttaccttccaatacaaggtagcagctcttgatttcattatcaaggatgctactcaggatgaaatggaaaaaaaagtcagagaagttcttgctgttgcccatcaaagaaagcctgtgttggatgtcaacgattggtttatactcgacaataaatttacgaaatttcaaatttccttctccagcatttattactttgaaacaaccggtgttccccacaaaatccgtctggtttccgaaaacagaactcttgagttttacggcgacctgaaagatattgaggctaaggacccaaggttgttccggtgtcatcgggcatttatcgtaaacctgatgaaggtggaatctatagataagagcaagaaggagatcatttttcaaaccaatcagaattccggagaagcaaggcgcattattcccgtttcccgccaattgttgaagcacctcctagataagatgggagaccggagcctcctgaacagacctgtttacgaatagaatagatacggagggcatagtccttcgggaagaaaaggggaggaatatggaacaaaggttatccgttcaagcagaggtgaaaggcattgatgccaccagtttaaaattaattgcaatattggcaatgctaattgatcatattggagggctattttttgccgattttttgggctttcaggtggtaggcagaattacattgcctatcatggctttttttgtagccgaaggatatatccataccagaagcttcaaaaaatatacaatgcgccttgctgtaaccgggctggccagtgtggtgccttatggattggtatttaaagattggtatagttcgggaaacatcatgctaacgttgttgatgggcatactggcaatatggttctatgacaacacgaccaatcctgtacttaaatacttggcgatttcggctctttgcgtagtttcttttttgggagactggagtgtaattggagtgttcctggttctggctttctatgtggctcgcaaacaacagaagatttacaacgggtggattattgcaataattgcgcttatgttcattttcggagtcatcattatatgggctgttcccgattcgctcagcatcctgggcatcaacgccagcacaatgaacgaatatctttatccgtttgcgatcggcggggcctgtatttttgccctccctctgctatcccaatataacggagagaggggaaaaggctcacgaaccttcttctatttgttttatccgctgcatttgctcgcgctctatctgctgaagttggctattgattattacatataagaagggctgtctaataagtaactaaaataaaaaaatggacgggaaacgacatgttttccgtctaatttttgcggtttcacaaactattcgaatgctgatgaagcagggaatattttgagggttgaaggaggagcagcatgaagattatgcctttacagaaacgtggaatctccgatagtcggctggcgctcggttgtatgccttttggtggagaatggagccatgcaccgtttacgcaggagcatgtcgttgaagcggaaagagctgtagaagctgcacaatccattgggattacgatgttcgatcatgcggatatctatcgtatggggaaagcggaagagattttcggccggattttaaagggacagccgggcttgcgtgaacaaatcgtaattcagtccaaatgcggcatttttctgccagatggtacgctcccgggccgctttgatttctcatatgctcatattatggagtccgtggatggtatcctgaagcgtctgggtaccgaatatttggacatcctgctgctgcatcgccctgatccgctggtagagccggaagaagtagcgaaggcgttcagcgagcttaagacatctggcaaagtacggcattttggcgtttccaatatgaatgtaagccaaattcggtttctggaacggagcctaccggagccgctaatcgctaatcagctggaaatgagcctggcccatctgcattttgtagatcagacagtacatgtgaaccagcaggcagggacaaatgtacattttggcgaaggtttgatggaatattgccaaaccgaggatattcaactccaagcctggggaccgctggcgcagggacgttttagcggaggttctttggaaggggcgcctgaacatatcgttaagacggcagagctggtgcaaaagctagcttctgaaaagggaacgacacgtgaagcgatcgtccttggctggcttatgaaacatccggcacggattcagcctgtcattggcagcgccaatcctgaacgaatcaaggcatgtcaggatgcggaacgccagagcgagctgatgacccgtgaggaatggtatgaattgtatgtcagtgcgcgcggacaagccttgccataaactcgtacttcggacccgtttgttacagcaggcgtatgtggatgtaagtgtatgaccttgtttatacgaactgtttaataaggccctcccttcgtctcattaacagacggagggagggcctatttacatggatgcatctcatattgcctcagtagctattcctcttcgtagcgtgcaagggccttggacgttgtttccttcattcgtgagatcagccgggagccttggacgaccttgacacgtttgccaaggaaacggattttggatagcacgtattcacattcgtctgcctggaaggtgagcgtaatacgataggtatctgtttcctgaacatattcgacctctttttcaaagcaggaaaaagcatataaaatacgggacatttcaccgttgtatatgggaataatttcgatgatgccttgctctttgcgcgactccagtataccgagtatacgttgggtgaatttttcggcctcttcgggtagaagctcatcttccgtgatgttcacgatattagacagcttggtagacatgagcgcgcagtgtctgcggttataccacagcaggctccattcttttttgaccatggagaactccagcttatatggaaaaccggacattcgctcatgcatgcgtccgttgcgcagtttgtaggtcatacagatacctgaacgggaccgcagaatgggacgcaattcacgcaggagtggatgatataccgagacagcagggatacctgctttttcccgcaaacttccatcggcctccagcggctcgtcgtctgcgagtatctgccgaagcttatcaagcgtagacggggtgaaagcctctattgctgccgagtctgtcagcatggattggagccagactctttcctgcgatgtggtagcaaaagcgcccgattcatccagccgagagatgatctgatagttaaatattttctcgaacaggctcataataggcttgcagctccttccattcctgtctgaattccttacgcagccgctggggctccaatacctcacagcttgatccaaagctgcgaatccacggttttatctcggtgattccattcactgtgatttcatagataaaggattcgctttcttcctccgcaatcgtaccccactgtccctgtgacagcacacgttcccgaataaagttgcgcttcgcgccctcaggattaaaaaaacgtacccgtaccttcacaggacgaccggtatcaacaagccagctgtaccgcattttttcttccaacaccgctagcagatcggcatgaaactgctctggtacaggcttgccctccaccaattgagtcatgccctccatacgaaacttcatgattcctttaccgcctacatgaccaagaacataccaacgtccatattgatgatcatagatgacttgcaggggcagaatggtatgttcacggccctccgtctctttttcaaacagcgggtttgtgttctgtgacccgtacatgcttcgtttggatgtcgaaaaatataaaaaagttacacagcgacgttgccgaatggcatgcagaagcggatgaatatgggcttcgtccagaatgcgtgaataatagtggtatttatataaaaaaggttcaatcatatcccgatctccggcttgacggcgcatagctttttttagatgatctcgcaacagatatccctgaacagagggaagctgggtgttggccataatgtctacaaaatcatataagtccagtaattcctcgtccgtcagtcctgtcaccaaatcgttgcggacagcatagcggtaaggtctgccgccgggttccttgcgaaccacgcccacttcgaccagatatttcagatcggaacgaatcgttttttcatctggcagcgaactgtcggaaggcagcccattgcagcaagcatccagcaattccatagtggtcagaggctgtgactgtagcgctgtcagcagaagagataagcggacgctttctgattccttgagcgatttggcccgaaacaggaatagtagtaatggatcagcggattcgtaataattaaagcgcagcatcccattaaaatcatgtccctggtcctcaggcaactgctgttgtacggattggacgatttccttgagacgccggattgttttatcaaaggtatgcactgaaatgcccagtctgtctgcaaattgctgccgattataagcgccgctggtcagtgtgagcatgcgcaggaattgaatctctttatcaaaactctctctcgccatgatgcattccccgtttctgttgccgttctccgaaagcaagtatccctttattctaacagggaagggatgcaggaaaaagggaatttattcatctttgtaatactttcaccatgttcacgacttccaaagtaaagcatcatagggatataagatagcacgatgaaataagaagcaatacataacagaagggtgatgcaacatgtttggacgacgcaaaaatgaagtgttatatccatgggtaggcaagctttcgatttatgaaacgattatgcagggactggatgctcagggcaggcttacatgcgtcttcgccgcttattaataggtgaaacggatgagtcgattagagaacagattcgggaaatactttaatgataagggagggaacaacatgacagatgtgaagcatgggcagggtttcattcaaccagaaatgcgcgaaacgattttgcgtgagctgcgcgcgttggagcaggaggagcaaatacgtattatatacgcctgtgaatcaggcagtcgggcatgggggtttccttcacaggacagtgactatgatatacgatttatctatgtaagacccatagaatggtatttgtctatttttgataagcgggatgtgattgagcggccaatcagcaatttgctggatatgaacggctgggatttgaaaaaggcactccatttgtttcgtaaatccaatccgcctttgctggaatggctgcaatctccgattccctatctggagcagtattcagtggctgaccagattcgtgcgatatcgccgttaaccttctctccgaagtcctgtatgtaccattatctgaatatggcgcgaggaaactatcgggattatttgcaaggagaacaggtgaaaagtaaaaagtacttttatgtactacgcccacttttggcctgtggctggattgaacgttacaacagcatgcctccgattgaatttggagacttgctagaggaattaattccgtcagatacagaactttatcaggtgatcgggcatttgctgcaacgtaaaaaagcgggcgaggaactggatatggagccacagctttcggtggtgaatgattttatccagcagcaaattgcttattttgaacaaaaggcgcccttgcttcagcatgtggagagtggacgggatcagcagttggatgatttgttccgcgctgcggtgaatgaagtatggaaagcataagctgggaaggagaagtcgagtatgcacatcacgctaaaagcaactggaacccatgcagggatgatttcgcatttgcttgctaagaatccttacaatacgtatgatcgcacagaaaaaggcgcacgtgtacgcatggtgtacaccgtctttaccgaggaagaggctgagatcgtcattcaggcctcgccagattcgatagatttggtcaaaaacagtccagacagctatgacattacacaatatattaatgaccgggagtttgtaaccagcagcttattttgcacttatattcgtggctcgcttggcacggccctgaacggcaaacccaaggaagactatgtaggatgggtgacgcacccttttgcgctggagttatcgtttgggcccattgcttcggatttgccggattctgtggtggaaggactatttgctccgctgggttatcaagtggctatagaacgaggggaagcggactattcttttcagctgaaaaatcgaagcaccgtcagatatgtcacattaagtggtcatcagacagtgcagtatgcgcttcgtcagttattgctgttgattccggtgctggataattataagcactactatattagtgaagaagagtttgacaagctgagacgttacggagaaggctggctgccagagcatccactacgcgagctgatcattcgacgcacgcttcgttttaccaatttgattgagcaatttgagcaatctgattctgctgaaacaacaggtacaaaaaaacacattgaaaaggatactgtccaagctcaaaaggataagcacgaacaggttcaacagcaagaacagccacaggaggaagggaagcagcagcctactgtacggctgaatgaactgcgatatcaagccattatggacgtgattcgcaagctgcctcgaagacagaaaatcgtagattttggttcaggggaagggaagctatcggctcggatggcccgaatgacgggcattgaagagatttgggcggtcgagccgtctgcgtatgcacaagtgagagccatggagcgttttgccaagctggaaaggcatgccgacgcgatcagccctacacccatgatgggctctctcttttattatgacgaacaattgcggggcaaagatgtgatgattctatgtgaggtcattgagcatgtggatgagcatcgtctgaaccgggtgatgaagacaattgtgacggagtatcagccgggcgtgctgatcgtgacgactcccaatcgtgaatataatgaagtgtatcgtatgaatcagcaagagctacggcatggcgatcaccgttttgaatggagtagaagcgagtttcaggaacgatgtgagcagtggattgcggaagctccttattcggtagcgctgaaggggatcggagaagaggtcgaaggctttggacaaccgacccaaatggctatatttacgcgcagaaaggagcagaaggaagcatgagcaattcatccaaacatacgattcatttaccgcatgctggactggttgtgttggttggggcctccaacagtggcaaaactacattattggacaggctggtgagcgaagggattctactggagacagaagtggtatcctcggatcattttcgcaagctggtcggagatacggaatttatagactggagtggacttccaaggctggaatcggatgtactgttctatgagtatcagcaaatgtcagccaaggcgtttgaggcgatggatacgattctggctatgcgctgtcgcttgaataaactaacggttgtggatgccacccatttgtatgctgaggaccgtcaaaaatatgtacagctggcagccaaggcgcatgttcctgtgatggcctgggtactggatgtacccgaagctgtgctgctggaacgggatttaggcagggagcatccgcgtggccgccaacgggtcaagcagcaggcacagctgttaaagcggaacctgcgcggtatccgtgaggaaggctttaacgcttgctatatccttaaggatacagaagaaatgagctttgttcgccgtgcgcagccactatttcatgagattggctcaggtattgacatcattggtgatatccatgggtgctaccgtgagatgctggaagtgatagagcagctaggatatacggaagatacggaaggactataccatcatccagatggcagaagactggtatctgtcggggatgtgatgagccgtggcccagaatcgttacaagcggtgcagttctggaaaaagcacgtggatgccgggctagcgtatatgattgacagtaatcatggctggaaaatcggccgttatctcgatggaagaaaggtgactctcagtcatggggatgaacgatttgcagaggaactggcccagtatgagcaaaaagcgggcaaggcagcggcggaacagcttagaagtgagttgagagattttctgctacatgcaccttctcatcttatttttggcagaaatggattgcgacacgtggtcgtggctcatgccgggattaaggatcattttattggcaaacagtcggcacgtatttccgattattgccgctatggagatacggaaggacaggatgcgaacggaaaaccgatccgcaaggattggttcgtagaccatgaatcgggagaaatagtagtatgggggcatgatccgagacctcagcctacccttgtgaatcagacggtgaatattgatcagggtgtggtatttggcggtatgctgaccgcttatcgttatccggaaaaggaatttgtcagcgttccggcacatgagaactatgcgaatgatcccgatagcccacttgtccggtggcagagaaaacggttttccccgccgaatttacgcaagctcatcgctggttacagtgtgctgacggaatcgtatggcgaagtgcgcgtacaaggagaatggatcaaatccgctatagataccgtgtcacatgtaactgtacccatagaggagctggtgtatattccaccgacgatgagtcctgctccagcggtgtctgtagaggcaggatatctggagcatccccgtgaggcgctggcttattatcgtgggcaaggagtacaaacgatggtggccgagaaaaaacatatgggtagccgggctattttgctattattcaaaaacgaacaggctgctgttcaatatgtaggctacccgacattgggcacgatttacagtcggagcgggagagctttctttgaacaaagccttgggaagcaagtgctggaaaagctgaatgtggatttacagacggctggatattttgaacggaaccagacggattttgtgttgctggatgcggaaattgtaccgtggaatctcaaggctcgggaactgattgctgcacagtatgcgcatgtgggggaagcagctctgctggatcgcagtaagctggtagacaagctgaagcaggcgaaggttgcaggtcgagaggttggagactggttggaggaaatggaacagaagtacgcgaatgctgtaacgtttcaagaggcttttcaaaaatattgctgggatgtggacggtctagatgaaattcgtatcgcaccgttccatacgctggcacacagcggaaagacttttttcgaccattctcatctttggcatatggagcaaaaccgggagctggctgagctgtcttccctgtttatggagacagagtatcgtgtcatcacggatgaagcaagcgaggaggaggtcattcgttggtggaatgagatgacagaggatggtcatgaggggattgtgatcaagccggaacgctttttgatgaaaaatcgggacaagatgattcaacctgcaatcaaggtgagaggccggaagtacttgcacatcatttacggtatggattatcttgcccctgagaatttaaaacgtctgaagcagcgtcgaacgaacaaaaaggagcgtcatgccctgatggaaggagcgcttggtgtggaaggcgtggaacgttttgtccgcaaggatacggtagatcgtattcatgaatgcgtccttgccgcgctatcgctggaatcggagccgattgatccgagattgtagtttgcgaaggagggattgagatggaaaggggtacaccgttaattgatattggtgtgaacttgatgcaccgttcgtttcatgcagatcgggaacaggtggtagagagagccgcggctgtagggatttcaccgctgattattaccgggaccagtgtccgcagcagtcgggaggcttctcagtatgcagcacgttatccgggcaagctgtatgccacagctggcgtgcatccccatgatgccaaagactgcagcgcagacacgattcagcagctctgccagctggcgggtcagccgcaggtcgtatccataggggaatgcggattggactataaccgtgatttttcaccacgtgatgtgcagcgtcgatggtttggggagcaaatccaactggcgggtgagctgaatatgccgttatttctgcatgaacgagatgcacatgaggactttgtcgctatgcttcgggagtatcaagggcttgtcgataaagcggtagtgcattgttttactggcactgaacaggaattgcatacgtatgtagaaatgggactgtatatcgggatcaccggctggatttgcgacgaacggcgtggcaaacatctgcgtgaactggtcagagatattcccttggaccgtctgatgattgaaacggatgctccatttttgaccccgcgtaatttgcccgtgaagcccaaagaagggcgtaatgagtccgtgtatctcgctcatattgctgctacggttgccgaatgtacaggtcgaagcatgatggagatcgaaatcgcgacgacggagacagccaaacgtttcttcggtttataggattgtcaaagccatagatgtggtatatattatagtgaattaaaaaagcattgtcgggagcttgagaaagtcaggctgagagggtggcccttgccactgaccgtgaaatctgatctgggtaatgccagcgtagagaaaccaagaacactatacaggaatgccgcttgttttgcggttgtcgatagattcaatgtatgtcctagcattttaccttgaccctgactttggcttggtatcagtgtagtagcttagactactggttatataaggcatatcgacgaatgatgttttgtatggtgcttcaccttttactgcgcataaagcttgcctggagattcagctccagacaagctttttttatggccaagaggccaattataaggaaaaaggggagcacgcaataatgaatactgctgtaagagcgtccaaagggttgaagctgactgatattttggtcacgattgtgatatctgttgtgttcgggttggtctacaaaatatggggacctgcttatgatttgatgaaaccatttggtctacacgccgagcaattgatgtatggcatgtggtttatggcaggcacgtttgcttatctcatcattcgcaagccgggtgttgcgattttggcagaggtggcagcggcaacggtcagcgcttttttgggaagcgaatggggcatgtccaccttatactatggcctgctgcaaggcttgggagcggagctgttttttgcggcttttctgtatcggaacgcaaacctgtgggttgcttcgctagctgcggctggggcggctgtcacttctctgattttagacttcagttacgggtatattgatcagctatcgacctggaactatgttttgtatattggctttcggatgattggcagtattgtgattgccggggtattcgcgttctatctggctaaggcattggaggtaaccggagttacacgaagtttgagacctgcaacggaacaagattataaggggctggattgatgagccggacaaccgaagatgtggtggcttcgatcacccgtctacggttgaaattccccggtgagcaagagctgctttttcacaatatgtctttgtctgtccacaagggggaaaagctgctgctactgggaccgagtggatgcggtaaatcaacgctgctccaagtgttaagcggtctgattccacgcacgatagaagtgcccatgaaatgcgatgctgctgtaatcccaaatgtctcaggtattgtatttcaagatcctgatacgcagttctgtatgtcatatgcagacgaggaactggcttttgtgttggaaaataatcaggttccccgggaacagatgcaatcccgtattcgcgagctgctgatacaggtgggtctatcgacggatgatatacacatgcccattggcaacatgtcacagggaatgaagcagcgtttggcgattgcgtctgtgctggctatggagccagaagtgctttttctggatgagccgacggctttgttggacgaggaaggcactacacaggtgtgggataccattcgcaatatttcggtagaccagacactggtgatcgtagagcataaaattaatgaaatcgtccatgatgtggatcggattgtggtgctttctgctcaaggggagatcattgcggatggaagggcagaagaagtatttcatgtgcatcggcaggcattgtctgagtacggggtgtggtacccgggagtatggaatgaatcgtcttcgccgcgttggagtgaatcagtgacacagcagaatggtgcggggactgatttgctggagctggaacattttagcggcctccgcggtttaagtccagtgatttatgtggagcatgcgcaggtgaagcctggagactggattggtgtggtcggtgaaaacggggctggcaaaagctcgctgctgctctccatgatgcgtttacttcgcacacagggacgttatagcgtgtgtgggattgaggcaggcagtacggaacaactggcagagcgtatcggtttcgcatttcaaaatcccgagctgcaattcgtagcgcataccgtacgaaaggaactagagtattcgttacccaagagcttgtttagtgctgaacagtgccgggagcgggtggatcggatgctcgtacagttcggattagagcggctggacgagcgtcatccgtatcagctttcgttaggccaaaaaaggcggttgagtattgctacggccatgatccgtgagccggaagtgttgctactggatgaaccgacttttgggcaggatgcgcgtaatacctttgtcatgctggatatgttggagcagctgagagcggcaggcacggccattgtgatggtcacgcatgacccggaaattgtccgtcgatattgtaccgatatatggcggattcagaaaggggaactacagtatgaacctgtcctttccccatcataaaacatggctgcatcgcgtgaatccgggcttaaagctcgttatgttttccatactgtttgtggtcgttatagtcattcatgatccgaatgtcatgtttaatgttgcgtgttctatgctgttgctgcttgtctggtcaggccatccatggaagaggctgctgctgtacggatctccctttatattggtgtttatttcaacttcaacgggcatgatgatgttcggcaaaggggtgacgacctggtggacatggggcttgatccatgtgacgcaggaaagcttttaccgaggcatgcatctgggctttcgtgcgctgagtatggctgcggtagggttgctgtttggtttaacgactcgtccggtggaccttttttattcactgatgcagcaatggaggctccctccgaagtatgcgtacagcttcttggcagccatgcggttaatgcccatgatggtggaggaattccaggcattgagacaagcccaccgtattcgaggcttgcatcagcatgtgtccaaatggaatatgtatgccacactccgcagatatgcgattccgctgctcgctcaaagtatccggcgtgcgcagcgcattgctattgctatggaagccaagggttttgctaatgaaaccaagcgcacgtattattatgcgattggctattcggctgtagatattttatttattttctattttgtggtgatgcttacgctggcttggggattcggtatccgctttccttatgtaggggtatgggatgtacgttaattgttgtcaaaatgctttgcccgttttctgctctgtggtatattaatgcaatgggaattgacggctcgtacagacccgcccgggctggcgggcttattacattttcccgcagaaatggatcatcaggaggccaagtttcatgattacgctgcatcaggtaagcaagcattataccacctcaagcggccaatttcatgcggttcaatccgtgtcccttcaagtggaggagggggaaattcacggtatcataggtgccagcggtgccggtaagtctacgttgctccggttgatgaatgtattggaaaggccggatgagggaaacgtggttgtaaacggggaagacctgactcgcatgccggaaaaacgtctccgagaagcgcggcgatccatagggatgatttttcagcattatcatcttgttcacaatcggacggtcagtggaaatgtggcaatgccgttagagctggcaggtgtcgcgaaaaaagagagagcggaacgtgtgcgcgaatgcctgcaattcgtcggtttagctgataaagcagaacagtatccggcacaactgagcggaggccaaaagcaacgcgtggcgatagccagagcgctggcgaatcgacctgcggtgctgctgtgtgatgagccgacctcggcgcttgatccgcagacgaccgccgatattttgagcgtgttacgggagatcaaccgtgaactgggagttaccattgtaatcgtaacgcacgatatggatgtagtacgcaatatttgtacccgtgtatcagaaatgcgagatgggcagctactttcaacgcagcgtgtagctgacactgcggtaggttcaacagcgggagcaggtgaagctgatgaatgaaatgctgagcatcattgcgcaatatcagtctgagatatggaaagccatcggagagacgtttatcatggtggggatttctatcgcagcagctgtactgttagggcttccggcaggaacgattttgtatttgtgtggtaaagggcaaaaatatgaaaatcgactgttgttcaccctattgaacagtgtggtcaatgttatccgctcattcccgtttttgctgctcgtcgtgtttatgattccatttacacgtctggtcgtagggacggcgctgggcacgatggctgcaacggttcccttgtcagtggtggccatcgcctattattcgaggctggtggagcaatcattgctcgaggtgcccaagggtgtaattgaagccgctacttctatgggggcatccaccctccagcttatttttaaatttctgtacgtggaggctcgttccgggcttgtactgggtttgaccacgtccaccattagcttcatctcctactccacggtgatgggcattgtgggcggtggcggggtaggcgattttgccatccgctacggttaccagcgttttgaaacaggcttgatggcgttcaccatcgtcgtcatgattattttcgtacaaacaatccagttcaccggaagcaccatatcccgccggatcgacaagcggtgatgataggttgtatggtaatacacttgcaccacccactatgggaaataagaatgactttacagtacctcaaaagcggagcgaagaatttgaatctgaagaagcgtcagcgttcgcctttgaaatgggattctaacctataaattgtgtcataaattagagagaatcctatttcaacagcgatcgtaagatcaaatcattcgcgaagcggctgtactgtaactcattttttatcttcccaatcacaatttacttggaggttcctcatcaaatgagtcggaaaaacaacatgaaaacgaacttgaaattacttacactatttgctgtcgttatgctactggttgccggatgcggtggtcaaaagcaggctgctccagaaacacagtctaaagaagcaaattcccaaaaagaagtgaccttgaaagtagcaacgctaatcccaccgatgacagatgtgctggatatcgtgaagccgctgcttaaacaggacggagtcaatctggaaatcgtcgtgctttcagacaatatccaaccgaacaacgcattggcaagccgggaagtagatgctaacttctttcagcatgctccttttatgcaacaatataatgaaagcaacaagtctgatttggtggcgataaaacctatttacaacgccatttacggcgcgtactctaaaaaatacaagaacgttaaagacctgccggaaggtgcgactattgccattgccaatgacccggccaatactggacgttctttagtaatgatggagcaaaacggtttgatcaagcttaaagaaggcgtaggctataatgctacacaggctgatattattgaaaataagaaaaaatttgtgtttaaagaagtggatttgttgatgctggcgcggtcactggatgatgtggacatggctgccatgtatcccgcatatgccaagccgctcggtctgacaccgaagaaggacgcgctgattactgaaaaagacgatacgcactttgccattaatctggtagcgcgtaaggataatgcagattccgatgctattcaaaagctggcaaagcgaatgactggaccggaagtacgtaaattttttgaggacaattacaaggatagcgttgttccagcattttaaataaataagtaagttgaaacatcgttttatgatgaaatacgacctgtataatggaaggaagtctgtgaagagcagatggtctcccttgtgcaggtctttttttcatccttaatatggaaaggaattatcgaaaacagggtataaagtcttattttttaaggttttagggtgttgcaccgctgcgaattttggtcataaagggcgatggagtaatgataaggaacatattaaaataaaaatacgaacaaacattcgatttcgttaacggtgtttttatatgggtcaaaaaattcagctgacaacgggccaaaagcgtgaataaaaaggaaggggaacgacatgaagctgtttgtaactgtaaaaagtctggggaagcgcaagcccgcactcgcacgacaggaaatagagctgagtcctgctccagaaacattgcgagatttgattactgcaaccgttgctctgaatgttcaaaagctgcgggaaaagcaggagagtgtcgcgctgattccgttccttacgggagaagaagtacaggcacaaggcgagataggcaaagtaggattcggttccatatataatgatggtgtcccggatatgaaggatgccgtgaacacggcgatgcaggcatttgaagatggtttatacagagtttttgtatgtgacgaggaaactattgaactcgatactcctttgtcacttaaggatgggaatgagattgtatttatacgcttcacaatgctagctggaggcctatggtagagggggaaatgaaacatgcatcaagagaacaatgagcaagaatatttcaccacactgaaggagcgcgcggcgcaactggatggaccacaacaggagttagctcagtatgttgtggaactgggtaagcttcattacatacaggagaacgaggagccttttaacgaatgtcagcgaatattaaaagaacgggcgacagaaagcggagagtcactgtttaagccactgacagaggtattacatgctctaattggacaaacaacgggcgacgtattcgcacatctaacggagcatgtgactgaatatccatacagcacagggtatgcgcgaaaaccgtttcgcacttcggatattacggcccatacttcccgggtttataaaaaaatggtgcagttgatccgaatggactgtatggggttctccgtaatggattatttaacaaaaaaggattatgaaccaggcagagattaccggattcaggaaacgattggtgactggattgcttatgagctggatcacggtaattcacaggtacttgaggcgttaaaagctattatttatggggataatcaggcggcgttacttacgcgcaatatgattaaaggcatgctcctgagtcatcaggaggagaattatcgcatgatcggcgaaatcttggcagccgccaaactccaggagggattgcgccaaagtatcgtggaacaaatggatgaaggaaccccggaggctctaatatatctgttgaaggtaatcatcgaccaaggcttcattcgttacagttcagtggtgcgggcgcttgcagtatggacgggaatgggcttggaatccgccaaccagcgggtcgttcgtcaactgatcgagcaggcatatgaagcattgactcgtagtgaactgcgccaggaatggctgaccagctcaaatgctaatgaagtttatatgagtttgtgggctacggcagtacatgaggaacatgatttgtatggacaggttcggaaactcatggaacaaggagtaacttaccagaagatcgtagcactgtatgtactgtctaacagtgacaacaaggatgtgcgcctcggaattgcgagagaatatctgggtgaaacggaccaagagcttcaatattggatactgacgaactatacaagcaattatttttatgaatgggtagaaggcgggacggtcgcggatcggatcgttaaagtggtgcgtactcctttgctggagagcaaagaggagcggcgtaaggattttgaacgacttcataacctgtttgtacatatgaaaaagggtgagtccaccgagccctccaaggtgctggattttgttaatctgtatcaccgctcagatgcacctattcaaaaaatgctgtatctcgctggttatgatatggatgcttcctggattggggaaatcatagccttaaaggaacagattagccctaatctgcgtggtgaactgttgaatcattttgtgcaaaaacctgaggatgcggtacaacgtgattttattttttccagtttgtctgacaaaagtatgagtatccgtgagttcgctgtggccaaggcacgtaagctgacgctgtcggaaccagaaatgcaacaaatggaagccttattaaagctcaagacgggatcgttgcgccaaagtgtcattggtgtgttgctctcacaatcggaagagccgctcgctggctcattggaacgcttgctgcgtgctaaggcggagctgcaacgattgggtggactggaagtattgacgaagatatatgcagacccggatcgtgccgaacagtatgaaagcctgcggactttggcggatatcattcagcaacctacagccaaagaggagcaactgctgtccaagctgggacaggaggatgcttatacaggggctaacggttttggactgtacgatccgaatgtcaaggaagcttggttggaagagaaagttgatctgggtgattttcgattggccgatatttttgttagtccattggagaagctcaagcagttcttgagtggactggacgagcttgttcatcatcatcgtgatgtggaatatactgcggagtattattcgggctacaaagatacattgcttatcgggacgaaccttcgtcctctacggttggttcaggtcgatgaagaagtagattccagactatctttatatcctctctatgaggagtgggaccgttatttgcaggaaagcggcatggaagcgcgtgaactgctggagcttgttttttatgaccgattagagcctatggaccgaacgctggatcgctattatcgatacttttcttttaacatggactattcagaacaaagcaagcacaagctgctggaaggatggcgtaaagatttcgctgagcaaatgtatcctttggatcgcattaacgaggtacagaagtggatagcagaactgacctattccgatcaggtaagcacattagttaatgcttattttatggacacatccggtgaccaaacgtttgacgtaattgaccttgctttaaattcactaatgcaaggcatgcctaaggacagacctgaagaggatatgggaatgctccatctattgtctggcccgtgggtggcactggagaaggggcaggtccatgatgatgagtcctttaagcgctttttccatacctttgtgaactacgcagaactgccaggagcggaaaatcgtttttattctccgctggatctggaggattacttcaaagcatatgaaaaagggttgattggtgtaggtgaagtgtatcgggagctgctggctggtagtgaaagcagaagacatatgagttctttaaccaatgcccgcaatacatggatttctagcaaatcagaatttttggagatacgccgtacggttattgatcgactgctagagattgaattggttcgaggcgatttgcctaccgaggctacgccaaaggttatgggcttgagccaatttgaaggtatggattatttcatccgtattctggagggtctcgacaaggaaacgtttgtgcgtggttatgtgtacggctacggtgatcgtattaccaaaaaggaatcgttcagccacttgctcaaggcatgttatccgagtgatggcgaggatgccacgttgctcaaggaaaagctaaagaacactaaaattacagataaacgtctgctggaggcggctatgtatgcaccgcagtggattgagattgtagcagactatctcggttgggaagggcttcgcagtgcggcatggtatttccatgcgcatatcaatgaaggtttttcggccgagaaggaaacgattgtagctcattactcgccgattgctccacaagattttaatgatggtgccttcgatattcactggtttcatgaggcctatgagacgttgggcgaggaacgttttgacctgctgtacgattgtgccaagtatatttcggctggagccaatcatcgtcgatcccagttgtttgcagatgcgacgctgggtaagctcaaacggagtgaaatggaaaaatcagtggaggacaagcgaaacaaagaccatttgctgacctacagtctgattccacttgctcagccgcctgaaccagatatacgcgaacgttatgattttatccagaggtttctggaacaaagcaaaaaattcggcgcacagcgtaaggccagtgagggactcgtttcacggattgcgctcgggaatttggcacgtaacgcaggctatgatgacgtaacccgtctcgtatgggatatggaagctcgtaagctggatgatcttcggtcttattttgagccacatgctttggacgaggctacaacggtgcagctcgtcattgatgctgaaggagcggcagatattgaaattgtcagcaaaggcaagacgctgaaatccattccggctcgtttcaagaaggatgagtatgttacgtcgctgaaggagcttaaaggagatctagtggatcagtaccgcagagctcgcaaagaattggaacgctctatggagtctggtacgacctttatggtgaaggaattgagaggattactgggtaatcctgtgcttgctccgttggtgcggacactggtgttcaaggctgatgatcacctcggatattttaatgaggaaacgttggtattgacggctccttttgctgaacagcatactataggagaagaggataagctgattattgcccatccccttcatttgttcgaaagtggtcgttggagcgaattccagaaggacttattcgaccgccagatacgccagccatttaagcaggtgttccgtgagctgtacttgctgaatgctgatgaacgtgcaaatgcgaccgtttcccgtcgatatgcaggacaccaggtacagccgaataaaacggtatccctattgaaaggtcgccaatggacagtcagctatgaggacggacttcagaaggtgtactatgctgagaatctgattgcgaacctgtatgccatggcggattggttctcaccagcggataccgaggctcctacactggagacagtgcagttctttgatcggacaacgtataagagcgtaccgttgaacgaagttcctcctgttctgttctccgaagttatgcgggatgtggatctggtcgtcagtgttgcccatgtaggtggcgttgatccagaggccagtctgacgaccattgaaatgcgtagggttattgtgcaggaatcacttcgcctgctgaaaattagcaatgtacgcttggatgggaattatgcacgtgtagatgggactcttggcgaatatgctgtgcatctgggaagcgggggtgtctacaagcaagcgaagggagcactgcatattatcccggtgcattcgcagcatcgtggacgcatcttcctgccgtttctggacgaggacccaagaacagccgagattctatccaaagttgtgctgttggccgaggatcagaagatcaaggacccgcaaattattacacagcttcaagcgtagaatagaattctgatatatatagattcataattaactcaacgttcgcacctaaacaatgattttgcatcctcgactgtgtaggtggaaacttagtttagttgcggaggttgagttatttaatattgagcgtttatcgagcacgaataaggagatatgggtaatattttaggttctgtggtttgataggaatctaacagtataacaatcgacgatcataggagaacacagcgatgaataatagtatctttctaaaagagtactcaaccgagtatcaatcacaagttgtcgatttaattttacatattcaaaaagatgaatataatatcgccataaccaaagaagatcagccggatttgcttgatattgaaaatttttatcagcgtggtaacggcaacttctgggtggctcttagtgaaggaaccgtagtagggactatagctttgttagatattaggaaccgtaagacagcactcagaaagatgtttgtaaaacataactatagaggtaaaacattcaatgtttcgaatcaattattgcatcatgccataggatgggctagggaaaggtctattgaagaaatctatcttggaacaacaccacaattcgtagcagctcatcgtttttatgagaagaacggctttgttagtatagctcctggagaattgccgattggttttccagtcatgaaagtggataaaaagttttacagatacgtcattcaataatgggtataaatgaagatgctgctaggccacaaaagaaaccgtcgtctagcaaatgtttcttttgtttaggacaggcgtttgctagaataaaagggtatgttgtaagtcaacgttaaccaaattgctgggagggacacaagtatgagcaaaaagattaaatggggaattgtcggcacaggctggatctcagatcaatttgtggcggatttggcgcatgttacgaatggagaagggtatgctgttggatcacgcactattgaaagcgctaccgaatttgcagctaagcatcaaatatcaagggcttacgggagctatgaggaattagcacaagatcccgagatagatgctatttacgtagggactcctcatccttttcataaagagaatgttctgatggctcttcgggcaggcaaagcagtcttgtgtgagaaacccttcaccgtcaatagcaaagaattggaggaaatgatcggctttgcacgtgagcgtaagctattcctgatggaagcaatgtggacacgttttttgcctccgattcgccaagtgcgagagtggatacatgcgggtctcattggcgaggtaaagctggttaaggcggaatttggttttcgggtagattggaacccggaggggcggcttttgaaccctgagctgggcggaggtgctctattagatgcagggatttatccggtttcttttgcttcaatggtcttcggccctgaacctgagcatgtatggagcactgctcatatcggggagacaggcgttgacgagacattttcgatcttgctggattatggaaaaggacgcacggctatgcttaacggggcagtccgtctcggattgacgaatgaggcatacatccatggaacaaagggctatatccacattccgtcattcttgaacagcacatcggctactttagttgtggacggtgaagaggcacaaaactttcaggatgaccgatcctctacaggctatgcctttgaagcagaagaagtcgggcgttgcttgcacgaaggcttgctcgaaagttctactatttctttggatgaatcattaggaattatgaaactgatggatcagattcgttcacagtgggggcttcggtatccgtttgaataatcacgttaattccagggacctttcaggttctctggaattttttgtttgtgagcgtttttttataccaggattttgcaaaattcgattccaatcgctccgaagtgcaatatatagacgaactaaaccatttcgatcatacataattatttccaattcccaaatagcgactttggtcgcacgataggtaacgccatatgagtcaatcaagagtgggacatatgaatcattttttgtgatttaaattagttaaaaaatagtcattaaaaagttacaaaagtgtaattttattatcagttaagtgaattgtgagcgctctctttttatggagcagaatgaaggtcctagtgctgtacttccaaaaactttcaatgaaattttcgaaaatgtacggtagggtggtaaacgtgtcacttgagccattgcggcttttgctgacttgcttgcttatcccgtggctctcgattcttgtcggagctcgcaggatcgagagcctttgcaagcctgtgagagttgaataggcattcacctcatgacctaacatcaaggaggagttacaaacgtgaaagtgaaatctacatggttgttccgtatggtgatgatgacagttatcgcggctgttgtgatcggacctatgaatattgcaggagcggcaggaagccagacagatcggccttggatgaacacggccctgtcggctgagaaacggacagcgttgctgctgcaagaaatgacgctggaagaaaaaatagatttggtgactggtaaagtcaacaattactatggattttataataattcgatggggcggttgggtattccggcgctgacgatggcagatggacctgcgggtgtgcgcatcgccaatccagatgtgcaggacaagcaatctactgcgttgcctgctccaattgcgttggctgcaacgtgggatacccaagctgccaaacagtatggtgatttgatcggagacgaggcttttaatacaactcataatgttgcgcttggaccggggatggatattgcccgtattccatggggatcgcgaaactttgaatctatgggtgaggacccgctactgcaatcgcaaatggcgaccgcttatgtcaaaggtatacaaagccaccctgttttggcgactgcgaaacattaccttatgaataatcaggaaacggagcgcttcaccacgaatgtcaaagtcagtgaccgtgcgttgcatgagatttacatacgcccgttccaagaagtcatcgctaaggcagatttgggaggggccatgtgctcctttaacaaggtcaacggcgagtctgcttgtgagaacaaaactcttttgacagacctcttgaagaaggagctgcaattcaagggcttcgtgatgagtgattacggtgcgaacctgagtacagtcgaatcagcaaatagcggattggacctggaaacaccggggacaccatatggtaaatggggagatcagctgctggcggcagttaagaatggcaaggtaagtgaaaaaacgattgatgataaggctgggcgcattctgatgcaaatgttcagcaaaggtttattcgatcgcccggctcaaaataatcaaattgatgcccgtgaccatggcaaaacagcccgtcaattggctgaggaaagtatggtactgcttcaaaataaaaacaatgcattaccgttgtctaaagataaactcaagtccattgctgtgattggccccgatgcagataacggcactgtggcaggcggaggcagttcgttggtgaacccgacgtataccgtgagtccgttagagggcatccgcaatcgtgtcggcaaaggagttaccgtccaatatgcaccgggcacagacccgatctctgcaggagacattatgccagggccatctgctgttccgtcttcactgttgactacatctgatcagaaagaggatatcagtgttggatatgcgacttatggagatggcgaacaggggcttcgaggcgaatactggaagaataacaagatggaaggcaatccgattcttgtacgcaatgatgaccaagtcaatatgaaccttggattttataattatcagggcttcaatgcgaagtcccctaaagttcccaatacaccaacgacactgaacggcttgatatctgcacgctggacaggggcaattgcagctcccaaggatggtgactatgcattgtcattaaccagtttgggatcaagcaagctgtatctcgacgataagctattcgtggataatcaaggtgaaaagctgggcactacgaagaaaaacatctcccttaaagcgggtgaaaagcacaagatacgtattgaataccgcgctgattatccgacaaatggtcgtgattccggtggtatggttcgtctgggctgggaacctccggcagatacgtcagataagttgattgataacgctgtgaaattggcgaaaaaatcggatgttgcgattgttgttacgcgtacgtatgagagcgaaggatatgttgagcgttccgatatggaactgccgaacaatcaggatcggctgatccgtgcggttgcggctgcaaatccgaaaaccattgtcgttcaaatgagcggcagagccgtgcagatggatacctggcaggacaaagtcccttccatcgtacaagcatggtttgctggacaagagcaagggaatgctatagcacgcgtcttattcggggatgtgaatccttcgggtaaattgccggtaactttcccggttaacgagcagtctacacccgtgtcctcaccagagaagtttccaggcgtgaacggtataggtgactattcagatggtatttttgtaggctatcgtgggtatgagaaatcgggtattcaaccggcgttctcctttggacacggtttatcctatacgacattcggatatagtgatctgaaaacaaaacagcatgcgagtggaaaaaaatccgatcgtacaagttccgtcgaagtttcgctaaaattgaagaacactggcaaaacagccggagctgaggttgtacaggtgtacagcggtaagcttccgacaaacgtagagactccatcccatcaactggcaggctggtccaaggtagagttaaagccgggtcaagagaagaaggtacgcattgagctcgacccgaaagctttctcttattgggatgaaaagtccaaagcatgggttatgccagcgggtgaagtgcccatttatgtgggcagctcctcacaggatttacgactgacaggaagtgttacgattccggcaacctctacagaaaaagcaaaaaagtaatcccgttacatttgttttaaaatggttatattcaagagagcacgggcacaagcaccggctctctttttgctatcggtatgtaaacgtccaacaggtatgcaaagggaaacccaagtgaaagctgaaatagtagggaggatggggacgggataatgatggggagaggaggatatagatgaaaaaactccaaaagcaacgacgtactgacatctggctgcttatagctgcagtagccattttgatctgtgcggtcctggccaatatggctatacggaatgttccggggccgaaagcagaaaataacgtcaacatgtggctaacaacacccgacccggcgaatcgcctaacccaacaaaccccgatccgttgggataaggataacagtaaagaaaatgcagcgaatgcggatacactgacgattgagattaagccagatattcattatcagacgatggagggatttggcgcagcggtgtccggttcgtccgcatacctgatgaatcatggcatgtctgccaatcagcgtgatcagctgctaaatgatttgtttacagctagtggcattcaactaagttatattcgccataccattggagcctcagattattccgtagatgaacagggacagcctggtagctatacctatgacgatgtggcaacaggcaaggactatgagctgaatcatttctccatcgccaaggatcgggatatgatcgatgtgttgaagcaaatcctgagaagaaaccaggatttaaagattatgggaaccccatggacagctccgccctggatgaaatatggggagcagatttataacggctggtatttggattataccgatccgcgcgtctaccaggcgtatgctgactattttgttcgttatctacaggcttatgcgaacgagggaattccgattcaggcgatttccattcaaaatgagccagaattcacgacgcccaagtatcccagcatgagtatgggagcagcagaacaggcgaattttattaaacaatatctgggtcccaccctaactcgaaaccatttatctactcacattattgcctttgaccataactgggatacagggagtgaatatgccaagaccgtgttgggagatgaacaggctcgtaactatacgcacggaacggcctttcattgctacaagggtgagcctacagagatgacagatgtgcataatgctttccctgataagcctgtatatatgacagaatgtagtgggggagcgtggagtccgggctttggagataatttgagctgggatatgtccaagctgatcattggtgcaccccgaaactggtcgcaaaatgtcctcttttggaatatcgcacttgacccgtccgggggtccgaccaatggaggttgcgccaactgtagaggtgtagtaaccatcgacccgttaagcggtgcagttacgaaaaatgtggagtactatgcgattgggcacgccagcaaattcgtccttccaggtgcggtacgtattgattctacacattatagtgggagtattgaaacggtcgcctatcgcaaccccgacggtacgcttgtcctgattgccgccaatacgggagagaacacaaagacatttaaggttcggcatggaaataaggttttcaaatctacccttccatccaagtccgcggctacctttcaatggaatcctacggcttcctgacacggcctgtaaatcaacgttttagagcgcttagcccatctggctgagcgctctttttttcatttgctacaaaacccagactgcgaaaaaaattttaatattgttcagaattgattcagaggcggatgataagatcttttcactaataacaagaatgaaccgtttacgggggatagtctgatgaatcaagaaacgaataaagaatggcaaaaagtgctgatggtgacgttgctggcaggtatggcatggggaccccattatttgacttttttaagagtccagcttaagtaggtcgtaggagttgctggcagagcgactatatttcaggttcatcaggaaccacaggaggcatctcttttgtttttttacaatatgtcgatggtggagacggtcgcatcgtgctgcaattgttttacaaccgagaatgtgacttctctcataaattagaaggatatgagctggaggttcaccaattcatgaaaaacacgaaccgtatgaacgtatccagcatagcactatatccggttaatccagtaataccgtatctgatcataaatagccccttttacgatttcatggatgtgacgaatgttgcctattttaatcaagagggtcatttctataacccaaatgaatttaatacggtcgcatatgtactcaaatatcatgaaactatacccgaaaggtacttatcaatatgtaggcaggcatacaccttaatcggtgtgtttgtctgagctcgttgtcttttgaagacaggtcatgaattcttataaaggtgtaacccatcaactatcgtgggttacgcctttttgaatactgagcattttgtattgatccaagcctttactgtacaaggagattttcaacatgaaaccatgggcatggggagttcttccgcagcagtatcaatatgcttgaacaatgtacccaactgaattacaatacaattgataatgatttttaatatcaattagaatgaaaagggggagttggactacatgtttggattgaccaaaaagctacatatttatacagcacttattctgttgatatcggtgctggctggttgtgcctcgggtggaactacagggacaacagacccttcaagtaagtctgcaagtggtaatgagagcaatgcagcaggcagtggtgcggacgagcagaccagagttatcaaacatgccatgggtgaaacgacagttaagggaactccgaagaggattgtaaccttgttccagggtgccaatgatgttgttgttgcacttggtgttaagccaacgggtgttgtggaatcctgggttcagcaacccgtatataaatatttgagagatgatctggatggtgtgacgcaagtaggtcaggaatcacagccgaatctggaagagatcaacaagttgaagccggatctaatcattgccaccaaaacaagacatgaggatatctatgatcaactgtcccagattgctccaacggtagttaccgagactttgtttgactggaaagagacggtaaagacggctggtgaagcgatgaatatgaaggaacagtcggacaagttgcttgctgattgggatgcaagggtagcggattttaaaggcaaaatgggtgaccgtcttcccgttgaagcgactattacgaattttagagccgatcaggttcgcattttctatatgggatacgccggaaaaatattgaaagagcttggatttaccagaccgcctggacatgatgaagacacctggggggtggagttgacctcgaaagagaacatccccgatatgaacgcagatatgatcttcaactttaattcaggcacggaaacagaagctattgagaaaaactataaggattggaccagcagtccgctctggaaaaatctcgatgcggtgaagaataataagctagtacaggttgatgaggtggcctggaacatggggggcggatacacatcggccaacatgatgctggacgacctatacaagcagttcaatctgaactaatgggagcaagacctgccatgtaccaggacattcgtatacgaagcgtatgggcaggcaggtctttttgcatttcacggatgaaagagtgagaatatgtttcccctttttacgaaggcaagtacgaaaatttatggactatccggcttattcattttgctattactcgcctgtgtagccagcatgatactgggacgtacacacataacatttcaaatagcagtgaatgcactacaacactatgacgaaagctcagtggagcacgtcgtacttctgacggaacgtttgccacgcacaattattgccgctgttgttggtgcaagtttggcggtggcgggaggactcatgcaagcgctaactcgtaatccgctcgcttcaccaagtgtgtttgggatcaatgcgggcgccatcttttttatcgttattgccatcgtggtgctgtcggtgtcctcgctcagtacgatgatgtggtttggttttgccggggcaaccatcgcaacagtgattgtgtacgcgcttgggtccatcggtcgtgatggtctgactcccatcaagattgtgctggcgggtaccgctatctctgcactttttgcttcgttcacacaggcaatcctggtgctagatggaacgggattacaggacgtgttgttctggcttgcaggttcagtgagcggtcgaacacttgacatgctgtatcctgtactgccatatatgacggttgccgctgtgatatccctgtttatgggccgggcaatcaatctgcttttgaccggtgatgatatcgccaaaggcatggggcagaacgtgctactggttaaggtacttatgggagccgttacagtattgctggccggtggttctgttgcggtggccggttcgattggtctggtaggattagtcgtaccgcatatcatgcgggcgtttgtaggcaacgactaccgctggcttgttccctactgtattctgggcggtgccattttgttattggcggcggatgtggttgcacggctgatcatcatgccgcgggaagttccgcttggcgttatgacagcgctcattggtggtcccttcttcgtctatattgcccgcaagggggggacaaagatatgaggaagatgattacttttcgcaataaaaaagatacgttatccttgcaaatggagcgcaaatcgctgctcattatcggaatctgtatggttttggtattgattgcatccattgcaggaaccagtgtgggtaatgattttatatctccgctgaatgtgctacagacgattttcggtctgggcacaggtgatcatgactttgtcgtgttgacgctaaggctgccgcgtgtgctgttatcgttgcttgtgggtgcagcactaggcatgtccggtgccctcttgcaggggattatccgtaatccgctcgcttcaccggatgtgatcgggataacgggaggagctgccgttgccgctgtaggttttgtcaccctgctgggtggaaccatcagtatcaagctgttaccgttgtttgccattatgggggcgatgattactgcaatcatcatctatcttcttgcctggaaaaaaggagttagcccgattcggctggtgttgatcggaatcggagtgtcagccattacgggggccgggacgaccttcatgctgatccttagtccattctatacggctggtcaggcgtacatctggctgacggggagtgtgtatggagcatcgtggaccgatgttagaacgatcatcccggtgattgtaatcgtgcttccgttggcgatttggtttgcccgcagtctgaacgcacaggaattcggggatgatctggccaccgggctgggggtcactgtacagcgtcatcgttcagcgctgctactgtgcagtgtactgctggccggggctgctgtagctgtcgcggggacgattggttttgtcggtctgattgcgccgcatattgcccggaagctggtagggcgcatgtttggcagcatgctcatcgtttcgggactggtcggtgccctgcttgtgtttgctgctgatctgattgcccgtacagtatttctgccgctcgatgttccggcaggggtatttaccgccggggtaggagcaccgtttttcctgtatctgttgttcaagaatcgaaatcagttttgaggaggagaatgctgtgagtattctggaagccaaggaccttacgatcgcctatggcgcagagcctattattgagaatttgaacctgactattcccaaggggaaaactactgtcctgattggcagtaacggttgcgggaagtccaccttgctgcgaacgatggcgcgactgctgaagtccagttcgggctcggtgctgctggatggcgaagagattgcgaagttgcctaccaaggaaatttcaagacgtatgtccattctgccgcaaggtccttctgctccagagggactgacggtaaaccaactggttcggcaagggcggtatccacaccagacatggctgaaacagtggtcctgtgaggacgaacgcatggtcaggcttgcgctggaatccacacatctgactgctctggctgatcggcccgtggacgcattatctggcggacaacgccagcgcgcctggattgcgatgacactcgcacagggaacagaaaccctgctgctggatgaaccaacgacttatctggatatgacccatcagattgatattctggatctgctgttcgatttgaatgaacaggaggggcgcaccatagtgatggtgcttcatgatctgaatcttgcgtgtcgctatgctcaccatattgtggctgtccacaacaagtccatctacgcggaaggaaaaccggaagacattgttacgcaggacatggtccgcgcggtcttccagatggagtgcgacattgcggttgatccgctgtttggcacacccatgtgcattccgcacgggaagggaaggaagttaaatgaaaccacacgctacagccacttggcttgatgatcaagagatgcaggccttggctgccgaataccgtctgacctgggagccttcgacagatcgtacattttcgatgccatttacggacttgctggacccgtccaaaagcctgaactatttgcaaggggtgagaggcatctttgagacggactccgaaacggctactgtatcgctctttgctaaacgatatgcttacttgatcacagcttcgggtctctatgccatgtcacgcttcaacaaaggcttgaattatgagattgccaacggcacgattgaatccagttattacggagaagcatggcttcccaaggctcggctgaccgattggcagacgacctcaccagaggcggatcagcgtgacgtatggagagatcaggtgattgaacagatattcgccggcaatctggctaaggtatggcaatcgctgtccaaggcaacccggatttcccgttcagtcctgtgggagaacacggccatttacgtatattggctctatgagaacaagtttgccgaaggagccacgcctgaagaaaagcagcgtgtcgaagaggacttccattatctaatttgtgatgcacctgcgcatctctttggtgaatcccgtaacccgctcaagcagtttaatacgcccaaacgggcaacagctgtctcagatacacctattcgtgtacgcaaaacttgttgtttctattatctcgccgcagatgatccagaagattactgcccgacctgccccaaattaaagcattaataccgatgattatcatccacatccccagcctatacttcattgcatctcaatacagcgaatagcacaggcaagcttatgacataacgaaattcagaacttgccttatttgttgtgtgggggttatatcatcaattgagactaaaccatgcctagaatagctgtttttataacattaatcaaagatatttataacatctagtaggataaacgtactttttctataagatgcagtgagacattatgattacttgtttaatcttatttaaggtatctggtagatttcgccatggagcaccaattgagccgcccaaagcatagcatttagtatgtgtcgattgtccacggaggtatgtcctatttgtggttttctttcaggtggaaacatcttggatttcgtatcatgtattcatctaatttttttaacctatttattcctcgttgagcagtttgaggacatagcctagtttgaaatataaaaaaactttttaggactcttattttctctccaataactcactatagtagtcggatattccatttactcccattaatttatgagctggaatacccgaaattctcataacggaagatttcgaaatagctatatcatgatttttcaaatattcgattgcttttttgagtttttctttgttcttattgtgactcaaattgctcagcagctttccaacacttagatatttgagcctcgtcatctttctcttgaaaagactttcttgaagcagcaatcaaatgatttaaaccagaatcatgtagtgtttcaggagaaataccactctgaacaaagaaatcttccatagaacacaatctattttgtttttcacagtcttttagatatttagctagtaatgtatttatgtttttatggacgtgtggtcctctctcacgtttcggtaagtttattagcaaatgttgaacttctttttgatagtaaccgtttaattcctattttactaacttccctgttagttgaataagagtacaatttgtgatttattaggaggacaggaattgatgcatcagcagaacgactttcgcacataagacttatcggaggaatttatggataataaaaggtgcttttcaattggggaagtttctagattaaaaaatgttacgataaaagccttacgttattatcataatattggcttgttgatacctgcatacattaattccaataacggttatcgctattatacaattgatcaattcatctatctggatattataaaaatttgtaagaaaagtaatgtaaatgttaaagaaattaaagccttatttgctaaagccgatactaattaccttaaactttacttagaacagaaaaaagaagaaattaataaagaaataaagaaattagaacaacttaataaacgaatagaactatta

SEQ ID NO: 48 - DNA, 233419 bp, Unknown
  Kingdom: Bacteria, Phylum: Firmicutes, Class: Bacilli, Order: Bacillales, Family: Paenibacillaceae, Genus: Paenibacillus
  misc_feature (77864)..(77865): n is a, c, g, or t
tgtctgcacaatacagcgggcttaccttctcatgaataaaggagaagtctatatatgtatccactttacgaagcagatgatcttgcggtaccagttcttccagagaaaccaattcaaaagattgttgtttgtctcgatgaggtcgcagcatatcaacaccgtccgttctacaatagttacctatattatacaacattaacgcggtgtcgtcttaaataaaatgaacataaaaaaagctgtcgagactttctcgacagcctgaataccctcctgaaataggagggtatctgtcctttcttatgatccacctgtcgtccttactaacgagggcgacagatcttcttcctcaaaaccacgttctcgaagaatgtggcaatccgtaaattgacgcatctgacgcatacctctactaccagtaagcatatcttcaagcacaatcaatcaatattaacccaaggttctccattctttttttacattttttactttcattataaaagcaaacgggcagaatttaaatcgagttccatcacatatcgttcatccccgtgaatatacttaataaccaacaaggccaaactgtgccgtgtatccacttggggggtgcctaataatgccggaaccacgccagccatattcattcgtcgtatcccgcgaagattggtcgctgcatcgcaaagggtaccaggaccagcaacgtcatcagcagaaggtcaaagatgtcattaagcaaaatctacccgatctgataacggaagaaaatattattatgtcggacggtcaacagattatcaaagtgccgattcgcagtctggatgaatatcgcttcatttataactatcaaaagcaaaagcatgtaggccaaggggatggagatagtcaggtgggggatgtcatcggacgtgatcctgcctcccagaagcctggtaaaggtgagaaagccggcgaccagccgggacacgatattatggaaacggaagtcagcatagaagaactggaagatatgctgttcgaggaaatggaattaccgaatttacagcaaaaagacaaggatcaaattgaggttgaatctatcgtgttcaatgatatacgtaaaaaaggcatgcaagcgaacattgacaagaaacgaactattctcgaaaatctgcgccgcaacgcccgtgaggggaaaccgggcattcatcatattagtccggacgatcttcgctacaaaacatgggaagagaagaccattccccaatccaacgcggtgattatagccatgatggacacatcaggctcgatgggctcttttgaaaaatattgcgctcgcagcttctttttctggatgacccgctttttgcgccgtcagtatgaaaaggtggaaattgtctttctcgcgcatcataccgaggctaaagaggttacggaggaagaattttttacccgcggagaaagtggcggcacgatctgctcttcggcttatctgaaagcactagagattatcgacaaacgatatcctccttccagctacaatatatatcccttccatttctcggatggcgataacctgacctcagacaatgagcggtgtgtgaagctaatcgaggaacttataaagcgaagcaatatgttcggctatggagaagtgaatcaatataatcgcagcagcacgctgatgtcagcctacaagaatattaaaaaggatcagtttatgtactatgtcatcaaggaaaaaggtgaggtataccaagccttacgtaccttttttcgcaaacgggaagggggaacggtgggatgagcaccgaccagaaggagctagaatatgcgatatcagaaattatggagattgcagatggattcgggctcgactactacccgatgcggtatgagatttgtccggcggatattgtatacacgttcggagcctatggtatgcccacacgcttcagccactggagttttggaaaaacgtttcacaagatgaaaatgcagtacgattttggattgagcaaaatctatgagctggtcattaactccaatccctgctatgccttcctgctggaaggaaattctttggtgcagaataaactaattgtcgcccatgtgctggcacactgtgattttttcaaacacaacgcccgcttttcagcttctaatcgcaatatggtggagagtatgtcggccacagcagatcgaatcaacagctatgaaatggaatacggttcaaaggctgtggaatccttcattgactctgtactggcgatacaagagcatgtggatccacagatcatcaaaccaaggcatctggataagcagcgctacatggagctcaaaattcgggaacagaaagaacccggaaaacgccaccgtccccctgggccttacgatgatctgtggtcactggacacagtgaagcagcatgatcccgccgagaccgagggcatcaaggtacgcaagttcccaccggaacctgaaaaagatatcgtctggtttattcaggaattctcggaggtgctggaggactggcagcgggatattatgacgatgctacgggacgaaatgctgtatttctggccccaaatggagaccaaaatcatgaatgaaggctgggcctcctattggcaccagcggattgtaagggaactggatttgaccggggaggaaaccgttgaatttgcgatgctgaacgcttctgtcgtacagccttccaagcaaagcctgaacccatactatttgggactgaaaatatttgaggatattgaaaaacaatgggataacccaacccgtgaggaacaagggcgacaaggacgcaaaccaggcgagggtcgagctaaaatgttcgaggtgcgagaattcgactcggacacctcttttatacgcaattacatgaccaagaaactgacagaggatttggatctgtacgtgtttgagaaacggggacccgattggaaaattaccgataaatcctgggaaaacatacgggatcagcttgtgttttcacgtgtgaatggaggctccccttatatcgtcgtcgaggatggagattacctgcatacgggcgagttgaagctcaagcaccagtacgaaggcattgagctggatttgaaatatatggagcgcacacttccgtatgtatatcagctgtgggggcgcaccattcatttggaaaccatgattgagggtaagctcgccttattctcatatgacggtaagaaacatcatcgcaagtttgtatagatatataaaatcaatagccatcctaatttaaaaaggtgcattccgaaaaaacggatatgcgcctttttactacttaataacagctctaagcaatcaccatttcttacggactggatggacatattcttccagaaactacttcctcttaaattcgacgatgtagctttgattgagctgttttccaccttccgaaatgttctggtacatggataaaaaccgggcggatgggctccataccgttgggctgtcataggattggatatcggtcgtaaccggagtggttttacccgtggactggtcaaacacatacagccctctcatgccttgctgatcctcatcataaatggaaaaagcaagcttggacccgtcgctggaccagcttccacgactcattaaagtaccttgaccgacgattcctttctctttgccctgttcatccaaaatgatcatacgggctggttcggatgtattccattttcgcttttcaatggcaatagacttaccgtcaggcgacacggcaaaggacatggcaccctctgcaatggtcacagcctgaggatgattgagagtgaaccgattcagcaccggatacccttgtttatcactgcctgtataaaatatggcgttacccactttttcgacatgagacatcaattcagagcgattcggatcttgaaaactcaattcttcagccttgccatccagaccaatcagctggattttaccatccggtgtgcctgtaatgagatcattctcatcgctccagctcacttcgttagtcatatccagcttgccaatcgatgtaaccttaccactgcttagttccaaaatgtagccctggatatcatatttgctactggtgctaccttcagtaaaaaagacatggcgctgatccggtgataccacagcaagtaactgtggagccttacgacctggtgttaaaatccgctccttgtctgtctctacattatgaatccacagctgggtattacgctcgacaatcagctcttcgtcgctcagccaagacctcgcgtagacatcacccagcctgtcgatagacgataccaccagctcgtccgttacttgctgctgggctgcatccgtgtcaatcacagtaagctgttggcccggtttcataccgaatgctggatttgtctcttctgcgctcttcatgccgcaaccactgagcaatcccccggcgattaagccggtcatgagcacccgcgtggctttctgtctgaaaactcttgtacgggaatcttcgcgatgagagaagccgttcttttgcctatagctgtctatgtttttctttatcatgtacaacggcctccttgttaacgatacccccagtttaatgccagaacatctcatgaatacatcgaattgtttccaagttgtaaacaagacaccattctagccctgtgctaacaatcggccggttacagggagccatcgtgaaccaagagggggagtctaagcgaaaattcattcccactttcattcgtatggccgttgccattttccaacccactatgatctgaagctgtaagctgcaactctccccccatgcgctcggccaatctgcgcgccagaggaagaccgagtccggtaccactgtcctgacgagatcgatcacgacttaaggtagcgaacggctcaaaaatcacgttccattgctccctaggaatccatggaccggaattacgtatatacaccatcacagtgtcttgttctacccgattcgataacgtaatccatccaccgtcccgattgtacttcactgcattatccagcaaattcagtataatatgcatcagatgcttagggtctccccacacctgggcaggaacggtatctatcgaaaaattcagtctacgcgctgccgcttttcctcgaatacggctccctgcatcttccagtaacgtatgcagttccacagcctccgtatgcaattcaaaatcatatttatccagcacagatagccgcagcgagtcctcgacaagctcgtacaaccgttttgtttccttactgatgctttctctcgcttcacgcaccagttcaggatcatccccatacatatccagtaaatcagcataagcttgaatagaggttaatggggtctttagttcatggctgatatttccaataaaagatttttgctgctgctctagctctctcaagcgctgaaccgcttcttccagccggagcttttcgttttccagcgcggtaatgctcttccggatcacatgactcatttggagcattccttcatccagtcttcccagttcatcctgccgccgcagcagtctggcttttggataatgccctgccgatatctgttcggaagcccgagtcagtcgtccgatgtccctcgtctggcgactaacatagcctaaacccaaaataaagctcaatatcagcaccgcaccccccgtccatagaaacaagtgggcaatggcccggtagaactgctgctgtgcttctgttgagctgtgaagctgtaccactcccagtaagccgtctggaccttgaagcggagccaaataagtgattgcgcttccttccgtaatatacgcaattttgccttggatcgcataagagagcgcctggctgacatctgttctaaaagccagcggtagagaattgccaacctcatgcccctgactatcatataaaataacacgcatattactggatacgcccagttccactgcgagcccaggtgcctgcttcttcataaagtcttccggtgattggcgcactcccaacaggtaagactgttttacacgcatttctacaatttcggcctgacgctttaagctgcgttccatttgatctgtctggttagcgcgaataccagtaagcacgagccagctcagcacacccacagtaaacagcagcaaagccgccagtaccagcggaaatttccaacgcaggctcaagcctgtaggtttgcgtttgcgcttctgttggtcggtggaccgcaagcttccttgctgatggagtgaatgatgttcgttcacgtcattctctctgccttatagccgataccatacacggtctgcaatatcgcctggtgtggctcaagcttcttgcgcaagcgctggatatgaatatccaccgtccgcgttccgcccacataatcgaagctccatacctgctccagcagctcgtcccgtgtatataccctcccggcatgggacaccaacagcgccagcacatcaaactccttgggggtcagctccagcgctatggctccaagttcagctgttcggctggacggacgtacccgtaatgggccgaggactacttctgttccttccggggcaggcgctccttctcgctccagcctccgtaccaatgctttaatacgagcgagcagctccctcaggtcaaacggtttgctcataaaatcgtccgcacccagctccagcccgagtaccttatcaacgatatcgtttttggccgtcagcagtaaaatcccgatgcccttccgactttccaaacggcggcacacctcatatccacccagtttgggcatcatcacatccagtatgagcacatctggatggaacaaacgcactttttccaaggcgtcctccccgtcaacggcggtttccaccaaaaaaccctctcgctttaatgcataagccagcgcatttcgaatgctcgcctcatcgtccgctatcagtacttttttatccatgtcctgccctccctgcataaaaaaaacactccagctacctatgttcccgcaaataataatgaatcagacaggtatgacatataaactgctcacgtggatcgttaagatcaaattctgtcatgtcgcgtatccgttctaatctgtattttactgagttacgatgtataaaaagataattggctgtatctaccagactgcccctgttttccaaataataaaataacgttttgagtaagtcactgccatgtgagcgatcatattgctgaagtctccccagcttgcgttcaaacacatttgaaaattcctctttgtccatcgcttctccaagcatatagtgcatttctatatcgctgtatttgcatacacgttgatcaggatacagtcgctgagctacagtaatggcacgacgtgcctcattgtagctttgcagcaactcccataactttttggcacttccgatgcctaaataataatcggcggtaccccaggccttttcagttgaccagtttttcagcgtatcactccaggacatttcctgatcagagccaggtacattctggtgatcattctgctgaagagttggcagaaataatatcgcacgatttgaacggaactcaatatgagacaccacacgccgtcgggtcgattccatactcagtagcccagaaagaatctcttctggcggagccgcagcactttccagtacagccacctcccagtcatattccgggttgaatcccaattgacgacctctccgctcaacctcatgccgcagcggcaacggaggtgtcattagctcatctataaagttcccccgtagtcggctttccgtatcttctaccgccttttcacgcataagttccaacgccatcaccagccgtgcctgctcaataccaacctgctccatatcatccagctcattgcgggcaatgaccaacttggcaactgtacgtttatctacgctaatgggaaaatgacgagcaccttgtaccatcgtccaatcccattcttgtggtgaagtgacaatggcttgacctccattatcaatcaaagcaaccggagctttaaaaagctctgctatattatcgcttacagcctgtatgccactgttctccagcaccatcgtcgttaacgttcgatagatttcttccgaacgtcgcagcagctctgcctgtcggttcaacaccatatccatgacacgctgcgtaatatccgtatagggaatatcggctggaatctcaatcacaggaaggccgcaggcattgctttcttccagcgcactatgagggatttccgtgagaaagcgggtaggcttgatcacaagcgctgccgctccgccctgatgcagtaattgaataatttggcacaatacctcaggctcatgacggatcgaataagccgttgtcatcaacaatacaccttcccggacccagcccttcaggtcagggacttccataatgtcaataaaccggacaacccggcttagcccctgttctccgcttaataccttcgcctccttcaacacgggtattgccatgagctcttgaactgttacacccggtattttcataaagacagaccaccctgctatttattttgcaaaatccttacttcatctaattttcaggatagtgtaccaaaaaagtgtacaaaacaaaaccttttaccgcttggtcaagtctacccacaccagcccattcctatctttaggagctcaatggaacctaaataaaccgcccttttctggaaaaggcggtttattttaatattcaactatttataatgaggtttaagaactatcctgcttgttctccacacgaagcaactgctagcgtaccgacacggctgcacccaacgccacaatcggatcaatagcccgaatacccagtgtacgctccagctctggcgcaaagttcatcgttacaaaacctgtgcaggcaagtacgattacctcagctcccttctcctgaagccgcaacgctgctaccatagccgcctctttaccttgtggagtgttcaagtccagtgtcgtctgcacacctatgggacgctctgtaccgatataggaattgcccaaaatgtggcgaatcagcggcggagcctcctccaaaatggtcaacacgcctacacggctggccgatgtcagagccaagagtgccgcacaagaccccgccccgtatacaggtacagatacagcttgacgagtttcctctagcgccggatcagccgcgcagctaataccgatagacgtacagccttgttcaacgagttgttgcgccgcaagcacaattttaggcaccgcttcccggtctgtgatatcatcgtagattcctttcggctgatcagggatacatacactggtgacaggcagcccgtagcgctgctcaatgacccggccgtgaaggtcgatagctgctttgtcctgcatggtaagcactctgatcactccaagcatgataacttcctcccttttatctctctagcaactgaccagccttcatcattagacgatcatccagatatacatccggtttttgtacgactccgtcaatatgtacacccgcagcgacagttcccccgaaggtattattgctgccaaaagcgacatgaatcgtgccatacactttctcgtcctctaacacaacacctgtaatgcgggctttatcattcgttccaataccaaattcggccagcattctaccatcgccttcgccgagcatatccaacagggactgtccggcttccccttctgcggcgattaatctgccattttgcaccgtcagcagcagcggctcttgtaaggcaccgattcctgctacagaaccgtccaccacaatctgaccctgtgccgttccttccagtggagcaatatacgcttcaccggaaggcagattgcccgattcgccaggattcaaatacatacctgtgctgggaacgccgttgcgcccttctatggtaaagttcaggctatatccatccttttcaatccgtacctgcttggcagcagtcagcaatgcggttacctcttcggtcagcgccttgaccttcggataatcagcagcgattgctccattcatgaacatatcgtctgtcataccaggcatggtcgccaggcgtgctccagcagctgcggcctgcttacgggcacttgtatgtgtcagcgaataccgggtgacacatacaacaacgttggagcgaagcatggcttcggcaacagggactggaggctcctcgcccgatttggagcgaaccttcatcgtcaaaatagctgcttctgctcccagtgccttgccagcctcatatatggactcgcccaattcttttttatcatcgtcggttacgaccagaagcgtctccccagcggtaagtcccaaacatttttgcaatacatttttactgatttcaatacgttgttgactcatagttcttacctccaatttttagctccttacaccatttccgataccagtttgccaatcaaggcattggacaatacaacgggaatccctgagtaatgcgccgctagctctcgatgcgtttccgtatagcccatgcaatccagcacgatcaaatcggcttgattcttgaactgtccggctgctcggcaaaattcttcctcactgccactgtaaggcgaggccgccgcaaactctggattcaatccataaggactgaatttaagcttgaggttattcttctgttcttcgagcggtccaatgagacccagtcttcttccgctggacatggcctttagtacaggaggaagcacttgatctggctcaattagaaaagcgctttgggtatgtaatccaggaaacacaccggtacagagtagcaaaatcgtacgtatgccttgctcctccaaatgtgtgattttttcctggagcagcggctggattttttcgcgtgaaatgaccaccgactccccggtcgtcaagcgcgaggttaatacatattctcccggtgacggtgatagatgctgttgtatatagtccaatgagagcccatccagcgcaccggcctgtaccagctctgcccgtccttccaatgccctttctacgataggggccacatctgaccgaggggcttgcccaatcgtaatcatcccaagcttatacattttgaacccctgctttcgcttcattttattttacgctcctggcgacaaagggcaagcccgcggtctgcccttatttcggttctggtgaatagtttcaacttatgttactgcaactttcctaacataaacaatgttcgttctgaccaaaacaaaggcttatttgttgtgcataaaggataaaaaaacaaaatcatagcgctattattacattttatccctcttttaatgtcaagaaatataacgcagtataaatatctcttccctcactgccctgcgctttgaagtgtcttacctgtccgtatatgctaaaatacttccgtatcggctattcgcctacaggagggcatgatcatgaaacaatctattttgatcgtagaagacgaagaaaagattgcccggcttctagagatcgaacttcaatttgaaggctatcaagtatgtaaagaaaaaaacggaattgatggactggagacgtattgcaaaggcaattgggatctagtgttgttggatattatgattcccggtctcaatggcatcgagctacttcggaggattcgtaagcatgatgcgaacgttcctgtcattttgctgacggctaaaagttccattgcagataaggtcgagggactcgatttgggagccaatgattatgttaccaaaccgtttgtgatcgaagagctgcttgcacgtgtacgggccgcactcagagtgggtgcaacgaaagacacggctccacaagtggtagataaatggcttagtgccggggatttacgtctccatgaaggtactcgtgaagttcttcggggagagcacaacattgagcttacaccgcgagagtttgacttgctcgttcatttactcagacaccagcggcaggtacttagccgtgaacaattactggagaatgtatggggcatagattatatgggcgataccaatgtggtcgatgtgtatattcgctacgtgcgcaataaaatcgaccctacgcgccagctccctgagctgatccatactgtacgcggaattggttatgttctgaaggaatccttatgaagctacaaaacaaaatccatacgtatacctcgttattattcgggattttacttgtggccattaacttctcagtctatttcctattcagccaactttcgatagacagtcgaaaagaccaggtagaggccgcagcagaaaacatgattcgtgggattcaacgtgctccggtatccgtagccgctgtggatcttctccgagcctatgtaccgctggatggcatgcttcggctaatgaaaccagaaggcgactttcttccccctatcacctcttcttccgagcaatctcttagcttgatgaagggcgtttttgatgaaacacggcaggttcgcatcattacctatgaaagcaaccgttacattcttgtatcgctccccatgatttggaccaatggcgaggttgtcaatctccaggtgaccgaaagtctgcaaccgacgatgcagacgctacaggttctcagaatcgtacttgttgctgtcactggaattgcgctcattcctgtcgtggtatcgggaagactgctcggcagactgattacacgtccaattacatctatgattagcacgatgaaagaaattcagcgcagcgggaaatttaaacgtcttccgctccattcatcatcacgcgacgaactggtcgaaatgggtgaaacatttaatgacatgattgaactgctagagcgaaatttcgccaggcaagaacaatttgtatctaatgcgtcccatgaattgaagacgccgctcaccattattgaaagttatgccagcctgctcaaacggcgggggttgcagcatcccaagatttttgccgaatccgttgaagcgatccattccgaagcgatccgaatgaaggacatggcagagcagcttcttctgttggccagaaacgaagaacagtggaatgtcgtgctggagcctgtacgcctgaccagaatagcgacagaattaaaggctacatttgaaaatgcgttcgcccgacaaattcaactggatgtacaggcagactgcattggctataccgatgaaaataagctgaagcagctcctatttatctttttggataatgcacgcaaatacagtgacgagccgatacacctgatgattgatacgataggcgatacagctcaaccctgcataagaatcacagatcaaggaattggaatcccggaagaaaagttatctaaagtattcgaccgcttctatcgtgtggatgaagccagaagccgcgaggaaggtgggactggactaggcttatcattggctacaggaattgcacaagctatacatgctcaaattgggctagaaagtgtagaggggagcggaacaacggcaacgatcatcctccctaccgttccaaaataataagccaaaggagggaataacgatgaaagccatctatgtgtggataattgggggtacgctggcggctgtattgattacaatttgtcttttacagtggccttgggcacggtcgttagcagcttctccattggaagaaaaggccgtcatccaatccgttttgcatcagtatcccggcgaggtgctcgaatcccaacgcttgggtgatttttatctgatcaggctggaacgcgccaaagggaagtatgatataaaagccaatgcctatgacggtgtcatcgactccattaagcggacacaagcttatacagatgtggagcaggagccccaagaccacaattccggtaactcaccaaccagagacacatcgaatccagctaataaacctgacccggtttctctcgttattacagagaaagaagcagccaagcttgctgccaaagcagttaacggaacatccgatgatattgagcttcaccgcaacgacaaaggcctctattatctggttgaggttgaggtgaaaaatgggcgtgaagcagtggtacaggtcaatgcagtatcgggctctatcgactctataacgtgggaaaaagaaaaacaggagcacaacgaatcatgacgacttgatgatcatctcagctcatgttttctcatggttttctcatgattctattatgttcctctcatgttcaagagataagctgtattcatgcttatagcacaaggaggaacaatgtaatgaaaaaaaactatacatttggaattatggcagctacggttctgcttggagttacggttacgggtgtctcagcgaatgccgtatgggccgctaaacctacgggccttattggagcgaccgccgctgccaacattgccaagaaggctgtggggaataatgcacaagttgaagatgtcgaactagagcgcaagaacggaaaagtctactatgaggtggatctccagcaaggggataaagattgggatatagatattgatgctcataccgggaaaaccatccgttcccattctgagcttgatcatgactctaataacgagtcctcccttaacaaaccaaatcacatcaccctgacagaaaagcaggctggacaaatcgcgcttaagcacgtgcccgggagtacccttttgtcttctaaattggataaggaagatggacaattcatctacgaggtaaaggtactcaccaacgaaggaaccgttgagcttgatatccatgcatcatctggcgcaatcgtggatacagacgatgatgatgacaacgaatattaattacccaggtcataattagggtaactaaatacagagctaattaaaacggagcagcgaactttcgctgctccgttttttgaccaatgtgacacaggaaaagaacgaagatggctccataaaactgcacctattatatcttcatgaatagactgataactaacagaggattaccttttttcttcaatccaaagtcaagtgaggttcttatggcgaaatcctatactaaagcacagattcgcaaaatcacccgtcgtttcggcctgatcccgttaaaatcaagcttagtctcatcattataccgaaaaaatgcagtgatccaggtgaaaacgaaaaagggaacttatgcattaaaaccctttagtcgtacaaagatggtccgttcaaatacgattcaacagatggaacgagctgcgagccatatcaggcttttgaaaaagagaaagtatacctacatgcccgcatggctccccactcattccggcaagttatggactctgtatcagggaacgccattttatgtaagtcagtggatcaaaggacggggactggagaccgctgaagatttcgaaaaactggggcgggcacttgctacacttcacgccacctccactggcttgcatcagatggataaaggaaaatcccctccgaccattcaacaattacggatatggaaaaaccaggatcgtctttttcaaagaaaaatgacaaaaaccagtcgacatgataaaacgtaccgcaactggtacaatgctcacggcgaagactgcaaacgtttatccaggcgagcatggaaggatttgcaggatgcatccattatcaggctgcttcggatggaacatcggcatccctccttgatacacagtgatatcactaccccgaatgtcattatttcggatgacggtcatctcaaaatcattgattgggatcgggttaagatcggctcagcctatgctgatttggcaaaggcccttatgaatacgactcaattcaaccctgaatttgtgcaatccttgctgaagggataccaaaaacgcaaaccgctaagccgtactgaacggaagattgttacagctttatataaactaccacgagaagcctggcatgcttcccgacacccgaatcgttcaagagatcgcgaaatcctggacaattgggatcagtcgtggcctcttcgattacaaatcatccatattttgcaggagtgggctcatgtataaaagaaagtgaggagcaaaatgtcgattttatcgaacgttgagcagatgtacggaatcaaaattcagcgtagccgtcaaatgaaggacattcacaagattgagaccgctaatacgacttattgcttaaaaccctacaaattcccggaagaagagatccgttttattacacgtgtcttgtcctacttggatgagcgcgggtttacacgcagccaaaaggtctatccaacagtacaacgagcggcttacatgacctatgaaggtgtttcgtatacattaaccaattgggttcatggactcagaccagaattcacaaaaagaatagacttcaaaaagggaattgctactttagccaaattccattccagtgccgtgggctttcctgtcactgaagctccgccatctagaatccgttatgaaggcttgagcgatgaaatagctggatacaaaaaacgcctcatcccatacagaggcacagcacacctcgtagctctttgtgaggaagtgtcccatcgcctacagcagcccaaagttagagaagccattgctcaggagcaaaaagccgccgcatttatacacggcgactataattatcccaatctgattaaagacaaacagctcaaaatccatatgatcgactttgaaaattgctccctacatgtaaggatgaaagatctctcccatcttcttcatcggaattgtctttggaatgggacaaagatgctgcgcgcgatagattactatcaacgatatcgtccattgagcacccatgatttgcatctgcttcacgcactattgatctccccctatcatgtggtccgcaatatcagaataggcggcttccgttctgccaagcgagtcattccgtcgttcgcgcatttgaacaaataccgacgtgaacttagatcactcttataatctgtcagcttggaactaaacaaaaaacagacccgatgaagcggtctgtttttttgtgttctgacaaccagctacaggaaaagcgcatgccgctaaagccaatcgaattgctgactgtaccggtacaaccaaaaatatatagcattgtaaacagcacttcccccttctacaatgatgctaagactcaatgctaaatggtttcgataagagaatttgggaaactaacaatagaggtgatggtacatgtacaccatgacaatagaagaaataaaagcttatttaaacagaatcggaattcccgaaattcagcctcctaccctttcctatttagttgagctgcataaggctcatgtaaaacatctttcatggcaaacattggatatttttgcaaggaagccggcagccattggttttcgagaatccattcaactcattctacatgggagaagtggttattgttttcatctgaatggtgcctttagtgcactactatattcactagggtacaaagtctctctgcatcgtgccggggtacaacctctgggagctgaaccacgcattaattcatttcatcttgggctaacagtgaacttgctaaatgagcatcatgaagatgaagtatggattgttgatgtcgggctaggcgatatgccatatgagcctcttccactccgtatggggacttatgaacaagcccctcttcattataaagttatggaatccggagttgttacaaaaggttggcgcttagagcatgactcacttgcttcatttgttggcgttgattttgcccctgcggttgttcaggatttggaagaatttatgccgaaacatcatttttatagccgctcagcggaatctccatggtttaacctgtttctgattcggcaaaggcaagcattagaggcgaatgaactcagaggatgtatttggaaaagacgcgggctacacagtttggaaaaaatagaactggataagaagtcgcagtggctggaagtgttggcagatgtatttggcgagccgctcgttaactacagtcgccaggaacgggacgagttatggaaaagagtacttgcggctcatattgaatggaaaaagtctatgactgaatcgttacagtagtgaagcctccaacgtaaggatagccttcaagccacatcttacacctttagcatttccgaggagtgctgcagcatttccaattccttcaccatgttttcgatcagctttgtgaacgaagccaattcctctgagctggaagcctgttgccgggcactggctgttgtgacagctgtttcggattgcacgctgtcaagcatacgggcaatatccagcaccttgcgctgaatttgctcctgtgcttgcttcgaattagatgcaagctttcgcacctcctgtgccacaatttgaaacccgcgccctgcttcctgcgcatgggcagcctcaatcgccgcattcagtcccagcagatgagtctgatcggacagttcccggatcgtaccgctcatctgctcaatatgcttaatctcgtcactcaaatgctgtaccaattcctctgtatgttcctgcgaagaagcagtgttgcaggcactctccgcgatattatccgtattttccctaagctcagcaatcatcccggtcaaattctgcgcaattcgggacacaacggtcagcacctgcgtttgttcgtcggccagctcgttgatttgttccttttccttttcctgataagcttccagtacaagctgggaatccaggttgaacattttggaaagagcatgcacaatagaaaaccaatcctctatccccgaacgctttaaaatgtcgactgcaatatcaagataagcaatgtaagtgcctaaataataatcggaggacagtccgattcgggaatgtacctgccccacaaaaagacggtgctcgataaactgatcatctatttttccatctgcgagagaaagccagtattcacgttgtgtttgttttagtcgctcaatattcgaccatttggaaataatcgacatgagatgcggaaccttttctacatgctcataaaaccgatcgaccacctcattcacaatagattggaatagtccctgataatgatgcaataaagccaaatcatcatcagtaataccaatatattgtatctgttttaatctactctccgcgacatgaatcataagttcctccaaataatagtttacatagattttacattaccatatttatcggcaactttttagaaaatgttaaaaaagcagaagattgattatgatttttttcatagcaatttcagaaaaaatatatataaactcaactgcttaatgatacaaaaaaagaatccggcagcacctgaaatcccctgtgcttgccgaattccctctacgaaacacgttcatcggatacctcacaaccgtatgacaccatccaaatcaacccatggtttcaccatactgtacttgtttattattcgtcttaccgattcaggaggctacctacataccttaacagatcgttggcgctggctcctgtgtagccgtgctcctcaatcagtcgcttaatcacctcattcatccgtttgagctgattagcgtcaggcgttttggtcgaagtcgtaatcttcacaatatccttcaaatcggcaaacagcttcttctcaatggcttctcgcagccgatcatgatgatgatactcaaactttcgtcccttgcgagaatacgcggaaatacggattaatatttcttcacggaacgcttttttcgcattttccgataccccgatttgctcctcaatagagcgcatgagccgctcatccgggtcgagttcctcatctgtaagcggatcgcgaattttcgcccaattgcaaaaagcttcgatgttatccaaatagttgtcaaacagcgtcttggctgattcctcgaaagagtacacaaaggccttctgcacttcttttttcgccaattcgtcatattccttacgagccacggaaatgaaattcagatagcgctcccgttcttcctttgtgatggaggcatgttgatccagaccatccttaattgctcgtaaaatgtccagggcattgatggattccacattttgcttaatcaatgcactagaaatacgattaatgacgtaccgcgggtctaccccggacataccttcctccagaaactcactttgcatttctttcagatcggcttccttgtatccttcgacctcttcaccgtcatacatgcgcatctttttgaccagatccatcccctgtttcttcgtctccttcaagcgggtaagcacggagaaaatggcagccgttcgcagcgcatgaggcgcaatgtggatatgtctcatatcactttggtcaatgagcttggcgtaaatcttttcttcctcagatactttcaggttataaggaatcggcattacaatcatccgtgattgcaacgcctcgttctttttgttagcaataaagcttttatactcggattcattggtgtgagccacgatcagttcatctgcactaatgagcgcaaaccgcccagccttaaaatttccctcttgggtcagagaaagcaaattccacaaaaacttctcatcgcatttcagcatttcctgaaactccatcagtccacgattcgctttgttcaattctccgtcaaaccgatacgcacgcggatcggattccgaaccatactctgtaatcgtggaaaagtcgatgctgcccgtcaaatcagcaatatcctgtgacttcggatcagaagggctgaacgtaccaataccaatccggttttcttccgatataaatacccgctccacgcggaccttttcaatatcaccatcaaattccgtgcgcaatctcatctggcaggatgggcagagattaccttcaatccgtacacccagctccttttcaaaatcgggacgcagctcatggggaatcagatgcagcggatcctcgtgcatggggcagccttcaatcgcgtatacggctccctgatccgttcttgaaaatttctccagaccacgttttagcaacgtgaccagtgtcgatttccccccactgacgggtcccatcaaaagaaggatacgcttgcgaacatcaagccgcctggctgaggaatggaaatattcctccaccaacttttccagcgctcgatccagtccaaagatctcctgctcaaaaaatttgtatcgcttatgtcccccaacctcttctacaccaaaagattcaatcatcttgtaaacccgtgcatgagctgtcatcgccggcgtcgggtctttcttgagtatctcaatatactctctaaaagtgccgctccaggccagacggttgttttccgcccggtactccgcaacgcgttcaaaaatattcatgctcggttcctcccatgactgcgtaatgactatcctccactcctgatgattatggctacactcgtcacgcctttcaggatatgatgcaatccccttaaaaaaagtgtaatacatacctatgcagattgatttcagaattgacctattttttgtgacaggtctctctgctttttcaaaaaaaccaagggatacactgtgctaaaatatacaacaacaacgcggacctgacgcaatatggtacaatataagctcggaataatgggataaaggagcgggagaagtcatggcggttcggcatgagacggagctgtacgctccggtgaaagccttttttgagaacttgggatatgaagtcaaaggagaggtgcgcaactgcgatttggtgggtatcaagccagggcaacagacaccattgattgtggagatcaaaaagacgtttaacctggcgcttgtgctgcaaggcatgcagcgtttgaaactaagcagcaatgtatatgtagctgtagaacgaaatcgtgccaaaaaaggggccgtgaatcaacgctggaacgagctggtcggactgtgccgccagttgggacttggcttgctcaccgtcacccatttcaaaacgaagccgccgctcgttgaggtactgtgtaagcctgcggcgcatagcgacaatgtccacaatgcagcaacggtacgccacggctcgcgcaaggaaaagctgctgcgggaatttcacgcacgcagcggtgaccacaataccggcggcagcacccgacgcaagctggtcactgcctaccgggaaaaagcgctgcgcgtagccgcagccttgcagggcttgggggaagctgccccggcgcagctcgctcgcatagcagccgtcagcacagctgctgccgtacttcagcacaactactacggctggtttgagcgcgtatcccgcggccgctatcgactgactccgtttggcgaagctgccctgaacgagtatgcggcagtactgcaagagcatggcataaaaacggccgctgaaatggccgcaaagcttgacgaggacagtggacagctccagattgcggaagcgccaatcacttactccaccgttgttgtggaagcggaggatgactgacatggggcgatggttttcgctagctccgcgcagtaaattcgctaatcgtctcaccgatcagattcatgcccataagcaattgctcacggcccggatggctaaaattaaggcgaatatgggacgcgccttcactgccaaccgcacatagcgcacctggcataaaggctacgcctttgggtaacgccgcctttagcagcaatgcgctgtccagcccatcgggcaactgcacccatacatacatgccaccggacggaatatgatacgtcacgtctttccaaaacgggcgcttgagcagctccaagattaattgaagtcgagtcgaatattccttgttcagcatcgctaagtgctcatgccattgaaaacgcgagctggtcagcaattggaacagcagccgttggttcatcgtactggattgcatatcggccagctgcttcaaggcgtacatcccttcaatcagcggtgcaggaccagcagcccaacccgttctcagcgcaggagcaactgttttattgaacgaaccgatatagagcacttggccgccctgacccgcatgatccagcgcaaatagagaggggtaagtctctgcaaattttcgactctgaccatgtggactcttgtcatggaactcatttttttgcttcaaatgcaattcaccataagaatcatcctcaactactagcacctcatgatgcctgcacaggtccaaaatttcctgccgcctagccgcgctccataaggagcccgtcggattcgtaaacgtcggcgtggcaaaaaaaagcttgggtcgataacggatcattaaagcttcaagcttatcaggaatgacaccttccccatctgattctacaggaacgatctgcgcaccctgcatagatagcacttgtaaacatccaggagacgtagggttttcgaccaataccggatcacgctcatccaccatcagccttatgatcaggtcaatggcctgctgactgcctgtcgtgaggaggatttgacctggtggtactcttactcctttacgctgttcccactctcccgcaagccatgctcgcaaagggaaatagccctccggttcaccatactggagggcgtcagggccggagccaaacacatcatgggccgcttcttccagcagcttcaccggaaacagctcttgtgcaggtagttcttcagccagagatataaaggagtgtcttctcgcattttcccggatatgacgcactggagaagccaacatcgcagccgttcgtgaagcaaaggaatattgcatgaacatcctccttctcctgaaaaataggtcatgatctccgggctgacgcgtcaggcgtatagctgcttcatctgacgcgcatataaggcataacgttcaatcgcctgcgcccggctggacacgcctaatttcgcataaattttacgtagataattatcaatggagcgccggctaacttcgatctcaatagcaattttgtcatatgtaattccttgtacaatacgttccataataaacacttcggtttgtgtcaattcgtcaaaaggctcggacgccattaacggcataaagggccaatttccacatcgaatccaatccatcggtaaagaagcaaatccttcgcgcaaaccgttgatcagatggattaactggctcggtgatgcctgtttggataacattccatttgctccaagcgaaattagctgctgaaacaacgtaatattatcctcatccgtcataataacaatatggctgtccggagacaaggcccgcatttgtgtcaaaaatggttccgccgttccctcaggcaacctgtagtccattaaaatgatttccggtcgaatcgagcaagccagctccaagccttccgttccggaggaagacatccctctgacaagcaaatcctgctggtcttccaaaataagctttgttcccagcatacttgtaggatggatatctatgatgaccacctgccatacttttctcatatctaaacctcctgagtttacaaaaaaatacatagttagtagcgaaaataattctaaaattagggattgcatatgtagaaattgcgcgaatgtgaacgtataggaagcgaaaaacgtttaaggaaattgtatcctaggacttccttccgatgcaatctctttttccaatatttttatacgactatttcgcttttgcgaaataaataggcccatgatagaattggtactgcaaataaagactggaaatttgactttacacgggagttgaaaatcgtatgcaagcttcacctgaacgtcctcctgccgaagctcagcggagcaattcaagaaaggggttacccgtaaaggcttttctgctattttggttcattcttattatactaggtgctctcgcaacctatctgtatagcaatcacttgaagcagcaaatgctaaacgagatgcaaacccatacagaccaacagattcaagcactcaaatctgactatgaaaagcaactggctgctctttccaaggaagttagcggattgcagggaaaagtccagtccttcaatgaactactgacctttacgaaggataatgcaaacaataagaccgataacagcaataaactgtatacccaattaaacgaagtcaagcagcaactcaatacacttcagaaaaaaatggacttgctaaaatgaatgtagacgcaaaacaagtgaaccggttctttatgttggcccttgctccttttatcggtttgttggggtatattttgttagtgcatccctcattgagctttcctgggtctacttctttgagtttgcaaaaagctgaagtcactctacaaatgcaatcagtaggcaagcagcttgatgaagccaagcaaacggcaacatacaccttgtctacaattcgccggacttctgagctatacaagcaaacgactcaaacgatgaatcagcttgtcgtgactgcctctacgcagtccaagcggcccgcgatcatctatgatcgacgcatcaccgccaaactgggggttccctatgagcgggtagatagcaatcggattaccattgaattatttaaggtaaacccgggaatttatcatggctacgctatgaaggtcaaacttaaagatcctactgctatgaaaatgtctttgggaagtgacaaattgggtggctcggaaaccaccatgcgtgcagtcttgagacacggagctattgcaggcatcaatgcaggcggctttgcggatggagacggcaaacgctatccattaagcactactgtcttgaacggccactaccttactggctttcagtccagttttaaggatttgtccttcgtcggactgagtaacgatggcaagcttatcggtggcaaattttacagtcaaggtgctcttgacagcttaaagcctgcctttggtgctaccttcgttcccgtcctgctgcaaagaggacaaaaaatgcctattcctggcaaatggaaagtctcccccaagcgggccccacgtacggtcattggcaactataaagatgatcagttgctcattattgtcgtagacggctacaatgaaagcgggggttcgggcgcgacgctcgaagaactgcaaggaaaaatgtacaatctaggtgttcaagatgcctataatttggacggaggcggttcctcgtcgcttatacttaacggtcgagtcgtaaacaaaccgtcagatggtaatttgcgtccagtccctactcattttttgttctataaatagctatgtgtagtctgctaacaaattaaatatgcttgccgacgtacggctctatccgaaaaaaagcatcacgaacgaatgtcgtgatgcttttgcctcatttaggaggaatactgtgtcatttctgtcaggcattgagcacaaatataacggtctttgaaatcgttcacttgttctactgacccgcagaatacacattttggacgataacgctccaaaataatgtggtcaccctgaaccaaaatttcgacaggatctccctcattcatttgatatcttttacgcagtgacttaggcaaaactattctccccagctgatcaactttacgtaccacaccggcaggtttcatcgtgatcgtacacctctcctattaagtaataacttacaattttctttccatgcgaaaaactaggtacaaagacactattctttatgtagtattcgctgtctttttgtcgaatcctgctgatcacaggaaattttattacattttttcataaaatcatgaaccatatcaaagtatggtacagaatgtctataatatttttatcgaccggaaagccaattatcattagccctcgctgagaaatttcgcaaatttttgaccatacaacctttatttaagttccactatcatgtagatttgagcaatataggtgaaacttttattaccaactaaggtcctggttctttattcgcatttatacttgttcactcgatgttctttacgataaatctggaaaatccatttgtctcaacgcttcatatacgataatcgcagcggaattcgacaagtttagagatcttactttatctgacataggcatcttgatgcatgtatttggattagcagctagcagctctggcggcaaacctttcgtttctttaccaaataccaagaagtctccatcctgaaatgcaatatcactatatcgctgattcgctttggtcgtcgcataaaaaaagcgaccttcctgatatttctcctgcacttcagcaaaagactcatgatattcaatgtggacagcataccaataatcaagtccggcccgttttaacgtggcatcgtcggtacggaagcccagtggcttcaccagatgtagatgagttccggttgcagcacacgttctagcaatattccctgtgttagccgggatttccggctcgacaagcacaatatgtaatggcatcacgtttcgttcccttcatcattaaattcatcagacaaataacctacagtttaaccaaagtgtataccttgaaaacatacacattcttttattttaacaaaatcagacagatatgaacatcaaacgacaaaaatttcaacccacaccactaaaagccttcccctatacacattcagggaaggctctacatttactttttcgatttcaaatatcgtgtatcgaaatatatgtccgtgtaatcaactgttacgttgcttgaatccgtccataaactcggctaatgcttgacagttctcaagcggaacagcattgtagatcgaggcgcgaagccctcctacactgcgatgccccttcagtccgataaacccggcctgttcggattccttaataaattgtttttccagatcctcgttcgcgaggcggaaggttacattcatgatagagcgatcagcgctgtccacacaaccacgatagaagccttcgctactgtcaatacggtcgtatagcaaagcagctttctgctggttcacacgctcaatgccttccaaaccgccttcttcctgaatccatttcagcacttcattcaccatgtatatggcaaaggatgggggagtattgtagagagagttatttttttcataagtgctataacgcagcatcgtaggaatattgtccggtgaggaagtcagcaactcttcacgggcaatcacgaccgtcacaccagaaggtcccagatttttttgtgcgccagcgtaaatcaatccaaattgagtaatatcaaaaggcttgcaaaaaatatcactggacatgtccacaatcaagggtacggaacccgtatccgggaattgcttaaattgtgtaccttcaatcgtttcgttggacgtcatatgcacataagcagtattctcaggcaagtccaaggaatccacattcggaagacgcatgtacttctcatcagcggaggatgcagcaacatgagccttgcccagtagcttggcttctttatatgctttgtccgaccagctacctgtcattacatagctcccagtctgtccttcgctcaagaaatttaaaggcagcatcgcaaactgcgtacttgcgccaccttgtaggaataacaccttgtagccttgtggattgcccagcaaagataacaggcgttcctgcgcctcattatgaacagattcatacacagctccacggtgagacatttccatgatcgacatccctgttccctggaaatctacgaattcagcttgtacacgttctagtactttgagcggcaatgccgctggtcctgcattaaaattgtaggctctcttactcaacaaattcccatcccttctctactctggtgtggatattatcgctatgatagcagtattcataaatgcgttcaagacttgtataaaaatgttttcaatttcatttatgatgtgacagagttgtgaatgttaacatatttaacatctttattctgtgattttcactttaatattaaaaggtccccggcataagaccggagacctattttgaataacaactgttacccgtaagctaatgcttgttattcaaagcagctatgctatcgacttattagcagtcaaaatacaggctgtattcgtgtggatgaacacggatgttcaccgatttagcttcagaacgtttgagctccacatagttatcaataaagtccttcgtaaatacgccgccttcagtcaagaattcgtagtcagcttccagagcgtccagagcctcatccaatgaaccaggtacgctacgaattttacctttttcagcatcagacagctcgtagatgttgctgtcaagtggaccatatcccaattcgattgggttcagtttgcgcttgatgccatccagacccgccatcagcattgctgagaaggcaaggtaagggttagctgtggagtccggtgtacggaactcgatccgacagcctttaggagtaacagctgctactggaatacgtacagccgcagaacggttacctttggagaataccaggttaactggtgcttcgtagccaggaacgagacgtttgaacgagttggtgcttgggttggtcaaagcgatcaacgcaggtgcgtggtacagaataccaccaatgtaatgaagagccatttcgctcagattagcataaccacctttttcgtagaacaaaggagtgtcgccatcgaaaatagattggtgaacgtgcataccgcttccgttatccccaaaaatcggtttcggcatgaatgttgccactttaccatattgacgagctgtgttgtgtacaatgtatttataaacgagcaggttgtctgctgttttcttgagtgtatcaaaacggaagttgatttccgcttggcctgccgtagctacctcatggtgatggcgctcaattctcagacctgcttcttcaagcaaacggcacatttcactacggatatcttgttgggtgtctactggcgctacaggtacatatccgcccttcactcccactttaaagcccaggttgccgccttcttccttacggttcgtgttccaagctgcttcctcggaatctacgaagaaggaggagctgttcatgccgctttcgtagcgtacatcatcaaagatgaaaaactcggactcaggtgcaaaaaatgctgctgtgcccactcctgccgattgcagaaatgcctcagctttttttgcgatgccgcgaggatcgcggtcgtatttttcgccgtctggcgtagcaatgtcacacaggatattcagtgtaggatgctgagtgaaagggtcgataaaaaccgcttctggatcgggcagcataaccatgtcggattcctcgatgccacgatagccgggaatggaagaaccgtcgaaagcaacaccgttaacaaatgtctcttcatctacttcggaagctggcaatgaaatatggtgagcacgaccagacaaatctacaaaacgaaaatctacccactcaatattattttcctgaattgttttcaatacgttttcaacggacatgtcttcttcctcccaatttttccgaacattaagtcttatacaaccctgaaatgttcatgatcgaatgtttttttctgtcgtcattataaatctcaaacatgacacgggtcaatagctatgtaaggtattttttaaactaatgttagatatgcttacgcccttgataacatttgaatagcacaaaaagcccgaaacatcgggctttttggcaatttaaatctcattactgcgttgcagcaaaacttttatgcattaatgttaaacattggttttaagcaatggtagtaggcgtgtgaaatgttttccccacagcaggagccaatatttccaaatcttttagcaaatctgaaaattgatctgggaacagggattgtacgccgtcacccgtcatcgagttgtcagggtctgtatgcatctcaataattaaaccatccgctccggcagctaccgaagccttcgtcataggaacaaccagttcacgtctacctgtgccatggctaggatcagaaatgaccggcaaatggctcaactgttgcaaaacagggatcgcggacaagtcgagcgtatttctagtgtaggtttcgaatgtacgaataccgcgctcacacaacataacattcggattgccgcctgccaagatgtactcagcagcattcaagaactcatcataagtcgagctgaaaccgcgcttgagcaatactggcttgccgcaagtacccagcttgcgcagcaaatcaaagttttgcatattacgtgtacctacttgcagaatatcggcgtattccgcgcagatgtctacgtattcaggtgtcatgacctctgtgatggtcaagagatcgtgcttttgccccgcctcagccatcatgattaaaccttctacacccgttccttggaagctgtatggccctgtacgcggcttaaaagcacccccacggagaacttgcgcgcctgcagctttgaccaatccggcaatttcatctatctgtgcagcagactcaacagcacatggtccacccataatgacaagctcgcccccgccgatatttacacctttaatagagataaccgtattttccggatgaaaatcacggctggccaatttataggacttcgatattttaaccacattttctacgcctttcatttgacgcagatgttcagccagcttgggctctacgctaccgatcagtccgatgatcgtgcgatccgatccccttgatacatgagcctgcaatccttctttctcaataacttcaacaatagcttgaatatgctcttcaggtgtttgaacaccagcgataacgatcatttttttcttcctctctatgaaacatattttataaaccaacatataggttaatattatgacacttagacgcttgttcgcttttaagcttttattcgttaaagcaactatacctgttttagctatactcgtcaaggcttaattatcccgatttattcaatattctaacttaatgaagctaaccggataatatctacaaattaaaacaatttaaaaagccgctatccggatggttgtatccgaataacggctgtaatcaatcatatactatttcgttgtttttgacttctctcgtacaggaggcagcagttttttcatatctatggttcgctgaatctcccacgtatccgggttagccgcgtcatactgctccaaatacgtaataacctctttggtaatcagtgtcggcgttgaagccccagaagtcacagccactttggctacaccttcaagccactctctcttcagctcggttacatcagaaatacgataagctgttgtaccagcaatctcctccgaaacctgagccaatcggtttgaattgttactgcgcggatcaccgacaacgatcaccagatccgcctgtccagcctgctcagctaccgcttcctgacgtacctgcgtcgccaaacagatttcattgtgtatctcagcacccgggaacttctccagcagctttttcataatgtgcttgatgtcccattggctcatggtcgtctgattcgtgataagaattttgccagctggcaacgtaagactgtcgatctcttcttctttttcaatcagatgaacatgatcaggagcaataccgatagctccttctggctctggatgattctttttgccaatataaacaatctgatagccttcggcagacttctcccgaatcagatcatgcgtctttgtgacgtcagggcaagtcgcatctaccgtagtcagccccttgtctcgtgccagcttgcgaacctctggtgatacgccatgagcagtgaagataacagtgccgctctctacctggcttaaaatctccatacggttcgggccgtccaatgtaataatcccttcgtcttcaaaggaattggtgacatgactgttatgcacaatcatgcctagtatataaataggccggggtaagtccagatttctggctgcctgacgagccaataccatggcatcgactacgccgtagcagtaaccccggggcgaaattctgagtacttccaaaatgagcccccgctttcttcgacacagtatacagctccgataactcggtagctgtgggcatcctagcctttaccggccaattctatgatgtagttgcctccctattatagcctattccaaaggcgcggaaaagctgaccggaagccagatgacaaatgtcgttccttctccttggcgcgtaaccacttccacagacccgtgatgttcatcaataatccacttggcaatagatagccccaacccaattccctctgtcaccccgcgtgattcatctgcccggtaaaagcggtcaaaaataaagggaacctcactcttgtccattccaatgcctgtatcactgatccgtaggcccacctgtccttgataaacaatggcatcaaatcggactgtgccctcaggtgtgtatttgaatgcattatcaatgaaaatgaatagcatttgctgcaaataatccttgctgccatccatataaataccattcagcaacgaaaaatctcccacattccattcggccgttcgctctaaaaactgagcacgacgggcaacctcacttacaagtggttccagcgcaacgggagtcttatcgaacgttttccctgtgtccgctctcgcaagtgacaacatatcactcaccaaacggctcatccgtttgccttcatccgccatgtcatttaatgcctccatagaaagctcgcgaatcatctcttcatccatattcggtcgctctcctggttcggtagtccacattttgagcaaaaaatcaacgttgccacggatcgtcgttagcggcgtacgaagctcatgggaagcatcagccacaaaacggcgctgtgcaccgtacgcatcttccagctccttgtaaaacacctctgtgcgccccagcatgttgttaactgtcccgattaattgaccaatttcatctggtggtccgtcatattcaatccgaacactcaaatcattactggattgaatctgattggccccctcaatgaccttgaccaacggcttcatagacttgcgagccagaaagagacctgaagtcgcagcagcgagtaatgcaaacaacgagccgtatacaagcacattttgtaacctgttcatgagtcgatcctgagagcccgtgaattgtcctacctgtagcagcccgaccaccaagcccaactcctcggatttgatcggctgttgaataatcataaaggaatccccatttacgttcacacgtcgaattccctcattttgaactgctcctgccgctgtagatggaacagggaaggtgatattgaggtctttcatattttgggtcgttttcgttacaccagacgtataattgtaaatttgtacatagagctgtgagtcatctattccacgtccctgctctaatcccaaatccaggttggggacttcaaacaatcccccttttataataaggcgtaattgcttgttaatctgtggcgcctgagtcataagctgacttttcacttcattatacgtgtagtaatatactagtccgtaagtaaccagaccaaaaatgactagtactatagccaagatgctcgaataccaggccgtcagccgccaccgaatagacatattacacatcacctcttaaaatatagccagctccccgaattgtacgaatgagtcgtttaccgccatcctgctccgttttttgtcgtagcatggcaatgtatacttccagcacattcgattctccgctatagtcatagccccaaattttgtccataatcagatcacgcgacagaacacgcttcgggttttgcatgaacaaatggagcagttcaaattctttggccgtcagttccaaacgtttgccgccacgaaccacttcacgggattcgttatccagttgtaaatcctcgaaggtaagccgatttccgttattgtcctgttgttcggttttacgccgcaaaagcgctcgcactcgtgccagtagctcctctagagcgaacggcttaacgagataatcatcggcccctagatccaaccccttaacccgattctcaacctcatccttggctgtaagcatcaggacaggtaccgtacttccaccctcccgcatacgacggcatacctcaaaaccatcgacctgcggcatcattacatccagcacgaccacatcaggctcagctgtcaacattttatttaatccttctgctccattggcggctgtcagcacttcatagccttcaaatgccagccctctgcgcagcatggaaacaattttttcatcgtcatcaatgattagaatagtagaacgcatacacgatcgaactcctttatctcttcttttccttctattgtagcaggagtagacgcgtgtagcatctggctgcttcatacagcaagaaacggaagggatcttccttccgtttcttacgtgcacttgttcatttttgtagagttttcatcttattgctgaagcgtcgagctaaagtcatttttgttgccaattttcagctgaacatcttttttctgccccgctcgttcgatgttaagtgtcagcgctgtacccactttttgtttttgaatgaactggatcagctcttgtgatgtgctataaggcgtgccattcgctccgataatcacatcgtaaggacgcagatcggcctgataagctggtgatttgtatataatatcccgtacaaccgagccttcggtcagggatgtacccagttctttggctacttcaggactcaaatttaacagacttgcaccaatgaaaggtacaggttctttcggaataggctggttatttttcagcttatcgacgacttccaaaatcgtattggacggaatcgcaaacccgattccctgtgcgtctgcactaactgctacgttcataccgataacctgcccttgcagatttaacagcggtccgccagagttaccagggttaatggacgcatccgtctgaatgagatgcttgtattgcgtcggttttccagtcgattcactattaatagtgatcgtacgttctttcgcacttagcaccccggctgttaccgaatgttcaaagccttcaggattgccgattgcgaccatccattcgccgactttagcgttatcggagtcacccaaagttactgtcggaaagttgtttttgccttcaattttaagtaccgccaaatcaagatcagcatttttgcccaagactttggcttcgtaaggcttattagttccctctactgtaacctgaaccacactcgcgccttcaacaacatggttgttggttagaacgtaacccgatttatcaaaaataaagccggaaccaataccaagcggagtcagctgcccgctgttgctaccttcattttcattactgttaccgctgctgccactgtcaccatactgattaccgaaaaagtattgatacagcgggtcattgtaataagggctgctttgtctgccactgctaccactggtttgtttggcaagcgtttcgattttgacgactgccggtccagccttggccacaacagattgaacatcagcggtacctgaaggcatcacagccggaactgcgcttggagtcgagctggtggttcctgaattagtcgtttctccgctttcagctgccgccgaagtcaacgccgtctcgggtgtgaacatatttgttcggtcagctgtatacatcaataccgtaatgaccagcatcccggccaaaaaagataagaatattgtttttacctgcgacttgggcttattcggtttgaattgccagttgccgccattccgacccgaaccatcctgctgctcaggcatagcccgatggtaagagggaggaagaggtctcactgcctgcggtggcgtaatctcaacatccttttccaccgactgcccttccttacgttgtccgtccgattgaactgaagaaaaagggccgtaagaataataatatgaggaaccgttcgaatcgttttggcgagttgcgttatcggtatcaacctgatcgttgtcgttccggcgtccggagttattatttttaaattcgtccattgtatatctcctcccaaaccctatgcttcaaggtggtgttgtttaactgactttattttgcactttaaaccttaattccaccttaaaaaaaattaaaaaggagataaaaccttagacctattgtacctaatcacttttacttaaaacgaaatgccccggatataatccggagcattatcgattgtatatgcttttttatttcgtgttaaagttttcatcgaacttttcgttcggtgtttgagcattattttgaattttgttgcgactggagttttgaactttttgtgctactgcacctgtaccgccttgatctgttgcaaattcttcatcatacttctcatttggtgtctggaagttgtcttgaattttattttgttcagactgctttaccttttgtgaaacgacacctaccgtattgtcttgtgcaaattccgctttgaactgatttcctgtgcttgccttgaagcctttgttcgtgaaagaacttccgccttgatttggcataattctcaacctcccagtatgttttgcgggataagctcatcccgcaacatagtatgtgatgttggaaaaaacaatattcaaggattatatggaagcatccagtgtcgcactcggaatggttttatgcgtttctatcgccttttggagcgattttaccatcttttccgtacattttccgttccctttttttataatttgaacatccacatctttcttgccccattcagaatacacctgccgggttgttttaaaatacagatcaattttattgcccttaatcgcagaacctgtatctgctacaatcccgtatccataacctggaatgtacaatatgcttcccaaaggaaacgttttgggatcagccgcaatcgtagacagtgtgttcttgtcacgacgcacttttacaccggaatacgtaataccgtagccgggatgacttggtcgtttgccagtcgattcatagcctgctgtatatcctgttgccgtgaccgtcatggtcgtaataacctgctcttcgcgtggagccaaaacaggtgtggactgccattttttatgctggaccggttctttgtgaccgtaaacttcattgccgggcaataccagacaggttgcaattaacacggttcccaaaatccgtttccataccaacatggatctcataaaaaacctccccttgaggcaaaggctttccagaaatccattgctttatacgaaaagattattatttttgaacatcctgacctggataaagtctgctcagcttcactttatcttcaaaaatatgcaggagggtccgcactatgggggtgtgctcatcgtctgtgtgcaatataatggaagcaggagaaatcgaaataagggtacttacgattcgatcttcgacctccatttctagttcaatgcctggcatctcgacaatgatgtcatctgcatcaggagtcggaatgggcaccatggcactatccagaatcgtaaaattatgtccgccttggtgaagtacgtgtacgagcggaactttgctttcctgaaaaaaaacaaaatatttaagcagccccataaattcttcgtattgccgatctgcccagaattcttccatggcatagtcgacgatttcttcaagctcttttttatacgcatggagcctaaattgaatcagtccttccaaattgatcacatgaagctccttaaaatccttctccagaagagtggtcagcttaccatgacgcttcaaacggcctctcgggccatcatcgtttaacagtgaacgaatcatactgcgaatttgctctgtatcctctttctccagcagcgaacaggctttggtgagaatgagattgagcaatccccactccttgacttcgataatataatccgctattgccgaagacatgatgctgtatacacaggggagaaagctttcaaacgccgaattgctttctgtgcccttgcaggtccatgccactttgttgtccagctgtctgaaagtgaatcgaaatccgcgccgtgacatatgtagtccctttgttctacttttgaccacttcataaaaccggtcggtttcctgatctccgtctgtattggtccacactgtaaacagttccattggctcactcctttcgatcactgctttcagtatatggcggcctctaaagggttatacgaagtgaacgactggaaacagaaagacatatccaaaagaggatgatcaagcttcaaaaagctggttggcgtgttataaacaattactgtgatataggaaaataacgaaagacgtttgaatatttagggtggggtatgttaaggttaaagtaatatgaatttttcacaagagggaggagataagatgttaacgatgctgaacatgctgcgtacattcatgatcgtcatattgagcctcgttcagattttgtcccttcctgtgacttttcatgcggaagacaccactcaatcccttcagtttactgcgggatcttctgttgtgcctcatgctgatgtttcctcgttagaaacagattctcacggtctggagcaccattccaaaccagctatacgcaaatcctcccctttacttcatctggcgatcgctgcggccaaatcacttccctttgccattttgatagcgcttgtgctgctattgagcatccctaaactacgtctaccttttattcctgtcatttgcaaactaaagaagcaattgtacttgttccccatcaaattcacctctagttatgtggcttaacctccctttgcatgcacatcaccacattcgcatgtctatttgttaatattttccgataattgtaatacgtaagtgtatgtatcaggttttttacgttaattcataaaatttaatacaaaaagaaagtttccatgtcactcccagagtatgtgatttatttcccataccattcatttaaataacgtatcgtacaggaggctttataaatggatattcgagagtctattttgccaggaatcgggattaagtatcgaatagatgcagagagtggcgaccgaattatcattattattcatgatgatggcagacgcgagttgtatcactttgattacgaggatctggaacaaagtatttctatgacaaccctgaatgatcaggaagcgcgattggtagcctccatcatcgggggtatgacatataagcccaaacagcttgaaagtgtagaaatgacgtttgatgattttattatcgaatggtatagagtggaatcccactatgcaagtgtcggcaaatccatcggtgagctggatgtaaggcaaaattcgggagccactgttattgccattgtggagaaaaaaggaatgaaatatgtaaatcctggtcctgaagtgattattaacgatgatgccactgtagtcgttgttggggaacgcgatcagcaaaaacgctttaaacaaatccttatgaacggaagcgggtgattggatggatcatctggtatttgaggttggattggcaattgctctcatcgctgcagctggacttatttcctccaaactgcgcttctcggtcatccctttttatatcctgatcggaatggcagttgggccgcatgcgatggagctatggcattttgattttcgctttatcgaaagcgccccatttattgattttctgggaagaatcggagtgctgtttcttctcttctacttgggtctcgagttctcagtaggtcggttaattaaatcaggccgttccattgccgtgggcggcaccatttatattggcatcaattttacactggggctggctcttggcttcctgagcggctttcctgtagcagagacactggttatcgccggaattacaacaatatcatccagtgctattgctgcgaaggtgctggtagatctcaagcggactgccaatgcagaaacagaaatgattttgggcattattatgttcgaggatgttttcctcgccgtatacatctccatcctctccggattggttcttagtgattcatcctcgctcgggggtgtgctgctatcagtgctaatcgcgcttggctttatgcttgcagtcattattatcggtcgtaaggccgtccctctgttaaatcggattctccgtattcgctccaatgaggtattcggacttgttgtttttggctctctgtttctggtggctggtttttcggaaacgattcatgtggcggaagctatcggcgccctgttggtcggtctggtactggccgaaacggaacatgccaaacgaatcgagcatttaattgttcctttccgcgatttcttcggtgccctgtttttcttcagctttggactatccatcgatccactgtccctgggaggaaacgcgatatggcttgcgctggcagcaatcgccctcacgttgtttggtaacatttgggcaggaatgctggctgggcgtacggcctccttatctcccaaagcgtcagcaaatatcggtctgaccattgtggcacggggtgaattttcgattatcatggccaacttgggcaaggaggacggtttgcttgatattgttcaaccctttgcagctatctatgtactcatactggcgattcttggaccacttctgacaaagcagtcaaaacctatctttaatatgttaaacaaaatatttaagttcaaggacccccgcctacgaaaggaagaaagtaactcggcataactgcaaaagctggatacgacaatccataggagggaaggctatgccgcacgctgtaaaacatgccgaaactctatgaggcggcttgtgaagcccgcttcaggagatgcgagcaggttccctgtcttttatacggtgattggtggaattacggcatccgtcggtctggaattgtttttacatccgcatgatatgatcgctggaggcgtcacggggatctccagactcatgtcgctttatacacaggagcattttgggttactgctattcgttttgaacttgccactcatgttgctgtattctctgtctactcacaaacccatgctgcttcgggcactacccggcttgttcgccttttcgggctcagccattattctttcgccttttccggcagtgagtggccatccggtcgtatgcgctttgggcggcggcatctgtatagggcttggcgcagggctggcagctcgtcatggtggtctgctcgattcactaggacttaacgaatctgacgatggccgtccatccagattgttgctaacacaccgcaagattccattaatacagattgttatgctgtgtaatggtctgttgctcattacagctggctttgtgctaggctgggagccagctctctattcagccttatcctgcctcgccgcctatgaaacgacccggctgatgtttaccggtctgacgcgtatggtttgtgttgtcagcaagaaacagcaaaccgtcgaggatgccatatatcgcaggctgcgtatacacagcacacctgttggaggctctgcacagatagagagtaagattaaaagcgaatctgaggataaaaaagaacaaatagtcatcgtttacagcgttcatctgttggatttgcagcgctttaaggtagtcatccaaatggctgacccgcaggctgagatcatgtatatgaaacgatggaaaacatagcaaagtaacacatcaaaaaacgcttatctacactaatccttgtacatagattagtgatggataagcgttttgtaattaacaatatattaacggatattaattttgcatgataaaatcatgttcaatactgctggcactgtcaaaagtacgaataatatcataacgggtattgcgctgtgccggaatgtgacccgtctcgcggatcaactgtaaaatggattcgatgttaaccttatatgttgcgcccgcagcggatactacgttttcctcaatcatggtgctgccaaaatcatcgcaaccgtagtataacgattttttaccgatttcaggtcccatagttacccatgaggattgaatatgcttgatgttatccaatacaagacgactgatggcaacggtcttcagatattcctctggcgtctggcgttccttcttcagattggtattgtctggctggaaggtccaaggaataaaggccaaaaatccttcagaattatatttgttttcaatgcattcatcctgagcatcacgaacacgcaacaaatgcagcgcacgctcctccatcaactcgccgaagccgatgaccatcgtagcagttgtgttcatcccaaccttgtgagccgtttgcatgacatccatccaatcacgccaagagcctttgagacggctaattttgcggcgtgtgcggtcatccaaaatttctccgcctccgcccggaagcgaatccaatccagcttcatgaatggctcgaatcgtatcttccatggatagaccggatttttccttcattttgtgaatttcagctggcgagaaggagtgcatcgtaatatcgggaaaacgctccttaatagctttcagcaaatccgtataataactgaacggcagattgggatttacaccgccttgcattagaatttcggtgccacctacctcctgcgtttccttgatcttctgaaagatcacctcatccggcaaaacataaccttcatcggaacccggtctacggtaaaaagcgcagaagcgacagtatacgtcacatacgttcgtatagttaatatttcgtccaatgacgaaggttttaatgggatcggggtgcatgcgattcatgactttattcgccgcgtgacctattttttctacctcgtctgattcgaacaaagcaacggtatcctctaaattcaggcgttcaccgcgtagggctttatctaaaatatggtcgattacactcatggtgtatcctccttcgctgtcacagggcgacgaaatgaacgacaggacttatgaacgagaatgctttcacaaacctgcgttcgaaccctgccgtaatgtatgttcatgactggccttgtatgttgtctgtgctatttagcatagtaaaacctaatgataatactaacatatctttaggtaaggaaccatacttattcccgcttctttctgcttttcacctaggaaaacaggcaactgcaagcttatctcaacattgcgtatagccaagaaataacaaaacaggactgaaagtgccttttttcacactgtccttcatgtcattcttatacaaaacagcaagcctccagaaatactggaaacttgctgtttagcactgtacatatttgctctcggcgtgaaaacgacaaagatgctgcggatgtgctaacgctctatcgcagcgcctcatccagatcactgatcaggtcatcaatatcctccaaacctacggagaaacgaagtagtccgtccgtaatcccgcgctccaatcgtacactatggggcatagccgcatgtgacatcatcgccggatacgacaagatgctttccacagctcccagactcaccgctacaattggaatacgtacgcgactgaggacttcttttgcacgctcaccagaacccacatcaaacgatatcactgcaccataaccgctggattgacgctcatgaacttcacgccctggatgattttccagaccagggtagtatactgcctcaatgtcgttgcgctcgttcagccagttagcgagcttagctgcactcttttcgctgtgagccatacgagcctccagtgtcttcataccgcgcatgagcaaccatgactcctgcggagccagtacggtacccagtccattttggagctgcttgatttgtctcccgagcgattcggtacgcgctaccgcaagtcctgccagcacatcgctgtgtccgcccagaaacttggtcgcactgtgcaatacaatatcgactccctgctcaatcggacgttgataataaggtgtcataaaagtattatccaataaagttaaaagtccgttgtcctgtgcccaagaggttattcctgctacatcggtaattttgagtgtcggattggacggggtttccatatatacagcccttgtattctcctgcaacgcctctttcacaaggttgaggtccgtcatgtcgacgaaggtcgtttcgatattcatccgtttcaaaatggaggtcagcagtcgatatgttcccccatatacatcctcggaaacaatgacatgatctccagcggataaaagcataaaggtagtagagatggccgccatacctgacgcaaaggcaaagccgcacgccccgccttctaataaagcgatataatcctccaaagcttgtcgtgtcggattacctgaacggctatagtcatgctggggaggattaaaaatatcatgatggtgaaaggtagaagcttgatagatcgggacgctcgaggcccccgtaacgctgtcaatttcagaaccaaaatgcagcagcttggtagcgaacttccgctctttgttcaaatcctgcccgatcctcctcgcatcctctatcattgcagctctcctccttctacttcttgacgtgccgcttccaacgccgaacgcaaatcttcaatgaggtcgtctgtatgctcaatgcctacggagaaacgcaatagcctgtcatctaccccgacagcatcccgaatttctgctggtatgtccgcatgtgtctgcacagcgggataggtcattaacgattccacaccgccgagactttccgcaaacgcaatgagcttaatgtgacgaagcaaaggttccacataacgagcatcctttactttaaaggagaagatacctgtatttccgctggattgtttattttgaatctcacgacctgggtggccttcgagagctggatagaatacttctgccaccgccggatgcgtcagtaaatagttagacaacactgttgcattatgctcatgtcggtccatacgcagcgctaacgtcttcatccccttcatcaactgatagcagtcactcggggaaagcacggctcctatggaattgtgcagaaaggaaatttcagctgatagctctttgcctttggttacgattaaccctgccagcacatcgttgtgtccgcccaaatacttggttgcgctatgtaccacaatatccgcgcccagttccaatggccgctggaagtatggtgttagcagcgtattatctacaatggtaagcaactgatgttgtgatgcccattcagccaccgcttgaatatcagtaatcatcattaacggatttgtaggtgtttctatgaatacagctttggtgttcggtcgacatgactgttcgagtgcttcaagatcgttcgtatccacataactggctgttataccaaatttagataatatgcgctccagcaaacgatatgtcccgccatacagatccagcgatactatgagatgatctccctgtccaaacaatgcaaataccgtttgaagcgccgccatacctgagctgcatgcaaagcctgcatcaccagattcaagtgcagcagaagcctcttccagtacctttcgcgtgggattgatcgtccgaatgtaatcaaatcctgtgctttgacccagacggggatggcggaacgccgtagattggtaaatcgggtaattaacagccccggttactggctcctctactgaaccgatttgtgccaatctgctttcgattttccactgtttttcactcatatgaatcctcctgttaacttccatagtgggtgctataaccaatcctgcaaaaatggatgtcaaagactatactgctgcgctactgcaaggtggtactgtacaagggtaaactacaagccccttttttaaatctggggcccgatatcgtaaggtgtctcttggtatacataatagttcagccaattcgagaataataaattggcgtgcgcccgccagattgagggcggtgtgcgctcaggatcatcattaggaaaataatttttgggaacttcaatatccattcctttggccacatcgcggtcgtattcccatttcaatgaaagcgggtcatattcagaatgcccagttacaaaaatttgtttaccgtcaagcgtggctacgaggtacactccggcttcctcggattcggataaaacttctaattcggcgatatgatcaatatcttcccgccgaacctccgtatgtctggagtgaggggcataaaacagttcatcaaagccgcgtagcaattttactttaggtttaatcacggtgtgtggaaatacgccaaagcatttgtagtcaagcccgtatttcgggacattgaaatgatggtataaacctgcctgtgaggcccaacagatatgcatggtcgaagttacattcgttttcgtccactcaaagatttgccggatctcctcccagtagttcacatcctcaaactcaagctgttcaaccggagctcctgtaatgaccatgccgtcaaaacgactgttcttgatctcgtcaaacgttttatagaacatgttcaaatattcttgcgatgtatttttggatacatgagacttcatgtgtaccagcgtgacgtccacttgcagcggcgtattgccgaccaggcgcaatagttgggtttccgtcgtttcctttgtaggcatcaaattcaaaatggcgatgcgcaacggacgaatgtcctgatgataagctaggctttcatccattacgaaaatattttcgccctccagcacttccttggcaggtagcgtgtctgggattttaatcggcatgtaaactcactccttgttcggtaagttttgcgaaaatcgtcctgctgagatgccgggcatataataaaaagacctttctctggttagagaaaggtcatatttgtatccatatgcgcctctctcatctgtcagggcaacgctctttgtacaaagcgcgcgtcctgcaagaattagcaccgtgcgattaaaatcgccggttgccgggtatcatcgggctagtccctccacctgctcttgataagatttcgctatattcattttgggttcacaaagttcttgttgttcactttaatgcatcggctgggcttcgtcaagatgggacttttaaatttgtgccctgcaatcacattttgtctaccttttccataggttaaatcatatccctcctttcgctgaagctcttgccactactgtcgatttagcccatgattttgcgcttgaaaggccgtaggccgagcgttatactatacaagtgctattaggcaaaaatatggagcagtagtgcagactttgagtgtttcctgcgatactgtggcaatctaaaaaagaacatttgagaggtgaatccggaatggaaggcgacccgagtccgaataggcggcgatccctgaacaacagcataggaatgacttcagcttgccgaaagacgggacgccaggctctgcatgctccaaaagcctccggcttttgatgagaatgcacgcttacccgcaccggctaactggctaactgagttcattccttatgcttaaggtaaacgtatttccgttacgacggagcataaggagtgacatatatgaaaatccgtttggtcaacaacggggtttttacccctgtcgaagaaattgaaatggcgcttactgcaccggcagaaggtttttattggattgatgctgatgtcgatgatttggcagtgctccaacctttattttccatgcatgatcttgcagtagaagactgtttgagtgaagaagaacagcgtccgaagatcgaaatttatgaaagccattattttatcgttgtaaatagcattcgttttgatgatgaagaaatatttttgcgagctttgaacatttttctcggccgccattttatcattacggtgaccaagcagaaaatcaatgagcttcgtaccctcaagcctatgctgtgggagcaagaagtcagccagcctgaccgttttatgtatctgttggtcgacttgattgttgacaactattttctggttggtgaccggattgaggtccgcattgaaaagctggaagaagatattctaatgcatacgaaaaagtcgcatttgaacgaaatcatcggcttacgaagtgagattctgtggctgaaaaaggtgctgggtccgcaaaaggaagtcatcaataccctgaacaaacgggatttgcgactcatcgacgatcaattacaaaaatatttcagcgacatttatgaaaatgctgtgaaaatttcggagacttttgaaacttaccgcgatttgatgggtaaccttcgagaagcttatcaatccagtatcgccaatcgtgccaatgaaattatgcgtgtgtttacggcaataacgaccgtatttatgccattgacggtcattaccggaatatatgggatgaacttcgataatatgcctgagcttcatacacgttatggctattttgtcgtcattggtattatggtggcactaggtgtcagtatgttctgtattttccgtaagaaagactgggtttaaaaagaaaaggggaaaagtacggagttggatacctatttcgattttcaagcttgatcataaaaagcagcagccgtgtcctatgaggaactggctgctgctttttagtatgttggaccctgaatgtactttaatactttagctttatccaatcagttctatattatccaacatgtcggtcgggtacctgctgatggcgaaaccgtatacggatcagacgcagacgctcataaatttgatccaatcctgtttctgtcgccttttcttccccatacactttcagcatgacaggcttgagcaacgtatcccccaactcttcataagcagaccagatgactgcctgctcctcctcagatacattcaccaattccttgcggatcagcttctccatatcaatgccatccctgtccaaatgctccacagcttcaatcatttctctacgatgcaaacctgtcttcatcccgatatgctccagtgaaagaccgtccgaaataccttcgataatcgttctagttaggctgaacttattcagctcctgcctgtattggttctctttttgcttgtatagccatgacaagaaaacttcttcttccagcgtctctgttacccagttcaacggaaatggcgtggtccggtcattttgtgtcgtaatagccaatagctccgtcccatattgcgacaccttaccctgacccataccaggcagctccaacaattcttcttcggtatggggaagatagacgctaatgagccgaagcagccgattcgtagcaataaaataaggcgcttttcgttccgttgctgctttttgccgtctccacattgtcaactgctcatacacttcatcacgtggaaacaaatcactgtagcaatacagcttttgcagcgtttgtcctcgtcctgatgatccttcttgctcatgaaatacgccatggattaagggcctgtagccctcagccattttgagcgccagctcatgacggtatacatgcagtaattcctgccacaagctgccctcataccaaaggtcgtctatactttcatccgggacatggtgtgtgctccagcctgcactccatcccccttcatgttgcccaatccatacctgagcaaagtcctcatagccctgttcattccgtttggacaagcgatttaaaaatacaatctccatgatttcttcctccctcatatcgttgaaagacagtcccgcacaacacaaaaacgcaaaaaaagcacctatcctgcgtattcgcaagaaaggtgcttccctttttgagccgtactatgctgttgcctatataataaccgtacctcggagtgccgtcaaccataaattctaatgattcagcttttcctttgccaatgccagagcaccgcacaatccagcattgtcacccaatcccggagatacgatatattgctcaatatctgttgtcagactcgaatgctgtacgtatccgttcaaaagttcttgaagcttggtacgaatgagcgggaacagttggtcctgcttcatcactcccccgcccataataattttttgcggtgacaggattaatacatagctcattaaagcctgtgccagatagtacgcttccatttcccaggctgcgtgatcgacagaaagctcatgtcctttaaccttccatcttttttcgagcgcaggacctgctgccagtccctccaaacaatctccgtgataaggacatgtccccttgtaagtatcttctgaatgacgacgtaccagaatatgccccatttctgggtgggataatccatgtatcagctttccaccaaccaaagcacctgccccgatgcctgtacctatcgtaatatacagacagttgtccaatcccttggcggcaccccaaatagactcaccaagtgctgctccattcacatccgtgtcaaaccccataggcacgtcaaaatgctgtttcagtttgccaattaaattgtaatttccccaatgtggctttggcgttgttgtaatatagccatatgtatcactgccttcgataggatcaatcggcccgaacgagcctacacccaatgcttcaatgcccttgccttcaaaaaatgcgatgacattctccattgtttctgctggggtggtcgttggaaagcttgctcgttccagtacctccccatgttcgttgccaattccacatacaaatttggtaccgcctgcctcaattgctcccaatactgtcatagttgctgttgtcccctttcaataatccggttctctctccactatattcacctgaaatgtgcccgaggtcaatccccttatggcaattgtatataatccttcacatgactatacaactcccttgacataacggtataaaaataaggacactaacgcacccagcgtcagcatccctataaacttacttcacttaaattgtccgtaattgtccgtatcaagcctaacagcttcattatgatccggttgcgacacccatcaatgtacacaagcttttcatttcaagctgctcaaacttgtctacaatttgcacgtgatccagcgttagcagacaactatccaaagcacatgctacaggtacaccgcagtgaatttcagcaagcttgcgtgaaagatgcagcatatccaaatcactctcgatttttttacggaccgagggtgttaattgatccaaattctccagaatgccttcaatagagtcgtattcctgcaccagcttgagtgccgttttctcaccaatacctcgtactcctggataattatcgcttgcatcccccatcaggcctttaaggtccaccacttggcgtggcttaagccctttttcagtcagcagggtctccggggtgtatatcatataattgccgtgcccttttttcataataatgacccgtgtccaatcatccactaattgaagtaaatcatgatctcccgagagaatcattacatccatgtcctcattttgcgaataatggcgtgcaagcgtaccgatacaatcatcggcttcaaaaccttccgctccaatgttgggaatgccgaggctgtccgttacttcccgaatcaatgtaaattggggaatcaaatcatctggtgcgtcggctcggtttcccttatacgcagcaaaatgttccccacgaaatgtcgttccgcccatatcccagcagcaaatgacgtgtgtaggattaaatgtttggactgcatcccaaaaatatcgaataaaaccatatatggcgttcgttggcactccagcttttgtacgacggatataaccgtttgcggcggttgcataataagcgcgaaatagcagggccatgccgtcaaccagcattacggattgttcattgcgttgtgtcacagattgtattgctcccattcatcataatatttaacccccacagtataacatatcgtgggggtaaattgggcgttattgagctccccatgtgccctcaaatgtttcctctttgaatcctaccgttactttgttaccatcggttacaatcgggcgtttgattaatcttccattcgaggataaaagcgaaatttgctcttcacggctcatgtctccaagcttatctttcagctttaactctttgtacacctcaccgcttgtattgaaaaactttttcagctccagcccgcttttgcgaatcaagtcttccaattcctccgggccgggcggttgttcaaaaataggaataagttccgtctcatgtcccttgttttgcagccatttcactgcattacgacaggtactgcatttagaatactgatatactttcagttggctcatcgctagattaacctccatttggttttcatcgcttatttatattttattctgaaagatattgcgctcttaatagctcctgcatttcagccatatcgtcaggtagaggagcatagaacgtcagccgctccccggtaacaggatgctccaaggatagctctgaggcatgcagagcctgtcgaggcatcctggcatcaagctgatcatatcgctcacgttgcgcagcgtcatcgggtgtaatccgatacattttatctccgatcaacggacaaccgatataagtcatatgcactcgaatttggtgcgtacgcccggattccaactttagcccaatgcggcttcccccgttccacacttcctccagcttatacagcgtaagggcaggataaccatccggggtcaccatacgtaaatgcggatcatgcgggttgcggtcaatcggtccgtctacctttccttcctgcagctcaggccgtccatgcaccagagctgtatagcgcttatccaccgttcccgcaatcatttgctcagaaatatgctgatgtacatacggatttttggctactaccagcacacccgtcgtctcctgatcaagacgatgaacaggacgaaaccggaacagttctcccttggcctgccaataatgcacaaccccattagccagcgttcctgtgtaatgaccgtgagtcggatggacaatcatgcccgccgctttgttcaccaccaacagatgttcatcctcaaacaatatctcaaaaggaatgggttcaggtaaaatatcatcagaacgctcgcgctccatacgaatttctactcgatccccggacttcacctttacgctgatgtacacacgtgtcccgttcagcataatgccttgctcggtcagcttgagtttggatattaactttcgagaaatgttcatacgtttttgtaaaatagtcttcaacagcatgccctcctcctcaggagggatcgtatatacgataggttcataatacaagctcatcacaaattcccggttgcctccttatttgcggaacacttttttgctgcgcacatattcgacatcgggcacaccctgacggacattcgctgtacgagcaacggcaaagaaataatcagaaaggcggttcaaataccgacgtaccgccggattaatgtccgtatgtttacctagtgtaacagcacggcgttccgcgcgtcggcaaactgtacggcaaacatgaagcgttgaggataatgtgctaccacccggtataataaaacgctccaccttcggattttcctcctgacatgcatcaatccagccttccagacgctctgccagctcgtctttcaccttatatttgctttcactaattttaacaaacgccaaatccgaaccacaatcaaacagctcctgctgtatttcttccaattgagtccgaatatccgtaaactcttccccttcggcaaagctgatcgcttgtcctacaaagctgttcagctcgtcaattgtaccgtatgcctccacacgatcatcatctttggacactcgaccgccgatcacagaagtttgtccttcatcacctgttctagtatatatgcccatttcattccatctcctttatcattccgtaagtgctttcagcaccttgatggcttcttccttattgcttgtacgaggcggcacggtagcaaataatgttttggagttatattttagctccttaaacatcttcatctgctccaccggaattccgaacaaatgagtttccttgcttacatctgatccttcttcctcctgccccttcttcttaaatacgccgccctcgaacacgccccgagcgtacgtcttcttgtcaaaagcatcatctaacggcagattcgagccattctgtccatacagcttcatgtcctcttccggcaaaagaaacagatcatgctccccggccgcatattctacaaccagcttctgctggttatacagcggactgactgaaatctcaatagtcggagcctgttcgcccagcttatccttaagcttttgtgccagctcttcacggatgactgaagcatcccctttatccataataaaaatggagaagctgtccttgtcccgtcccccacatccagccaataatacaagtgcaagcattccgatgatccatggcgatagcctttttagccctgctctcatatgtacgccccctcttccatgccattaatatatcataagttgtgaacgcaaaaaaagaaggcccgacggccttcttcttacatttggctgacttcatacggttaaaccttgcattccgtaccatacagcttcatatattcattgattttcaaatcgagcttgcaactgatctgaataacaagatcagaggtgaaggactgctcttcctgaaacgtccgcatcatctcattgcgcaggaacaaaatttcatcttccagggaaatgtcgtatcctattgaactagatgaattatatccaacatatgacatgagcattcctcctacaattgaaaaattgaacttcctgcttccgatttcaaattatagcatagaaatttagaaataaaagactattttttatgaattacccataaaaaaataattttaaccttcttttcttactttttctacaaaatgaccaatccgatccagtgcctccgtcagctgagcaacagaagtcgcgtatgagcaacgaagatagccttcgcctcccaaaccgaacacattacccggtacagccgcaactttagcctctgccaaaagacgctgtgcaaattcatctgagctgagtcccgtgctttgaatactagggaaaacgtaaaaagcccctcttggctcatggcactccaggccgatttcccggaacccttcaaccatcagacggcgacgctgattataggcttctaccatacgatctttctcacccaaaccattccgcaagccttccagtgccgcaacttgacccatagaaggcgcacacattacggtgtactgatggattttgagcatagcggcaatcagatctggatgcccgcatgtatatccaatacgccagcctgtcatggcgaaggctttggaaaaaccactgacgagaatcgtacgatccatcataccaggcatagcggcaaaactgacatgcttttctccataattcaattcagcataaatttcatcagaaatgacgatcaaatcatgtttttccacgacttcggcaatcggaagccaatcttcataagtcatcgtagccccagttggattgctcggatagcataaaatcaacaccttggatttaggtgtaatttttgcctccagtgcttcagccgtcagcttgaattcatccttagcaaatgtttcaatacctactggaatcccgcctccaatcgaagtgattggagaatatgaaatgtagcatggctcgggcacgagaatttcgtcgccaggtacaattaaagcacgcaaagcaagatcaatcgcctcgcttcccccaacggtcacgataatctcatttttgggatcataacggacttcaaattgctcattcagataatcactaatcgcttcacgcagttctggcgttcccgcattagacgtgtagctggtaaaacctcgctccaatgaatagacacaggcttcccgcatatgccaaggggttgtaaaatccggttcgcccacaccaagggtaataatatccttgttgccacccaccaagtcaaaaaacttacgaatacccgaagatgggatctcgcgcaccaacggggacaaataggaactcatggctttgttactgtcggtaaatgcttctgttttgagattcatcatgatcttcctttacggcgaaatcatcagacgattatcttcctgatggtcttcaaagataattccgtcctgcttgtattttttaagcgtaaaattagtcttggtagacaagaccgaatcaataggcgacagtttttccgacacaaaattagcaacctcacggagattgcggccttcaacctctaccagcaaatcgtatgctccagacatgagatagaccgatttaacttgcggatacaaataaatccgttctgcaatcccttcaaagcctcttccacgctcaggtgtaatctgtacttcgatcaaagcggtaaccttttcgtcgtcgactttgtcccaattgactacagcggcgtatttgacgatcacatgttggtcttcgagctctttaattgaggtgcgaacatcctgctcgtcaacccccagcatagtagctaatagagtcggtgttcttcttgcatcttcttttaacaattccagcacttttaatttcaattcattcagttctgtcattctacataaggcctccatcgaaagagattactatacatcatacaatacgcactttaaacctgcaaagaaaaaccgtccactccggtaaacccggcagatggacggctgttatgggaatctgcttcaaaaacgaaaaatcccgtttacatataataagggttgttttgatgagtagactggccttgctggtgcatagattggccatatactcccgcggatgccgatttttgctgaatgaactgttggcattcttgttgggtcttgcgagcttcttgaatctgtttgtccaaatcgatgcgcagtgctttagtcggagtggcatacatattgttttggctcatcagatgatacaaatcaccttgcagacgcaatgtatcattcgtaaggtcggtgaacatctgacgcacagacggacaattggattctgtcgtcgccgttgtgtactcgcgcaccgtacgtttcatatcagcaagaatagtatagagcaaatcttcttcgggcataaatgacatattgttttgtgaatacattctgtcaaacctcctttattgtaaatccaaattactgctgcggttgcattggggcaagctgctgatgctgttgaagagcattagaaagcagattcaagtggtgctcatgagttcttgccagttgcaaacaggcttgttggatggctgggtgctgaatagaagccgctgtcgccgcactttgtttgagtagtagttcttcattggaaatggagtccacgatgtactccagctctttgcctgacaagggttgcatgttcgtagattgcataatctctgtgcctccttgaatgttttgttgcacgctggttatcttgtccgtttggcgaaatactatgtacacctaagaaatattacatattaccttatgaggagtgctatttatatggaattgataagcgggaatacatattggcccagtaccttggagaaaatgttggatttcccgcctttggcagaggatttaaattgtgatgtattgatcataggtggcggcatgggtggatccatctgctcccgactgttgggagaacgacaggtagacgccgtggttattgacaaacgcaagctagtacatggaagttcttcagccaataacggactgctgcaatatagcaatgataagaccttaacttccttcatcaatacgtttggtgaaatgaacggtgtactgttttaccgtatgagtaaagatgctctggatcagttggaaaaactgtctaccacgctggaaattgatccgtctttttcacgccgaagtagcctgtactatgcaagtacatcggaggatgtgcagacacttcaggaagagtacaaacagctaacccagtttggatttcccgtcgaatactgggatgatcaacagattgctgcccgatttcctttccgaaaaccagcagccttatatacacgcgaagatgccgaggttaatccatttttgttcgcccaaggactgctgcgatctgccagccgtcttggtgttcgcttatatgagcatacggaagccaagcatttagaatttaacgaaaatgaagttgtttgtcataccaacggtggaattatccgagcgaaaaaaatcatttttgcaacaggttatgaaacacaagagattaaaacagaccgtggagccgttctggaaagctcatatgctatcgccaccaatccaatcggagatacacccttgtggcatgaacagtgtctcatctgggaaaccgctcgtccttatctatacatgcgctccacaccggaaggacgcattattattggtggtttagacgaacctgtactggacgccaatcaacgtgaagtcaggctgctgcaccaacagcaaaagctgctacaaacattacgggaattttttccgggtataccatttcagatcgactttgcatgggctgctgtattcggctcctctcaagacggtttgccgtatattggtccacatccgcgttttcccaactgctactttttggaaggttacgggggaaatggagcagtcacgagtatgatggccgcacaacttttggctgatgaactgacgggcacacatcgacctgaaatggagctttattctctgacccgtactaccaaaccctcgcccgaaacaacggaaccgatggtttaacgtgtggaaacaaaaaaagaacctcctttccctttaagtgggtctggaggtctttttaaatatattttcagactattcggtttgcttgtgcaagcgtcgtgcgtgggaatgagactggctctgctttgtcttttgttccattttcagcacacttcgcataaaaaaccatccgagcactggcatcaatgccagtccaatcaacaaccagatcatcgccgtaggagccttgctgatacttaggacacccaagaaaatgagtgttccggtcaatcggcctaccattaagcatagttcgcgcagtacaaccagttccactctctgattggcgtctcctttactcgtacccattaaatcaaagctggcagaaatcatgggaattaaatacaggggcataaataaagcggtgccgatccccataatcagtagtgtactatactccatacgccacaataacggtaaaagcgcgatcactaacaacacagcacccaaaagcatacccgccgaacgatagtgtggcttgagccattttccgacagcccaaaagctgaaaaatgaaaccgccgatgtaataagtgaaaactgcgccagcttccattcctgttgagtagctacatacacgagcagcgtaatcaggaaggcaaataccccttcacggatgccctgggcaacaagtgataacgacaacggacgccacatactccctttttgtgacaatcgctgcttgggctccttccaattgtaatttcctgtcggcttacgcttgcgaagaaagaaactaagcaccactcctacgacataaaaggccaaggaaatactgaatatcacgcggtaacctgcgtcatcctccatacgggcaataatccaaccggacagccaaggtcccactataccggaaaacgagcctagcagacccacccaaccgttaaaatgatcacgacttgcctgatccgtgacttcgaaaaaaatcacattaaacgccagccagaataaacctaatgctgcacccagcaacatcccgagcggccatatgtagttcacagcctgcggtcccgtatataacacgatcagataaaataggccggataatgcggtccccacgcgcaaggcattcattttattatgttccttgacccactttccagccacccagaccataattcccagtgcaatttgttgactgacattaaaccagccgatcatcgcgtaatcctgcctgcttttccacaaatacacgttaagaaatgtgcctgacaatgctgctgcaaacacaaacaatccattcaagcttaatagcagaatggattgtccgttcaggtttgatttcaatgcagttccccctaaccgaaaaatcaccaatcagcttatttcaagccagcttgttcaaagatttattcgatttaagatgcccgtattgagcttgggcctatccgggggattgctatttaattgttggaaataccgctgagcttctccagcatccgcagtcggtcattctctgatagtgtctgctgtacatggaagcagctagcacacacataaacattcaagacgaacggcaaatccagaacaggcttgccaagcgctggagacatcgacggttcaaagccttctctggttacggtttgcgaacccgcatgcagcatgtactctccacattgggaacattcaagaacctcatcttgtctgtcgagtatttgttcagcgccatgttcataagccatcagatccgcaccactttcttcgaatttttgcaaagtatgcagcacaggcagcttatgaagctcattatcctgcaacaacggtgcatcaaccggtttttcaactacgatttcatcctctgcctcatataaaatatcctgctcctcatcatcaccgagctgaatactcaatgtacgataacccttcaggtcttcttttccatgagggtggggcaccggggttacagaagccacatgatcatgtttcgtctcttcatgtccatgctcaccagcatgtctatgcacaggtggagaaacagactcatcttcatcatcggtgatgtcagagtaccctttcagatcattatggcaataaggacactcttcctcaggtcctaattcttcatcccaaataatttccatgttacaccatggacaaatagtcatttccaagctttatcatccttccgttccaagcgtataccaggctctagtatacaagatgtgtcaagttacactggcaccgatcacataagataaagatatggaaataatcatggagaacaagccgacagcacgattatcctctttaatctgttgatcgatagaaaataccggtgttagaaactcaaaaagaaagtacgccgcaagtagcagtaaaaagccaacgaacgaccaaatcatcgtatcatacacactagatttggcttccatcgcaaagcggagcacgttgcaaataccgaacattttccctcccgtagccatggctaccgaaacattgccgcgcttgatctcttcccagcatttatagcgggttaccagctcaaaacacgacaaaaatacaattagctccagcaccgccaccgagaaataacccagcatcatccccaacggatgtgacagcaattcatcaatcgccatcttcacttcgtccctcccgttctaccaagcgttcccgggcaaagccggcaacccatagctattccaattcagcaactgttacgcctgtgccgccttcattgtaattaccgatacggtagcttttcacatgtttatgcttgcggaggtactcctgaataccggttctcaggacacccgtacctttgccatgaataatgtgtacctgacccagattggccagaaacgcttcatccatgaagcggtccacttccatcaaggcttcctcgacgttcgccccccgaagatcaagttcacttcgtacgttatcatcccgtgtccgcttaacgccagtcactggtttttgaactcttggagtcgttgcttgggcaggttgcagtagttccagatcatccagactgactttcatcttcatgatccccagttgaaccacagcttccttggtaccggacagttcaaccacgtggccttttttattcagactgtgaacggatacttcatcgccagccatgatagaacgagtacgtgtagcggccgggcgtttgacggtacttttcttgcgttgcttcggttcagcctcatccaattctctgcgagctgcaatcagcttatgctccttaacagaggccccttcttcctgagccaatttacgcaaatcagtaatgattttctctgcttcactacgagccttatccacgagaactcttgcttcgtcctcagctttttccagcatacggtcccgttgggactccagcttatccaactccgtctgatgacggctacgcaatgcttccatttccttacgcagctgctccgctttttcccgttcttgctcagcggttaaacggttctgctccagtgacgcgatcatgtgctcgacgcgctggtcttcttccgtcacctcaccacgggcatagtctaaaatacgccctggcaatcccaatcgctcggcaatggcaaatgcattacttcgtccgggtacaccgaccagaaggcggtaagtcgggcttaatgtagcgacatcaaactccatgcttgcattaataattcctttacgctcataggcatacgccttcaattcactatagtgagtcgtggcaaccatgcggcaacccatggcatgtatatgctccaaaatggatacagccagagccgaaccttccgcagggtccgttcctgcccccacttcgtcaagcaatacaagacttttgggcgtcatatttttcaggatgctaatgatattggtcatgtgactggaaaatgtactcaagttttgctcaatgctctgctcgtcaccaatatcggcatagattgcatcaaatacacacagctggctttcatcctcaacaggtacaaacagtccagacatcgccatcaaactaagtaggccgatggttttcagggtaacggttttcccccctgtgttcggtccggtaacgataatggaggtgtatgaattgcccagctccacatcaatgggaacaacctgctccaacggaattagaggatgtctgccctttttcagcttcaaatatccgcggtcattcattaaaggcaaggttgccttcatttcacgggcgagacgcgcttttgcaaaaataaaatcaagattacccaatatgtccacatcatatagcaacatatctgcttgttctgcgacaagtgcggtcagcttttgtaaaatgacttcaatttcacgctcttctctcagccttgtttccctcagcttattgttcatggctacaatggattcaggctcgataaacaatgttgcgccagacccggattgatcatgaacaattccgccaaaataagaacggtattcggccttaactgggatcacaaaccgatctccacgaatcgttatcaactgatcttgaagcattttggatacagttgaggaacgaatcatggaatccagcttttcacgaatacgcacttctcccgagcgcagctcccgacggatttgagaaagctctgtgctggcagaatccagcacctctgcattttcatcaatacagcctttaatggagttttctaaacctctctgctccgaaagctgctcgctccaatacagcaatgtttcgacaggattttcctcatgcaaacttgccacgtatacctgtatacgccgtgcggcctgaactgttgtccgaatgccaagcaactcctgcgggcttaacgttccgccaatacgggcacgcttcactgccggagtgatatccactactccgttaaatgaaggtactcctttgagtcgatcagcagcataggcttcatccgtgcctttcagcattttcttgatatgctccaaatcatcgctgggctgtagtcgaagggctgtctgttgtcccgttgccgtttgggcatagtgacttagtttatttagaattttttgatattcaagggttttaaaaattttagagtccaacttcactactcctttcacatatatctatattataccgaaagcagcaaacttacgctatttgccaactcctttttacacataagaaagctcttcatgccacacactaacctttgtctaaccctgtaaattcaaaaaacaaaggaggttattccgtgagcattctcgggcacattgtacgtttcatcgttgccgctctggtgctgatggtcgtaagctggatcgttcccggatttagtgtaggcggcttttggagcgcgctgattcttgccattgtcattgccttggttggttacattatcgaggcagtgttcggccgacgcgtttctccatttggacgcggtatcgtaggttttcttgtgagcgctctggtgatctggatcgctcaatatgtggtgaccaatgtcagtgtttccgttctgggcgcattgctcgctgcattggttatcgggattatcgacctgtttattccggtatcgacaccgtttgaagccggtcgcaaagacgggaaataacttcaatagacactcccgacaaagctgtcccgaagcagatttcgtctgccaaaggacagctttgtgtcatataacttctgagtggatacaataagcaaacaatccccggcgatgagcagccggggattgccttacatttttaatccatatctactgatcctgttcgataagttcaatccattcattgtactccgtttgaagtttagtgtattcttcctgtaattgacgtaattctgtagaaatcttctccgtattttcccgatctacgtcctgttgtacttgtaacagacgaagctgatgcgccgccatttcatatttttgacccacttcgtccaattcagactgcaaggccattcgttcctgctctatggactgctgttcagctttcgctgttttggcagcttcaaccgccaaacgagtctcctcctgaagctgttccttttgttcaacggttaccgctatttcccgttcccaagatgcaaattcttccttacgggcagcatcttcagcttccagacgttccgcttctgccttcaactgatcgtatttaagttgccactctaaagattcttcctcagcacgttccagtttactccgccgttcgtgatcttcctgttgaagctgcttaatattctgctccagctgtccagctcggctcttcatgcttccatattgctcctgaagcgattgatatgccttagctccctcttgctctcggactttggctttctcaagctcatcctgaacgcgaatcagctcaggtgaaagctccttgattctcgcttcaagttgaactagccgttgctgttgtgaagcaaatttatcattaatagcttcgagctcagcctctgcgtgctgtaattgctcctgtatcgcttccttctgttcacgtgcttccagcagggagagctccagctcatcaactgccaactggcgttcttctgcaagcttcttccatgacttctcgctttcagctagcgtagccagctcactttgcagcttgcgagaagatacgtgagcttgctccagcagcttctgcatccgccgctgttcttcctccagcttagccgtctgctgctgcgtagccttagcttcagcttctaattgatcatatcggctttgcagttcttcacgcgcaagcgtatctgcctgctctcgctctatcgcagcctgtcgctgtgtttccagcacagactccagctcggactgttgttgcttcagtactcttgcttgttcttgagcctctcccagacgagaaacaagctctgtactgcctgcttgtacttgttctaattgttcctgaagctcctcaacccgaatctcctgctccagtgcagcttcatcagctcgcttctgcgcttcctgatgctggagcttttcttcattcaacgccaattcagcctgtttacgttcctgctccagctgctcattcagccctgagcacttggtctgccattcgcttaccttcttactatgctcttgctgcaaagcagatcgcagcttgtccagttctatacgcctttgctcctgatgagtcttctctgcagctgacagcttggcttcagcctgtttagtcgcttcagctacttccttcttcatctgctcttctatttgccggatacgggcattagccgcctcctgctgctctttcagcttgcgagaagcttcttgacgagactcctccaattcacgtttagcttgtttttgtccattttcaagttcagtcgcttttttctcctgctgttccagctttgccttcaattgggcaatctctttggctgatacagattcggtttccatcagcttcttctgcgttgcttccttttcttcctttagttgaataaaagattgatgcagatctgtatttttttgctgctgttcccctagagccgtctggagttgcgccagatctccccggagctctgctcgttccgctgctaagcggttcatatgactctgaatttcctggatttgtacagcttcttctgccatatgaaccgcagccagcacggcaattcggggcatatccagacgcgaatgagcttgagaaatactgtgcatacgctcatccacgtaattggcaacctgcttcatataatcggtattgctgccgacgagtttataagaagtaccgtagatctctacagtgacgcgagtacgatctggtgtagtcacaattatgccctccttcaatactactgtatgttgattctaaggtgtgtccggtactatggtaacccgccttccgtgaagcgttcaaccttattagtccggcttccccgcagcgggtaaatatcagagtaagagagcttctatgaagataggccaaaaagccgtatcgaacctctgtcactaagattcgatacggcttcccgcatttcctgctactttctcaattccgctccaaaagtttgttccagagacgtaacgacaggagtatgcgccgcattgatctcttcatccgtcaacgtatgttcccaatgacgataggtcagagagatagctacgctcttcttatcttcaccaagcttactgcctgtaaatacatcaaacactcgtgcatcctgcaacagctctccgcctgcagcgtgaataacacgaagcagttcacctgcctcaacgtctttatttaccacgagggcaatgtcacgttccacggatgggaagcgagccagctctctgaactgaatatgagagttggcgtgttcaacgacctgttgcaacgcaatttccgctacatacgtatcattcagcccataagattgttgaagctccggatgaatctgcccaatggtaccgatccgttgagagttcccattcacatccagccataccgaagcggaacggcccggatggtagctttgtggttggtcagccacataacgaatgctggcactcaatccgaaatagtcaaacaccgtttcaagcgcgcctttaatatcaaagaaatcaaccttttcagcaccaatattccattgtttttcacggcgtaccccagtcagcagtaaactaagcacttgaatttcctgcggctgacgggttaatgtttgttcctctgtataaaatactgttcccatctcaaaaatcgccagattgtcttgcttgcgattcatgttgtacaccgctgtatccagcatctgtggaatgatactcgtacgcaaaacactacggtcttcgctcataggcatagccaaacgtaccggatggctaccttctgtcagggcattaaataaccccgtactctgcggatgtacaaaagagtagctgatggtctcctgccaaccaccatgagccagcaatctgcgcatggagcggcgcaatgattgcgatgctgtcaaagctcccggagttgtaggaccttcaatcggcgtggtcgggatattgtcgtaaccatacagacgagctacctcttcgattaaatccacgtcaatggtaatatctccacggcgtgtaggaacttgaacttccagtacaccttgctctgcgtcgccacatccgaaatgaagtctaccgaaaatcgttttcacctcaagcagcgacagttgggttcccaaatatcggtttattttatctagcgacagcttgataatgcggttttcagcttttgcagacgctgattctacgatgccctggtgtacagtgcctcccgcataacgctgaatcagcgcagctgcacgattcacagcaggcacaacagcgcctggatcaacctctttttcaaaacgcagacttgcttctgaacgcagtccaagttgacgggatgttttgcgaactgtaccgccgtcaaacttggcagattccagcgcaatgctgaccgtcgcatccgtaacctcggaattggctccacccatcacgcctgccaatgcaatgggtttcacaccgtctgtaatcagcagcatatgcggctccaacttacgctcctgatcgtcaagtgtaatcaatgtttcgcctgcacgagcgagtcgaacttcaatatttccattttccagcttatccgcatcaaaagcatgcaacggctgaccgtattccagcataacgtagttcgtaatatctacgatgttgttgatcggacgaacacctgccgccatcagacggttttgaatccataacggggaagcccccacttttacacctgtgatataacgggccgcatagtgcgtacacagttcaggagtatctaccttcacagacagatgatctgccgctgcatcgctaatttcaaccaaatccttagccgggtcagccagcgaaatgtcacgtcccagaatcgcactcacttcatatgctgctccgtgcatgctcaggcaatccgaacggttgggtgtcagatcaaaatccagcacctgatcatccagcgccagcagcttcgtaattggcataccaatttcagcatcctcaggcagcaccaaaataccttcttgcaattcctttggaagcagcttgtcattcatgcccagttctttggccgagcagatcatgcccatggatacaacaccacgtagcttggcctttttaatgtggaaatctcccggcaactttgcacctacaactgcaacaggaaccttttgacctgcatccacgtttttagcaccacacacgatttgcagatcttcctcttgacctgcatcgacaatacatacattcagcttatcagcatctggatgcttttccttgcttttaacatagccgacaacgacaccagtaattccttgattgcgctgctcgacctcatcaatttctatgcccgaacgggtgattttctctgctagatcctccgcgcttacctgatccagcgatacatactcggacagccactcgaatgatactttcatatgggttcacttcccttgatatagttgtttattgacgcgcaaactgtttcaggaacgacaggtcactgttataaaaatgacgaatatcgtcgataccgtatttcaatatagcaatccgctctacacccataccgaatgcaaagccgctgtaaacctcgggatcaaaaccgcccatctccaacactttcggatggaccatgccacagcctaaaatttcaatccatacacgttcgccatttttcttcacaaaagtcacgtctacttcagcgctcggctctgtgaacggaaagaagcttgggcgcaaacggatttcggtcgattctccgaacatttcgcgtgcaaattgaagtaaggttcctttcaaatcactcatacgaatgtcttttccaatgacaagcccttcaatttggtggaattgaaaagaatgcgttgcatcgtcatcatcacgtcggaaaaccgtacccggacagataaccttaataggcgtttcgcccttcatcgcttccattgcacgaatctgaaccggtgacgtatgggtacgcatcaacagatcctcggtcaggtaaaatgaatcctgcatatcccgtgctgggtgatttttaggcaggttcaatgcttcgaagttataataatccgtctctgcctgtggaccttcagccactcgatagcccatacctgtaaaaatatcctcgatttgctcaatcactttgttgagcgggtgcagtccaccttgcggcaacgcgcgtccaggcagcgtaacgtcgatcttttccgcttgcaaacgctcatttgtttctgctttcgtgaactcgtcctgcttacggttaacgacttcttcaatcgcctcgcgcacctcattggctacctgtccaacaactggacgctcttccgcgctcagcttgcccataccgcgcaagatttcagtcaatgcgccctttttccccgaatatttgacccgtaaatcagccagctccttgggtgttgccaccttctccaatacttccagtgcttcttccttcaaggccagcaaatgttccttcatttggatggtttcgctcatcgcctgttcagtcccctttcttcatttccagcttttcagacaacaaaaaaaggtcttttctcccggtaagggacgaaaagaccgtggtaccaccctcgttagacaataagctcagctcacccagcgttctgccttacggcaactagttacaggtgattttcatgctatgcatcatcgtctcgctctacacgttgtaacggtcgtgaaccggtatcccctacttgcacattcgccattcacatggcgtctgaggttcaaggaactgctccggagcgaacttcaacagcccagtatttgcagaaacgctctcaatcctacggcgcttcctccctgttcaatcggacactgtctactcttctccatcaagacattttcaaaaattcgaactattgttcattattatatgcaaactaccgcgctttggcaagcagggcatacgtttcatttctttagatatcgagatcgtccaaccgctccagatttgcacgaatgtgcctgatttcgctcaacaacttctcgttttcgtcattcgtgcccgtcattcccatcaactctgtaagacgcaattgtaatcgaagccgttcctcacgccgctcctggtcttctggctcccgttgacggctccgctcatcttcttgcttttcgtcggctgtcccctcatagatttcatatccgccccccggcttcatatccagtaaccgagttgccgtgcacctcaccagctcccgatcatgtgagacgagcaccagggctccatcatagttacgcaaagaatcctctacaatttcacgggtttcaatgtcaaaataattcgtgggttcatccagcaccagcagattggctccactaaagtacagacgcagaaaagctaccctgcatttttctcccatactgagtgtcccgatccttttaaatacgtcctctttcgcaaaaagaaagcagcccaacaccgttctcgcttctgtttgagtcatcgtcgggagtgcaagcagactgtccagcaacgtttgatcctccggaagctgctccagctcctgtgaaaaatatccgatgttcaactgtgggttggttgtgatttttcctgtctgcggctccagttgacctgttaataaccgaagcagcgtggttttaccaattccattgggcccccgaacagccagacggtctccacgtgcaacgatcagatttagatttttcacaatgatacggtcgtcgtagctaaagtcaacctgctcagcacgcagcaaatattttgcctgaaacccgctgtcacttaatttcatgtgcaaagacgcagcctcacgcggttgctctactctattggcttccagtcgctccagttccttctccttcgcatggtaacgggaaatattttttttagccttggccttataaaagctctgtgtaacggccatctcaaccttggatgcgccacgatgcgcctgatgaaaccattccctgtaatttcgaatcgtttcctccagcgcctgtttcgccagctcctgcttccgatagttggcttcctgctctcgcagttctcgctccttttgcgctttatattccttatagccgcctttatagcgcccaatacctgtcgatgtgagctcaactatactcgtagccacccgatccaaaaaggctctgtcatgcgatacaaacagcagtgttcctggatacgtggacagccactgctccagccaaagcaagctttcggcatccaaatggttagtcggctcatccagcaccagtagcttcggctgcctgaccatgagtccggctaatcgcactctcgtcttctgtccgccactcaggtcaccataagcaatggaccacgtctggacaggcattcccattcgagtgagcgccttttccacctcagactcccaggcaaagccttgcaggcgttcgtattcatccatcagctcgccgtaacgctccagatgattctccatatccttcccagcatcggctaggtcaacttccagctgtcccaacgcttgcttgagaagccaatgccgagggctggcctgctgtgcggcctccagtacggttcgagaccaatccaccgtatcctgctgcttcagccagccccgctcttccagtggcaaatcatgctctacttgaccagaggttggcgcttcatctcccagcaatattcgtaatagcgtcgtcttacctgctccatttcttccaaacagtgcgagccgttctccttccatcacatccaacgacacattctcaaataaagatgtcccgttccaatcctttactacattgcgaatacgcaaaatcgttctcataccgatcatcctttcccagtccggttttttgaccccggaagcaataaaaaaagccgcagaaggctgcggcttgcatacaaggaatatagaatgactgttatgaatcgtctcagaacatacgcttataaaaaataacaccgtaaacgaataagccaaatcccgttccggaataaacgcatacgtccctacattcattttcagacacacttctcccgttgcagcttacagccgcctgccagtaactgtgcagttaagtgggaaaatcagtgtgcttacttcatcggacgtatggttaccttccttttcatgggatacttacttgcagtcagtatagcagatcacagcacatttgcaaataacccgcgttattttccaaataccaaagttgtattggacgaacctgcatatttcgttacaaactctttcgtatattcagggatctgaacctgatagcatttatctagctccaaacaaaacaaaaaacccttgtgtcacaagggtttcgaatttcttaaaacagtaagcgggtgatgggaatcgaacccacgctatcagcttggaaggctgaagttctaccattgaactacacccgcattttataacatctcgattcttatgtatgacacgcttaacctatcgtcaaccagctgaatcaggatgttatttagtataacttacctttcagcaaaatgcaagcatactacatactatcctgagccagccaattcataggtttacgtaaaaacaatttttcaaagacttctgcaggaatggggcgactaaagtaatatccctgaccctcatgacaatcctgtgcctgcaaaaaatgaagctgctcctcattttccactccttcagccgtaaccttcagcttcaaatggtgagccatggaggcaatagtagatacaattgccgcatttttgctgtcgaccagtacctcatttacaaaggaacggtcaatttttagacgatcaatcgggagattcttcaaataatgcaatgagctatagccagttccaaaatcatcaatactgattgcgacaccaatagcctttatttttttcaactgttcaaaggcccgatccttatcaaaggtcatactttcggtaatctcaagctctagatagcgtgcttcaagttccgtataggtcaaaatgccccgaatgacatccaccagctttttttgctgaaattggcgcatggataaattgaccgaaatcgggatgggtgggtacccgagctcctgccattgcttattttgcagacaggcctcccttaacacccattcccccaagggcacaattaagccactttcttcagccaccggaataaaatcgcccggcatcaccatcccacgatgaggatgattccaccgcaccagcgcctccaaactcgttagctcgccactttgcaggtggacacgtggttgatataccaatgaaaattcctcattttcaagtgctcgccgcagatcattttccagctggagtctttcatgcgctcgcatctgcatcgcgctagcataccgctgaaaattcactccctgctctttggcactatggacagccgtatccgcctgctgaataagctgttcgctctgattcgcatccaacgggtataaagctataccaacgctcaccatcacatgataagattcgccattaatatcgaaaggctgatcgaacagcttcaccatatcatcaatacgatttctcatagcatctgtatcttcgtatcccgttagaagaaaggcaaattcatctccgcccatgctaaagactgcttccccttcatggctaaaatgccccaagcgttcgcctaccgcatacagcaaataattccctgccatatgtccaagcgagtcattaatcgccttgaaacgatcaatatttagcactaaaagcgctactgtctcatccgatttcaatgatttgcgcaatattttatctaagcgttgggaaaggcgacgacgattggggagtcctgttatatcatcattataggcaatgtgattaaactcagattctgctgcttgcttttcacgataaggaaccagaaccatcaaccgaaccagcccgctcaacatattataaaatgctaccgcgttggtcaaaagtcccaaaaggtgattaatatcgctcatttgctcagaaaataaatagaacaactgactcacaacacacagcccaatcccacgaacaataagcaacatgcccaactccgccgggcgggctttccgatattttcgcaccccgaaaataaaagtgagcacaagcagtaacatgacagccagatttaatgtccagcctaagttgcctatttcgtatcgtatacgtagatccggtaagtctgcaccaaatgtcttaataactcctagaatcagcaaagtgcagcctatccctgcccacaaagccactgtcttgtattcagacttcgtcttgctaaacgggaggaaacaaacacataagagcaagacagaagtaaaggcacgatttacaaatagcagccataacgaaatgcccggagacaaagcaaagtccgtcaggcttacgaaactaaacgaaacaatatgaacaaggtaaagcagaccagccaccaaaaacgtcggggcaataagaagtctctgcaaggataactgttccagtaaaacggaccaggactgataaaaaatagaaaaacaaatcgcagcacaggaaaatcctacaatcggatataacaagaaaaaaacattatgggagtatatcttattcaaagttacgtgaaataactgaaccaagacaaacaaaactatcgaagcaatgccgatacctatcgttttttttacttccagccgtatactcattcagcctcttcagccccctgcatatcggagattccgatcatctaagacgtttgacagctttggaagccgttgtttaagtctatagtatcaaaaataatgttgtattctggtatataatagcatttaatctgtgaaaggtgaatcatttttttgtcttaaattcatgaattcattttcgcatttacgcaaataaccgagcttacagcaccaaaaaagcgcatcatcttgtcagattatgcgcttcagacaaccttttccaaaaaggtgatacctataccccaacgctgcacaacataaaagaaatagtatgtacaggacccctctgcgataacctccccatattaaactacaggaagcgtgattttgaattgtgtgccacttccatgtttactgtctacatgtatgaagcctccgtgatttttgataattcgatagctcacagccaatcccaatccggttccactttcttttgttgtaaaaaaaggatcaaataaacgcgccaatgtattgtgatccatacctaatccgttatcttcaatacaaatgtggacatagttaccctcaagcactgtatggatatcgatgcagccctctcgttccccactgatgctttcaatggcatccatcgcatttttaatcatattgaggataacctgcttaatttgcttcacatcaatggaaaccttcatgagctcatcattttcgtccaatgcaatctggcaacccttcattaatgcttcgctttctgtcagcatcactacctctttcagcaagcccatcacagatacagctgttttttgcggagccgaaggcttggacgaatttaagaactcataaataatgtcgttcgcacgatcaatctctgttaatataatgcgggcatactcgtccctgcccaactccaccaaatgtggccgaagcaattgaataaagccccgaattgcggtaagcgggttacggatttcatgggcgatagaggcagagatgcgtcccagcatcgctagcttatcgttttgatacgccgtctgctcaatctgcttataatccgacacatccttgacgctaaacaaaaagtccccatccatctgatcaccataggtcactgttatcaaccaatgccgaccatactcatcaatcaactcatgatagcgctttctatgaaagatagtttctttataaatccgcatgattttcttcttcttaaaccgacttaactcaggatgatgcaaaatttgcatcaaattgcgacctgctagcgaactccgtggtagctccagcaatttcgccatttgcacgttaataaaggtcagtaccccgtcactgtcaaacagcatgataccactatccaggttctccagcacattttcatacttgttattggcgatctgtgtggaaggacaagctcccacggtatcaagcaaggcttcttggaattcactgatcatgccaggcttcccccttgtttcggaatgacaaactggccgtttcggacgcgtaataatcttgaagaagagaaaggcatctatcgactacccttcaatgatgtagaaaacagtttcacagaaatccgaccatctctttccaattcgagtcgagtcttattttatgatagacaagattaaggatcgcagtcaatcggaaaaagtgtcgaatccaaatttttatcctgttttctttcgtcataatatctgcgcaacattaccaaaatgaaagattacgttaggaacaagcgccctacacaccaaagaagctcnngagcttctttggtgtgtaggatgtcaactgccgctcttattatgttgaagtcgggatcgtctttggctcataacggccagtcttctcttaagctctccctgccatttttcatcattcatctgtttggctaccatcaataaatccagagatatgtcaatttgacgcttcacaatttcaaaggcatcttcactttcacgattcacacaattttcaaatatcgtatcatcgtcttccatgacataatcctgaaaatcaatctcggttgccccatctccatgtgcatattcagccagaatttcatactcattttcgactttataatgaacttcaatgcgacgacataccgggcaaaacagcaaaggaacattatgaacttgggtgcggtaatgcttcagcgttcccttggttcctaccatgcttgctccacagcaataactcatccgggctcagcctcctctgaacaaaacctgttctgccttgtttatcttctacaataccttattcgctttcatcaggcaaaattcctccagaacacaacaacatttccataattatttgttacttcactctatattgtctcatttaaacaggatatcctcacatcttgcgctgcacagagcaggcaagcaagcccccaataacggcagagtaaccgctagttgggggcttgcttgtttaatttcaacttgtgaagcttatattacagattttgatcgcctggtttccagttcattgggcacaagccaccggattgcaaagcttgcagtacacgcaaagtttcttccacactgcggcctacgtcgttgtggttaaccacttgatatttcaattcgccttctggatcaatgatgaacaagccgcgcaatgcaacgccttcttcttcgatcagaacgccataatcgcttgctgttttcttcgtgatgtcagaagccaatgggaagttcagtttgcccagaccattgttttctttagctgtgttgatccatgctttgtggctgtgcacggagtctacactgatacccagaatttcagtatccagctctttgaattggtcagcagcatcgctcaacgctgtaatttccgtagggcacacaaaagtgaaatccagtggatagaagaaaaatacgagccacttgccacggtaatcggaaagctttaccgaaccaaattcttgaccgtctccagtcactgtttccaatgcaaaatcaggggcgggtcttcctaccaatctttctgccataataatgaaatcctcctttaaaatatgtaagaaaaacaccgaatgtgttttcctcaatcatctgtattgtaatgaacaacttacttgataaatgttatcattcgctgaaatcaaagtcaacattataaccattacttttttataattattttaaactagcttaaaaattcacggtttattcacattttgaacttttgaatatacaagtagctcctgattgctcaggagctactgtgctaaacatttgccgaaaaaggctgtactgtataaccttactatataataggaagctttttttcagaacaggtgatttacggagcttttaacgaatagctgctgcgatcagatctcccatttgagttgtcgagatcgcttgagatttatccaccgcaatatccgccgtacggtgccctgcatccaatacctcagctaccgctttctcaatggcatcagctgccttctcgtacccgaaggtgagacggaacatcaaagcaacggacaaaatcgttgcaatgggattcgccagcccttgacctgcaatgtcaggcgccgagccatgtaccggctcgtataggccgaagctgccttctccaagtgatgcggaggagagcatgccgatggatccggtcagcatagccgcttcatcactgagaatgtcaccaaacatattttccgtcacgatgacgtcaaagctagatggacgacgcagcaattgcatggcgcagttatcaaccaatacatgctccagctcgacatccgggtagtctacagcaacccggttaacgacttcacgccataaacgggaggtttccagtacattagccttatccaccgatgctagtttcttgcgacgtttttgtgcaatttcgaaagattggcgcactatacgctctacttctgttacattatatgcacaagtatcgactgcttcctcaccctgaggactttctcgtctgaacttctcaccgaaataaatgccgcccgtcagttcgcgcaccacgatcaggtccgttccttccaacacttccggtttcaatgtagatgcgtccttgagacagtcaaagacgacagcaggacgaagattcgaaaacagaccgagctctttacgaatgcccagcagtccggtttcaggacgaagttcctttggattgttgtcccattgtggtcctcctaccgcccccagcagaacggcatctgcagcttgacatactgccagtgtttcttccggcaatggtgtgcctttcttatcaatggcaatcccgccgaacagcgcatgctccgtttcaaatgaaaggccgaacacttcttccgtacgtttcaaaattttctctgcctctgcgaccacttccggtccaattccatctcccgctattaccgcaatctttttaacgtctgccatcacgtacactcctcttgttatacagctatacaaccgtatttttcataccttctttgtaacatatatggcagggctttgaccaagatatagaatctatcaattcaataggcacagcctataagttgattttttcatcagagaaaaagaaaacaggaccggaaacatccgatcctgtatatatccaactcttaagtctgcataaaattaagatttataatctacgcgattactgtaatttttacgcttgtcgatcaaaccatttagcgcatctacgtaagcccgagcacttgcttccagaatatcggtacttaccccgcgtccctgcacagacagtccgttttgcgtcagcactacatggacttcacccagggcgtccttaccatgggtaactgacttgatggagtaatctgaaagtacaacgctttcgctgctggcttggtcaatcgcattgtagatcgcatcgactgaaccatttccttcagcttctgtctcgataacctgaccttcatcgttaaccagacgtacttgtgcggaaggcgtagctttgtttccataggtaacaaaaatggtttccagcttgaatacttcaggtgcatcggccaatttttcttccagcaatgccaaaatatcatcgtccgaaacttccttcttcttatcagccaagtccttgaactgcccaaaagcgcgattcagatcttcttcgttcaattcgtagcccaactcgatcaaacgctcacggaaagcatgacgacctgagtgcttaccgagtaccagcttgctttcttttagaccgatactttctggtgtcatgatttcataagtcgttttctctttcaacatgccgtcttgatgaatacctgattcgtgagcaaaagcattggctccaacaatcgccttgttgcccggcactaccatccccgtcaaacggctaaccaaacggctcgtgcgtgcaatctcagacaattgcagagacgttttggcctggaaaaattcctgtctcgtctccagtgccatggcgatttcctcaatggccgtgtttccagcgcgttcaccgataccgttaatggttccctcgatctgatccgcgccgttcaggatggcagcgagtgtattagcagtagccattcccaggtcattgtggcaatgtgcactcaattgaatcttctccacatcgaccacattttccttaatgtgtttgaatatatttccatactcgtagggtgtcaagtaacctaccgtatctggaatgttgacaacagaagcaccttcttgtacagccatggtgaccatttcaaccacaaaatcaagctctgtacgacctgcatcctccaaagaaaactccactttaggcaaatatttcaacccatagcgtatggcagcacgagcagtttccaatacctgtgccttctccatccgcagcttatgctgacggtgaataggagaagttgccaagaagatatggatacacgggtcctgagctcccttaagtgcctcgcgaaccgcatcaatatcctgttcccttgcacgcgaaagaccaataaccgtcgaatttttcacagcttttgctactgcattaacagccgccagatcacccggagaagcagccggaaacccagcctccatacgatcgattcccagcttctccaactgatgagcgatctccactttctcacgagtattcaagttcacgccaggtgactgttctccgtctctcaacgttgtgtcaaatatatatattttgcgcaacctaacgcacctcctcaggattaggacccttaaattacaatgcggctcacgcaataagcagggccgcattgtaattaatatttataataattcatattgtcgaattcatagaacaaaagattattactttttgatccaatgcatcatttcacgcaattgtccgcccaccacttcaatcggatggttagcttcattacgacgagtagccgtcaggaatgcacgtccagattgattttcaaggatgaagtcacgagcaaatttaccttgttgaatgtcagtcaatacatccttcatggctttcttcgtatcttccgttaccacgcgtggtccagttacataatcgccatattccgctgtattactgatggaatcacgcatcgttgccaatccaccttcatacatcaggtcaacgatcaacttaagctcatgcaagcattcaaagtatgccatctcaggagcataacctgcttcagtcaatgtttcaaagcccgcttttacgagtgcgctcacgccgccacacaataccgcctgctcaccgaacagatccgtctccgtttcttcacggaaggaggtttcaattacgcccgcacgtgtacagccaatgccttttgcgtatgcaagaccgatttctttggcttgacccgttgcgtcctgctcaattgcgatcaaccccggtactccaaatccttctacataggtacgacgtaccatatgtcctggggattttggagcaaccagcaatacatcgctatctttaggagctacgatttgtccaaaatgaacgttgaaaccatgggagaacaaaagagctgcgccttttttcaggttaggttcaatttcatttttgtacacagaagcttgagtttcatcaggtaacaaaatttgaaccacatctgcacggcttgttgcatcagctacgttcagaacttcaaaaccgtcgtttcttgcgacatcagctgatttgccttcacgcaaaccaataacaacattcacaccactgtcacgcaagttttgtgcttgagcatgtccttggctaccgtaaccaataacggccactgtctttcctttcaatacgctgagttctgcatctttttcgtagtacgttgtaactgccatggttaatttcctccttttaattggacccttcataatgagcgggtaccccaagagactttccctcgtgctcagtatccaaaaatctcttcgagcccccgctcttatgcgggcggttctttattgatgtaatgcgctataagcggtaattcgttaaagctccatattaagcattgccacgtatcatagctgtaaccccggttcgagtcaactcccgaataccgtaaggcttcaacaactcgatcatggcatcaattttttctgtatcgccaatgacctgtacgatcaagctcgtcgttccaacatcaattacagctgctctgaatgtttctaccacacccatgatctctggccgctgaggcggttctgcctttacctttatcatcgccaattcccgagctaccatcggcttggaactgagatcgatgaccttgatcacatcaaccagcttgtaaagctgcttttcaatctgctccaagttgttctcatcccctacagttacaatgaccatacgggataatccaacttcttccgattgtcccacagttatgctctcaatgttaaagcctcggcgaccgaacaggccggacacacgttgcaaaacgccgggttgatcatttaccagtacagcaatggtattttttgttgtcattttactcgtcccccatcagcatttgatcaattgtcgaaccttgcgtcaccatcggatatacattctcttccttgctgactacaaactcgacaacgaccggtccgggtgtatcaagcgcctcctgccaagcccgacgtgcctcttccttattcgtagcacgcagtcctttaactccgtatgcttcggcaagtttcacaaaatccggacttccagccaggtcaatgtgactataccgattgttatagatcaattcctgccattggcgaaccattccaagaacctggttgttgataattacgattttaaccggaatgttattgattgcacagatggctaattcctgcgaacacatctgcataccgccgtccccgttaatcgatattaccaatctgtcgggatttgccatctgagcaccgattgcagaagggaaaccaaatcccatcgtaccaagtccaccagaggtgacccatgaacgtggctgattgaatttgtaatactgcgctgcccacatttgatgctgtcccacgtccgtcgttacgattgcgccgcccttggtcgtttcatccaacaactcaacaacccattgtggtttaagcaccgtttcagaatccttatatgaataaggtttctctttcttccaatgctgaatttgcgctctccatgcatcagctcgatccgcacgttttacatcctgattcagcaattccagcactgccttcacgtcacccacgataggaatatccgctgcaacattttttccaatttcagcagggtcgatatcaatgtggacgattttagcttgaggagcaaagccatccaacttgcctgttacccgatcatcgaagcgggctccgatacagatcaacagatcggactgttgaatcgcttgattggaggtgtatgttccatgcatccccggcatccccgtccacagttcatgtccacttgggaaaccacccaatccgagcaatgttgtcgtaataggaatttccgttttacgaacaaactcgtaaagtgcttcatgtccaccggagtatacaactcctccaccagccagaatgaatggacgttctgcttcggaaatagcttgagttagcttgtctagttgaattttgttgggtatcactttcgggttataaccccgcatggtcacaggttccgtttgtggaacaaacaacgtctgggctgcagaaatatccttcggaatatcaatcagcaccggtcccttgcgccctgtgttggcaatatgaaatgcctcatggatgattcgcggcagatcctccacatctcttaccagatagctgtgcttcgtaatcggcattgtaattcccgtgatatcggcttcctggaaagcatccgtaccgatcagggaagatataacgttacccgtgatgaccactaacggcaccgaatccataaaagccgtcgcaataccagttaccaggtttgtcgctccaggtccggaagtggcgatacagacacccactttaccgctcgcccgtgcataaccatctgccgcatgaatagctccttgctcgtgccgagtgaggacatgcttgaaatccttaaagccatacatggcatcatagatataaagcactgcaccaccaggatatccgaagacacaatctactccctccagcaacaggctacggagtaaaatttccgaacctgtaatcacttcaggcttcatccacttttcacgtaattcattggttgacctaacttcaggaatttgtgcactcattggtcatcctcctttacaaaatttacatacatctgacatttgtaaaaacaaaaaaacctttcatccctagaacagacttgctgttactgagggacgaaaggctgtagcttccgtggtaccacccgtgtttgcccgatatttcgcaatatcgaaccttggcaggtacagaaatcacaaaggatctccatatctggcgtctgtaacgtagaccgtacgattttccctaataggtgattcagcgcaccgttaatatcatcgggcccaaatacttttcaggaaaacagctccaaggtgagctcgttaaaaagggattttggtgaagcttgcagctaatgcctcactctctgaacaaaagagccctaatcacttcgtcctcttcattgccgttgagttcatgtcattctttcaaatgtttagacacattatatgtctctcatctgggatagtcaatacccatatttcataaaaatttatgtttcttttctgaagcacctcagagtcgcacgcttgtaagaggtacccgcatattataaaaaagaccacacggtgagacagtgcactcctccaaagccacgtcttatcttgttaaaagggtagaaaaggaggcccgtttatgattcgaaaacgcagctatcaagatgacaccatcatctttcgtctcatcgagcaagagcttgtccctctatcgcatttaagtgtccaagaaatggaacaaatacgcaaagaattaccccggcgcttaaaccggggcatcacttttgtggcttgcagaccggataatgcacaggttgttggcttcattcatgttatgctgcatggcgaactattatacattgatttgatcgcaatctcttcggctcatcaaggtatgcgatacggaaaaaaactgctggagcatgccgaacactacggacgactgcgtcgctgcaagcgggctaaagttatggtggacgaagacaatatcagggggatccatttttatctgcgtcatcaatatcaaatgctgcgctacgtagctctgagccgatgccacgaactcgaaaagtcactgtaaaaagtatctttttcgagctcaagattttgtatgactaaaataaattagggtaatacggatatcctactccggggtaccccccgtctgtatacgggcctggctgcggaccatatcctggtcctccataacctggaccgtagccaccatatcccccaccataggcaccaatgtatggagctgtgccgatggcaagcaagtcaaacagcaccagaggaataatcgccttcgtgtttacttttttcttgcggtttggttgaagaaccagtcggttacccgaaatgcgaatcagcttgccgctgacctgggaaccatccttgcgagtagcaaagatgactttgccaacaagcttctccacctgctttctggttactgcctgtttcatcgtatttcctccttctttctcaacggatggacagattgaacggctccttgatagctcatcaccaccacaaaatagaccggagctgacaggggccgagcgtcccgtccaatctgcatagcacagtctattccattcatgccagtggcgtatgtttaaatgcctgcacaatataaaaaaatctggtacctgcacatgcagataccagatttttttatacaccaatgtacattttcaaaatatacacatcagctgtttataagttttaacgcttgcttggatcataaagttgacccaaagcggccggagcacgtgaacgtccgacagccgctaccagtacaataatcgtcaggagatacggcaacataaaaataatttcctggggaatactttgggaccatgcgaacagctgcacatagttgcgaatggcttgtgaaaaaccaaaaaacactgctgcgccaaaagcgccgagcggattccatttaccgaaaatcatagcagcaatagcaatatatccctgccccgaaactgtattgtgcgagaacatattggttgtagtcagggtgatggtagctccaccaataccagccaacgccccactgatcataacaccaatataccgaagacgatttactttaatacccactgtatcggccgctcctggatgctccccaacggaacgcaaacgcaagccaaacggtgttttatacaaagtaaaatagccaataataactaatagaatggctaagtatgtcgttgggtaagcttggaaaaaggcttttcctgcaatcgggatatccacaaggtaagggatggatatttcgttgaaaccctgaatccgacctgtgtcaccatcaccctcaaataaaagcttgaccatgtacagtgtactacctgctgccaaaaagttgataactataccacttattacctgatcggctttaaacgtaatagaggctacagcatgaattagcgaaaccaaaataccgaacaccgcagctgacagcacacctacccaagccgcagaggtgcctcctagtccagcttgctcggcataaaatccgccaacacccgctgcaaacgctccgaataccataagtccttccaacccgaggttcgttacaccggatttttctgaaaaaactccgccgagagacgcaaaaataatcgccgtcgcaaaaacgagcgttgtatggattaattcaccaagtgttaaccaactcattttacaacaccttctctttcttccgcttggagtagagcggcttcacaacccaacgtacaataccttgggccgcaatgaagaaaataatcgagccaatgacaacccggataatttcgggcggtacatctgcgctaaagctcatccccgcagaaccatacgtaagcgttccgaacaaaacagaaccgagcagcacaccgaaggggttattcatcccaatcagagctacagcgataccgtcaaagccggttcccggtgatcctgccataacagattgataatggaatactcccagtacttcaaaggcacctgccaatccggcaaaaactccactaatgaacatcgcttttatgatattacgatttacattcatacctgcatagcgggatgcatcctgattaaatccgacagcccgtagctcatagccttgctttgttttccacatgaaaatgtagaaaaagactgccgccagcacagcaataaccgtaccccaatgtacccgagcattccccatcatctgggacagccattcgatggaaattgaagcagaaggctgaatatccacagaacgattttcaccatccataagtgcgaactgattgatcaccaaattagccaaatacagaccgatccagttcatcataatacatgtaataacttcattcacgcctcgtttggccttcaaatagccagcaatcgcagcccacaggcctccgaaaactgcacctgcaatcacagccaacggtgcatgtatgatagctggcaacccatggagtttaatgcccacaatcgaagcagctgtcatacctaccagaaactgaccttcgccgccaatattaaacaatccggcgcgggccgcaaaagcaaatgccaaccccgttaaaaccagcggagtcatctcacggatagcctctccaaagttataagaatctccgtatacacggctaaacaaagcagaataggccacaatagggtcatacccgccaatcagcatcacaatagcacccagaaggagacccaaaataatagagaccagcgccagtacaaaggagtcttttgtgaatattttcaatagattagccattctctactcctttcttcactgcacttcctgccatcatcagtcccagttcctggtcattcgtttcttctggcagcacttctccgacaatcttgccctcatagatgacagcaattcggtcggatacattcataatctcatccagttcaaaagatatgagcaacacagctttaccttggtcccgttgggcaatcagttgtttctggacaaattcaatagctccgacatccagaccgcgtgtaggctgtgctgcaatgagaaggtctggatttttatcaatttcacgcgcaatgatagccttctgctggttcccaccagataatgctcttgccttcgtgtgaatatccggtgttcttacatcaaacttttcgataagacttttggcctgtttctctatagcatctttgttcaagaagccatttttactgtaaggcgcctggtaatacgtctccagcaccatattttcactcatagaaaaatcgagcaccaacccatgcttatgacggtcctccggtatatgtgaaacgcctgcctctgaaattttgcgtggtggctgattggccacctcttgtccgagcaaacggatgcttccgccatccaccttgcgtaagcctgtcaaagcttcaatcagctcactctgtccatttccatctactccggcaatccccaaaatctcgcccgccttgacctgcaggttcaactcatttagaacattaatgccatccttgtttttagaaattacattgttcatttccagtactgtttgtcctggttgcgcaagctgcttgtccactttaaaggacacgcgacggcccaccattttctcggccagctcatttggtgttgtttcagacgtcttgaccgtatcaataacctgacctcggcgaatgatcgtaacggtatctgcaatttgcatgatttctttaagtttatgagtaataagaataatggatttgccttcagcgaccaagcgcttcataatgtccagcaactcagtgatctcctgcggtgtcagtacagctgtaggctcatcgaaaatcagaatatctgcaccgcgatagagcgttttgataatttctacacgttgctgcataccaacagatatatcctcaattttggcattcggatttacctgaagaccgtactgctcagacaaccgctgtacttctgcggcagcctttttataattgattttcagacccttacgtggctccgagcccaggacaatattttcggtaacggtaaacggctgtacgagtttaaaatgctgatgcaccatgccaatccccagatcaatcgccttatttggactatcaatctgtacgggtttacctccgatttcaattgtcccttcatccggctgatacagtccgaaaagaatattcataagcgtagatttacccgcgccattctcacccaaaagggcatgaatttctcccttatgcagcttgatgctgatggagtcgttggcaacgatgccggggaatcgttttgtaatttgctttaactcaacgacgggggtcgctgcatccatgagatcacccttatacactttatagtatgtgctccaatgagctgattttgcccgttataatccatataactccagacgtaagaacaaggctagtcttatgaaccagccttgtcgctacttctatattcttcaagccaaaacttatttcgaaggaactgtaatttcgcccttaataattttttgcttgtattgttctacaagatcaagcacgtctttaggtacgtttttcgttgatgtgtctgccaaaccaataccattatccttcagagccagtgtctcgacaccacccttaaatttaccatcaattacttctttagatacgcgttttacagcttcatctacacgttttaccatcgaagtcaatgttacgtcgtcaccaaactcaagtgattggtctttatctacgccaataacccaaacttgctgaccttgttgcttacgtgcgagtgcttcattaaatacacctgtaccagatccgccagctgcatggaaaataatatccgcaccgctgttatagatcgtcgcagctgctgctttacccaggtccggcttatcaaatgcacctgtgtagttaacttccaattttgcatttggatttacagctttaattcctgcttcgaatcctttttcaaaacgtttgatcaatgggctgtcttgtccacccacaaaaccaattttgtttgttttggtaagcttaccagctacaacccccaccaagaaggaaccttcattttcagcaaaaacaaccgattttacgttaggcgcatccacgacactgtcaatgatcgccaaattcttgcttgggttgtctttcgctacttgtccaatcgcattcgccagattaaaaccgattccccaagtcaggttaaaatcacccttaacaaattggttcaggttaggaatataatcttgatcggatttactttgcaggtatttaactttaacgccggattctttctcagtggcttgtagtgcctcccaagcagattggttaaacgatttgtcgtttactccacccacatctgtaaccatgccgatttggacattcgatgttttggcagaaccacctgtgtctccaccatttgcgttggacgcaccttgatttttgttaccgcagcctgcgagaatgaccgagatcgccagcagcataaccaaagacatactgaacattttcttcatgctgatactgttcccccttagtgttagatccctggactgtctcttttctttgaacatgtacatgctcatgcatgtcatttactgacgagacagatcgtacagaagacttactttagagattatacaattatgatcggctaaaatctagacaattaataaccttgggtcaattttttttaaaatctcatcaatgtaagcgttacaaagttaaaaaaaacatacattcttccatctcacgtcatatttattcgtattttggagaaaatgaagtcttttccgtaacattgagtatgtacaaaaaaaggcatccctacacagcgtactgcttgggatacctttttaccgctttcgcggtttccacgccttcattattaataattaagcgttgattttgcctttagcaacagttgccaaagagttgaatgcattaatatcattgactgcaagatcagccaagattttgcggttaatgtccacaccagccaatttcaggccgtgcatcaatttgctgtaagacaaaccgttcaaacgagctgctgcgttgatacgcacgatccacagtctgcggaagttacgtttcgtctgacgacggtcacggtatgcgtaaacaagcgatttcattacctgctcgttagctgttttaaaaatgcggtgtttggaaccaaaataacctttagcaagcttcaatacttttttatgacgacgacgaacgacgaatccgccctttactcttgccatatcaatagacctcccaaataatgtttatacttcattcattgcagtgctagtgctatttcaggttagcaagaccttgtttcagacgtttaacgtccccaggtgccatctcagggttagtacccagaacgcgttttgcacgtttggatttgtgggaaagcaaatggtttttgtaagctttgtaacgcattactttaccagtaccggtaattttgaagcggcctttaaggctgctatgtgttttcattttaggcattgaacttcctccttaatttgtcattgactctttggagccaatatcataatcatgctgcgtccttcgagcttgggttggcgctccacggtacaaagatcagcaacttccaatttcacacgttcgagaattttttgacccacattagcatgggtaatttcacgaccgcggaaacgaacggagcatttcaccttgtccccttcattcaggaactttaccacattgcgaaacttggtttggtagtcatgttcctcgatgttggaacggaaccatacctctttgatgtcaacgatcttctggtttttacgggcttccttttctttcttctgttgctcatagcggaatttaccgtaatccataatccgacacacgggcggcttcgcttgaggcgccacgtttacgagatccaagtttgcgtcaatcgccatttgcaaagcttcacgcgtcggtgtaatcccgatttgttccccattcgcaccaactagacgtacttctctcacccgaatctcatcattgatcatatgttccttactaataaccctccacctccagaacctgttattgttgtattgtgtttaagcacaaaaaagggatgacgactatacagccgacatccctgtctgatactcaattcatcatgaaagttcaattcacaaatcattggatcatgaccagccggcaataccgggcaggtgagaagtcggaccttctacttgttaatccatacttttcaattaacacactcaaatatcttatcacggtgcaatcgaggtgtcaacactttaataaaaaaatgaatgacaccgatcttcagtcctatttcaccgtccaattaaccttgcttgctctgaacctcttccaggcgaacgacacgcgtatgctgggtatggctccattgcttgttgttctgtgtaaagaacgcatagaacgtaatcggataccacgagaccagatataccgggaatagcagcaggtacagatatacttttttgaacgtgaccttttccaaaatcattgcgatcacaaaggtagcaatattcagacccacagctatagcaccggtccaagccgggaattgcacataaatattttcgatattaggtccaccaaataacgcaatatctatccacatagctactgtcatcaagaaggtgagcagtacgatatacacgtttagaccataaagagccatatcgaatttaatcaggcttctatgcttgatactttgccacagcaacggtaagaaataacgtcgagcaaccgtgaaatgaccttgcatccagcgcagacgctgtctggacgaagctttgaatgtcaacggcttttcatcatataccttggcatcgtaattaaatcttggatatacgttgcgttgtgtgcagcgcatggtgaattccaaatcctctacgagacttgttgcaccccagcccatttccttaagcagatttgtttcaaagcacatgcctgtaccaccgaggaaattagccatgttcagattgtgacgtgacagctgccacaaacggttgatgtaccaataagataccccgtatgccgctgtaatccaagaatcctcaggattcttagtatcaatgtacccctgaataacacgggcacctgtgcacagatcattgttcatttcactcaagaaattggtatgcgccaaattgtcagcatcaaacatgacaatggcatcatattggcgcggcatagcccataattccttgagcatccactcaatagcgtagcctttaccacgcagatttggattcgtacgttcacaagcattcatgccgtgagcgcgaacaatatccgcagtcttatctgtgcagttatcacagattacgaacacatcgtaaagttccttcggataatcaagttgcttcaaattttccatcaatgctccgacaacctgttcttcattgtgggcagcgactaaaatggcaaatgatttttctggagccgcgtgctctttccttttcttgcgaaccaatccgaacaaggagaatgcaaactgatagactgcgatcaccgccagtatgacctggagcgtcacaaaaatagcgtctaacatgatctcttgttacccccttttttataccccttaaaatcttgcgtttgtttgttttctatctgtgtagcgcaagttgcggcgctttgcgcgccttttctgtagtttttgacccgacccttgctttcttcattggctgtgcgcagcccccttttggctgacacaggaatgccattacgattttcgttggttttcaatcttttgtcaaagcccttaaaccggtctcagcagcaaaaaaacacaacaaactcccgtttgaaccgggaatgcggcgctggtcttctcattgatgacgcttaggtcttattttcatccatttgctaactttttatttctttggtccctcctttttgtgggccaattagcaaccacttctaaacactctatcttattagacggatgaacgcaaagaaagttatacaatttggcttatattccattaacatttttgtgtagaattgaaccaagtaagttatgaatctttagtgattcttgaaatgaacagcgtttaaaaatatgatgagagcaagagaataattacttatggtctgattatgtcaaaatgactcaaaatattgccgactgacctgaaccggcaaccggaggaaaccaaatgcaacgtttagtcgtaaaacttgtaaatctggagcagcagttgttcaaatggatcaacggacgcttacacaaccgttttttgaacttctggctttattatctcacacatttaggcggggctacctttactatagcctccacactccttatttggtggctcgctccgaatccgtggaaagataccggtatgaagggagccatcgctctcggggtcagtcacatccccgtagcaatcgttaaaaagctgtacccgcggattcgcccgtatttggcgctaccaggcacaaatacattccgcaaccccttgtcggaccattcttttccctcagggcacacgaccgctattttttcagctaccgtgcctttcatgctacagtcaccgatgctaacattgctgctgttgcctgtagcgacaattgttggtttttctcgaatttatctgggtcttcactacccaacggatgtactcgcaggagcggtcatcggaacgtctgcagcaataggaacggttgcattctggccttaaagccgatatggtatgattgagaacatcccagcaggaacaggtgaaatgagagtggctaaaaaacgagtgttattattatcggaaggtttcggtgccggacatactcaagctgcctacgcgctctcaagcagtttgcggaagctttctccgaatgtgcagaccagagtgctggagctggggagttttttgaatccaagaatggccccgcttattattacagcatacaagaagactgttgtatcgcagcctcgtctagtcggattggtttaccgtcatcagtacaaaaaatcattaaaccgtcttacaacgctcgctttgcaccgtctgttctacacgcagacccgaaacattctccggcagcttcgtcccgatttggtggtatgtactcatcccatcccaagcgcggtaatttcacgtttgaagcgcttaggcttacatgttccgctttgtactgtcattacagactacgatgcacatggaacatggattagtcccgaggttgaccggtactttgtatctacgcctgaagtcatgcgtaagctgcgcgcacgcggagtatccgtctcgaaaatccaggtgaccggtattcccgttcatccaaatttttgggaacatcctgggcacgatgaaattagagaacaatttgaacttaaacccatcccgaccgtactcgttatgggtggcggctggggccttatgaatgacgaagtcatacatcgttcgcttactcagtggagagatagcattcaatttattttttgtttggggcataatgataaaattcgtcgtaaaatgcagttggatcccaggtttaatcatccaaatattcatatcttcggatttacacgggaaatcgacaaattaatggaggtatcgaatctgctcatcaccaagcccggcggaatgacatgcaccgagggattggccaaagggattccgatgctgtttcacaaacctctccctggacaggaggaggaaaattgtcaatactttacggctcaaggcttcggagaaccgattacttcgctggatgttgtcgttaaatggatgaaccgactgctacacgattttccagaaatcgtccgcaagcgacaggagcacgtccataatgtagcgcgatattatcctcttcagagcgcacagagtattttggatatactggaaccgaacagggtgctttcctaataaggaagcaccctgtcttattttatccatttgatctgtttttatttcccgtacttttcaaggcgtgtttttccgtactcttccaaagcatctttgccgatcagcacctcgactcgatgaatattcatacctttgcccataaacttttgttcatattccgtcatgacatgctcctcgttaatcccctcacgatgaaggtttaacgaaatattcgtcatctgcaaaccactatcgacaaacgaattcagagaaaactcaaacagtgtctccgaatcagtcttaaaatgaatttgtcctttgctgttcaaaagctgacggtacttgtccaaaaaacgcggatgcgtcaaacgacgacgtgcatgtttggctttaggccagggatcactaaaattcagataaatgcgttcaatctctcctggttcaaaaacattttcgatctgttcaatgtttgccagtgccaatttgatattaggcggcgtatcaacctctgaattactccaggccagacgagacttttctgttgcacggcgaaccagctcatcatacatatcaaagccaatatagttaacctccggattccggaagctcatttggcttataaattgccctttacccataccgaactctacatgaatgggacgatcattaccaaaaagctgctgccatttccccttatactgtgctggctccaagatgactaggtcctgctgttcttccagactttcccgaattccttttcttccgcgtaaacgcatgttactcctccatatactctgttatcaaggaaaaaggaatttcacccccgcttgaagatacggaaatgaaattcctttttcaatatatttggattggggtccaactaatttaattgttcatagtctaccccatcagcaggtgaaaaatcaattgtcttttggcaagccgctctgattttttgacgtgcggtcgttccaatctgacgatcctgcccaaaacggacaccagtcaatgccaacgcctcatcaaaggttaactcaacagtaactttatccatacgcgtcttatcctgcgcattcataaaagatcacctcacgggttatttgtgatggaaccgacgtgcacttaccctaaaacaggcgatagaaacagcatagctgcctccctgaagaataatcattagcaacggataacttttatcttcaggatcgaaaacagtccttttattgtatgtctggtaccgcttacaatataacacattgtgtaacctttttcaatccgcaacgccataaaatacgcacattttattgacttgttcggtcaaatgattcccaatgaagactgatttttgttacaatagggtgatcgtaaaaaaaggagtacacccatgaaaacagatttattgcctgctcctctcctgtggggagataaacggttccatacttggaattacgaaatgcgtgagcaatttcaaaataaagtgttcaaagtcatgctggatgccggttttacctgtccgaatcgcgatggctccatcgctaaagggggttgcaccttttgtagcgcacgcggatcgggtgattttgccgggcgtcgtcgtgatgatctggtcacccagttcaatacgattcgggatcggcagcatctaaaatggccaaacgccaaatatattggctattttcaagcctatactaatacgtatgccccggttgaggaactgcgagaatacttcgaggttattctggagcagcccggtgttgtcggtctgtccatcgctacacgtcctgattgcctgcctgacgatgtagttgattaccttgccgagctaaacgaacgcacgtacctatgggtcgaaatgggtctgcaaactgtccatgaatcgacctcagagctgattaaccgcgctcatgatactcaatgctatctggatgcggtggaaaagctgcgcaagcggaatatccgcgtgtgcgcccacatcatttatggtctgccccaagagacgcatgaaatgatgctcgatacgggacgggcagtagccgctatggatgtgcagggcatcaaaatccacctgctgcatctcatgcgcaaaacgcccatggtcaagcagtatgaagcgggattgctacgctttctggaaaaggacgaatacgttaagctgatagttgatacgctggagtttttacctcccgaaatgatcgttcatcggttaaccggagatgccccacgcgatttgctaatgggacccatgtggtcgcttaaaaaatgggaagtgcttaatgccattgatcatgaactgaagtcacgtgaaacgtggcagggaaaatactggaggcaaccttaaatgggcttcctatccgtcctgagctacgctcatcaattggtggctgcacgggtgcagccaggcgatactgctatagacgccaccgtcggcacaggagcagatacgttgtttctggcaaaagctgctggcaaacggggccgtgtctatggcttcgacatccaacaagaagcactgcattgcgcccgtcgtcgactggaagaaaacgcttctccttctttagcagaagtatcgctactgctacaaggtcatgagcaaatgcgggaggccgttccggacatgctgcatggcaaagtcgctgcagtcatgtttaacctcggctacttgccttccgaaggcgccgatcctactgtcatcacccatacagacagcacgctcgtcgcacttgatgctgccttacaattgctgcgaccacgcggcattctgactgccgtgttatatccaggacacgccggaggcagtgaagaagcagatgccgttcttcaatgggcttctgctctcccggtctccagcggtcaaagcattatttatcgtcaattacaacgagccgcttcgcctttcgtagtggcggttgagaagaaataatgttggattttaaactcaggttatgagcggctttttaagccgccttacatatattatttttcaagctcgtttgggcactattcatcccagtttattgccacagcggcacgttattgatttccctattctgttaggtcgcactcattactcaatatggaggagagaaattatgctaaagccatacccgctgcaatttcaacctgagttcaaagagagagtttggggaggacgggccttagagcaatttggtctaaccccaccagaaggacatatcggggaaggatggatgattgccgatcatccaaacggaacaacaacggttatcaatggtgagctggcaggcaaaggactggatgaaatccgcgagacctacgggcaggattggctcggggccaagggtgtatcggaaaaaggcggacgattcccacttttaatcaaactactggattgtaatgatgacttatccgttcaggtgcatccgacagatgattacgcaggacttccagccggagaattaggaaaaactgaaatgtggtacgtgcttgatgccaagccagatgccaagattatttatggtctgaccgaaggtgtaacccgcgagagtctgcgcacagctcttgaaagtggggatatcctcggcagtttgcgccaggttccagtcgaagcaggcgatacgttcttcatccccgccggaaccgtacatgcactgtgtgcaggcgttgtcgttgctgaaatccagcaaaattcggatactacctatcgcttatatgactacaatcgcccaggactggacggcaagcctcgtgagttgcatatcgaggattccctcaatgtaacctcctacgaaggtgcaggcgcaacaacgatgaaaacggacggcttacagcctggtaaatggctccagttggcagcctgtgagtattttgttgtggaaaagggtatcgtagatggaagttgggcactttctacaacggaagacagcttcaccattctcgtgatttgtgaaggcagtgggaccataacatggaacaataataccgagtctctttcctgtaaagctggagattgcttcctgttgcccgctaacctgagcggttacacgctgaatgacggaatgaccgtacttagatcttatcttccttaaagcttaaaggatgtgatgtctaattatgcgggaatacaccttcaccatcgctgaaaatgacggaacagagctttttgcctaccgctggctgcctgatcagaatttgcccattaaggggattgttcaaatttcgcatggtatgtgcgagacgtcctatcgctacatccgactggccgaaaagcttactgcttgcggttatggcgtttatgccaacgatcatatcggtcacgggcgcacggctggtgatcctgataagctgggtatgccgggagctaatgcgtttaatcgaatggcaaacggcatgctggagctaggcgaaattgcagctaaggaattccctgatcagtctcgttttttgctgggtcacagcatggggtcctttttaacccagaaaattatgtatgatgatcggcaaacgtatcacgggtttattttatcggggaccaacggacgacgtggtctcctaaaactcggagagcaagttgctctactgcaagccaagctgcaaggaatggaccatcgcagcatgctgctcaacgctatggtctttggcggctttaaccgtgcctttcgtccggtgcgtacggcgttcgactggctgtcccgtgatcctgaggaagtagatcaattcgtgcatgacccattatgtggagctatatgcacgacaggcttttttctggattttttcaggctattacaagaaatccactggccttcctcgctgaaacacatcaatcccaaactgccagtttatatttttgccggggatcgtgatccagtgggtttgttcggtaaaggtgtgttgtcactagtggaaatgtatcgaagcctagagcttcaggacatcgaatatcgcctctatcctgacggtcgccatgagatgcttcatgaaacaaaccgcgacgaggtgatgagtgacatcgtggactggctcgaccgtcatgttaacacaggggtgacctctgtttccgcattgtctggagactccgaggcacccggacattcaacctcgcccaagtcatcaaccttgtgaggaaataagaaaagaaacctttaaaaccacgattaaagtggattgaaggtttcttttcttattgccttatattcatttggatatagttttaaaaatcaccatgcattccgttctctcagggaagtaatatgagctgtgtgatgcttgccatgccaggcatagatgccgatgtttcgttccaggcggatcgtctggcccgattcaggatgaataaatgttcggtgtagctgatcctctcccaacgatcgtaacacggtcacccaccgttcatgcagtccttccagcaattgcaacgaaggttccagtggaagctccctggcgtctggtatttcggcccaacgcccctcatcatatggcttgatcgtcggcgtatcctccgtcagtgccagcttaaaacggatatagctgttcatatggctatctgccacatgatgaactacctgccgaatcgtccagcccccttcgcgataaggcgtattgagctgctgctcattcagtccttcgaccgcctgacgcagctgtgcaggcaattcagcaatgtcgtgaatccatgcgataagctgttcttctgtaatggtatctggaacaacgaatgatcctatcggatagcgcaagtctttgtccaaaacagttcccgcccttctctacatttactgcctgtaatgtcagttgccttatgttataactatgcaggaaaaaaagcagactcgcaagagtctgcttgtgtcatacacgtaaagaggagatacacttgcccgattgattttatccttccagtaacaatgattccggatcttccagcaattctttgaccgttaccagaaaacgaaccgcctcactaccatcaataatccggtgatcgtaggacaacgcgatatacatcatcggacgattttccatgcgttcctcgtcgatggcaatcgggcgaagttggatcttatgcattcccaaaatacccacttgcggcgtattgagaattggcgtagacagcagggagccgaaaatacctccattggttatagtaaacgttcctccttgcaagtcggccagagaaagcgaattggagcgtgctttgccagccaaatctgcaatacttttctcgatctcagcaaagccaagacgatcagcatctcgtacaactggcacgaccaaaccttccttggcagatacagcgatcccgatatcatagtattttttcagtacgatatcatcgccattaatctctgcattcacggtagggaagcgcttgagtgcaccaaccactgcctttgtaaagaaggacataaaacccaagcctacatcatgtttttccttaaacttatctttacggcgtttacgcacatcgagaatggcggtcatatccacttcattaaaagtggtgagcatggcagctgtttgctgtgcttcaacaagacgcttagcgatcgtcgctctgcgccgagacatccgctggcgttccacaggcttgctgtactccgtttgtgctggagacggaggcgcaggcttgctagtagcgggagacgcaggtacagatgctgcacgtgacacttcagagctgttatgcgtttttacgtcctcctggaaaacacgtccgagcgggtcctttccctgtacctgctcaagatcaatcccgcgctcacgcgccaacttccgggcggatggtgatgccgtctggccattcccttcgccattcgatgaaataggcggtgcagacttttcttctgctttaacgccgcctcctacggaagacggtgaagtcgctacggacggtacttcaggcgcttgagtcgctgcaacttctccagcaccggttgattccgcaccaccactgccgcttccgatcaagccaacagcttcaccgatgaccacagtatctccctcctgacgaaggattttctggaccacacctgcttcttccgcactaatttccagattgaccttatcggtttccagctccagtagaacatctccctgtcctacggaatccccttccttcacaagccatttggagattgttccttccgtgatggattctcccattgctggcactataatatcgctcacagccgctacctcccaagtgtaatattgtttttggaatcctgcttcaacgccgattgaataattcgctgttgttctaggctgtgtacttgctgataaccgctggccgggcttgaacgatctggtctgcctgcgtaacgaatttccgctccctgtggcactacattccgcagacgaggttcaatgtaactccacgcccccatatttttaggttcttcctgagcccatacgaactccttaacatgcgggaagcggccgaaaatattccgaatttcctcttccgggaaagggtatagctgctccacacgaataatatgcagacgctcttctgcctcattcttatccttttccaatgcttcttcgagatcgatggcaatcttgccactgcacagtacaatgcgctctacacgatccggacgtgcacccagaccaggctgttccaacacaggacggaatgctccttcgctgaattcagaagcaggcgaagcgacacgattattacgaatcaggctcttcggcgacatcatcacaagcgggcgggcttcctcactttcgcttaatgcagcctgacggcgtagcagatggaaatactgtgaggcactgctcaaattagcgacagtccagttattttgtgcggacaactggagaaaacgctccagacgtgcgcttgtatgctctggtccttgtccttcgctaccatgcggtaacagcatcaccagactcgatttctgtctccatttggcacggcccgcggagatgaattggtcaaaaataacctgtgcacagttagcaaaatcgccgaattgtgcttcccaaatcactaacgtttcaggagaatacacgttatagccatattcaaagccgaggacagatgcctcagacaatggactgttatgaatactgaatgaagcacgtgcttccggcaatgtatgcaacgggcaatgtgtacggcctgtttcaggctcatgcagcacaaggttacggtgagcaaatgtagcccgctccgcatcctgacctgtcatacgaataggcttgccgtctgcaagaatggtggccaaagccagcgtctccgccaagctccaatctaccttttccccttcgttcagagcggtttttctacgctgtaaaattcgatccagcttcggatatacatgaaaagcctgtggccatttgagtaagttttcattgatttggcgcagctttttcaattccactgcagtacgtaccatagaattctgattctttttcgccttcacaggactcatttccggctcttgttccggttgattcttcacatgctcatgcgcttccttcagtctgttttggaccttttcaatgagaccggcactaaacgcttcatccactataccctgcttcatcagcttttgagcatataatttgctcaccgtcggatgattcttcaccttacggtataccagcggttgtgttgtttccgggtcatcggattcattgtgaccataacgacggtaaccaatcagatcaatcaaaaaatccttcttgaaacgattgcgatattcaccagccatacgtgccgctgcaatgcaggcttcaggattatccgcgttcacatgtacaattggaatttcatagcctttagccaaatcactggcataacgggtcgaacgtgaatcgacactctctgtcgtaaaacccaaacgattattcacaataatatggaccgtgccgccattacggaagccacgcaaatttgtgaaattaagtgattctgccacgataccttcacctgggaaagccgcatcaccatgcataataattgtagctgccttgctcacatccagcttcggataaccagcctcactgcgatcttcctgtgcagctcgtgaaaatccttgtactaccggatttacatattccaggtgactcgggttattcgccaatgtcagacgggcctgcactgcttccccatcttttacaaaacgatcagcacccagatgatatttcacatcgccagtccagccgtagttaattcctgtggaaccttctgacgggatcaaatccttattcggcgaatgatgaaattcagagaaaattttactgtaaggcttgcccagcacatgagccagtacattcaaacggccgcgatgcgccatacccatcaggacatgacttgctcctgcatttgtcgttagacgaataatctcgtcgagaacagggacaagcacatcattaccctcgatggaaaaacgtttctgtccgacgaatgttttatgcaaaaactcttcgaactgttctacttctaccaatctgcctagcaacgacttgcgttcctgtgttgtaagtggcttggaggaccagccagattctgcatagctgttcagccagcggcgttcctcctcgttgtgaatatgactaaattcataggcaatcggtcctgtgtatgctacacgtaaccgttgaatggcttcccatccgttaagtgttcccgcaggagcgttatcccatattaaagaggctggaaaagccttcaagtcttgttcagttaaaccgtaagatgctggattaagcaagcgtgtatcctgctctgcatccagttccagcggatcgatttgggcggctaaatgtccgtactcacggatattccacaccattttccccgctgtaaccgctttctgtaatgtgtttgaatcaaggtgccccaaagcacttgtgggggggccttgcaatttgttgtctatcatggaagcagccgaatattcggattgtggcggctcaccccattgatcaaacagctcgcggtaagccggatcaaccgttccggggtccgctacatacttttcatactggtcctgcacataacctagattaggtccataatacgcctgccaaggtacctgtctgctgctctcttccattgtcatctcgttccctccgtcaaattttgaaattcatagctggacggaaatcattttcattttttattaagtcttcaatttaagttgttcacaatatgctcacattatatgaaatccttcatcaaaagtcgaatttcacaattcttattcctcttccattgtataaagttttctagctaggagcatttcctttttctcaacatatccatgcgtaaatgagatgaatcgggctaatctgtaatcaaacacctggcaacttaaataaccagccgttggatatcaaccgtcggctggttatttaagtttatattgctcctcatactacgccaaaccattttgaaaataacttcccagtccacctcactatgattatcgttaacagcagaatttaaaaggcagagggtccgatacgatgcaaattcaaacttaaagtgacattaaagtcacttttctgtacaatattcctacttttcactattattttaattaggcatctaaaaaccgctttgaaagcgaaagggatggaactgtgactggattaaaacaagtactcagaaacaagaattatgtcaggttttttctggcaaccttcgcctcacaaatgggaggaattatcggggttactgcattcatgttttatttgttgaagcggtttacaaatcagccatactatgcaacgcttgccgagttaatgtattcgctcccgatgctggtagtatttctcgtggttggagtgctggcagatcggatggacagacaaaaaattgctgttaattgtgactggatcagcgcttttttatccttatgtttgcttatttttatttgggtcgattcgattcctttgatatttgccctcctcttcattcgtagtgctgcctccaaattcttcttcccagccgaaagtgccattatacaggggatattaagcgaagatgattacaccattgccgcaggcctcaatcaaatgatggggagtcttttcatgttatttggaggaactctgggggctgtcgtctactggcactttggaattactggagccatcctaattgatgcgatttcttttattgtgtctgctctgcttattcgttcctgcaaaattccaaaggaagtacgccttccgaacggggcacatcatttcaaacaattaaaattcaaacttgtcatgatcgattttaaacaagggtttctttacatattacgcaacagactattgctttggttggtttcaggcttttttatgttcggtattttaaatggtggttttagcgttttaccgatgtttattcttaaatataagctagctccaggcaactatgagcattatatggtatggacaggtattatttttggagctggtgtgttgcttggtaccctaatcgcttctctcatctccgccaagctaaagctacaccaaatgattgcagcgggagttctggtagccggaataggtatgtgcatactaggatttgttgaccacatctacgcttttctgattatcaactttgtcattgcactgatacttccgttcattaacattggcataggaggatggcttcctcgtattgtagatcctcaaatgatgggacgtgtgcaaggcttgattaatccgttaatgatgctgtcccaatctcttacattaggtttcattgctataagctttccttcatttatttcaattgagctcttgtttttattagttggggtctgtaccgttattgtaggaatatactacactattgtgcttccccgttatgctgattacagcacttcttccaagacccttcaggaatctttatagtcaaataaaaaagtcaaacagcagaccattccgccagcattgttgagttgccacttctgcctccgaatccagtgcagaggtggcttcatcatatctcctctcaaatgctccacaagtacatacgttggttgcatacgactagctcgtcacaacccagtagatacatagaccgatagggtatgtaatattcaaaaaaaacgcccggcagacgcattagctgcatcaacaggacattttgattgaaatcggagtagcgggattcgaacccacgacctcacccaccccaagggtgcgcgctacctagctgcgctataccccgataaccaagtgtatgtagatcgatgctgttatttaccattatattctggtcataaaatcctgtaaagggattattttctcatccttccgttgcatttttaagttgttttcattatggtagatacaaaagttaagaggtcaaaaacagagatcataggagctaaccatgcaaagcaaaaaagtgcttatacccgttgcattacttcttttaatacagttaagtgttcctatcttctatacctttgcacaggataaccttgtcatagatcatgaaacgaaagagagaatcaaagaacaatatggcttggatgaaccggaatttccttcatcaaagcagcagcaaaacatattattgggaggtgattttggatttactccctctggtgatgctgttgtagtggaattgaccatattgattcggtatccgctcatttttatcagtcaacaactggtacattcactgaaatcataattttttttctacaagttccatgatatagagcataagaatcatttatttcgtagcaagttgtctgccactcggggtcacttcatccttcttattgaaaaggtttaattcaatggggcccctcccatgtagccacagcagttcatcgaataaaaatgtcagtccatccttagcgcgtaagcgttcgatgatctccgtaacaacttgcataacttccccttgtacaccctctgccagttgcaagcctccgctctctccatctaggtaaagatgcgtatgatatgattgctccaccttcttcacatggcgcaaacacagtatgccattttcgaggtaaaagaaatattgatggtcatacagaatcccctcgcatatctcatacatatgaggtaaatcatatggcccctgaatcatggatacccgttccaatcccattacccattctgtcatacatcctcgctccattcctttgttcatttatcacagcttagttcgatgaaatattaacctgtattacaatttatccattttaaaaaccgctcaaaattattatataacgttgttatatgaattttataaggaaacttctatacgatttttaagcctcctcacgcattaattgttttaggattatcaaaatagtgactgttgctaaatttaaagcattttgatactatgaaggcatcaacttagtttacttataatcttgttaactagattacttaattacaaatatacacttatatttcatacatgtcaactagtttacttgattactttttggaggaattgttatgattagattttctcttgataaaattatgaaggaccgtggactcgaacagaaagatattgtttctattacgggaattaataggaatacgattaaagctttggcctccaacgcaaacgcccgaattgactttccaaccttgaacacactttgtagaacccttggcgtactccctggtgaactgatcgaatacttgccagaagacgacgaagagagccgttaacatgcttacggccctctgttctttgtataatctccaaaatacttttttaccgatcttcccattcaaatgatttcgatcatcgttaaaccattcctattagcgatttcaaataaactcttcccatggatgataaatatcaaataatgcattaaggttacgttgtccctttaatactgcaaacattttattcgttacgatcatgatcacatccatatctttttgcctagtcaaaccagtgataacaggacgatttacgctaacatacgacttaggtttaaaaacaactccccagtccaatccactatgattactttttacaacctctcctagataaatggcaatatccagtgtaaaagcttgagactttgtatcaagttttttatcatatatatagcccttcaaccattcttcagtttctgaatgctcctcttctaattccgaagcacttttattttgaatctgtacatttcttagataccattcccaaatgtctataagcgaacgatcactataatccagatgtatctgtgaaaatgcgccaagttgctctaaacgtgaaggtatttgtcgtttaaaccaattaaaatgttcttttgcttcgtttttactcatttcagagtattctttcatgacaaaaggtggttgcattaatttatattccattttaaaaattcccttcatgctttgctatcttaattcgaagaaaaattcacggtaacaccacctgatactaagatcgttagatgctccgtaaaatattgctgtggtaaaaatctataacctctctcttcttgatcccattcttcctcgaatctttccaagaaataatgtacgtttttccaatggatcgtgaacggtcctactgtcccaaaacctccacagagacagtccgatatactgtccaagctaaatccatagtaccctccgggcccattaatcgcttcaccagtgctatgaaaaatgttgtaaaatcagatatgtattcaccgtccaaggtgtagacttctcctcgtttatccagtctggcaaaatgattagatgcagatcactgtttcttcatcatttaaaatagcaatgtacaagttgtatatagattgttttaacttcgttatgttttctatgaattcttcgttaaatacaaattgctcaaaaatgatcttttcatatgtttcgacaatgatatcacccgctaaaccaaccacatctctacaataaccaactgtgagcccactttcatcgtcaatgacagcaaatctcggcctcattttatatcatacctcctcacaataattttaaggaatgtagcattttaaggcatcacttttagcttcttgggtagaataaccaattattttgaagccgataaggattgagatcctctacactttttattttctttagatcttctgcaggtattgcaaaataaattttccccttctcagacttaaacgttaacgaagcatcatacttcttttcaacaatccactgctttatttccaacatctcttgaagataatgagtggctgaaaagttacctttaatacaaattgaagcttctgaggagagtttttgactaaccttagaatagcttggaacctcgtcatggtaggttaaagcatcccgccccatatgagaaacatttatgatgacttctgcatctgatcctgtaacttcctttgttttttgtgttacagctttttttagctcatccctccacacagaagaggcgtagttatccatcatttgcctataatagtcttcatccaccaaaaaagaaatccctgagtcagagatcacatttgctataaatttatcattcttaaaatcataatctattgaatcaattttccagttcatagtgtacgttttatgtaggtagtcagtgacgttactccgaaattggactctttctatcggacttcctgttgtaatggatacaactgtatatgcaattacaataatgatcacgaataaaacagctttttttaccactccaaccaaacctctctaataaaagaatcatgtaaaaagctctaaagattccagcaaaaagtcacgcttatatttgtttttataatcggctagctttcttcttatcttttgtctacatatgtccttttgcgccttagtaattttatcttttacggtacttatcagttgataggattgtctactcgcttcaaaggtatcatccagtaaatctaccagcgccacaacatgagtagatacgtcaaaaaattctaaagcatataacagtgttcctctattccccttggtctttggatttcttaacaagtcgataagaggcaacaccgcttcacggtctactagatcagctaacgtaatggcgattacatttcttagcaatacactatccgtcgttgctaaatatctcaataatattggagtaaatgtataatccagcttttcacctatctcctctataatctttaccgcttcctttaaatctccactttctatgacttcttctaatcgcattttgttcatagtttaccaacccaccttattacaatatatagcaactattcagtcttaatacaattcaataatttacatatgataacaatccgatgtctcttttgtatatagcgaacattgtcgagaccctaaataaatatccactcattgatttaaaataaacaaaatgttatattgtctataaaataatcatcaattaattgaggtgtttgctaaaatggatcattccgaactattctggaatgctggaatcgaagaactgaagcgaggatatattcgccaagaagaacaagtaatttgcctgctggacggacagcgatacgagcaaggcatcatatatcaggatcaaggggtattttatgacgcggagaggtacatgcgacttcatattgagcggacgtacggttcggtctttgactatttgatcggtctggacaaaaagctgactggactgacggatcatcagaatcggttgcttcagttattttatcaaggcatgggcgatgcggatattcaaaaggaaaccggaatcggtagcgcatccaccatacgtaatcatcgctttggtctcaaagaaaaagaacgacaggccaaggtttttctcacattaatggagctgttaaaggagaaagaccgacacgctcctgccattgtagaagtaccagtacaagcacggatggtggacgaacgctacaacattacggaaaacgagcggcaaaaggtactcacgaagtattttccgaatgggacagacggacgcctaaagacctttaaaatgcaagaaaagcacaagctgattgtgctgcgtgaaattgcgggccgttttgtaaagggacaaatatatcatgagaaggatatcaatgcgattttacaggaagtatatgacgattatgtcacggtgcgaagatatatgattgaatacaatctattggatcgtaagccggatggcagtgaatattggttgaaggaatcttgaatctcaacgtttatacaataggaggattcgacaatgaatcgaagaaaagaattggtgcagcagtacatggagatgaagacagaggcaggaatctattgcattcgaaatacacgtaatgggaaaattttcgtctcttccacgccgaatttaaagtcgctgaatggacggcgttttgagctgaacatgggtggatttaagaataaacaactgcaacaggaatggaatgagtatggcgaagattcgtttgaatttgaagtgctggacgttttgaagaaaaaggactcagcgttctttgatgtcaaagatgcactgacaaagctggagcagacctggcttgatcgactccagccatacggagacaagggatatttgtaaacttaccgatccacggaaaactccttccgaaggtagccaaaaataacagcgtcgacaaactgacctttttcataaaaatagtctctcaggtgaccttctttagtaaagccacttttgagcagtagccgtctggagccttcgttatctggatcaatgaaggcttctatacggtgaacctgcggcaattgaaagccataattcacgaccaccttcatcgcttctgtcatcagaccttgccgccaatattccggtgccagctcatacccaatttcaatacgggagtgctccttgtgccagttatggaatccaattgtacccacgatccgctcaggagcttcttttaacgtaatcccccaacgaaagccctcttgcttctcatatctggttagcatcgaacgaataaatttttcggcttgctctacctctgtaaagctttccaagtcataatattgtgtgacctcatccttggaaaaatagccgaacacatcctccgcatcccctactgtaagctgtcttaaacgaagcctatcggtttctaaaatcggaaacgtttccattgacattatccatctcctcctttacatcgaagaacctatcttatcagccaccagccaatcccaaccatcactccatttatgaagaataatacaatacatgctctccatttgctgattccacttgtttgaaaaaaacctgtgactttactacgacacatgaacaacgtaaacaacaaattccaaataatacgcataccatattttacgtagtatagagcagggtttagctgtacaccgcccaacgttggagggacatccggaataaacagaattgcacacgtataacgcatggtctcatatgtaaaataaaatactgccagccaccaagcccacttcttaccaaataacataccgacaccggcagtcgtccctgccaaaccgagtaacgcgataaatccttgaaacatgcccctacaaatgcctactaacgtagaagcctcatttaatgcattaagcgtcaatagctgggtcaccaacagaagtgccccattaaagatcaataaaatggctgaaatgcttacacctaaaggtcgttcgaaaaccacgttcgttacataatcttctacttcttttttcgtatacagatctgacacttcttctactctcctaacccaaattatatacttccattttcgggcgggtataataacagtatgttctcgcctcattcccatatatcggcttttaggaaaatatgatttaatctttcctgaaaattccgttatacgtaagctaatcattattattcagtgcagccatactgctaatgatcatcctctaatggtatctaattagcgtcatgagaatctttatcattaacagaatcccaaatagagtaatatctatccttatactaccattccaagaatgaatctgacaaatgaatggactactactcccgcttatgaatgtacacgcgttattttcgtggcccggtaaccttcagatgactggatatactctacttgataacccattcgggcatccaaaagctcttccataaacggaaggcacggactgtaaataaaactccctcctggccgaatggctctaagcaattccatatatttgcgagcgtactcatgaatattaccatctgccttcagatgatgatgtataaaatgattggagaatgccatatgtgaaatgatcgtcccccatgcactttctccaaaggtggtctctaaccaatctcctcgagtgacacaaccttctgtttcagccaaccgatctgttccgtaagcctcaattccacaggcacgtaaataagtaattaaccgtgcctcagatccgcaaccaacatctagaacaggctcttgcaaacgagcaatgtccaatcctagtagattagcttgcaactccggcgtatattcctcacaaggtatccaaaaggtatactcacactctgcatacttagcaaacatttcacgtccgttggtacgagttaaaaaatccctcaaatgcccgtaatgctgctgaagcagcaagtccaggattgctctatctatagatttcttctggaataacttttcaatccgagtgaagagtcgatcatacagctccgtaagctccttcgcatgatctgtgtgaaaatgtagatactgattggtatttacaaactgggacagtattttagccgctacatccgtcacaaaagcgttatacgtatgctggcgcttcaagctttgaagcatgaggatcagttccgagcttctctgcgtcagccagtacgtcatttctgttgaaggtcctaacagaacagaaccctcgcgcatataaaataaactccgatgctgattgtacaggagttgaccgttaataagattatgaagttgggcgactgtcattctcgcttcctccttaagatccagaacattaaagccctacccaagcctaagcaatgctatctttgggtagggccagcttattttctaagtataccatgactatggaaataatgttttattgcgaatcttccgcctgtacataagaggataaaggaatgttcagctcacgtattccctgagctaccagccgagctatttgctccgcaccgtattcctgaaaatgtgtatcatccttcactccatcaggaaatgcaggatacacccctggctccacatgtaaaaataacggaagtgttccttcgaggccaagtgtatcatagtacgctacactcaagcggctaagatcgaccagtgcaacatttgtctccgatgctgtttccttcatggcctgcacatattccgggaaactaatccgaaacgaggcacttgccgcatcataatcccggcggccaacaggagtaattagcacaggtgttgcaccgcgttggatggctccttggatgtaggtttttaagtaaactttgtaatccgcgggtgaaacataacgctcttggttgttgatcgcggcatcattatgtccaaactgaatgagcagataatctcctggacggatattgcgtaaaatatcatctaaccgcccttgtaccagataggttttcgtgcttcgtccaccaatagaacggttcacaaaaataggctcatctgtgaagaacggtgcaatcatttgcccccagcccgcttgaggcttcatcgcggatttataggtttgaaccgtagaatctcccgcaagatataccgaagggcgttctccagccgttcgagcatcctttggagtaataaccaaagcgttaatcttcgcttcattacctgagaaatacaattcgagctgaccgtcgatgagtgcaagttcaaatccagcctcgacaaattgtcctgctgttttggtagtaggttctaccttgacaatggactcggctttaaccgtaatgtctgtgtttccggcagtatccccggcaataagggaaagcgtgtaatccgcaggtggtaaattgacaacaaatgatgatccttgaacacgaacaaaatctgagcgtatagcatcacttccaccacgatcctcttcatccaccttggaaagatcggtaaatccatagcctcgctcaggcgtgtaaacatccttggcagtgacttgggtgtagccgtcagctacgttccctgggccaaagtcgaatcgaagaggcgccgcaagctgtctttcggccagtgcttgccctgggataagtatggttgcaaacaacaagctgaatcctgcgcataatccaatcatcttaccgaacaacctgtgacgctttcccttttgtttcaagcgcaaccctcgcttttcaggttatttaagtggtttgtcattgtctctacgtgtattgctccccgccagcttttgacagccttgatccagcgcccaggataccacaatgccaaccgtgtacctgatcagatccgcggtcaggaaccctttcccaagcaccaagccacccagcgtcgttgcccgaatgtggttaatccagggtgcctggtacatctggctgaactcaatggcgaagcaaaacagcaagctgccccacagggctacagacaattgacgattcacccacaacattctcagcccaaaataaatcatgcacgcccacaaagcatccccaaagtgattagcaacgaattcaggcaactgggaggagaaaacccggcttcccaaacccaacaaaatcgtgaccagcacagcaattaggtacgcagcgcgggccttccagcggaatttcgcctttatttcccgattggcctttctaatgacgctcttacgaacgctcctcatgctaaatcacctgtcctaatgctgggacatcttcgccaagctgctggaaattcgtaaagcatcctctcttggatagcgcttgcaagattgctgaaccttttgctgatgacatattgtatgcacactaacttgtctgtatttttcataatataattaatcataatgagcctccgtaatatcgtacaaaccatcagcaacttccaaactgttcatgtgaggatactagaattcaataccacgcaccttggcaaaaaccatttggtgtgccatgctaccctcttcatcatactcgacgtttcttaaaatcccctccagtgtaaaacctgcacgttccgctaccttcgcgctgcgcgtgtttctggaatcacaacgaatctccacccgattagcatgcaaatgctgtatagcaaaatccgtaataccatgcacagcctctgtgataataccttttccagtccaggatgttctgagccaatacccaatttcaaatcttcgtgtatcccaatcaatacgatgcagaccgctgctggctacaaattctcccgaaaccgtatcaaatatatacaacatcatatcagaccgatccagaaatttaagtctggcttggcgcgaacggatttcagattcctctgccgtaggaagatttcttgcaaacggaagccaaggccgcagttcattcgcactctctcgcatcgcctcattgactgccgccccatccccccactgcggggcgcgtatggtcaatcgttccgtctggaattggtcagggaacgataagagaatgggattcggttgctgctccatactcatgatgcaccctcctccttattcgttgaataactgcgacgatccagccaacctgtgatttcacgcaaactcccaatctgatagtccggtacaatgcccgtttcctgccacgtcataaagccttccagccagatggtatgcaatcctgcactttgtgcaccacgaatatcatttgtcgggtgatcgcctacatagcaggcatggccgggatcgacaatgcccagctcattcagagccaactcgaaaattcgaggattaggcttctggatgttgacgccgcccgatacgataatagaatccacataatccctcagcataactcggtcgattttcgcttgctgcgtacggagtgagccgttggtaataataccaagcttcaagccacgagaccgcagttcagacagcacttccttggccccgtccatcaacaccgtaaacttatgaaattcaccataccaaaagcccaacatctcttgtactgacgtatcgggatttttcagttccaagtctgcatgcagctcggtatacagttccctcttatcccgatatccgtcctgatccgccaaacgtatctgttcaacgacagccgcgcggatcgcaggttcttctgccacaataaatcgttctataaagcgctctgtatatgccgcaaacgcctgtttacgatgaataagagtattatccagatcaaaaacaatcgcttctatggacataaatagctcccttccttcatcctcttgcaccgattaggttgagacaaattgaataattcctattagaaataaaagaaaaaaaatagacaagaaaatgatgatcatgtacttcaagattctcttggaggtcgacttttgttccagtttggtctcgatctgggtcaacctttctttgatttcttccaaatcctgctccaccttcacatcatgctcccctttcttcgtttcgacttattcatcttcctgacactcactcacaaaagttgctccaaaaacgcaccttttttacggcattaaaatcaatttgttcataaggcttctctccaaattccagcttgaaatactcctgcaaacattccccatacacgataatatccgtttgatacactgaaaataccggatttccttcttcagatggctgctctgggatatatcgatgtccgttgatcgggattagcttgggcacacgtaaaatctcacgtttacatatatcaacggcttccgccgaatctgtcggtttttcgccccattcgggaggccagaatatacgttgctccacatcaaaaattataccttccagcggccaattcaacctttgccgaattacacccatccgctgtggtgacgtatctctccaagggataaagcttttaccgatgggaagaacactcatcagaagctccctcaaatcgggcgggaagtgaatatcatacctgccttcgacatcggtaacctcttgcatggataagcctggagctaaggtcacatcgtgtttacgtaataaatctatgatataagcgatatccatctctcttatcgactcctcagcagctagctagttgaccggattggtcaagaggcctaccaggcttgtaacttcaacttcaccaacacggcgcgggccttccataaaatatcccctcgttcctgcgtatgctgtctgctattttcataggggttccacatttcatatcatccctttaggtcttttccaaaaatatgtacttcattctagtgtaattcaataggaaaagaaatccaatacttatccgcaattcattgctgaataagcttggattatatgagagtcctttattaaaatatataacttctatacatgctgtccgttcacctgaatatctgcggatacttgctgccccaaccaagcgcgcatgcgattccacgaaaaaacctgctccatgtgaaatacaccgtatggaagttctgaacggtacagggcgagcgctgcaaagacggctgccttagcggttaaatcagactgatggtggccccttagccggcattcaaccttcgtctctttgccattgagagttcctcgagcatctaccttgaccgctacagcattccctcctagatgtatcttgccaaagctgcgaaccactgcatcacgcacaatttgctgtcggagtaaacctgatactcctatcgtccgaagccctgccagaagccgggtggtcaagcgcgaatcaaagcaaaggcgtgtgctaacggtaggaactttgagcgtacgaggaagtgtctgctgatccgaaaaaggaaatcgatacgcccgatggcgccccactcctgcaccaaagtctgccactatgccgtcagtaaagctttttcgagtcaccaggcgtccctgttctataacctccaaatcggcatgaatctgatctactgtccactcaatggcagcctgaccgtgttgatctcccaagcctagcatcaaagatatgttcaactcatctgtctgatccatgagctgtgtcgcttgcagtgccaacagattggtcagccccggagctaatcctacacttaacagggctgtggcctgataagctcgggcttcttgatgacactgctccacttgactcaaaaaggccgcattcgctgtaatatccatgtaatgcaccccatgttgaagacaggcacgtaccaaggccgtattgtcctgatcgagacacatgataaccaatttagcttgctctaatatcgacgggtccatcggctcatgaatatttagctgcaagggccgtatcttaccattcgattgtctactaaattcagtggccctctccagactacgacctgcggcaaataccttaccgggaaacatttcacttaactccgtgcatacaatttttccaacatggccatacccaccaatgatgatgatgttatcctttgtcataagtcgtctctccctctttaaccgcaaaccatgctattactaaaaaagcgccataataccgggtgatgtgggtaaaacctgcatctatcaacagttcctgtattgccgcattggacaccgggtttgactcacgaccgatggaagcagcgaatcgttcccaatcctccagtgacggtcctctggatgactcttccaacgtacctgcaacaaatgatattgttgaactgatgcccgcatgtgtcacacgcttacgtgccaaatccagcatatgctcggagggatcaactgccgtaaaggaccatgcttcatggcgctctccgagcgtaatcaattcctggccgcctccagctccgacaattagcacatttggatctatatttcgaatatgagcttgtgccccaagttgtgcggctatcaaacagtctgtcatctcgtacaaatgagcatatccaggtatttttaaagcaatcgtatccgctacttatgcacattcggatgattccagctcataggttgatttgagtccgtatttccaataggggtatgtttcatatgtgctttcctccaaacatttagccttgatcttctcagaccattcgtttattgttgatttaattaagaatcattctcaattataaagacaatacgaatatccaccatcccataaatgtgggatttaataatcgcgcttgagaacctccagctttcacgataggagtaaatgatgaacgcacattacacgccatttgcacagcttaaggacgctcgacagcagatcatggatctggggaaaaaagccccctcatccctaacgtacaagcacaccctaatcgaccgtttgcgtactcaggttgctttcgatgcggcgtgctgtacctcagtagatccgcgtacgttgctttccacgggagcatttacagagtcgggtgtggaggacattcataacaaactgctagaatacgaatatctgcacgacgatatgatgaagtatgatcagttggtgcgagaaggacagtctgtagcgacgctacatgggtctacacaaggccaaccggatcggagcacacgatatagagatgttttgcaacccgctggattcggggacgagctacgtgttccgtttatgtacaaagggagctgttgggggtttcttacgttgttccgtcaccatggaaaacctgtattcagcgaggaagagcaacaactgcttgaagcgttagcgccgtccattgcctaccatctgcgtcaggccagtgtcggtctatctccagcccctgccatgattacggaaaatgaacttgaaccaggagttctcatactttctgataagctagaaccgatcgcatccaatacagtagcagagcagtggctacagctgcttcggcagcaggagggaatccatgaagacagccttccggctcctgtccgggcggtatgcttgcgagcgctatccactgccactgcaccagcccgactatgtatcccttccgcagacgcaggaaccccatgggtaaccatcagggccacccttttgcaaggcggacaggagcatacgggccagaaacagctagccgtatggtttgaggctgctaaagcaactgacatgctgccgcttatgaccgaggtgtactcatggtccgaacgagagagacaaattgtccagctcattgttcaaggcttttcgaccaaggagctggccagcgcacttcatattactgcctacacggtgcaggatcatctgaaagcgattttcttgaaaacagatgtaagcagccgtcgtgagctcgtatggaaggtatattccagattcaactaacctatgtaaaaaagacagatgacccaattaggggtcatctgtctttgcttcactgctctatttggacacaagagccttatttcttcgaagaggagttcgtatcatcgtatgatactggtgagggcttcgcaatccattcatccgcctcaggctcgatatccacgccattttccagcttcgttttctccatcaaggaatctccgtcctcgtccttcttgttgcggattttcgcttcgtcttgagtgtgatcgctcatgttgattcctccttttttaatttcatctgatggttgtaccttactcataattacccattgccgtcctgtacaaacctctacacgaccagatgcccttttttctccgctggttcaatggttgcctcaatgccagcattaaactccagaaagtcgctttccactccatcgctgaaaataactccattttccggcatctgcgatgcaatccgtaacggcttttcggctgctacctgaccaaacacaagatccgcagcagtcgttcgactggggaagggttctctcaccgtaaaataaagcgatggcaaactccaggttgcacgatgatcctgactcgttccgtctgctgccccttcctgactgaaggctgcacctggcatcagctggcctggagtcagcgagattggatgccgtgtagcactgccgacaatcccggccgctccagcaagcacgctggtcagccagcctgtcgctcccaatccggttgaaacgataatgccgctggaggattgctgctctacctgatcctccagtcttagctcatatctcgcggagacatgagttttgcgcccaatgaacaaatcatttacagcatacaaggattggccatcatttaattgggccttagccagcgtaacttccttaattggccgtctgtgcacgaacacatccggcaccacccagcgcaggtcggatacagtaaacggcagcaataccccgtcccagcgcaatggatctggattcacaccgataagcggctgctcggtcaaatattttaacgtgttggctaccagcccatcctgacccagcaccaccactgtatcctgctccccaaaaataaagttcggcacatgctcccgctccacaatctgaactcgacccaaggccgttaactccgacgtagccgttgccaccgccctgcggtaattttcgtcctccagcacataatcactgaaatccgcacccagccgttccataaagaagcgagcctgctgcaccgtattgtatcgaacaatcagttcctccagtcgcgttttacgcttcactaaaatgatcttttgctctgtcattcggctgctcatcgtgttcttcctccagaccctctcgatcctgctgatccgcttgctcccgtatctgacatgagaccttgcagcagatccggtgtaatattcagctgaccgattttccctgcattttttgcaagctcctggaatgctatcgcaattagcttatccgggctcatatccatgttggccatagcttgaagtacgttcggctcaacatcctgcaacgatttcatgactgctgtcagctcgtaggccttggcatcggcttctgcctttttattcgttacggtcagctcaatcagctcgcgctttttctcctccaaggccgtgtcaaatcgtagctgctcctctttcatctcgctttgcttttgcttcacagaacgctcggcatcaagttgagtttcgcggatttgtttctttttcgtctccactgcaatctcggtgttcagctcgttttccttcacacgccgctcttgctcaatagatgcattacgacgctcatacaaagcgtgatccgcgttgcgaagaatctcttccctcgcttgagcctccagcgctctcatcgtctccttattgggtagaatcgccaaaatcgacaaccccataacctcaatgccgagcttttccatttccgtatgctgagcaatatccttcgtcatattttgggccagacgttcactggactgaacagcttctttgagcgggacacgctccaaatactttttggtaagcaccttggcgatgttaatcacccgttgggccagcttgctcggatcatccgaaatgtagcgtcgttccttcaagtcatacgtatagtttaaaatctgcgtcgttctccgataatctacaattcgataagtcagttgcccctgcaccgtcaccgcctgaaaatcattcgtcatatcctcaaacatgaacggtacatcaatggaagagacgggcacgacgacgaccgaggtggtcggggcgtaataataaaaagataatccaacaccctcccgaaccaccttcccgtttttcaccttcatcacatattcactgggctgaaatttaacaaaattaaatccaaacatagccgcttccccgctttctttatagtttataatgttttgttattatcattttgttattaacaataaaataacacacattttcgataatatcaatatgacatttataaaaaaataaaggctgtttcccctccgatatactcggttagaggaaacagccttattgaaacacttatttattatccacattccattctctataaaattgctccaagtacatctccatccattgatgccgaacctccgccagctctcgggcataagtggtattcattaaatctttgagcttgagtagcttttcgtaaaaatggtatatggcacttttacctgcggcacgatactcatgctgtgaaaagtctttatccgggtgatgcatcatactgccctttgagcctgcatacataaaggttcttgcaatcccaatcgctccaagagcatccaaccgatccgcatcctgcacaacttgaccttccagcgtctccataggcgggttttgtccaccattgtaggacatcgtagctataatagtcatcacgtgcgtgattacattcggatcgctgatgtgcagacgcagccactgctctactttatctagcccggcttgtttagaatcatttaatttttcatccgctacatcatgcagcagtgctgccagctcacaaataaacgaatctgcgccctctttggcagcaattttaagagacagctttctcacccggtctatatgccaccaatcgtgaccactatgatcatgctccaactgctgctgtacaaagggctccgccttttgaataatatctgccaaaatcgcttcctgttgctccgttcgtctcttcatatgtcacctttcaatcccgtccatactttctatggtaggttcgtttaattttttaatgcttgtccatttgcttactacgaatcattcttcattttattctatagggtgtagctatccaacctttagaacgagaagtcagtaacctgacaaaaaaaagaacctccaaaaccacatcaatcgtagtcgcggaagttctttttcgtttgtctatctaaacccgatcctctttaacttaattccgtatcttactctactccacgacaccaagctcgcggttcttctccttaaaacggctgttatgagaagatacatatgccgctttgtcagctgctggatcaatgtgcaacttcgcgctgttcagtgcaagggcggcatctgtgaacgcaccggcaatcagatacaacttgcttccgtactcaacaaaatcgcctgccgcgaaaatccctggtagattcgtttccagtttttcgctcactcgggcatgccactcacccatatccaccccccaatcccgaagcgggccgaaatcggattttagtccatgatttacgatgactgcatcgacattcaacacctgtatttcgtccgtatctacatgactgatcgtcacctgttcaatcgtctctccattgttgctatgtagctgactcaccgcgtatggtgtgagaacacggaccgaagatgatttcatacgagctacatttttctcatgtccgccaaagtgatcccgacgatgtacgacggtcacactcgccgcaatagactccagctcattcgcccaatccaccgccgagtcgcccccaccggaaatcaggacgtgcttgccccggaatggctccagctcttgtacagtataatgcaggttcgtaacctcatagcggtccgccccctcaatctccagcttagccattttgagaataccatagcctactgccagaacgatcgtgcgtgtccaatgctgttcccctgtggcagaagttagcaggaacgtgccatcctcttgccgatccaaaccagtgatctgctgtcccaacacaatggtaggctcgaacgtccgcgcctgctgctccagctgatcaatcagcttttcacataaaaccggggtaacccccccgacatcccatatcatcttctctgggtatatgcgcatccgcccgcccagctcatgcttggcttcgatcagcttggtcttcatatctctcattccactgtaaaatgcggtatacataccggcaggaccaccgccgatgatcgttacatcatataattccaaggatactgtcactctgcaactctccctatcatagcgtaatatgtctgctcctattataagtgataataattatcaatatcaattaagaaataaaaacatgaccattacagagtttttcgtgaccttagaactgtattttataggtttatataactactacttccgttattctcgtaaatttcgcgaggattgctgcacagaaggatgaaaaagcttcttctacctcatccatcagttgttccttgttttgcatggaaggtataaagctgtcctccattccttgcttgtatgtaatcgtcgggtccataatcttggctgcgtttctgcgcacatgcaccatgatatggttgatgatcccaccaatactgttcgtttccgcctcaccgacgcgccatagcacctgttcatccaaaagcacaatgcatgcccgcaactttaccaaatattgatcgtacattctgtgcttggatatcattataaactcatgcatggaagaatccatatattcatttcctccttcgtcctatcaagtgaatgtttcaaaaaaatcacttccatcaatcatccaatactgttcaggtgaaggtacctcgttcaaaaagttttgatattcccctttccaccccgctgggacatagtgttcaaacgaagctggctcaggaaatagcgaatagagaactttctcgtcaaagttaacatacagagcaggacagaactccaacaattcatcctgatgctgaatagcctcatccagcaactgaagcattgaagttagttcccctgtagccaccttatattcacagatgtgatgcaaaaatgctcccactgtggtttcatccaaaatagagatgccaaaccgttcctccatctcggtattcaaaaaccaatactctctttccgtcacataccaattccatttcccttcaaaaataacaccaacaatgatattttgtgcatattcaggccataatttcatgagcttctcgcgttcccctctttctcactcacagttcgatccaaaaccggtttacacggtttccgtcttcctctatgtaatccttgtccggcgttccgccgttttgtatgattgtttttttggaggcaatattatcggagtcgcatacgaccagggctcgggaaatccccagctcttttgctttttctaacgccaaggccagcattgtaacagcgtacctgttccctcgtgcagaaggacgaataccgtaaccgatatgacccccggcattcattaggtgttcgttaaggtcatgcctgatattcactgctccgaggacctgattatccgcatccataagccagtatgttgagcttttgacccagccctcagacagattaattccattttcctgattactcaaaaacgtcagcataccttcaaaatcgtacggctctacagagatcacccaaggtaccatatgctcctgactctttttccattcctcataaaatgaaagataagcttccttccagtcctgatccggctttaccaatctaacggtctgcatccactcacggcctcctctttaaacgttcaattcatctgctattgcttatattcaatatccatgaatttttgcgcccaatctgcaaaagagagcttatcatcccaagtgactcgcttcatcgctttggcacatccccagtttagaacatgctgatgcagcacatgcacccggaaacgctcagtaaatccttctttggcttccatcccttgtgcgtaagcagtaagaaacccttttgccaactcttcttcgccgttctccagatgtcgtcgtcatctttacacaccatagctcttaatcgttgcttccagggtttcatccgtatctgccagccaaacgaaactaacctcaaacgttcccggctcgaaaaacaatggaaatctccgcttaaaccaatcctgcatcggcagatttagcgcctccttcatatccacccacagcaattctccctcagggggattttttaatagttcaccttcagtggctgtagccaaatagttaaagaccatatacctcagcccttgatttggatcacaatattcgtcgattcctttaaatacaatttccgtaacggttaagcctgtttcttcctttacttcacgaatggccccattcacaatgctttctggaaactctacttttcctcctggagcaatataacccggaaacccctttcgattgggtctattcataagcaataccttgcttccgtcttgaatcatacacatggtatatattttgtgtgtcacttctgttgtcaatccgatcatacctttctttattcacgattcactgtaatcttgctttactttcacaccgacaaactgtggttaaatatggcatttctcctactttaactcgttattttgtagagcgcaataactctaaccatagactagatcagagaacctgctgcgaaacctttgggcgaaatacgctcgatctcttgaagctctgcttcctgcagagtaacctgaagcgatcacagtccctcgtcaaacaactgcatacctatgatttcaaaggcgacaccttcacccgctttaacgttgacatcaccatttatttctttagaatccaaaataaacgtagtgtctcctactacaatctccagacattctatctcgcctgcttcgccctgtatcacttgatgtatcgttccttgaatccaatagtcgcctagctttggttgaggtcgaaaaatccctgtctcttcagtagacttcagccttctgaacccctctatactgaattgagaagtctcgaccgaaattacacaaccgggaatcatcttattcaagctttgttcatacgggacaacatacgcatatccggaagtcagttcatgccaaaaatatgtccagtagccgtatactttttcctcgctcatactacgaatgatgatatgctgatctttatttatttccttgatctgtacacgcatatatagagtcctcagtagatacttttcttataataatagtgtttaaagcctctcggagcatcgtcaatgacaccaacgacttcatacccatgcttttcatagaatttaggcgcttgaaaagtaaacgtattaagttgtataaaattacaccctttatctctagcaatctgttcaatttcaccaagcagttgtgaaccgtagccctttcctctgtaacgctgatctacccacaaaatatcaacctccacccagttccaacatagtacacttaggagaccgcccatgacctgaccgtcttcatctttgagcgtaagattaatctcttcgtatcgggctcgaatatctgctgggacgtgttttacattaaactcaatcaacttgttcctgactaaacgcgcttcctctctactacttcgattcatctgaggttccagcgtcatggcataaatcctccaatttgaaatgattactagcacttactgatttaaatatagaaaataatagggttaacatactttcatcttcctactgttatatattgtatatacttttctatgtttagtcacatgattcaatttagatggacagaattattctaatcgaaatatcgctgattaaagtcgctccctggattcatgcaaaatatttagtaaacgaaaaaagcaggcccctatgaaacggagaacctgctatcgtttatacatcgtctgtcatacaggagaagagatggaatgattaaattgaaatatccagtgatttcccaactcccgtaatatcgctgctgttagcgctgttgatacgagttgtttctgtgttacttggagcgggcttttccatttttggagttgacgtactgctggattgcgaactttgctgtgcaatttgagcttcaatctgtttaatttgttgctgaagctgcttcatttttgtttcttttgtatctttattatccttactttgctgtaccttgttgtactccgcttcaagttgagctttttgcttttccagactagctgtatcgttggtactggatgatgatgtgcttgcaatagatattgaactgctggatgtggatgaaatgttcatacgagatttcccctttataaaagtatgagtttatacgtgtgggctaaccggttctaagctgtggcatttcactctaatgactatgacgacgatgatacagattgttcaaaaatcttagcgattttatcgaataaagccgatatttcttcatctgtggcattcgattcatctgtatttccccacgcgtcttttaacgcagaaagcagatctgtttcctgatctttgtccgaagctgttgagccggatataagactggaactcagaacgctctgcaaatcactcagcaaggatcttttttcatctactgtaagctctttttcagatgtagtgctgttatcctcttgattggaagtctcttggatattccatgcgaatggaggcataattccacccattgcctgcatcataggaggcagaccactgctatccatttcaggatgggacgggtcaccttcaggcggcggtgcaggacgattattttggatcgtttctgctatcttatcgaatagatcagatacttcctcatctgttgccgtcgaaatatccacatcagctaataagtctctaaccgaagccaacggattcttcgtgctattggtgagatcatctgtatcagaggaagcactggaagacatcaggtaactttgcagatcagacaacagcgttttctgttggtctgcaatggtatcctggtcatcgtacttgtaatcattacagtagttttccgtaggaagcggagcctgcattcctcccgtgtattccatgaattccttgctcaattcgagtgaatcgttagatttcttgtgtgtggtatgacccgcggtatttagtccattctcatttgacttcaccatattcgattgatcataggaagtcgtgatgagatgcctgttaatggatagtgacaaagtagatcccctctcagtgtacataatgttttaagctgcccacctacctttcatcggtaacaaaactgaatgcaacctgagggtatgctgaatgataactgaataaatacaaactcatataccgtaacccttttattatttcctagaccatagtcaaggaaaatcccctccgcaagacggggggatcaaccctacttgagacaggagtaagtaaagggataatttgttactcttagcaaagaataaatgaacgtattttaaaaattgaaagtagggaaatgatgtatgatccgtattagccatttggttcacgagagacttatgttcctagtcaaatttttgtactcgcctgcatacgtgggtagtgtaacaccaagttccagatttttagctaaaaatatgatagaatccattccatggagtgaagttcatactgttgccgagcttggtgctggaacaggggcaattacccaatacatcccgtctgctgctgaatttcaacccaaggttttactctttgagaaagaccaaaccatgcagcagagtttaaaaagaagattcccgaattatctgtgctattccgactcgcgtgagcttcagcttgctatgaaaaatgcccaaatagaacagcttgactgcataatcagcgggctgccatttttcaattttccacaagcgatgcggaatcaaattgtagaacaaattcatctatcgctcagggatggaggaaagtttgtggcctttcaatactctaaacagatgaaacaacagttaggtgaatggtttgatattgaagaaatcaagtttgtgccaatgaatgttccacccgcattcgtgtatgtatgccgaaagaaaacctaagaaaggagtacgggtatggacgtggaatatttaatttccatcatcgaacaatacggctatgccgcattattcttttctctatggctggggattgtgggtctacccatcccggatgaagtcatcgtgatgactggcggggctgtaacaggcatgggcatacttcacccgttacccgcttttttaattgtatatcttggggttatatcaggcttgtccttaggttatgtattggggagaaccgtgggcacaccgattctagaacgtttacgccggaagaaaaaaatggacaggtacattacgttttcagaaaaattgatacataagtatggcaatttcactatttgcatcagttatttgctgccgatcgtccgtcacattatcccttatattgtcggaatcaataaaatgagcttcaaacgctatgccctcttctcttattcaacgggtttgatctggacgctgatcttctttctactcggacgtatctttggcgatcatgtacaagcagtaggagaactaatccatcgttatggcttgcagatggtattgcttctcatcatgctgacaattatattttttataatgaaatttgtatgggggaagaaaacaacggaggagtaaaggttaagtatattcggtatgttcattacctacatgaaaaagaaatagaccgccctcactaaagtaaacggtctactctcgaccacctgatggccgactgctctttatgcagttgttgtatgctggggccgtgtcagagcacggctccttatttatttcttacctcattataatcgattttatgtaattgcgtgtttttatgcttggataattaaataagtgaatttaaaagttacctgtcgtgccactacgtagacggatggtgcttctcatcgccaccgcccccggatttctgaaataaagtcttcatcggtagaaatccggggaggtgatgcttccgaagtgagctttcctacggaaagcttttaaagcgaccgcttcgcttgtacagcaccattccgtctactccgttttccatgtacatttttttagttcaacctatagagactattatttcctcacatgacaggacagagctataggatcagctcataacggtaaaatcccccatcattgatattttgatttccttcatactctcttgtactgaaatattattctttcctatcgatacccaattcccttgaatcctgtcagtgtacatgttgctgagctgcggtcaataatagttgggagatccctcgttttcggtattcttcatccacgcataaatcatcaacatccaagatcattttatagaaatagaagaaaacgaaagaaacaattgtgtaaactcaatcactttcttttttgcttatcattttaagtaaaatcaagaatgttcacaaaatattcgatatttattgaaatttcctattgatttgatgtcactatgatgtcacctttcggtataccaaatcgctatgcaatgatacaatatttacatgatattttgtcattccacattaaaatattttccctccggaggtttgcaaatcatgtctaattctttagaaatattagttgaacccataatcagaaaccgattagaaacattgtatagcaatctttctaaaaccatcccggaatacaaccaattttccacggaaagcaaccagtattttcaacaaatccgtgaatccgttcccgagcatctcgaacataccctgtttttatatgaagatgcccaaatctctctacaatctattctagagaaccaaatatatttacagggattcaaagatgctatgcaaattttagatgagttacgtaacacctatactgggtaagaactacataataattttcaacttttaaaatatatcttttaaaaaaacaaaaaacgcctagaaacaggcgttttcatttttgtcctttttagcaatactatccatatgatatactataaactaacaacgcttagatgggcggtcggctagtctcctgcaaaggaggtgatgcctgtggaggttaaagatacattgatgttgatgattcaatttgcgacattggtgatcttgattctttccttcaacaaaaagaaatagaccgccctctggaaaaggttagcggtctattttactaatccaaccctacagccaccgcccttataagcggctgttgtaaaagagtgaggatgttggcagcatccttactctttttcagtatatacttattagctttagtttatcacaggaaaaaccatattgccaatatggaaaatctttttaagggcggctttcctttcacaccatgttacttctttaattgaagcaactttactaacttgtcatgaatggcagtattcggataattcccgctaaactgagaagacccaggtcccatcgcggttaacgccacatcaacagatgtatgtccacccgtggtccaatcgatataaaacttctcatcggagccttttacagtaaaaggaccatcctctttggaaatgccttcaccggattcatcctccgcatcttcgccttcaatcgccaaaccgcccgtttcatgatctgccgtcaccaacactaatgtatctggatgcgctttggcatactctttagctactttaacggccttatcaagttgttgcccagccttaatcgttaactccccttcattgtcatgcgccatctcatccgttccttcttcttctaccatcaggaaaaaacctttttggtttttggaaagaacatcaatcgctttagccgtcatatccggtagagaaacggttgggttgtaagagttacccagcttgttgtgagcttgaaacatctcttcattggcgaacagtcctagcaacttagaacctttggctgctttcattcctgcctgatccgtcacatagctataacccagcttcttcgcttgttctaccaaattcccttgagttcccttactagcttcctcaggatcttctgccggagcatctggatgtttgcctactgttccggcagggtaccagaaatcctcaccaccgcccagaataacatccagcttgcttttctccagatactgcttggcaatctcgctttgagcggagcgtttttcgacatgcgcaccaaaggcggcccccgttgcgtctgtcacttggcttgtcgtcacgacacctgtagacatgcctgcttttttagccagctccataatcgttgccactggttttttattcaaatccattccgattgcgccgttatacgttttcacacctgttgcaatggcagttgcagccgcggcagaatccgtaaccaggttatcccctgaacttgtactaaccaggccggttacaggcatgttatccatttcaagtaatcccgatttccctaccgtcgccaagcgaatcgcgttgcgacttgcttctcccataccatcgccgataaaaagaatgacattcttaggagcatcgaccttcgctgacgaagttttcagtcctttggatacctgtgcggtagtagacttggtattagatgaggctgcaaaagcgttagggatattagcagataacaatggcgcactcaaaacggtaatggcacctaaagcaaggatactctttttcatcgaacgctttttcacaaggtcacactccaataaatttgatattcatatatgataaagtaatcatatatttgttttgtaaagcatcgtaaagcaatagattatgcgaatgtaaaatttggaatgagcgcctatttatttataaaacaaaaaagacaccgactcttggtatatcaaagtcgatgccctctggcgtttttatttaaatggcggcgatatttttgccgatcggcatggtgtagtagagcggtttttgctgtccattttgctgatagactacaagcagcagggtgcggccttcggctgtcaatgggcttcctccgctcaggatatgatccagactgaacggcagtacatccagcacagcgtgcttttgcagttccttttcactcagcttcaaggaagcaaaggctggaataatctcgcggtatggctgcggctgttgactgcctacatccgtcccacctgtactctccttgctcgcatctgccacaaaatctgtaaccgcaggtgacaacagcgcatccggatgctggagaaccattttcatatagctggaccaatcattcttctccaaggtatgctcccaccaaattttacgcggcttgtatttatggttaaggaaataatcaagcttcatcagtccaagcaccatatccattcgctttgttccacgcgattctagaaaggactggagacgcgtgaacaagtcttcgagctgatgcccgattttttgccagccctgtccttcccagtagtctccgaattcctgaaagaaatcaaaggcggacgagaattcgcgctcgatcagatagttaactgtatgatccatacgatgagagttccagtatttttccaatacatcttccaagcgcttgagccggacgatatcggcaaaggaaaggacgtcattgctcaacatttcatacggcgcaacatccatatacgtatagttatacttgtctgcgtcgatacgcagtccggtgccacgcagcattttgaggaagccaagttgaagctcttccgggccgagcgcaaaaacgtcattaaacgttttacggaatgtgttgtagtcctccaaaggcaatccggcaatcaaatccaaatgctggtcgattttaccactttgtttgaccttggtaacagtacgggaaagtttggtaaagttctggcgacgcttaaccaactcattggtaggatcattcgttgattggacgccgatttcaaaacgaaatacgcccggtggcgcgttttccgccaaataatccaacacctcgggacgcataatatctgccgtaatctcaaactggaagacacaaccacggtgattttcaatcaaaaatttgaacatttccagcgcataatcgcgtttaatattaaacgtccgatccacgaacttaattaggttggctccattgtcgatcagatacagaatatccgactttgtacgctcgatatcgtaatagcgcaccccaacttcgatgctcgacagacaaaactggcaactgaacggacagcctcggctcgtttcaaaataaacaacccgtttcccaagttccggtatatcctctgcaaaacgatagggcgacggtagctcgttcaagtccgctttcgggcgaccgggcatctgaataacctcttctcccttacggtaagccagtccatacacaaaatggaacttgccatccccttccaactcctgcagcagttgatggaaggtttcctctccttcaccaaccacgataaaatccacattcgccaagcgcttcatccagtgatccgtatcgtaggatacctctggaccacccagaacaattttgacctcgggcataatctttttcaacacatcaatgactttgatcgtctcttcaatgttccaaatataacaagaaaagccgatgacatctgccccgcgttgaaacaaatcggatacgatgttcatcaccgggtccttaatcgtgtactccgccaactcgatatcaaagtccttttcactgtaggctttgaggcatcgaatggccagcgaggtatgaatatattttgcatttaacgttgataaaatgactttcataggtcacaaccttctatagtttgcatgaactgttatatccccttaccttagtatagctattcaaaatcctcgtacacatcgtctgcataaatctcttcctcgcttaccgttcccccgatactcccctgattttgaaaaaaatcaagaaacggcttgccgtacttgcggaacttcacttcgccgacacccttgatccgcaacatgtctgcctcggattgcgggctcgctacgctcatctcacgcagcgttgcatcattgaaaatgatataagacggtacatgctcctgagcggccagatcgcggcgaatcaggcgcaattgctcgaacacggtttcgttgactgcagccgggtatgcatcgcgtccctgtcgtccgcgtgaacctgctccacctgcaaaagccgtggcatgtcgcaccacacgctgcatgacttctcgctggcctttcagcacctcagccgcaagctgctgcaagcgtacgactggatattgtccctcggacaacattagatagccttccgaaacaagaacattgataatttcggcaatttctttttccgttcggttgcccatcacgccataggttggcaggctgtcaaaaccatattgcagcacttttttgttacgcgatcccttcaacaccgaagcgaccatcgagaccccataacgttcccgcatgcgatgaatacacgaaaaaatcttctgcgcatctatggtcatatcaaccaattcccgctcatctgtacatgaactgcatatgccgcaagcttcatgctcctccgcttctccaaaatactcaagctgtgccgtacgtaggcaacgagtcgtgtagcaataatcaaccatctgttggagcttgcgatagtcgttgcgcttgcggtcttcatcctgtggattttgctcaatcaggaacttctgcgtcacaatatcttgcggtccgaacagtaaaatacattgactcgggtcgccatcacgtcctgcgcgccccgcctcttgtacgtaagcctccatatttttaggcatgttgtagtgaatgacatagcgtacgttcgatttatctatccccatgccaaaggcattggttgctacaatgacccggatatcgtcgtacagaaacccttcctggctatctgcacgttcctgatctgtcatcccggcatgatagcgtccagccgccatgcctgcgtcacgtagccgttggtacaaatcgtccacgtccttacgtgtcgccgcataaataatgcccgattcaccctcatgctcacgggtataattcagtaaaaagctgcgtttgtcttccccacgcagcacactgaacgccaaattgggccgtccaaggcctgtaacgaacgtctccggtgagcgcagacgaagcaggcgcacgatatcatccatgacctgcggtgtcgccgttgccgtaaacgccgccacgattgggcgttcatacagcccgtccacgaatggagccacagccaggtagctggtacggaaatcatggccccactgggatacgcagtgagcctcatctaccgcaacgcaggaaattggcaactgagccatttcatcgcgaaaccagtccagttccagtcgttccggtgcgacatatagtaacttcaagtcaccattccgtgcggctcgtatgcgatcattcacttctcgaccactcaacgtactattgatgtaggcagcagcaatccccatggtggtcagcgcatccacctggtccttcatcagcgagatgagcggtgacacgacaatggtcagcccctcatgcaacaacgcggggatttggtagcatatcgattttccgccccctgtcggcatgatgcccaacgtatcgttgccctccagcatactggccacaattttcttttgtccctcccggaaatcgggatagccataaaatttttgcagcaagtcctgcgcccgttccaatgttggtgcttgtacactcatagtttcaaaactcctcatatttctagcgtccttgacgcatatcggcttttctttcgttacctttagtttaccggggttcagggtaatgttcaaccgctagaagactgccaatctggtttagtcccttatggcgttcgctgttttctcatgatatagtgaacacggtgccgcaaatttgtccataattatgaagagacacggttccaagaaggagaaagaacctatgaacaatcggaaaccccaacggaaaaatcatacaaaatctacgtcaaacgcaagccattccaaacgcagtcataaacctgccggaagatctggctcccatagaccggaagctcaacggagaacgaatgcttttgataaagcccctgccaaaacatacatcgtccaggagcctgccgagctgttaagctttttagtagagcatgtgactggcatgggtcgtaactccattaaatcagcactggctcgtgggcaggtgtccgtcaacggcattccgcgtaccgtgcacaattttccactggagcaaggtcagactgtcgcgctttctaaagaaaaagtaactcccgtcgtaccactgactgggctacgtatcttgcatgaggatgaagccattatcgttatccataaggatgccgggttgctgtccgtggcttcagcgcaggagcaggaagtaacagcctatcgccagcttacggcccatgtgaggcgcgaacatccgtacaatcgtatttttgtactgcatcgtttggatcgggatacatcaggagtgatgatgtttgcaaaaagcgaagccatacagcaggaaatgcaaaaagcgtggaaggaagttgtgtatgaacgaacatacattgctcttgtagaaggacaggttaaaaaagctgagggtacaatcacctcatggctgaaagaaagcaagacgctaaaaatgtattccagtccttatccgaatgacggacagcacgcagtcactcattacaagctgcttcaagccaatcgtcatttttctttgctggaagtacgtttggaaaccggacgcaaaaatcaaatccgcgtacatatggaggatatcggtcatccaattgttggagataaaaaatacggttccaaatccaagtcgattgggcgccttggcctacatgcgagggtattgtcatttattcatcccgtcaccggagtattgctgcgttttgaatccgatattcctaaaacttttttgaatccgtttcgggagtagaattgagcaaagcatacggagattaagtggaaaaatagaagaggaaatgagggggctgtagaaaacagcaccctttttttgattgattaagcggtatacctccgaataccatcagccattttcatcaactcatcccatatatatatgggcgtattacacactggacaatctagccaaccgattaaatagggtaattgagcaagaagcttgttctcttcaattttctgggcatattcgtgtaaccactgtatattagcacctttatggtccaatgaacgggggcggatcggatggggaaccagattgtctgaatttacagggtccttatcatagacaaccagggtgtcattctgttcatcaggccaaatatagagcggggtaccgcaatgcggacaatccagcgtatattcgtcacctgtatcgaagctttgtagcatataagctatacagcgatatccctgaaaagcggcacccgcagccagaacatagcgtttacctacatctccttcgtgttctttcgcatagagcaccatttcttcagtcaattctgcaagtcggacaatggcacaccgatattgcgcataaatatattcagccacactagaatccactttcacctgatcccttgtaaattccaatggaactttggtatgtaagggattgttattcttcgcttcgaatattccgcaaatgttatagatatctgcacgaatccttatatcagaactttttaacgcaatgtctacaaggtaaggaacagccgcaaatgtacaagtatacaatgtattttggtgatacagttcctcccaatacaaggtgtcagccatttcgccgtcatatccagcttggagctgtttcaacatttttgggacgtattgagaggaaccgtaggggccttggagcagagtccaggccggatcggacaaagccagcatcttgatactccttccaccgtttttcttacagtagaggattttgcaaaaatccaataagcaaactccaatgaacaagatatagatcgaaatggtttagttcgtctataacttgcaaattcggagcgactggaatcgaattttgtaaaatcctgatagtaacatgcgatcggtttataaaatgaattttgctatcaaaattcattttaacttcataattctcagcttcttacgtttatttcattatacgcatattattagctgaggttgcttttctcgattttcgcaatatacaaaatcactatttttttgggtctataatcatattcggttaagctttcggcattgtgaaggtgaaacacattaaattaatgaattaatgaattactaacccggttcttatgtcttactacgactcctctgtccattcagttccttcttcgtatgcatagtccacattataagtcctgttacttaaaaattgctgagtaagaaataaaatatatatacattaaaatttccatacatgtaaaaacaaagccactcccctacctgtttttaattatgccaaacgggtaagacatacttgttcaagcctttaatctaacagttacaaaactgattttatgaatcggtatatgaaaaggcgtgttgggaatattatgtatgaatactgcgactataaggggaaatagcctatgaccataacaccggaacagcggattaccctgcacggatttaacaacctgaccaaatcattgagcttcaacatgtacgatatttgttacaccaaaaccaaagaagaacgcgaggcgtatattgaatatattgatgaacaatacaactcagatcgactgacagctattttaaaaaatgtatctgacattatcggcgcccatgtgctcaacgtagcccagcaggattatgtacctcaaggagccagcgtgaccgtacttatatcagaaggacccattgtggaggtaccgactgaatcttatgccgagtcacccggccccctacctgaatctgtcgtgatacagctggataaaagccacattacggttcacacctacccggaatatcatccagacgaggggatcagtacgtttcgagcagatattgatgtctctacctgtggggaaatctccccgctcaaggcactccactatttgactcattctttcgacaccgacattatgacgattgattatcgggtgcgcggcttcacacgtgatacgaatggacataagcttttcatcgaccatgatatcgcctccattcaaaactatattccggacgaagtgcacagtcagtatgacatgatcgacgtgaatgtgtatcaggaaaatattttccataccaaatgtaagctaaaacaattcgatctggacaattacctgttcggctacaccaaggaaagcctgagtgaaaaagagcaacaaaatatatcaacacgtctcaaaatcgaaatggacgaaatttactacggtaaaaatatgacgtaacagatcgaatgcaaaaaaataaaatagatcatttcattgaaaaaaggaggatcgcttggactggaatatagccgggctttcgtccttttttaaagacaaaataatagatagtactcaacttgatctgtacaagcgagagattgttcactatgataggggaagaaaccactaatttaaaataacagcatggattttacatccgcttcttattgtaagcgcaatcaattgatcctacgtatgattttgttatggaaaacaaaggaggaatttgtatgcaaggcggtattggcggtaaaaacatcattttacgattggaaatttccaccgggcacatccaatttggtcaattgattacgctggtaaacgaacatggcggagatgtgattgccattgacgtcattagcacctctgagaaggtcaccgtgagggatattacggtgaccattgccgatccagcagaaatcgaccgtatgattgcccgaattaaaaaagcacaaggtgttaaagtattatccatctctgatcgtaccttcctattacacctcgggggcaaaattgaaatgcagcccaaagtcccaattcaaaaccgcgatgacttatcccgggtatatacccccgatgtggcacgcgtatgcatggcgattcacgaggaacccgacaaagctttccgtttgacgatcaagcgcaacacggtcgctgtcgtctctgacggaagcgctgtcctcgggctaggtaacatcggtccctatgcagccatgccggttatggaaggcaaagccatgctgttcaaacagctcggctccgtcgatgcctttccaatctgtctggatacgcaggacaccgaagagatcattaaggccattaagcaaatggccccagcttttggcggtattaatctggaggatatttcatcgccacgatgctttgagattgaacagcggttacgtaaagagctggacatacctgtttttcatgacgatcagcacggcacagctgtcgttttatacgcagggctgatcaatgcgctcaaagttgtcggcaaagccctgtctgacgtcaaaattgtcgtctgtggtatcggggctgcgggtgtggcttgcaccaaaattttgctatctgcaggggctgtcaacatcattggcgtagaccgccatggggctcttacagctgatgaaacatacgagcatccgatgtggaactggtatgcgcagcataccaaccctgaacggctgtctggcacgctgtccgaggttctgaaggacgctgacgtgtttatcggtctgtcggcaggtggaatactgcaacgagaagacgtgaaacgtatgaaagaagccccggtgctgttcactatggctaacccggttcctgaaattgcgccagaggacgtcgaggacattgcaggtgtcatcgccaccggacgttcggactatcccaaccaaattaacaatgtactttgtttccctggcatctttcgagcagcgctcgactgccgtgcccgtgaaatcaacgaagagatgaagctggcggccgcagaggccatcgcaggcacgatccgtcctgaagaactaaacaagttgtatattatcccaggtgtatttaacgagagtgcggttcaacgggtacgtgaaaaggtaattcaagccgcgattgcgagcggtacagccagaagagtgcctcgggatttcagataaaagaaaaggattgctcccctaaatgcgggtgcaatcctttttgctatcgagagatcaagcttcatatccgttatctttacagcggttatgacctccatttagagaacaattgactggcacgctgagcaaactcctccagattaaagttggagttatccagcttgtagtaccattttttaatcgtatccaaaatccatgagggcaccttaacctccgagataccggaataaaacgtatgatacgcccacaccaaatgctcccagcgcttgtcatcgccttccttcacgtattccgatacgtccaataccttggcacgcccatcttgcataagtacattcttgaggtgaatatcacggggattcagccccttggaccggacaaattccctcgccttttccacatccagaatgacctgctctggcacaggaattccttgcagcaaacaatccagcagcgtaataccggattcataacttatgacaatatacttgtcgccttttccgtaataatgaggaaaaaagtcagaccctcgcaaacgctcatatacgtcggcctccgcatcttttttctcgatcgccatgtctgagtacaccttgaacgcgtagcctggcaacgtatcgagcgtaaatacggccgcatctgtcccgatgccaatacagcggacgtcttgagtggctgttttaatggtaaccggatcattatcctccgtactgtatacggtcacttgacttatgatgtcttctgcctgcctccattgttctaccatgcgcgatcccctccttctctgttctaaacctttaccaatgaagttagttctataacagataaatagtattacgggttatcttttggaatggcttcaaaataggttgattcttttaaaaaatacggtatgtaccgtgtctaacgagcgtccggcagcagcaaccttcttaactctgcatagcttgctgctgttttatagttccccagcacatcagtttccgggggagcattcctgtgattgaaccagatcacctgccaatttgcagctatagctcccgccacgtcattacgccaggaatccccaatgtagcagcaatgctctgctaacgttcctgtccgctcattcactacttcgaagatgcgcggatcaggcttggcatagccaacagtaccagatacaaagatatgctctgccgcaacatgattttccaacgccatcgccttgatcttgctcatctggtgttcttcaagaccatttgttattaatccaactaaaaagccagccgagctcaaatcatttattaacgaggtagccccctcaaaaggctcaattcggtactgacgatccaagtattcttgctgaacatgtactgcctgctcacgggtaatttctaccccgaattcttgtaaagccagaatgaaacggccttccctcatctcatccagttcatctggccctgccttcccctccaatagtcctcctttagccgacagtacatcgctgtaatagcgaatacgatggtaggctttctcataaggaaaacgctcacttaatcctaatactgtacgcaatgcatcgcgtgtagggtgcaaatgatcgtacatcgtatcatctacatcaaaaaaaacagccttcttttgcaagttcatatgcccacttctttctgttaaatcttcggatgacgctccttttcaccttgtcctgatattatacccgttggcctgttacgttgcaccttgtccttcacactgcgcatcctgcaatcacacttcaccgttgctaacatacactgaaaagaccgcattttcgcaaacccactttacttctctaccgagctaacataggtatcttgtcctgctttgctcgaaagcgttttatttgacaacacacgggtaaaaggtcacatttttgaaaatattcgtcatacaggtttacatttcgtgtaaaatcacgtaccttttagggatgaacgctttaatggatgtattggataagggaggcatacacgatggattccggttctaacctagcctatggatcagctacacctttgattgaggcacttatagaatttgaaaaggagctcgaagcgaaccggcattctctaagttttgatttgggattgattatggagcagggccgcgcgccacgatatatggctacaccaccagatgttattccttttgcccacgcaggagtggacggaatacattatggctttttaacggattttggtcttgaaaaggacctatcacaggcccctatcgtatgcgtatctcccgtcgattggacgggtgtatgggtggttgcccgtcatttgcaggattttttaagcgttgtttatacagagaacagttcattaaaacgatactacgccagcggagacgactattctggacatgcaggtcagcgactgcctcagctcttagatgaacgcaccgcgtttgtacgtgaatgctttcgggaacgctttggtatcgaaccgattcaggatatggctgcctatatcgacagcttgcgagcagaacggaagcacaatgaagcagctcctacgctgaacggcttgggcattcaggtatcttctttcgcgaagcatagctcttctatggaaagtaccctcttgaccgtaacggagcctttcctttgggaacaacaaggcgaagctgtgcgtgaattgttctataacggttcgcgtgaagccagactggcctttattcgggatgcccagacacggcatctgttcacccattctgcccttcgtgcttttgtagctggacagcttaagttgatgggtctatctgaggccgcaacatatctggaagagtcctactataccgttattcccgatatgatagaatcttgacgaaaacttcgattccccctaacataaccgcctctgaaaaggcggctttttgtgctacaataaatgaaaataatagggtcgaacggcccgatacgaatgaaagagagcgagtatgaataatcattcctatcctactcctgaaatcattgaagtttgtctgttggcgggcaaactgatgatgcaaaatggagccgaaacctatcgtgttgaagacacgatgtcccgcattgcttcagcctatggcatatcccagtcccatagctatgtaacaccaactgggattttttttgccattaatgattcggagcctgccaagctcatccgcatcgtagagcggaccaccgatttgcacaaggtgacagaggtcaattccatttcacgtaaaatcagcacaggtgatttgtctccccgcgctgccgtaaaggagcttgcggagattgagcgtggccccctccgctattccaaccgtgtacagctgatggctgctgcgttggccagcggttgctttatgattatgtttggtggtgtctggcgagacttccccgcagctgtgttatgcggcggtatcggatttgcagccgtacagtattttcacaggctcgttaaggtcaagtttttctcagagttttctgcatcttttctaatcggcttgctggcggctctgttaacgatagtaggctggggacagatgatggataaaattataattggctccgtcatgccactggttccaggcttgttaattacaaatgccattcgtgatttaatgtccgggcaccttgtttcgggtctttccaagggagccgatgcttgcctgacatctttcggcattggagctggcgttgcggttatcatttcttatatgtgattcggaggagattcaagtctatgcttgcacaattattcacaagctttattgccaccgctggtttcggcatacttttccacgccccccggcgctcgctgctgcaatgtggttttgtcggtatgctaggctggctggtctattattcaaccacggacagcatgggacctgtgagcgccagccttttagcaacgatccttatcggcatcgtcagtcaaggctttgcgcggctgtacaaaatgcctgtgattattttcagcgtagcaggcatgattccgctcgttccagggggaatggcctataatgccatgcgccagttcgtacaacaacattatcctcaggcactggagctggccctgagcacgctgatgatcgcaggagctattgctgtcggtttggtgctctctgaggtgcttaatcaaatttttcacaacatacgttttagacctcagcgttaaaagcgatgaaaatagcaaaataaaagaggctgctcccaaaatcatccgcagtgtatgagacgattttggaaacagcctttttctgtacacattacaaaaaatatttaactgtcataagctattattcatccactcgcttgcccaatatcgccaaatctcgctctatactgtccagcacagctacacgcggatagtacccccattgctcaaaaccaaacttccgcagcagcccaatacttggctcattatgaccaaaaacaaatcccaacaacgttgtaatcctcagtctcggacattcatttagcaagtgctgtaccagacgacttcctgtcccggttccacgagaatcctcatggacgtaaatgctaatttctgctgtaccgttataagctggacgcccataaaaggactgaaggctggcccaaccggcaatggttcccttttgttttaatacccacaaagggcggtggttctcctgatgagcctcaaaccatggaatgcggctctccactgtcaccggttccagatctgcggtgaccattcgtccagcaatcgtagaattataaatatccacaatatcgggaagatcctctctacacgcaaattcaatggaaaaagattggtcctgattcattattcgtatccgcctcctatggtgtgatttatttattgtacaagacaagcgcccgatcagccatatcgagttgttttgcggattagtcccaaagggttttataatagagcttgaagataaggaaaaataaaaacggggcaagcgatttaacacgatgagacgggaggtatgtttcggagtcaaggattctgaagcagcttaatatgaatattggaactcaactcttgattttggaaatacctatggaatctttttttggaaaaacgactatttatcctgtactgctcaaggacgaggatggacttacactgattgacacgggaatgctcggccaatttgagccattacgcaaggctatctcagatgtgggtgaggatatcagccgcgtgaaaagaattattttaacacatcaggatattgaccatatcggaaatgttcatgcactgctggatctgctgccgaatactgccctgttagcccataaggatgacgttccttacatgacaggagagcgaccgtttgtgaagctgacgtcggaacggattaaacaaatggatactgtgctcaagcagcaagcagaggatatgattcgccgcctgccagatttgcgctttgctcatattcttgaggacggtgagcatctgccttatggtgggggcatacagattattcatacacccggtcacacgcccgggcatatcagcttgtatgtgcccgcacaaaagctactgttggcagcagatgaactgctggtagtcgaaggtgaactggtcggtcctgctgagtcggctacgccggatatgccattggctctgaagagcctcgaaaagctgacggtattggatgttgaaaaggtaatctgctaccatggcggctactatgatcagaacgtacaagcacgtctgcaaacattaagtcaggcaagagagtaagccattcaaagctataaattaagatgtaataagagctataatgaatacatggacagaaaggaatgagactctatgaatgataaaattacaagattatatgatgaattgaaatcacaatcttgggatggcctgcttgtgaccgatcccaaacatatttactatctgacgggctttgccagtgatccgcatgagcgttttcttggtctcgtgctgcttcgagaccaagaaccagaactgatcgtacccgctctggatgcagaagccgcccaagctgcttcttctgtgactcgtatatccacccacaccgatacggacaatccatatgatctgttgcgtcaacgtacaggcaccggagtgaaaacattcgcactggaaaaggagcacgtctccgtcctccgttatgaacagttacatactgctattggcgcgactcaatatgtggatctgggtcctgtgcttcaagaaatgcgtgtgagaaaaactcctgaggaagtacaacgtctgaaacatgcagctcgtttggtggaagatgctcttcgccacggcctcacccatgtgcgcgaaggagtgacggaagtcgagctggtggccgaaatcgaatatcagatgaaaaaaatcggtgcagatggcccgtcctttgacacaacagtgctgtctggacccaaaacagccttgcctcatggtgttccaggcacccgcaagctacagcatggcgatctgctcatgtttgatatgggcgtatattccgatggctatgcttcggatattacgcgtacctttgcttttggaaagctgtcggctgagctggagacgatttataatacggttcttcgctcgaacgaagcgggaattgccgccattcgcccgggagttacctgcgcatccatagaccaggcagcacgggctgttgttgaagccgctggatacggccctgcctttaaccatcgagttggacacggcctcggtatgagtgttcacgaatatccatctgtacacggaggcaatagcgatctgcttcatgaaggcttcgtgttcaccatcgaacccggcatctatgtgccaggcctcggtggtgtgcggattgaagatgacgttttggtcacctctaatggtgttgaagtgcttacctcttttccaaaagaactgacagtgctcggataaacccatcgctattcattatataggtatgtaaaaaaggatgaaaaaaggaggggcaaccccaagccatcatggcttgagggtttgcccctcctcttctataaagcggaaattgcgtgcgatgtacaaaatgggtgtacccgccgcggtcagtacaaattttaagatgtaggtggtgaataatatctcgagccatatcccccacgcataaccgtaaaaggcaatagtacagaaaatgagcgtatctataaacgagctgatcatcgtgctgccattgccgcgaatccagagctgatgacgttccgggaagaacttgcgaatccaggcgtacagacgcacgtccagcaattgactgaccgcataggctgtcaagctggcaagcgcaagtcttggcaacaatccaaacagctgttgcatcggtgtctgggcaaaatccgttgcagtaggctggaactgcagcaccatctgcatcgttaccgtcgtcataatcagagtgaaaaagccaaaccatacagctttacgcgcttctttaggcccatatttttcattcagtaagtcgctggccatatacatagaaacatacatcgtatttcccaatgtcgtggtaatgccgaccagatcaatcgttttggttacctgaatgttggccagtacagtagcaacaccaatccaggcgtatagcccttttttaccgaacaaccgaaaacataacaaaaagaacataaaattgacgaggacaaaagctgccccccataacagattaaacatgaaatcctcctagttttgatagcgcgggatggttgcgaaccgcggttcatccgaagcaagccggaaaaacattattttaatgtatcatagattaggatttgtgaacagctataattacactgccctaaactcaatacaaagagccgaccttatggccggctctttgtattgagtacacactgtacgtttgttacataagctacagatgggatatgagactgcatcttatcatttaattaggagtgtgctgttgcatccaaatccataccatgattattgaatacgtcttgatcgttctccttgagcaccttgcctgaaataagacctgcagtaatagaatcattgacatttaacgctgtgcgtcccatatcaatcaacggttcgactgagatgagcaatcctgccaatgccactggaagattcatggtggaaagcacgatcagggaagcgaaagtggcaccaccgcctacacccgccacgccgaacgagctgaccgtaacgaccagaatcagcgtgaggataaaatcccagctcgttggatcaatacccacggttggagcaatcataaccgccagcattgccggataaataccagcacagccgttttgcccaatagtcgctcccaaggtcgcagacagattcgcgatgccgtcggacacaccaagctttttcgtttgtgtttcaacatttaacggaatggtcgccgcactggaacgagaagtaaaagcaaaaaccagtgtaggcaatacctttttcacatacgtcaccggattgtagccgaacaaggccagcaaaataagatgaatgataaacatgaccaacagagccacataagaagcgagcacaaacttgattagcttcaaaatttcatctggattggtcgtagctactactttagtgatcagtgctaaaataccgtaaggagtcaatctcagcaccagcgttacaattcgcatcactacagcgtacacggcatcaatcactttacggaaggtttgcgcctgttccggttttttacgatccaatccgagtacagccaccccgataaaggccgagaaaataactaccgccagcgtcgacgtacgacgtgctcccgtcatatcctcaaaaggatttgaaggaataaattccagcacctgctgtggaatggtcatgtcctgaactgttccaaggcgctcttccatcttcaagccctgtgcttgttccttttccccaccttgaatctcaattgcctttaggtcaaacgacaggctggttacaatactaactgaagcagcaattgccgttgtaatcagtagtactgcaataatggacacgctgattttgccaaggttctgtcttccctttaaattcataatagccgaaataatcgacaccatgataagcggaataacgaccatttgcagcaaacggacataaccgttacctgcgaggttgaaccaatcaaccgattttgtaatgacctctgatcctgcgccataagcatattgtagaatagccccgtagatcagtccgaagccaagtccggcaaataccctttttgtaaaggagatgtgctttttctgcatccagaccaatacgcctagcagcaaaagcagcacgattacatttaaaataataaagaaggtatccatgtattatttcctccaaacttatacttaatatgttttataaggtgatccttcaatccgaagaatactatatcacaaaaccaactatttttgtaggttttctaacaataaaatagttaagcagcttcaaatttggattttatcgaaaacgccaaacagcaagccttcatctttcgagggcttgctgtttttttgtcctgaacagaacgacatgtattcaacttagctgccggggctcttttccacaaccgagttcggagaagcattcatgccagatgtagatactccttgcgaatgctcgtctttttcatccacaaagcccacaaaatacgtaattacgccagccgtaacaaacgaaatcagcatacccacaataccgtacacaagcgtgggttcagaaaataaaggcaaactgagcagcccagcagagacaccaatactagtaagctccgtttcaaacagacacatacaagccccaccaacggctccaccgatcataactgctattaacggttttttgaaacggatattgacacaatacatggccggttcaatgattcccagcatggccaacaaacctgtggacgcagccagcgttttgactttggcatttttggatttaacacatacgccaaatgttgcgccagcctgagcgaaagccgctgcaatgaccacgggaaaaaggtgatcataacccaatgttgtaagcgagctgatcataatcggtagcattatatattgcatacctgcaataataagcaaagacatcgtgcctccgagcaacaaccctgtaaatacttctgcattgtcaaacaaccagcctagtccatcggatacatgttggccgagataactccacagtggcccgaaagcgaacaccattaaaggtatagtgatcatcagtgtcaaagtcgggacaaccattaatttaagtgaataagggatatacctgtttaaccatttttcgacatacgatgctatccagacgacaacaagtatgagtactatagatgaagcagcttgtgggtctataactggcagaccggcaaaacgtacctcctcaccagactggagtaaacttgttaattggggatggaatacggatgctgcgatggctgccgcaacaaacacattgctgcgcagccttcttgccgcacttgccgcaacgaaaataggtaaaaaataaaatatcccatcgctgatagccgttaaaatagtatatacctgcggatcaaacaacaataaaccgaaggatattaaaactaatataattaccttaaccattcccgcaccaatcattgccggcaagatcggagtaaatacgcctgatacataatctaatagtcgacttatcggatttctccctgtggcagctctataactgccggaagtcagctcctgtgtatcttctcctctgacctgcgaaatcacttctttggaaagtaaatcccgattcataacaaccgtttccccttttatatgtatattgaagaccactttcgaacttacaaaccaagcttagaagaatattgtaaaaaagccgtattccttatgctacttatattacttcttttttacaatagttttaaagaaggagtaatctattcgtttttatgcacctgataatttacatctaacttacatctaaacacctaagaccatagttatatattttttgtttgtttttgggcaaatatgactattcaaccgtctgttaattatgtaaaataggtctaacctactttttagtaaatcatggattacttccctttcatattcttgtcccttgaattcagctgaaatatacatagaatccgaacattttcagtcttttcttcaagcaaggaaaggaacacaagtagatcatggcgtgtcaagtatctattggacaagcggcctacttcaagcagggaattcgtctgattttattaccatcatgtgagaggagatttttcatgaagcgttttaatcgttccattggcgcgaaattacgaattatgtttttgctgattcagctctttgcgtcccttttgttcagcatcagtttctatgcaatatccatgagtatcattaataacagtgtcatgcctcaggtagaccaattgctagaaactggagctaaaaatgtgtatcaggatctcaatatttccttagctgttcaggctgggcaaggaagcggttctgattccggctccgctatacagatggaatcctatcttcaggacaaggtcgataccctcaaattagaatcggcatatatcacggtagtgaaggatgataaagccgaagtcgtcgcacggaatgtaaaatcagtatacaaggtcaaggatgcactcattcctgttgaggatattaaaaaagcaaaacaaggcgagatgaatatcagtgaaatttacagcgattcatacggagtacacaaaaccgccttctttgctatatcaggtagtaatctagttctgggtgtgaacgaagacgtcggatttgtacaggaaaaatcccaacaaattctatggatttgcataggtattacagtggcaacgctcctgctgggcggaattatttctaccctcgtgatacgtaaagttgtagaacccattgctgaattggttcgtcatagcgaaaaaattgctcaaggtgatctttcacaagaagcgaaggttcatggagttaatgaaattgcccaacttgcccgcagcttccaatccatgtctcataacttgaaagaaatgatcggccatgtactttctacatccggtgcggttgttgaaggatcggacgagctacttcgtcggactgaggctatcagtgtaaaagtgcaggactctacagttgccgcagaggaagtagcaaagggcagtaccagcatagctacagctgctgctgaaaatgcacaggctatggaggaaatcgctcaaggtgttcagcacatcgcctcctctgccaatgatgtatccgatcaaatcagtgaagcgacaaaagaaacggttaacggtaatacgctcgctcaaaaggctgtagctcaaatgtcacaggtaggacatgctgccgatgaatcgcttcgatacatccatagtatgaatgagcgctcagaagccattggcagtatcgtttcggctattttcgatattacgaagcaaattcaaatgttgtccctgaatgcctccattgaagctgcccgtgcgggcgaacatggacggggctttgccgtagtagccggagaagtacgtaagcttgccgagcaatctaaagaagccacacaagaaatttccgactatttggttaccattcaagaagtatcgcaacaatctgtggactctgtgacccaggtgagccgtgaaattcattcgggaacggaaatggttcaacaagcgagctcagcctttaaccagctaagtgagcttatgcaaaagatcaatgctacgattcaaacggtatctgcagcaacggagcaggtatctgccagctcggaggaagtatctgcttccgtggaagagacagcactcatcgcagccaatgcacagcatatgattcaagaaatcggtttaaatgccgatgagcaactgaatgaaatggaaagccacagcgaggttgttcgccaattaagcaaacaagcaaccgaactacaaaaggctgtccaaaaatttaaaattacgtaagctgatacaatacaaagaggtatctcacagtcttgaaaatggctgtagagatacctctttattttttaaaagcgattttaataatcatccatgaagtttatgaatccattcccataatacgataaatttgctccatatctaaatgagaccggaccacctctgcgacacggtcaaactctcgttccttggcttcacgtacagtaaaagtgctttctaaaggtgccaaacccttggcttgtcgcaatccatccagccagcaccggcgaaaacggtcattatcaaacacaccgtgcaaataggttccccatactttaccgtctgtcgtaccccagccttcctcaaaagctgttccttcgccacgccggatatagaataaccttttcatttcgcttaggtttaaagttctatctgtaggtgcgcatggttccgtaacatactccgtaacgcccatatgtatttcataaccttcaatgcttggcttgcaggcagaacctgaatcagtcgcggtgctaagcaaaagcgggcaatgattagacagggttccctgtacgcgtacggtttgcttttcctttaaaaaggtcgtggatagagcaagccaacctaacccttctgcctgctgcggcaacccagattcgacggcttcgggatcaaatagtgcggtacccagcatctgataacctccacaaatgccaatgagctgcgtgcgttccgtattcatggcctgctgaatgtcctcctccagacctctttcacgcaattccagcaggtctccaatggtgtctttggtccccggtaagataatggcgtccggtacgcccaactgtccggcttctgtgacataacgaacactcacatccggctctgcggccagagcatccgtgtctgtaaaattggaaattcgcggatatcgtatcaccgcaatatccagttctttatcctttgcagattgtttgggcttcttgtccagtactaccgaatcctctgcttcaatgcgaatgtctggcagatagggcaatacaccgagtacaggaatgcctgtccgttcttccagccagtctaatcccggctgaagcagagacagatcacctctgaatttgttaatgataaatccgcggatacgctgtacttcatggggttccagtaactctatggtgcctactagagaggcaaaaactcccccccggtcgatatctgaaataagcaacactggagcatccgcccaacctgccagattcatatttacgatatcgcggtccttcaaattaatctctgccgggctgcctgccccttccataaggacaatatcataggtatcacgcaaccgactcagagcatccataacggtctgtttggcttttggcaaaaaatccttccggtaatcagaggcgctcatataggcataaggtacaccgtgtacaacaatttgtgagtgcatatctttgaccggcttaatcagaatcggattcatgtcagttgtggcctcaataccgcaggcctcagcctgcaccccctgagcgcgtccaatttccttgccgtcctcggtaacataagagtttaacgccatattttgcgacttaaacggtgcgggacgatatccgtcctgcgtaaaaatacggcaaagcgcagtcgtcaccacgcttttgcccacatccgacgctgttccttgaagcattaatacggctgccgggttcgtgcaggacggttcgaaagttgacaattgcctcttcccctttaacgaattcatttcaaatctggtcacaacccgtacaaaatgacaataaacaacaataaaacagcctccagcaattcgtttaaagttccgtatatatctcctgtaagtccacccaagcggcggttaatacagtttgccgtgaaggttccaacaccgtaagccaagaccggaagcaacacaaaacctagccagattggaaggctctcagaatatgaaaggaacgtctgtaagtaggatcctgccaacgacagattcccagtcccccttgttgctgtagccaaatctgccagaagatattgtcctacggcagcacttagggtcactaatactgcccagaatacggccaaccctacgcggccaccactcatatcagcaaaacgcgcagccagcccatcatcattacgggctttaggccagcgtttcattgcatgtaccataaaccagcggctccaaaccatcggaagcagtagcaagccagacacattccgttcaaccagcaccgtatacagcaaagaagccttgagcataagtagcagcacacaagcaataacgcccattgctcctacacggctatccttcataatctccagcatccgctcacgggatcggtagctgaataaggcatcagccgcatccatccacccgtccaaatgcaacccgcccgtcaaccaaacccagacaacaagcgtaagaatcgcacacggcaacggcggcaacaccatagaagtaagcgccgcaaagccccagacaatgatgccaataaccactcccaccagcggataataacttgcactgcgtttaagcaaatccggggaaaaatctatttccgccttcaccggaagacgcgttaaaaattgaaaagccgccgcaacagcctgacgttcgcggctcatagcttatattccaactgtttgagttctacgggaatccccgccgtcaccaaaaatacttcatcacaaagacgggcaatccgctgattcataaccccactcaaatcccgatacagccgacccagcggatattcgggcacaataccgtcaccaacctcgttggttacgatgacgagctgccctggatactgctccacagctgccgccagttcattaatggcagctctggacgcagcttcgccgtcctcgcctgcggccagcagtacgttcgacagccacagggtcaggcagtcgaccagcaacataggcgcgggctgcgacgctcgatcgccaccaagccgctgcagcagctccggcagcgcctgcgcttcctccagcgtctgccagtcgtacccagcagactcgcgctggacccgatgaagggcgatgcgctccttcatctccatgtcataggcttgcgccgttgcaatgtagcaggcgcgcgaagcgcgcgacatgcataatcgctcggcaaagtcgcttttcccgctgcgtgccccgccggtcacgagcgctttcatcgctgcgcggctccctgaccgtccgatacgcctgcatcggcaaaggtcgccatttcgcgcatgatgcggcacgccgcatcaatcaggtgcaagctaagcgcaccgcctgtgccctccccgagccgcatgtccaaataaagcatgggctccagcttgagctggcggagcaccgccgcgtgcccgcgctcgtccgaggcgtgcgaagcgagcatgtacgcagcgctagcaggcgcaagtgcacgcgctgcaagggcggctgcgcctgaaataaagccgtccaacacgactggacagcgatgtgcggctgcgccgaggatgactcctgccaaggcggcaatctccagaccgccgaccttagtgagcacatcgagcgcatcatttgcatctggctggttcacgtccaatgcgcggcagacaaccgatattttacgggtaagcccagccatatctacacccgttccccggcctacgataacttccggctctagcccggtaagagcacatacgaccgcagcgctggctgtcgtattcccgatgcccagttctccggtaacgaatagccgtgtgccacctttgaccgcttctgctacggcttcagctccggccaaaaccgcctgctccgcttccgtacgtagcatcgctggccctttagctatattcgaagtacccatgcgtaccttacggtccaccagattcgcgtgagcgacatccgcattcacgccaacatctaccaccttgacatctgcgcccgcatggcgtgccagcacattaattgccgcgccacctgacagcatgttatacagcatttgctgtgtaacctcagccggaaaggcactgactccctcttcacacaccccgtgatccgcagccatgaccataaccgttttacgatcaaattcaggcttgtccactcctgtaattcctgctagcttgatggccacactttccaactttccaagacttcccggtggctttgttaattggtccaaatgggctgaagctgccgaggccgccaccccatccggctgggcaatgctatcgatcagctgacgcagcttgttgttcataccttccactccctgctctttttaagtgtgtttcatcgtttatttaatctgctgtatccgaagcacttctgcgcagcaagagctgcggcacaccgctatctggatgcggaagcatcacaggctcaacaccgtatactcgtcgaatccgatcctcggttaataacttcgatgaagctcccaatccttcaaccattccatccttgagtacaagcaaatcttcgcaaaattgggctgtcaagttaagatcatgcaagaccgcaatgatcgtcacacccgtttcttggcgccaatctgccagcagttccataaattcaagctgatagcgcaagtccagataggtcgtaggctcgtccagcagcaatattcgtggctcctgcaccattacttttgccaaagctacacgctgtcgctgtcccccactcaagcggtccaatgctctgtccgccaacgtggcaagacccaatcgctccagcacgcgatccgtgatcgcctccacatcaacacccttttccctgcctaaccagtcctgatgaggaaaacgtcccatttctacgacttccctgacagtgtatcccactggaggaagcccttcctgttggagtacggctatgagtcgggaaagctcttttctgctgtagctaccgacctttttgccatagatatgaacgtttcccgaagttggctgatctacacccgaaagcagatgcagcaaggtcgattttccactgccgttcggaccaataatcccccaccaagttccttcgtcgacgctccagcttatattctttaacgcatggaactctccataggcacgtgtcagacccgctacctctaatgcccgatcccgcaccttctgtgattcactttgttctgtcacagcagttcccccctgcgcagcttcttgttccggtacaggagatatgcgaagaacggtgccccaacaaaggccgtcatcacgcccagaggaatttccgtgggggctaacaacgtgcgagccgccgtatctgcccaagccataaaaatggctccaccgagcgcagataatggaacaatcatccggtaatcaggacctgtcaccagacgaatgatatgcggtacaacaagtcccacaaagccaatcactccacataccgagacagcggcagctgtcagcagcgtggaaatgatcagaacagatagcttcgtcgcatctacatgaactcccatgtgagccgcctgccgttcacccaaagccaaaatattcagtacacgtgcccggttccatagaaataccagtcctatgaccacataaggtaaaaggattcctgtatatgaccaaccgcgcaggctaagacttcccatcgtccagtacaatatttcattgaccgtctccttcgacatggctgtcagaaaggaaacaactgctcctagaaaggattgcatcactacacccgacaaaatgagactttgtgtcggaatttttccaccttcccgtgccaacgtcagcaccatccacagcgtcagcattccggtcgtaaatgccactagcggcagcgtccatatgccaacaaatgaaaattgaaggccccaatagatcagtactgccgctcctaccgaagcccccgaggatacccccagtgtatacggatcagccaaaggattacgcagcacaccctgaaatccggctcccgccagcgccagcgctgctcctaccaacattcctagtaacactcgtggcaatctgaccttcaaaataatctgctctgaggatgtattccaatccggtgtaaatgtatcgcctaaccacggaaggtggttaaccagaatgcccgtgatctggctgaccggaagcttggccgagccgatgccaagacagagcagcagcgtcagcaacagcaagacaagacctgtccctccaaagccgatcagtttacggttcatttgaaaatttcaggatacacgcccttggccacttccttgagaccttccgttacgcgtggacccggacgactgatcaaattatcatccacggcaaacacccggttgtggcgaacagccgatatttgatcccatccactgcgagctttaatgatttcgccgagcgtttggccagttttgtcgtccttgacacttttgctgtacaaaatcacgtcagggttcgcagcaataatattttcctcactaatttggtaccaccccttctgcgtggcacctacattttcgccgcccgccaaagtaatcagctcgtccataaactcacctttaccaactgtccagcctggtgaaaactcgacgtatacccgcagcttctgccctttaccgatatttttaactccttctttcacttccgctacatctgctctcatcttgtcagtcaccgctctcgcatctttctgatgatcggtgatttttccatacaattcgatgttagctatgacatcttcaactgtcttcggttccgttttaaaaatcataattcccatgtcgcgcagcttggtcgtagcctgttcactaagtgatatccctgcaaaaacgacttccgggttagcagcaatgatcgcctcttcgttcggtttcataataccgcctactttaggctttttcgtagctgcttccgggtaatcagagtagtcggagacgccaactatttccttatccagtccgatggcgaacagcgcctcggtttctgccggggagacggaaacgattttatccggcgcttttttgaatgtaaattcctgtcctgttgcatccttaactgttagtgggtaaactgttttgcccggaggctcttgtgcggttacggtctttcctggctgctgtgcagaagtctgattctctttattttcagcattttttccattagcgccacatgcactcagcacaactgccaaaatcagaaccaatagacctgttgtccaaacctttattttttttcctgccatgatttgcaccccttcataaaaaaatcgttaagagcgttacttgagcatcatcagatatcttctaaatccagccttcttttcctatcaaaaaacccccgcatccttatatcaggacacaggggtcacgttagcgcagatcgtgcgcaggcggcagcttctttccgcacggacagtcactgcgaacacgtcatcctttcctcgaaggattatggtgacaggcggacgggcaggtatcctgacttatggtaagatgcatgtcctgaaattccttcatatgcttagtagcacataaagcaggactaacgggcatgcttccatttacagtggcgggaccgcgccggacttacaccgacttcccttttaacagcgcaggcaagggaaaccatagtttcatcacactgcgccgacctcgtctgctggatatttgatgtagtggtagtcaagccgttcttttacttgatgattataggttaaaatgagacggcttacaacccaaacagcctctttatccgctggtgtctaacctaatgagggagcatttcggctatgtaattgtgcggtcctgccagcctcaattgaatcctaaatgcttctcccggcttcggattcagactccaaaaatcatggcccggtatcaacatacaagctaactgacgaattacgccaccatgcgtaacgaccaaaacagagagcggcccagcagtcaaatccatgggttgaacttccatagcaactcgccattcatacagagagtcaagaaatttccgcaaacgattcacaaaatctgtccaagactctcctccaggaggggttatccgttgtggctcatcaatccaagcgcgatacaacgacacatccttgagcatgtcatacgtttttccatcccactcgccaaaatgaagctctcgcagacgtggttccatcataggagacataatagatagggaacctccagacgtcaattctgattccggcacaatgatctgcatggtctggcgacatcgcattaaatcgctgcaatagattcgagcaaaggactgcccctgcaattcttcttgcaaaggctttaattcctgttctgctcccggtagcaaacctaagtcggagtgtcccagatatcgacgttccttattccataaggttgtgccgtgacgaactaacacgagttccatgtcccaatgcagatcttctttagcatcatacggcaccttatcctcctgtgagttcggactttgtgcgtattctactgtcctttttgctgctatatcttgtttcaagatcatgtcacttcctgctcgatcattattcagtgtgtcacgcctcaccctcaccgcacccatcccaaggcaaaacaacctgcggctcctaacaaacacaatcctacaaacatactggacacggcgaacatcagctggattgtatgccgtatatctttcgattctaacggtcgtatccaatcgcccatgtatgcacgaaaggagcgtacgccatgatacacattatagcctccaagacgaatccccagtgcaccagcaacagccgattccgggtagccactgttcgggcttgggtgcagatgagcgtctcgcttgactgtgcgccagcttcttgcagcatctcgcttgtacatccacgccgctaccacaagcattgccgctgtcaggcgtgccggaatgtagttagccacatcatccagacgtgctgaagcccagcctaaatgcagatacttttcatttttatagccaaccatggaatcgagcgtattcacagcacgataagccagcgccaagggtgctcccccgatcagggcataaaaaagcggggaaataatcgcgtccacgatattttcagcgaccgtttcaaccgtaccacgtacaatctcaggctcatcaagctgttgcgtatcccgcccgacaatcatgcccagctcccgccgtgctgctgccagatcatccgcctgcaacgctcggtatactgccattcctgcatcctttagtcctttagaagcaatcgtggtcgcaatcagcaccatttctgcgccgacagacaaccacggatgaatccaggcaagcaagtgtaacagcgcccaggcgagcgcaaaggagcctcccgccacaatgagcggaagcagtatgcccgcacgttttagcccccggtcacttcggacctggcggcgaatcaatttttccaatgccgaaatggcatgtcccataccgatgactggatgcggcaaccacctcggatcaccgatcagcctgtccaaaaggtaggctgccaggataatcaagctaactgtcacgccgctgttcctcctccagcacctcacccaatacagacagcagcctgtcgttggcttctccatccttgaccgcaatccgaaaatggctcgtcgtcagtcccggatacatagcacagctacgtataagaattccgcgttgtccaagcgcctgctgaatagccgatgcgctccatgtacccggcgcccttgccagcacgtaattggcttcaccgggaacgacaccgcagccccattccgccaaggcggtcaacaggcggttgcgctccgcagcaatcagctcctgtgtttggcgctcatatgcttgcccacttctcaaacacgcctccccagccagcaacgccaatccattcacactccaggtcacctgtttggccgtcattcgccggatatagtccggatgagcaatcgcatagcccaatcgcaagccaggaatggcataaaatttggtcattgaccggatcaaaatcacatgaggatagcgatccagcacaggcagcagtgagattcgccgttccagcggaataaaatcaatgaatgcttcatccaccaccagcacggtacccgttgtgccagccgcctctgccagctcgcacagctcctgctcactatattgcacgccatttggattattcggctgtccgaggaacaaaacatctacctgctccatgagctgaaggatgtcctccacgtccgccttccattgaagcgaggccttcccatacacccgtttgacctcggctccgaatttgccagccagctcggcatattccgaaaaacacggctccactgtacccacacgcttaggagctagtcccaatagtaggagcgccatgctttcagccgctccgtttccgatacttagcgactccggtggaacatgcagtcgccgtgcgagcatatttttaaaattccgatgcccagggtctggatagcgaatcacagtgtcaaatgagtgttgcagcgcctcaagcacctctggcggtggaccaagcggattaatatttgcactaaaatctacaaaatccgcagcagttccgccaaaagtcgcggcagctgtctccctgtctccgccatgaccataaacctctatcattgcctctcatcctttccgcccgtttccaatcatttagctccattatgaggctgctttttgcgtcccgtcaatgcaaatgagcttttgtacatggctcacttgggttacaatagaaggaggcacacataaattacacagtttatatacggaggaatggacatgctgttcatcgacaaccaggggatacacgatccagccattaatcttgctattgaggaatacgcgctcaagcatctaccgctggacgacagctatttgctgttttatattaatcagccttctattattataggcaagcatcaaaacactattgaagaaatcaacgccgagtttgttagggataacaatattcaagtcgttcgtcgcctgtccggcggtggggctgtatatcatgatctcggtaatttaaatttcagcttcattactaaggataacggggagtcctttcataatttcctcaaatttacgcaacctgtgattgatgccctgcgccaaatgggagtagaagctgaaatgacaggccgcaacgatctacaggtcggagaacgtaaaatttcaggaaacgcccaatttgccacacgcggacgtatgttcagccacggtacattgatgtttaacctgaatctggacaatgtggctgcatcgttgcatgccaatcccgaaaagtttaaatccaaaagcacaaaatctgtccgcagtcgcgtggctaacatcagcgaactgatggaccgtgagatgaccatagagcaatttcgcgaggaactgctacgttccatattcggagcagaattggatcaggtgcctcaatataagctcaccgatgccgactgggtcaaaattcatgaaatttccaaagaacgctaccaatcgtgggattggaactacggtctatcccccgagagcaatatcaagcacacacgtaaatttccggtcggtattattgatatccgcatggatcttaaggaaggctacatccgtgatattaaaatctatggggatttcttcggtgtgggtgacgttgctgatattgaaaatatcctgcgcggcaagcgttatgatgaagttgaggtgcgtcaagccttatcctctctcgatttgaagcactattttggtaatattgagctggacgattttgttggacttgtatttttggaagactaaccgttactttttcccatcgtttcaagccaatacttcagtggttataaggggacaggctcttataggagctgtccccttttcattgcgatattgtcattttgaatattataagatacaattttagcattgccccatgatagagataaaggagagaataccgatatgtataaattaattgccattgatattgatgatacactcattaacgaccagaaagaagtcacaccagcgacacaacaggcattagaagctgctgtagcaaaaggtgtggtggttaccctcgctactggacgagcttatgcctctgcacacaaaattgctcgccagacgggtttgaacgtgccgatcattacgtaccaaggagctttggttaaaaacctgctggacgaaaacgtgctgtatgagcgttatgttccactcgtggctgcacgtcgtctgtatgaattctgcgtggaacgcaatctgcatctgcaaacgtatattgatgacaaattgtacacacgtgaagataatcagaaaatcaaagattacacggagctgaacaacacggaatattttgtagagcctgtattcagtaaagttatagagcagccggctcctaaattgctgattatcgacgagcctgaagtgttggatgaattaattcctgaacttcgcgaactgcttggcaatgaagttcacattacaaaatccaagcctcattttctggaaattatgcatcatgaaggcactaagggccatgcgcttaccttccttgcaaatcattttggctgtgaactgtcggaaacaattgctatcggtgactcttggaacgaccacgagatgcttgaatgcgctggtctcggcatagcgatggagaatgccattcccgatttgaaaaagctggctgattacatcactcgcagcaataacgaagacggtgttaagcacgccatcgacaaattcgtactcaacgttgaataaagtaaaaagtgactgttcccataatacttaaatgaagtagtacaacaacaaagcctccaacgtcgcatgttcaataacatacggcagtttggaggccttttctgtcagatcatataataacctgccccctttaaaatatcaggcagcagaacgtaccttacgcctgttcaccagacggataattccattgttcataaggattaatccggtcacaatgagcagcaccccagccagcatccaccagcttacatgctctccatacaacaacgctcccaagcccaccgcaatcggcggtgatatatacagccacgtcgtcggaaacaggggatttgtacgctccatgagccagtagaatagtgtatgtgcaatcatcgaaccaaacaggatcagataaagtaaagaccccatggcaggaaggtactgccacccctcagaactccacggttccgtgatcgcagacagtaacagcagcatccatcccccatggatcatttgcgccgcattcagggcaatcgggttcgtttcacgaaatacatccatcactcgcttggaatacagagctcccccggaataacacagctcccccatcaaaatgataaggcatcccgccagccacagaccactgatctgaaccgccaatccgggcagcacaaccagcaccacaccaagaaagctgatcatgcagccaacgaccgtaatccgtgacgttttttgccgtagcagtacagattgtaaaatgacgatcatcatcggcccggtagctgacagaatagctccgatcccggagctgacatattgctctgcccaatacaaggctgaaaatgtaccgaaggtcgttcctgctccaatcagcaacatttccttacgccataataacgaccatcgtacttttccggtcagcttcatagcaatgaacaatatcgcccctgccgcgaaaaaacgtacacctgccgataggaatggcggaagtccggcttccactcccacttttatggccaaaaacgttgtgccaaaaataagacacattactgtaaacgcgatacctatcatgatacgtccctctcccttcagttgcttttaagcatacagggagacgaacagaacagatgtataactacagaacagttgtatacgtttttgaagtgctatatagtacaatacacagaaaggagcgtggatagcatgggtaagaacaacagcgaactactctttgcagccgatcatgccttaaagctgtatgagcaggttatccattatgtaactgtgcggattgatcgcggggattggcaaacagacatgaagctgccgtccgtacgaagcttggctcaggagctgggtgtacatcggctaactgttttccgggcatatcaggagttgaagcaacggggactggtctatgtaaaggacaaatcaggatattacgttcatgcttcccaagcgactgggcatgcaaaatatgctggctactcgggacattcgtccattaacctcacgattcactccaaatctgcccatgcggcagatgatccgtcagtttcagcctggagaggaatggatggacttagccgtgttcaatccgtaaatacgaatttccagttttccaaagcgctgattgacccctctctcctgcccaaccgattttggggagagctaatgattcaggtatttgaaaagcatccgaaagtagcggccacctattccgctgtgcagggtgatgccgagcttcgggaggccatggcacagcattttagcgtggataagcattttgctttatcaccggatgaagtgctgattacctccggagcacagcaagccattgatttaattggccgctctctgctccgtacaggagaccgtgtattgatcgaacgccctgcctatggccccgctatggaaatattccgtagactaggcgcacgtctgactatgactgatattcgaccagaaggttatgatatggaccagattgagtggtgcatgaaaacggaaaaaccacgcctcttttatatgaatccaacattccacaacccgacgggctttacggtccccgatgagcagcgcaaacgactgcctgaactagccgagcgctatggctgcctcattgttgaggatgacagcacctatgacattagctttgggcaaaagcccccttctccgattttcgcctatgatgtttcgggaagcgtcgtctacattcgaagttacagtaaatatgtcgcacccggtctacgaatcgcagccgtgacctgccgaccacagctcatgaacagcctgctgaacgtcaaagcgttagtagacaatggatcgccactgctgaatcaaaagctgtttttagaatactttcaatctccacgtatgcagcagcatattaaaaagctatgtatcgcgctccagattcgtaaggaaacgatggaagacagtctccgcgactccggttggacatggaccagcccggcagggggactcaacctgtggctccaggtgccttccacgttgaaacctaatgaattacttgccaaaagtttacaagagtctgtatcctttgtccccggcaatgtatttgatcccatcggcgcagagggtaaaacgcatgtacggctgtcctattcatacgccaacgagctacaaatcaaagaaggaatctccacacttctacgtatcagtcaaacgatgtaaaggtaaaggtcacctttattctaacggcaaactcatgccggtgtgtgccaagctaatcccttccagaagcccatagttgcgtgtgacatccacatcatgggacatatgtgtaaacactgtgctttcgggtttaagccttcctataagctcctgagcctccagcatgtcgtatacggaacgggtggcatactcggcctcctcatgataaaaactcgttcccaggacgagcaaattcagattgtgcaagggcagaatttccgcctcattcaatccaatcgaatccgaacagtaagcccacgagaaaccgtccttttccagacgataagcgtaggcatatccgttcttcccgtgattcacacgccatccccggatattccacccgccaagttgggctccctggtctactggaataagatccaagtttccagagagccaggaaaattgacgcaagatcgtgtcaatcacttcctgtggcgcgtacaagcgacctctgtttccagtccagcgacaggcatctgcccattctggtaatcctccaatatggtcaaaatgtgcatgtgtcacaaggatcgtagggataaaacgcagaccgcgcaattctagctgtctgcgccagtccgggccacaatcaatcataaagtcctccgtctcgctttcgatcagcagagacgatctcaatcttacattcgcccctgtcgtgcgagcttctgtgcatacgagacaatcacaatatacacgcggaacccccattgcatcccccgtgccaagaaaaataagccgattcatggtttaactcctatctacctgggtctttttactactattataacgaacagaccgattctacgtaaatcatctgcgtaaatccttccagcgtccaacgccaaaaggagcatgcccaaagccgtgaaatccggctagacatcccctcatgcgtgatcgtatttattttcaaatgatgataggcattggatcttccttcaggcggttttccaccatccagctggactggtcattatagagataggctcgatgcaccaacactcgcacctgttgaccaggttccagcgtagacttctccagcgagcggtatgtcatgagacaatgatccccgacctgtacttcaaccatccactcacttccacgaaaatgcaaatgcttcactgtgccttcctcggtcgccgacagaagcgtaaattcctcgcttggcccaacatcaatatactctggacggatcaaggcacgtgttcccagtccagcagcttcttcgaagcctctgagactgcctgcctgttcaatcaccgtagattccccaataaaggaagccacgaacggagtacccggttttttataaatatcccaaggtgttcccttctgctccagtcgtccctgattaatcaccataatttcatccgctacttcaatcgcctcatcctgatcatgggtgacaaaaattgaagtaatacccacccgctcaatcaactctcgcagccaggtgcgcagctcctgacgaatcttggcatcaatagctgcaaaaggctcatccaacagcagcaattgaggctctggtgccaaagcacgcgcaaaggcaacccgctgtcgctgtccacctgacaactgatgcggataacgatgctcaaatcctttgagccccgttagttcgaccaactctgtgacccgttccttgatgcgggttttggagctttttttcactttcaggccaaaggcaatattgtcgtagacgctcatgtgcttgaacaaagcatagttttgaaatacaaatccgattccacgttcctgcggggacagctcgtttactctttttccatgaaaatgaatttctcccgcatccggttgctccagacccgccaaaatgcgaagaatggaggttttccccccaccacttggaccgagtaagccaataagatggcccgcctgaatatcaaaagatacgtcctttactgcatgaaaattaccgaaatgcttgtttaatcctcttacttccacatgcatatccgtacacttcctttccgcttctggacctgttcaggaacagcagcagccttgcttctcgcaaagcacgtacctcatttgaaatcatttaattattccaatgtatatactatgttttttcttatgtgatactttatcaaaggaaagtaattttcgtcaactatatattatattaggaattaaaagggtaaagtattaggaagaaaggagatggagttattgttgcatactttagaattatccactacacggcgagatgaaatgcgcgatattacacgagaggttgcttcattgatcgaaaaaagcggggtacaacaaggaaccgcacttgtttattgtccacacacgacagccggcatcgccattaatgaaaatgcagacccagacgtcaaacatgatgtgatattaagactagatgaagtttatccgtgggagcatccccaatatcgccatatggagggaaatacggcttcccacctaaaatccattacgacaggcccctcacaaacgctcatcatccatgatggaaagctgttgctcggacgatggcagggactttatttttgtgaattcgacggaccacgcagacgccaataccatgtaaagatcataaagggctgacggaccgggtaaaaaaacagaccatgatgttttcctactggatgcatcatcgtctgttaaattcttagtcgctttcgcaaagtaacgtaatgataagtcaccgtcatgaagtgtatacacccaaaaaagcgccctacatgttcatggctgaagtgtgtgaatgcaggtacgctcataggtgtctgcacagtagctttacatgtgctaaagcagcgggcctaatttcttcaaatgttaaaccgtcctgaatataaaatgatacaaagccatgcatggataaaaacaggcttttcggtacccttgcgcaatcttcctccgaatgcccctgaccactcaattcttgacggatcatggacgcaaatagttccacacaacggttttgctctgtgcgacagtatgcaaatagttcttcatcgtgcatcatgaacataatttcgtattgatatggattttccaaaccaaaacggataaattccagcatcaagtactccaacctgctcaagccatcatcaggcgtacctgttgctgcttgcagtagaatcccacgcaatgtattaaaatcttcaattacaatggcatagaacagttcagccttctctttaaaatgataatataacgaaccatgactgtaacccagatgctggccaatgctgcgcattgaaatcgcacggtagcccttggtaataaacaagtgcctggccgcttccagaatccgccctcttgacaactcctgttctactgctcttctagccatattatttattccccttcaataaagtaaagctgctctccctccgacacaagcgattgcccctgcgtcaagtctgttatccagttgctgaaggattccgcatcaccagccagcggcagacaggttaaggtaactttatccgtaaacattgtttctccaatgcggatgctgcgattgcgtaattcattttccactttgcccaaccaggtataatccaattctacaaaaacttcgcgatgcagcacacgtgtaattgcatcccctgcctcgattgctgcaacagcaccatctgaatacgcgcgaatcagaccgcctgctcccaacaaaatcccaccaaagtaacgggtaacaacaatagcgacattttttagcttctggttgcggatcacctccaaaataggctttccagccgtaccactcggttctccgtcatccgattgcttttggatttcgtctctttcgccaatcatgtaagcagaacaattatgggtagcgttccaatgctcttttttgatgcgctctatgaaagcaactgcttcttcctcagtttgaacaggctgaatatggccgataaaacgggattttcggatcacaatttccttgttgccggcaccgcgtacagttcggtattgttccaacatacacgtataaccttccttaattcattttacaagaaagcagtcccccgcttctggcagctggtgaactgctttcctgtactttaattgatgctatacactataacacttctgaccgaaatcctgtttcgcatcagagattacagcactcttattcagacaatctcgcttcaagctcagctttttctttttcgaagcctggtttgccgagcagcgcaaacatgttcttcttgtaagcttctacgcccggttgatcgaacggatttacacccaacaggtagccgctgatgccgcaagctttttcgaagaaataagcaagatagccgaaagagtaagggcttaagtcaggaatatttacaatcaagttcggtacttgtccgtctgtgtgagccagcaatgtaccttggaatgcttttttgtttacaaaatccacagttttgcctgccaggaaattcagtccgtccagatcatcctcatctgcttcgatggtgatgtgacttggtacattttctacttggattaccgtttcaaaaatgttgcggctgccttcctgaatgaattgtcccatggaatgcagatctgtcgagaaatcaacagaagcaggataaatgcctttgtaatccttgccttcgctttctccgtacaactgtttccaccactcggatacaaaatgaagagacggctcatagtttacgagaatttcaattgctttacctttgcggtacaaagcgttacgaacggctgcatattgataagcttcgttctcagctacattcgggttgctgtactctttggaagcgtctgccgccccctgcatcatttcctcgatgttaatgcctgcagtagcaatcggcaacaagcctactgctgtcagcacggagtaacgaccacccacgtcatcaggaataatgaaggattcgtagccttcttcgttagccaattttttcaaagcgccacgttctttatccgtcgttgcataaatacgcttgcgtgcttcttctttaccgtattttttctccagagctgcacggaatacgcggaatgcgatcgctggctctgttgtcgtacctgatttggaaatgacgttcacagagaagtctttaccttcaatcagttccaacagatgattcacatatgtagagctgatgttattaccagcaaaatagatagctggacccttgcgttgatctttaggcagcgcattgtagaaagaatgcgacagcatttcgatcgcagcacgtgctccaaggtaagaaccaccgataccgattacgatcaatacttcggaatcgctttgaattttagcagcagccttttggatgcgcgcaaactcttctttatcataattggtaggcaggtcaatccaacccaagaaatcggaccctacaccggtttggttgtgcagttgctcatgagccagcttgatgggctctgcaaaataatcaatttcgtgctgacctataaaggagagcgctttagtgtaatcaaaattaacttttttagacatgtttggaacctcctgtttggtattactaagaccatgaatacgaacataaggacttaggaataggatactttaatttgcgggacctgacaagcttgcgttacctgtgtatcctgtgcttgacagcccctcctgtagatagggtagcatgcccatgctacaattaactgagatcaacctgttttatattcatttcaagccgaactcgcaatctgcatcggacggcaacttccaacaagaaaggtgattagcaatgaaaaatatcggatttatcggactgggcaccatgggcgccccgatggcatccaatctgctaaagcagggattcggagtcacagtttataatcgtaccgcttcgcgctgcgaaccactggcagagcaaggtgcacgtacagcttcaactcctcgtgaagcagctgaaggtcagcacttggtcattaccatggtcagcgatgatcactccattcgtgacatctattacggcgatgacggcgtgtttgccggacttacggctggcatgaccgtgatggacaacagtacgatttcacctgaactggtcaagcaactggccgccgaagcggacaagctgggctgctctttcattgatgcacccgtaacaggcagtaagcctgctgctgtagacggtacacttgtgttcatggttggcggtaatgcagaagccattgcggcacaatcagatgtttttgataccctgggcaaaaaggtacttcatatgggacctaatggcagcggggccgtagccaagctcgctcataatacgatggtgggtattcataacctcgctctggctgaaggctttgctatcgcggctaaatccggcatcccggcagacagcttccttgaattggtacaactcggatcggcaggtagcaaggccgctgacctgaaagggcgcaaaatcattgaacatgattttagcaaccagttctcacttgccttgatgcttaaggacttgaagcttgcttcctcactaacagacagcctgtccatccctgcacctatgttatccattgccaaaagcctgtttcaagccgggcaaacacaaggctacggcgaagaagacctatccgctgtcgtgaagacatacgaagcatggattggccacaccattggtggtcaacctctcgaataagctgcacctttctttgtaaccatacggctgtgcttgtgtacatatggcatagctttagggtaagcacacttggcttgaaggttgagtgtacttaccctttttagcttttattcgggataagaacagcaataatcagttacacttcgtacttccagcttgaatgaagactttgcaggtacgtgaaaggttgccgtcccttgtatttctagccattcctcagtacctgtaagcaacactctcaaatcccctgccaaaatctccatgatctcacgggaatccgtgccgaactcatacgttcctggcagcataatacccagtgtaaccttactgccgtcacccaggatgactgtacggcttgtaacctgaccatcgtaataaacgtttgcttttttaactacgcttactccatcgaactgtgtcattcgttatcccctcatctgctctcaatggttgaatgaatattggtgcatcataacatagatttgattccagcttcagtatgaaaatacacactgtatcaccgtatcctatacattggaattcaatagtgatttcattgcaaagcatcaactgtatgaaacaaacagccgtaagcctttctcaggttacgactgtctgttttagatgctcagtgttttatttcaacaaagctttcacacggctaacaacattctctactgtaaagccgtattccttaattacgcggtcgccaggtgcggatgcaccaaacgtgctgataccgagaatgtcgccttgatcgccaacatatttttcccagcccagtggatacgccatttcgacagccaaacgagctttcacttctggcagcagaacggaatctttgtatgctttgtcttgtttttcgaacagatcccagcttgggaagctgataacacgtacttgaataccttgttctgccagtgcttcctgagctttaacagccaattgcacttcggagcctgtagccagaatttgagcaaccggtttgccgtctgttgcatctgcaaccacataagcaccacgtttgataccttcgcgtgcatgctcagcactagcagccaggattggcaggttttgacgagtcaataccagagcaaccgggtttttcttgttttccaatgtataagcccaagcagcagaagtttcattaccgtccgccggacgaattactgtcaggttcgggataatacgcagggaagccaattgttcgatcggctcatgagtcggaccatcttcacctacagcaatactgtcgtgagtcagaacgtaggttacaggcaatcccatcagagctgccagacgaacggctggacgcagatagtctgtaaatacgaagaatgtaccgccgaatacttttacaccttggtgcaacgccataccgttcatcgcagcagccataccaaattcacggataccgaaatagatgttacggccggcgtagtcttctggcgtaaagttcgtcaggttgttcaaatgtgtcatcgtggagctctccagatcggcagatccgcctgtcaggaaaggtacgtttggagccaatccattcagagcattaccagaagctacacgagtcgaaacggctttgtctccagtcgtgtatttcggaagatcacgatcccatccttctggaagatcgccgtttacagctgtttcgaactgagctgccaaatcagggtgagctgctttgtatttcgcaaactgttcatcccatgctttgttcgccgcgataccgcgctctcttactttagcaaaatgctcgcgaacctcttgtggtacgtggaagtcctcttcgtatacccatttgtagaattctttagtcagcttggcttcttctgatcccagcggggaaccatgagtaccaccgtgtccgcctttaccttgtttgttcgggcttccgtagccgataactgttttcacttcaatcagcgtagggcgtgtcgagtcgccttgcgcttcttcaatggctttttggatggctggaaggtcgttaccatcttctacgcgcagtacttgccagttgtaagcttcaaaacgtttggcaacactctcggaagaggacagattaagcttgccgtccagtgtaatatcattggaatcaaacaatacaatcagcttgcccagttgtaagcgaccagccaacgaagcagcctcgtgagaaataccctccatcagatcgccatcgccgcagattgcatacgtgaagtgatctacaactttaaattcgtctttattatatgttgcacccagttgagcttcagccattgccatacctacggacattgcgagaccttgtcccagaggtccagttgtagcatctacaccagcagtgtgcccaaactcagggtggcccggtgtaaggctgccccattgacggaattgtttcagttcttgcataggaagatcatagccgctcaggtgtagaaggctgtatagcaacatggaaccgtgtcctgcggacaatacaaaacggtcacggttaacccacgtaggttgatccggattatgattcatcgttttagcaaaaagttggtatcccattggcgcggagcccatcggcataccaggatgtcccgagtttgctttctcgatggcgtcaattgccaacgtacgaatagttgtgatggacaaattgtcgatcgtggagttttcatccttttgaatcgcttgattctggtcagtcatggtttgcctcctcatattgtataaagtatgtcaattgcattcggtcatactcttcaacaccaccgtccgatatagaaacgatgtctattgaagtgagtgaatctgcttgaatgtttcaatatgacttatacattcttaagtattgtaccatttgccgtgaaagtttgccagatcgtttataaagatgattgtggaaatgttgtaccggatcctcatataaatatacccgtaatgtattaacctcatttaaaaaattataaaatcacaaaaaatattatgtactgaccgtttataaggcaaataactcacataaaaaaacaaagcccgttatgcgacgggctttgtttaacaaaaaaaatatattcacaaattttcttctaaaattttaagattagttaaaaacgaccgttttgttctcatgaaccagaatgcgatcctctgcatgccacttcacggctcttgccaaaacgacccgctctatggtgcgaccgatccgttttagctcatttacatcatctccgtgacttacccgctgcacgtcctgctcaatgatcgggccgccgtccaattcttcagttacataatgcgcagtagcaccaataattttcacaccgcgattataggcttgggcatatggcttcccacccacgaatgcaggcagaaaggaatgatggatattgataattcggttgcgataatgctcaataaacttgggcgaaataatctgcatgtaacgggccaaaatgataacgtcaatgtcttcaccaatgacttctagttgtcggcgctccgcctctggcttggtatcggctgttaccggaatatggtgatacgggatgccaaacgattccacatactccttcatatctggatgattactaaccaccaatgaaatatccgcgtccagatctcctgcctgccattgccacagcagttctaccaaacagtgatcttctttggaaacgaaaatagccagttttttcttgcggctgaccgcagaaatcgtccactccatacggaattgctcggcaacagcggcaaaatcctgctccaactgtggctgggttgcactcaaattcggcagatcaaattcaatccgcataaaaaacataccgccggacgggtccattgtatattggtcagattgaacgatattggccccatgctcatacaaaaaacgggacacggccgctacaatacctggtccgtctggacaagatacaagcatacgcgcgcggttttcatgggctgatagagtgctatttggctgatgttttacgtgaatttccatgtggctattaatcccccttagcttataccgtcactggcaaatgactgccggcaaaccaggcaatcaaccgttgattaatgtgttcttcgctcaaatctggaaatagtgctgcttccgttatcatgtcatacagacgctccaacggctcacgtggatcggcttttcttgctttggcatcatttttcagcagagtccaggtgtccagcacaaatttacggacatccacatcctgttttttgaaaaacgaatgcaattgctctacctgacccaaaaactcatccccaaagcgctcctttacatttccgcgaagcagggcaatttcaacctcatacatcggacgctgagttttggcttccttcccaatccatggcgtctccaaaataaacggacgtccttgaagtgcttcatgatgcaccacattatgaatcgtctgatagccaatccagcctgatccgatcggagtatgtcggtctttatgagcgccaactggattcttactgtcattaatgtgaacaactgcgatgcgattcaagccgacaatgcggtcgaattgctctaatacaccgtccagatcatttacgatatcataacccgcatcgtgaatgtgacaggtgtccatacaaactgtaagacgctcgttatgctctactttatctataatggaggcaatctcctcaaagctacgacccatttccgttcctttgcctgccatcgtttcaagcgcaatgttaacatctgtctccttcacaccgtttagtacctcgttcaaaccatcagcaatacgcccaattccgtattctgcatccttatcggtaaaagcgcctggatgtagcacgatatttttcacaccaatcgcgtgtgtgcgtcgaatttcctcctgaagaaagctgaccgcaagctcataggtattttctttgtaagagccaaggttgatgatatacggggcatgcaccacgatatcttccattcccttctcagccattaactgcttgccttcctccaaatacatggactccattggcttacggcgcgtgttttgcggtgctcccgtgtatatcataaaggagctggacccgtaagaagacgcttcttttgtagcgctgagcagacccttgtccgagaaggacacatgagaaccaattttcagcatgatcctgattcatccccttatcctgttatgcttgtcttattttaatttaatcattttaacgtgattattgaaatcaaacaacatagcttttatggcagctttcttaaatgactctattaagggaacacgttgataaagtacacatccaaatatatgttagtttaaacgagggtaaataaaatcatggattgacatccttaaccgtataaaggtactttcatatgaagtttttttctcgaaaagggttatattctataacagatgtatttttttgtgaatcggaaggagagttggctccatgaacatcatcgtatgtggaggaactggattggtggggagtgcactggtcaaaagcttgctagacgacggatacactgtgaaagtcgttacccgcaagccactggtaggacacgaagcgagcccccgtttgcaatatatgagttggaacgaattaaaacaaaagcctgaagtactggaaggcaccgatgcggtcgttaatttagcaggcgaaacgctgaatcagcgctggacggataagtccaaacaaagaattcttcaatctcgactgctatctgttgcccggttggctcaagcattgaatgctctacaaaaaaagccgaaagttatcattcaggcttcggctgttgccgcctatggtacttccctgaccgaaacattcgatgaaacgagccctcgtcgttcggaagattttctgtctcaggtggtagagcaatgggaggaagccgccaatgcctacccttctgattcccgtttaattaagttacgcattagccttgtgctggacagaaaaaaaggggcattccccctcatgaagatgccttatagcttcggattcggcggcaaaataggcagtggccatcaatggatgagctggattcatattgaagatatcgttcgtctgatcacgtactgcatccatacgacggaaatcgtcggggcagtgaatgcttcatcaccacatcccttgacgaacgaccagtttgggaggacagtagctacggtatatcaccgtccgcactggtttcccgtccccagcattctcgtttcaaagctagttggtgagatgagcacgcttgtattggatggtcaaaaggtactaccgcgcaaagcgctggagcacggatttaagtttaactatccttcacttaaggacgctcttgaggaactccattcttcccaaaaacagcattgaatctaaaaaaaggaactccaggctggtaggtagtgtcactgccagcttagagttcttttttagtccgacacaatctctcaagcagactgcaagtttttaagatgctcattttattcctatgaatagcccctattacaaagaaagaagccctgaacataacaggcctcttcttgacatatatccatataacctttatttatgatgcattggaggatttaaaagtgtccaaccgataagtataagataccccggcgattttaaaagtgtctccatccttcattgtgtactccttataaggcaccataggctctccattcagaacagttccgttcgtcgaggataaatccttaacaatgtggctatgttctcctgtaactatacaaagctcaatatgagaacgggaggctccatccgtatgctccacaaactggaccagttgcgggtctctcccgatgataaagctgcctgcaacgaattggtctggctgcaaccggatgcgctcggtccctccactacctggtggcttgcgatccaggcaagcaatcggtgattgctgaacaggtgaaatctgtatctcttgatctggacgaagcagcatcgtttcctgcttagatgcagcatttagcagctccgttaccccggagagagacttataataagcctcactggtatcactggcttccaattcatttccccgcttcgcacctttccacgatggctcgtgtaagtcataatttgctgaagttttctccctgtcttccgtaactcggtctcccacgcttttagattctgagtttggaaaagtccatctccagctctcctgcccttgatcactcaaatcggaagatcgcttgtcttgatgatgctgtcccgctacaaatccggtcagcttatctacctgataacgatcatttttccgctgcgctggggaagaagtagttcctaaccattccgaatccaatacaggtactgaatcgctgtacatatgagatgaagttctattgcgctcccatttccccgtccagcttatataagcaacggcggcaagtaccaaggtcagcaccacggaaatgatcaaaggtaccgtctctggatgatccagataaatataacgccacacgatggccgaagcgagcagacatccaagagcaatgtacgttttatatttttgcaatccaggctccacatcttctacttcgttttctgttacaaactcagaattctcctctggtttcatggacggtttgagccgattgatccgtttaagctcctgaatctcctgcagagtctcccgatgctcttgcccgtatgttccgccacgatcagtatagttcccctgtgaggtatgagagacatgagaggtatgagcagatatgagagggtcggctgatgaaaaagctcgcccctccatactttctccctgcacgctagcactctctgtaccggccttcattccttgtaataacagttcctttagcaatcccaattcaaattcatttctatcacacagatccagtatgcgttgtatatattctccctgagagtgggccacacgagtcattaaacgaataaccatctgcttaaattgactgcctgtttgccctgcatactgtacactgcgtaaaggaacataggttaaactggcggtttccctagtacctgaaccacttagaaaaatataatcctcatgcaaaataaactggcggatatctaacatatattgcgggctacgatggagggcatctgccacttcaaaaagaatccggtagaaatcagaagtcgacacgctcccacctttccataactgggaaagcatgcgttgccccgaaatgtcgtaatgtaactcaatctgaaaatcgacttcctttattctaagttccagcagaccgggaatccgattaccagtcatcatgccggtctgtacggaatttaaatcatcggtcttgagcccgtcttccttgtttagaatcataaatgtcccgccgttccgggcaaaatccctgcttaaaccaaacaattcatgacctccttaacaatttcctatctccgtgaggtagcatgatctcccccaacggacatgtcatggcaagaagtaaagataagcactgatcgctcccggaatgactgccgtcataaaaggaaacctgaggtgcgcttcatttccactggtcagcgctttgccgctgcgaaatagaaaaaatcctcctaaattaaaagccacacgccgcagtctcatgatcgtttccctcttccatagcaaaattcctatgccaataatacctgcaaaaaaaatcgaatataaagctgactgccatgcaaaagcggcacctgtccatgctccaatcaagccgaacagctttacatctcctgcaccaacagctcccatccagtacaaaatcagcatgaacccaaatccggtacccagtccagcaacagcaaataaaaaaccgtgccaccctccaaacagagtattgaacaccaagcctaccactataccgggcaatgtaagcttattagggattttcatgctacgtaaatccgtaactaacgcaatcgcgagcagtactccgcatacaatatacatccacgtcaatgcgatcttccccctttaaaaaatagaactagcagactaccaaatcattttccatcgtagccatcccttacacgtctatatccatcctatccatcagctggcttttccacggtaaacggaacttctatacgttgaccgtcctccgtttcaatcacaaagctccattgaccgggtgttgtgttcgttcccacaaaccagttccattcaataatcccgtccgcattggcagaggtccagcccaagtgctgagctgtgctctcacccgacttataaagtacagaaaggttagcagtcgtcccaggctcaaccttggccttgatcaaattgtacacacctttcacagcaggttcaggcttgacgagcaactgtatggaatgctgcgcatccttatctcctgtcgcatttcctgtacctgctccttcccctgtgtcgccaatccaaagacgttcctctgccgccgcctgaagcacaatgctgcgatacagaaaggggaccttcatcggcagttcatacgacagctctactctaaaataagggtccttagttcctgtaagagcaggtacatgtacgctcgttatatgaatacggtcatactccagaatgctttcctccataaaaggctttagcatcggcttcagaacagggtcaagtgcagcttccgtaaatcgcccccgcagctcctccatcggcttttgaccgccctgaacagcgctttctacccaatcaccaattggaggtggcaactgggcagcgaattggcttgcatattcactcacagataacttgggcaattcatccagcggttcacggactgcatctattttcgcggacgccgcctccacggctagagaaactgggtagattttagtcgaaacctgcttaaccgcttctgaagcggtggtctgcaaggctgtggataccagcgtcatctgaaccatataaatgagaaaaataataaaaaacagaaacattggcaacacgagtgacgcttctaaaacaatacttccttgttcacgccgctcctgcccacaaacctgccgtagatactgattaataggaaaaatgcgctgttttcgtgacatagtacacacttcccttaatgctctcgccttcttttgaggcggtcccgagcatcttcattaccccaggtagaaaccacagcctcatcccattcttgacctcacccgttgcatacgtttgccgctcagcaggattgacatctgtattcaggcggatcagagcaagcatacgggacatttttcgttcattattgctatggagcatcaggaacaatcgcaaatgatctttgtatgtcattcgaaattttagaaaatcagacaatggcacgtcccccttttgtgccagcataatcatatcttctatcgctttttctactccatataacaaagctgccgccaaaacgaccagcggattaccttttgagctgtttttaaccaatccctccattgttcgaatggcgagtctcatagcaaaaatttctccataggcggatgccagattacccgtcggattatggaacccatacaggatgtactcaacttcctgattattcacctccagctgatctcccaaaatctgtgcagcatttcccacatttccacccgatccggccaaactgccaaaacggctaaaatccacatgatggaagtaagaaagcgcgtattcattctggtaaaactcgtctcccagttgagccagtaaattggatgccgacccgtatagaccatccatactatccatggaagctcccgctgcatcataggtgtcataggacaaatcagcggatacagatggactggatgtagactggttaaacgaaatactttcattgtaataccgctccagatttcggaattgttctgcactttgtttacctttggaaagaacctcaatgatccgataggcttgtttgagcttgtttttcgcctctttttccattttcttgcgttctttatccggtccacgtcgcgtatccatcattttggcttcaccgtcgagtacattcgcaggtcccgtccaagcgtacgcactcaagtatttatctatctctttgagcgttgaagcgacttcttgcttgagcatgtctgcattcaaaaatggatctgtataaaaagataatgtacgcatcatactcgttattctattgttagcagcatttatagaagtccgttgcttttcaatttctgcttcccattgctcaaattccttgtctggaatcaacaaatcctctaccttttgccgtgcgcttcctaccgacggatctgcgctggagcctgctccgcttggagtaggcgctgctgaaacctcatcgtagcctgcattggccgccctctgcttatactgggcaatgactttgcgcatctcttcattgatctgccgggcctcatttaacggttccttggcttccagaagcagcttatcatgttcttctccagcctgagccatgatctgacacaggcgatcaagcgctgccctcgctctacgtgcatatttttccatctgcatgattttaacgtcgtccacactcttcttattgtcttcatatacatgtacgtaatgcttatattgagcggcaatatcagctacaacctcaagcgggtcccatatatactgattgggcatataggtgcccctctgtttaataatccgcttacgaacctcttccatataagctcctgccttacgctgcttctccagcatgtcatctagtttggcctctcgtctgtcgtacagcttttgcagccgtttcagcaaatctaccgtatgtgaagcctctttcatattttgagagagcggctttagcttttcgagcacttcaaacgtaaaatcgacaggtgctttatacttcatctcttcacggatctgctcgttaaatatggcatatttaccaagctccctttccattttcagggaactagaatccagcttcatgttcataagcggtagcgtttctgcgcgtgccgtacgtcgcgcgctgtcattgagcactttgaccataatttgttctccgccgccttcgccataagcaaacaaaccgtactcctgttgtaatgtcggatcataagcagacatcactgaacgaaccgccgcatgggtcagccgttcggtctgcacatgcagtgcagcaattctcgcgtaatcaataaatacagcaataaaaccgaacatgaccgccaaaatcagaattaaaaagaccgtgacagcacctgattccccgtcctttgtattgtgtcccttaccaaacacccgcttcctcctttccagttacattcccattacttacttctcactgaccgttttgaccatattgcatcaatactttccctacaactgccgaatctaccttttcaccagatcctctgcccataaacttcgcaccataataacggaccaactccaccgtacgaatccattctacaggttcgaccacgccagaactcatttccccttgcaaatctgtctgatctaaaaactgattcagcaaaggtaccttcactatcttatttaactttgtggtcaccttacggtgaatcatactgttctcatatgtcatctgcccctgcatgcccgcaggcatattattttctgcattggacagcttttgagcaggtaacgagcctcccccattgccgcccggcacctgtacactttcctgattgttggctccggtccagccaaacagggctcctagcataacatcatccttcaagcgccaatagagagaatcccgttgcccttgtgtaaatgctcccgtacgcgggtccttgaagctgttatcccaactgtaagcggccctttccgaagcagtagcagcgacctgcaccaatatagatttttgatatatgtacaggcaaaaaaataacatcacaaaaatgaccagcagtagaatgggaaagacgagggaagcttccaaggagaagctcccgtcctctttttgtgccaatttgcgtagcattatgaatccataaaatcgttactttttttatccgcctttttcaaaagcccttctacaattttcttgatctgatccttgaaaataattgccaccgcaatcagaatggcaatgatcaggatcatttctaacgtacccagaccatcctcatccttgtacaatttacgaatactgcctgttactaatgtcatcatcgttgtattcctcctacatattcatcatcattaaagccggagcgcccaccagcacaattaccgttagcaaaatcagcgccatcgggaatactagcttagatgaagcctgctccccccttgtgcggctaattgaagtccgcttgccccataacgtctgggataactcacgtaaagccatcacgaaatcgctcccgccgcgcctcatattcaacaaaactgtcgtcgtaaataccgtcatttcctgaataccacaacgtttgctcaggtgctcaaatgcctgttgaaaggaaaagccactttcccattccgccaccgtctgcctcagttctcgatacaacggatgttccgtatccgcccctttacgttccacgcaatgtagcaatgcccgttgtaccgtctcacctgcacctactaaaagcatcattttactcaacagttcaggcagttccattaaaatttgctgatcccgcttctgtactttcccatgcaaatccttgatcagcgcgatgggtaccagaataccaagtcccaatccgagcaccagcccagtcgcatccccgcccagcataagcgatattaaagctccaccagcagccatcatatatccgtaacccaacatttcagccagaaaaagcatcgttttttctccgctgttgcgcataccatacagcttctgcaccgaacgctggagcttgaacatcagcaaaggcagccggtgagtagcacgtgaagcatgaatcatgtgtacaaatgggactgaaagtctttgcagccgcagtccctccagcttcatatggcgaaaatgcgcatacttagcactatgcatctggttcagcaccacccaacctcccacttgcagaaccagcatgaccagacaaaccaacatcaccacacccatctctccttacacttcaatcttcataatgtggttgatccacacaagacacccaccaagcaccaataaacaaaaggttgataaaatcatacctgtaccgctgtataagggcatcatgtaatcacccgccgtcatcgtcataaacaatacaaacaaaaaaggggccgcaaacataaccctcgattcaaaacgtttctgcgcaatcattacaccgatctcctgctgaatttccaacttctcaccaatgacatttgaagctcgtcgtacgacttccaccagatcacctccggttcgtttgcaagccgcaaatacgtccgcaaaattcgtaatgtcctccatctgcgcccgacgggccaaatcctgcaaagcagcctctacaggctgtccgatttcgagacaggcggtaatgatgttaaattcaaaaatcaggtcgtgatctccatctggactaagcaatctcaaatcctctacagcctcacgaaaaccattctccaccgaccttcccgctgaaagagaagatgagagtgaatataaagcctgcttgaattggatgcttagagcagatctgcgtcgttgcagtaaaaattgcctaaaataacgaggcgtcaccacagccccggcagcgcacagcaatgataatatccattggtgataaaacagatagccgatcatcgcaaacagcacgccactaaacaatatgcacagacttttttgtactgtcgataatgtatatatcgtataatctggcagagaagggacctcacgtgatacttgcttggcaatcgtttttcctgacttcacgctgatactcctcccctgtgccagctttccggattgatcccggccatttgcagcttcaaagtatgttgcagaccctcgccacaacgttccagacctcccacgattcgccccttactctctcctcgttcctgaaaaagataaagaggattaagcgtcacctcaccattttcaaaaccaatcacttcgctaatttccagcactcgtctggatttgtcgcgcatccgtgacagatgaacgaatatatcaatggccgagctgatctgctgccgtactactccaagcggaagctctgcccctccgagcaccatcgtttccagccggctgaccatatcgcggatattattcgcatgcccagttgacaaacttccatctaatataatatggtattgattttcttgtggataaactaaaaacgcctgaacatttgtccaagcgtcatgtatgtacctcttatacaattttgattcttataatcttaacgggttgccctacaatagcggcagcttcttttttggcttgttcttcaatctcagtttcgtcattcagctccgtttggaaaccgatagattttcttttctcgcgcggtccatcaaaatacatatattcagcaacaacactgttcatcctctcacctcctcgttaagtataacaaaaaagagccccgaagggctcaagcagattttttcgcatttgcattgtaatcttgcacagccttttcgatcacggcccgtatctcctgttctgtcacattcaatcccataacccgcagtctaccgatcacatagtcaattgcctcctgcaacttcttatctccttcaaagtccttgaacacagattccgcataggctactgcctcaacaccaactttatgaagaaactcccggtctttaacggatgtattggacacatagtattcagtagccttctgctgcgcctttttaagagcacttgtagcaatcgtagccaatagaccaatcagtgcagttacaatggttaatacatacggttgagctgcttctattaattgttccttcattataatcactccttatagtttagggaaaatatctacacgcttaggatttgtcttgtcccaaaagatacgcgccccaagcgctgtggttagcgcacgagctggcacatgaccgataccgttgatgtttaccgtctctaccgcgtcgccgttgatagttaccttgctgcctgtatatccgattttaccgccaagcatttcgccaattgggcgagaaggtacgaaggttatatttttgatgctgtaccccgtgaattcctgactacccactattacctccattgccgggtacggcgctgtctcggctggtttaggtgtaactggcgttggtgttggctttgtatcgggtcctgtaaacggtacgcctacatgggcacacaagccttttgcgatggctagagcaacattgttttgaaagtcgttgtcaaagagcgttgcttcttctactgcgttgctgataaatccaacctctactaagactgcatccattgtggtagagcgtattacctgaaagttaccataagctacgccgcggtctctaagccctgtagctgctgccatatgcttgtgtatggtgttggcaaggttcttgctggtaggacgcatataatacgtctctgtgcctgttgcatctgggttgctgctactgttggcatggatggacacaaaggcatccgcaccagctttgttagcgatggatacacgctctttaagctccaaaaatacgtctgtaccgcgtgtgagaatcacctttagctcaggattatcttttaaaaatgcttccaccttaatagccatagtcaggttaaaatccttttccttcttacctgttggcccgagtgctcccgggtccttcgctccgtgtcctgcgtcaattacgatcgtctttttccccatctcgttgtccctccagttgttggatttgtcggcatcttgggcataagtaaacgtcacccaggataataaaaagggccgtcttggccccttcagaaagtttggcaaatcttcgtttggcgtgttcgcatcccattcaatcccggcctcctgcatgattaaatctatcttggattccattcgcatcattcgtatatcttgttcctccgtcagtagccaaggtagccacttccgaagtagtcttttcacttttttctgtttcagaatcaaaaatattattccggctgccgtcgacagtgaaagcccattctttatgatctgttctgctgctgaaattatgaagtcgtacattgctgtccaccgccgggtatagaaacttgtctcgtgctgtcgggccgagcaaccataaaaccatattcaaaaactctggagataccgcacactcgcggctatcatcatccagctctatatactccataatgacctccataaagaaaaggaccgccagataatccggggtccttaataaggtgtgtagttagtaatcattaccactcgtttccagtatagaatcagtcttttgcagataaattgaactcttgcataatctgcttacgcgccttttcactagcctttttaagcgatttttccatttgatttgccttctgttccgttgtgccactgagattcctaattctacgtgctgtctcttcaccttgcacctgagataagcggctgaactgctcacctgtgagtttgttgcccttaatggttttacctgggacacgtggtgccagtgtttcatcctctgtctcagtaatcaggttaacgacctcctgagcttcaggagatagtttgtagcgagatggaaagccaggatttaagaatatattagccaaacttgaatcttggtaatgtttttgttcttgacctaaagtatcatatttcttaggtaatctttctgccaatcctgggatcttcgcctgtgctttgttgagtgattgctccaatttatttggcgagtaggtttcacgcttgttgttatcctgtgtctgcttcacctgatttaatatagtcgggataaaagatgaagggatatcagacagaatgtcaacaattttatctgtagctgtttgaccagcgtaaccagaagccgcgtcactgatcccttttaataccgactgctcttgaagagtgttgataccgccagcgaagctattgtatccagccgctagtgttccgagtatcgggctttcgtccggatctttcttttctccgatattcttgttaatatttgcacccatagaaatagcaatggatacaggttgcatccaatcataggtgtataataaatcatcctcctttagctttacatccgaactaaaaccagactctataaagcgttgcagcgcggacaggttaacctggtactggccttctcccgcagactgttgtaaagatctaatatccttatccttgctggcttgacctttaatgattcctttgtccatcaagaaataccccatgcccatcatcccaaatgtaccaaccattgcacgtgatagagcaagtgtagcttctctcgggttagactcagcaaagcgtgctcctttttcaagtatacgggcactacgaacaaacccaactggactaaattccaaagccctcataagcaaagcgcctggcgtattcggatatttcagaaccaggtcaccaatcccgaagtctttgcctgcgttcaaaccacgtttaaccgtggaaaggaacttagaaatagagttcttgtcttgaaaagttacatatttaccatactgcccagcgatttctgtcaagttttcatcagcgcggttaataaaatcctggacgtactcacgggtaggtttcacacctttgttaatagcgtctaaggttgccatttcgcccattgtatcattgtaagctcgcatgtaagcggcgttatcaaaccctctcagtgcagctccaagagtcttttccagataagtcaagggattatatttacctctaaaagcttgaccagcaagatcatattgcgtttgtaagccgttaatattaacgccgttccatcctgcttttgatccttccatccaatttttccaaaactgtccctgattatttgtccgaaacgtcacataccgctgaccacctgttattttagaacgagctatatctatcggtgtagcgacaaatttattaagtctttccacacgataaaacaactcattgcctaaaacgttccgtacttgtgtttttggattaagcagctgagcaatcgtttgggctgaactaatttttttgagcaatcccggtttatccagagactgtaatattacctgcaaatcttgagaagcaatgcgcttcgcttctccagacaacccagatactttacgagccagcaccaacaaagattcagcctcattatcagttaaatttttctcgcggattatcttttcggtcagtttctcagcccggctaatggtatcctgactaactttcttagcagacagttcaaaggcttccttagaccgcgcatatagcccttctaggctcggtctaatgccctcacctaactctttcaccattgcctctgaccagtcggcgaatttaattgttcctttccccatcttagctgctccaattactgcataatcaccccaaacatccagaggggttgaactaatttggataccacgagcacgtaaacgttccttagccgcctcttcttgagcgtccaaaaacttaactacattatcacgcacacgttgatccttcatagctggcggtcgtcgcggcggtgttggattagcctttcgactggattccttgacaaattgtttggattccttcacgaaccgggataactgatcaatctcaatatcatccagcttttcgccagccttagcgcgtttcaagatatctacaacatcattagccagtcctttaacgcctgtcatgcgctgtgtggtctcggctagatctgtcattttagcagccatatcatctgttatttttactttttctgctttggtaggcaacttctcattaacgctgttagcgagcttctgagcacgaacaagaaccccttctggcgttaatcgttcaaacaaggaaagtgcctggatagactggccagcattggttgcttcttccgctactttgttagcaatattgaccgccatttcatagtttttctgctggttataatgatcaatgagtcgttgagccgttgcagctttttcggcagtgaaacgggaatcatctaaaacatagttcgttgcttgtcgaacgtcttcagttagtcggcggttagcctgctgtactgtttcagcgtttgtaataggtcgatatgttgagtctagacgttccgcaaactcagctggtgttttctcagactgccgcagagtgctagcgaatccacgttcaacctgacctgcttgaccagtcggcggctgaacttcattaacaatcggatttactgttacttcttcagctacgcgcggcgcatttacaggtggttcattcgccgctgtagctcgggcgtttgctgcatctattctagcctggcgtacacgcatgaacttaggtacttcaggatcgttaatattaaagttttgctgacgattgatggatgattcattcaccctctgaatgggttcccggcttgctcctggtctagcacccacacgttgcacaggagacgcagcttctcctacaaaggtagaaggctgggcttctcgtacaggtagtggaacaccatatttttcgcgtgtagcttgattctgacgcgctgttttagcaaggtctgatgttacttgtcgccgcgctggatatgctcggtcaataagatctgataagcccggatctttgcggcttgccattgtactccacagctgttccaattcttccgcttctctgcctggtgtgaattccgtttggttagctacacggatcaggttttcaaacttagttcgatatggattttcaagacgtgccagtctgcctgtagcccctgatgcgttccgtccagcaggaagcgccaaaggttctggcgcccagtttgtcgggttaacaatggctccttcactggttgataggctggatcgttgtccagcttgagctatgcgctggtcaccgcgtccgagtggtagagccaatatttcttcagcaacctgtttcccttttattttagagagagcggcttgaattccctttcctataccaacgcctgctgcgcctaatccaccaccaagagcccctccatatgcaatgttaatcgggtcaaatgtttcattccgaaaagcaacgtcacccaattcctgcgctgtggtatccaatgcacctgcagcggaaccgatagcaactgctcgtgtaaggttactcgagtttttaagcagtggactcaaaagtttggcagtacctttgccgatagctgcaccaggaggaatataaccagcaaactcacccactttgtacggtgtactttctgttgtttgcttaatcaaaggagccaggttctcctttccacccggcgtaagattaacagctgcatttgcaagcccttgtgtggctccgaatgtgcccgtatcaaaagcgccggctttgaaattagagactgctttatcagctgaccacaaggagcctaatgcgttatcaagagttgatccagcaatattatctgcataccactgctcataggcattcattggctgtatttttggtgttacattctgtcccgtagtttgtttgtatgttttagtagcgctaggatcacccatagcagcacgggaaaacgtagaattttcaataaatcctggtccaattgtaagaggagcaggcaacttgaggcggttattttcttttgatgccgcctgccgttgcatctcttgtccagcgtagttcaatcctttatttacaaagtccttaacaccaggtgatttgagtgtatccataagcgttggacgggtatcttctatcatgcctaattccattttacgtttctgtataaaacttaagttggaattggagtttgaattactcgcaggagcggaatcagcaaccattcctaactcgcgctttctcttctgtataaatgattcagccatgtttcaccctcctatctcaacatacccaatgcgtcattcacttctgatttaaaccgcttcacaactccactacgtacagatggggaagaactagggaaatacttcataccgttgttcgctgccctctctgtataaatgcgtctgataatttcagcgtctgacatattaggagatataccagcgttcttgaaaactttattagcgcccccaacaccgtgttgagtagctgtagaccaaagtacactctgcaaggcttcagatcgtttggaaacgtctaagcccgtagatttaacaatttttgaaacagcaggagcaaaagtgccttgtctcatatattcatgttgcatagcattgaactgtttcggattagatgccgctattttcttccaagcagaatcgaaagcagccgttcctggtttcttaccagccagttgctgatacatgcttggggatacatttttcaggtaattcacaaacgaattcacactgcctgtatttgtggcaagctgatatgtgccgtaggaagcgcccccaatgtccccgggtgtatgtgctacagttccggggttgccactggattcatatttacttgagagcgtcccaatccctcctacggctgttgttttgggggctgcccattccaagcaagtccataccgttgatataatttaaattgctcatattcagtcaaaggagctgcaagtatggacctttccagatccggtttatttgaaatgaattcattgccatcagcatccttagatttaattacttgactatccaagtaatctttcgcatagctttcagccgtcatacctttacttgcagcagtccgatctttttctactccatattcgaattgacgcgcatctagcgttcttattccctgtggaatgcctgttaaagatgacaattcgcttgttacataaccaagctggtcagaagccgaccatgcattttgtagagcctgctgatccactgtattgccaaactgagctgtagagaaatcattttcccaactttgctgtccttcgttaaattcttgttgtctgacagcaagaccgttattaaaattctgctgttgggcttgcaaagtaagcggcgtatttgggttattggcttgtcggttaagtccttgccaatcatcctgtggcgttacagcgcgtccggtcatttggctaatagtattggctgcattaagattggactctttccgctgttggtctacttgctgtccttgtagtgtccgtgtacctacaccgacgttcttagcagcctgaccagcattaacattggcaccataaagacttggatcaatgcccattgcttgcaattgcatccgtagttggtcggcttgcgaactatatccgcttcgttgctccgctgtcacacctttagcctcagcttgatttttcagagcaattatattgttcatcgctgtccgtgcctctccagacaggtaattacctgtagtctgtgcctcagccaaaggcttagtaacgtcctgctggtattgactggaatacaaattcaccaaattgttgatttgactttgtcgtgcatctctatcgtaattagccttgtcgatgtgtctggtgtatgcctgctgcatgagttgcggcaatgtggtattagcgatactctccatacttcggttggctagttgattggctacagtatcagaccaacttgatctaccttgaccagtagcccgtaacctagcattagtattacgctgctctgttgctaagttagcccgtgcttcagcaagcgcagattgatacgctggatctgattgagcgtcatatttaaactctgcaagtggagcagcttgcgtactagctaaacctgacaaagcacttaatgtctgctctgtccgcggcgtaggcggcgtatatgctgttgtagtggtgttattacgtacattgtttgcagcttgcaccataggtgaagccttggctacagttggcacagctacaggcttagtaggtgtcataccctgccaggcgttattaaagttttgctgcgttgacattgctgatccattagccactgaaccgggcttaagaaagtttttaccgttcaccgtaacaaatccatctttgtagcctatttgattatttttaacacccttgttgtttagcgcctgtcgaacaccgtaattattggtggttgccattgcatacctccgttcttgtgcaataaaaaaaggaccctcgtatgagaatccttttgctcattattttattgttgtggttcttcaactgtttgaagctttgctaagttggcttcaatatccttaacggtattttcataatcagcaagttgctgctcatatctacttatgatttccgaataatcggccttttccttatcggttgtagctttatctgctttgtcttttttatcagcaataaaatcctttaattcttgaactttcttattgttttcagctaatgcagttttatagctttctattttttctaatctatatttttcttttacctctgcggtgttcaattttgcagcaccatcctttttagtgccatctttcaacactacatttttaccatcaactgtgactgtatatccagccgcttcaccaatagaacgaacaggagcataactctttccttctactactattgccttatcaagttcttttccattaactgaaacggacgtttcgctctgaactttttttccaaccaaactttcaatttcatccgcaaacgacgttgctcctattgtaaatagcgcaccagctaaaaaacctgcgacaattttcttcatgatgtgtctccttcgatccatttttcaccaatataacacatcattgctggattatgaaccttctaatgcttcaagtctatcaaaaatttctgataaatcttgttgaagtgttctactagtgctcctgttatataatctattccagttttcaaagtttattttttcagagactgccatatctaagtctcctccagtcacgtttatcactaaacccccgattccaaatagctccattataccggatacatcatttaatcctcctcttggggtaccattaaatatccatttcaaagcaggagtaccagcatagttaggatcaatagcaatgtaatgatcagcgctagaaaaagcagctaatatattgccttctgaccccatttcaatcttagggaaagcaccatccgtactactcaaaagaaacttagtcaatgtaactaaaccactctcaaacactttaaacgctgccttagcacggtctgggtcaccagcccatatacgtaggtcatcttcatccgttcgtgcgctggataagcctacggcaccgtctttggattgtagctcggttttattgacgttgtagccgccaatctcacggacgtttttactatctatagcaccgttgacgatgaactctaattctttaacaactcttgcaaacaaatccaacaattggtcatgactggtctgcgctactacttgtggagcctgaaacattgccatgaatatacctcctaatagagcggcaactcacgttgttgtcgcgtaagttcgtgcagcttaaaatagcctgtaccctcaaatttgatgcgtatataattttcattcgccatcttggcggtaggtatgataactcgatgcttaataaggtcggaagctggtgcaatctcaccaacctgcacccaatcgttaccgttgatagatggtgacagcgatatctttactgagctgttagatagtaaatccacgacagcccatagcttgtacatacgcagcttttgagcgattgagctattgttaaacggattagtgacaagtgaccatttaacgtcctgtgttccatctttagaacttgagaatagctgtagcactctacctttgctgtctcccacgtagaggttgccacccatctctgcaaagcacagtgggtcgatatcattgaacatcgtccaagcttgaatgcgtgggtcataatttagtatgtcgttttggtgagtggaaaagaatagtgttttaccgtctgtccctgcacagcttgtgctgttgacaccgtttataaagcctttgacgacctcactaaacgatttatcaggtaagataccaccagtatattgatagacaccatttaagttggcaaagtaaataacaccatcctgcgtgattacgctttgattgttacgcacgccgatacggtcagccaccatcttagtggtaaagtccgatgggacaccgccgtacatctcatgcaagctgtttggcattcctatcgtaagcttggttaagctaccggacagcatattcacggtttcccctgccatggactccatttccttgccgtagctgtcctcgtcatcaccgttgtacaattcccatttctccggttgatccaaggcgcaagacttaatttccttgcccacagcacaccataacctattttggtaggtggtaatatagttacctttggctggtgctccggttaaatcagctactgcagtaccgtcatagtgcttgattggatcgactccgttggcgcctactaaatggatgtctgaccaattaccttggaagttggtgaatgaccaacgggccgaagtatccagtcctgatgctagcgtctgccaagtattattgttaaacactctccatgtaccatcgccaaataccgcatgtagctgctggttcttccacacgcccaagcccaagacagctgtacttatcgcactgccaagcacgctgtaaccgcgcctggttgctatgactgggtattcgtccaatacaaaattgctgatgctggtaaacagattgtcctggatggataaagggtcgaagctgctcaaccctttccattcacggactgtaattgcttgctgtataccgggtagcggttggtaattggcttgttgatattggattgccatcaagtcaccaccgctttctggtagttctgtgatgctacattccacgccgctttgtattgattctcgtaatttgaagccttaacggaatcatccatactatgagcgatgtatgcagcaagagccgggatatacgtccagtggtactctgctggcgcatccggctctatggttaagttgctgcttgtatatgctgtggtgccaatcctactgtacctcaccagacctcctaaacctactgtatacggtggcggagatagggttaatactttcgttccatcgtcgaatctaaacgtattctggagcgggttcggtgcgtctgatgatagttcgtgatacttgactacgccacacataacgaaatctatatttttaaagcgcacattagctgataaagtgtactggctttgatcgaggaccgaaacgaacgaatcgaatgcaggaatttttaccacgttgaaaaagtcctgattgattgcgttaagccagatcaacttatctgctgtgtcgactgcattgggtaccagtagatctgcttcttggataatctcatttattttcatgttatcaccctacgattttgcgacttcgactgtgacttcaaatgcattattagtgttaactacattgattaaagtaagggatatcttagcgccttcgctgctcacaccccaacgggaaatgttgagcttggctgctggtccgatgttggatgtacctatcacatcggtaatattgccctgctgaaaatgagcatcggcgaagtcgcgaatcaccactaaaaatacacgactgacggaaattatatccgttgatgtgtctttcatggtgatggtaaaggtatgagttttcttactgttatcaatcaatgagtccgtccagaaatcgaacgttttttcaacgccgtatgtgagtgtatctttttgtcgcttgtacgttcccaggttattgactaccgaaatgtctgatgctccagtcaataacgatccaaaagaagccttatccaggttacacccggtaaagttaatatttttactacctgaaccagttacaaggtgcgtaggtttcgcattaccctcccagtaatccatcgtaaacacgttgccgctgaatacgatatcttcacaatttatcatccgtaagtgtgtttgttgccagtcgttgacattggaataaccggaagccatcattacatttccaacaaaggctaaatcccttgtgttattcatgtagatgccttcgttctctcctcggtcaaaaacattgcccacaaacgttgaacgctgtgtgccagtaagggatatatgcatatcgttgtattcgatcttattgttaacgatgttgcacgccgacccgttatataccattcctatcttgcaagtgtagataaaattatcaaacactttggaatcatagagtaggttaattccaacattggcgttaaagatagcgttgctattgatctgccactgctgcccctgtgtaccgccaaggtcaaaacctattgcagtgttaaatcctgcccattgacaattggttacctggagcagtcttaccgatccgtcgataccgttagtcacccggctttgacctacaagagtaagattgtgtatgccgatgtgactggcaccgttagctctaaacaaaaattcgtcgccaatcttagcgataatacgagatggtcccaggtcatactcgtagtcccacgtctggttaacgcccatgagagagatgccgttgtatagtgtgagctcgccagcgtagtaacgcccggccgggaaaaatatatatccgcctaccaacttcagcgcatcaatagctgcctgaatagcagcagtatcgttggtgacaccatcacccttggccccatagtccttaacgttaagcgagtatgtgccttttttgacaaaagtgtttttgtttgcgacccaatcattcaagtctgatacctgttgcggactcatcaggccgctcacagtcagcgttgaatttggtatagggtcagctccatcgctcaaatgagacgatccatgcaagccggggattgcttctccggtagccgtgaagattaatttgtcttcctctggattcgttgtaatggctatgcctgtgcgagcctcaagggtcaatgtatcttccttatcatcagccactaccgggagcttcccaggtacttctatcgttttaaatgcattcttagcaaaattgtcgtcagcatatttcttcgcattttcttcggctttatcagccttctcctgcgcacccattggggtttcgtaccttgggttaagttgagagccaatatcttgtgttgtgttaggacgccatggtaacaccaatatcattcacccctttacggcctacgtcctagccgtgtaagtcttatatgcacgttgtacaagctatatgtgcctgcacctgattgcgatgccttaaacgtaattacatccgttgcagccaaatacctttgttcttcgaatcccaaaaacgtaaccgcaccagctccaaacccaactacttggcggcttgtcagcatcgttccgttttgatttattgtcaaatccaatcggttagttgctggcaagtcctgcacggtagcaagtaggttgatgctgtaccagccatctaacggtatcactacggtgctgccgctacgcatgctgtagctatcctctaccactgaggtaatcggcacatccaatacagtcggactcgctggcaatgttaatagcccgctacgcacataggtaaacgggaaatcagcccacgttagatagccttgttgcttaacatatcccgtagtagctacctgagtattattggttgctgctgccgctgtaggagccgttggtgtgcctgtgagcgctggactggtaaacatggtcgccttactctcgttggttacattacttagtcctacatcagccttagttagcgtcacgacgccagttttcccggctacactctgcacaggtgacataggagtaagcaactcctgccagccggctaatactgtgggatcgtcacccttcaatatgaacgacttactaaggtccgtacgtatagccacatcacccgtttcggctaccagtgccaacatatcggcttgagtagctaccacaaatgtatcagtgaccgctatagttggcacaacaacagcgtcaagcttgccgttttcgtccaataccgggacattgcctgctgcggtaccagcatccaagtaagcagagttaccagcatcgtataccttgcttaatgggatagggtcaatatctactggcccagttgccgttacggtgattgctctgtcgtccggatcttgtgttacccgtatgccgatgccctgtagtatcttgaattcagtcatctttgcattagctgggattccatttataacggtaaaggcgttttggttgacctctgcgccccactcaatgccatctagtttgttatggtctgtctgagtgacatggactgtctgatcagcggcatgctccttaaaacggtcgtccagtgcgtcagtgtatgacttagaatcctgctcggctttatctgctttctcttgggcaccaagcggtgtttcatagcgcggatctaattccgctgctgtattttcacttgtattcccgtgtttccatggataaggattagccacgttaccacctctcctctattacataacgctcataaccacttgtggccgtgcgatagtcggcaagtagctgctgatagcgcacatcaaagttgttgttctctggcatgatgtccctgagcacgccgtacaccagcaacatgtcccaatccgggtcaaagcctgttgtagattgcatatcgtttactgtgatttctggatagactggcgtgtaaaatatcttgataccataagccttggcatacttaggtggtggaaatataccaatctgaccagcaacgaagtagtaataggtatgtttcatgcgttcgttaaactgcctgagcggtatcctatgccaatcccggctatcgtcatgaccttcgctattgtcgtaaatagctcgccgtatatcgacgtctgtgacgtttcccggtgggcaaggtagatcatataagccctcgccgacaacggtgtctatggcttcttcgattacctctgattgctgctgtgccgcggttggtgtacgcaacagcatatctcttacattagtcagcttccgcaagatagacacgactggggttttgttctccggtagcttctcgactatttcctctactacatcctgtacgcgcatagtggcacctctcttagtacagcgctaaaatatttgttgctgtcgtcccagtcgcttttattcgtttagcaggtaaaaataacggtacgcctgctggtacagccttaattgttacggtattacctgacgggcttacaacagccacatcgccacctacaccgcagtaaatacctacacacttaccatcaggcaaatcggctgtatcacttggtgtgacatccacataatcacttgcttgttttacgggtagcggatctagtcggcttgacattctcgtgctcatcatcttcacctctcgtttgctttactatgatttcaagcagctcattcgttcgctgttgctccttaataagcgcgtttaaagcgtcaatctccatcctgtacgacatcacaagtacctcctatacataaaaaaagggagcaattagctccccttcttggtttccattccaccgtttttatcaatccagtcacgcatagaattatatgtttcaaccatttgcttttgtgagtcgttgaagtcgtcggataccttcaggcgaggaacatacttgtgcttgggtgttgcacccttgccgcctccgctcacggtccattcaacatcttttctcacggtgccaccacctttactttccacgaaccagatgccaggtctactgtcgctccagttgggttgaacaaggaaaatttaatggcattagcagcagatacataagcttgtacctgtacgccttgcagatcgtatggagggaatacctctacacgtctgccaaggactgcgccagttacggtaattgcactggacaccgctccggtcatcgtggccaaggaaggaggatcaaacgttactgttcctgcaataacattcgagcctcctacgggttgtcctgctactgtcaagctgttgatttcaagtgcatcaaaatgtgttttagacaatttaacccctccttatactgggaagtgaccgaagccccaagtccagtcgatgcaaccgtaagaccagcgaccaatcactttgaatttagcaatttcggaatcaaagtcatccatgttaccagtttcaggacgacgtttatcaaaccatttttgtgcacgtttcatacggctgctatcagcaagtacccatgcctttttattaccctttgcaaagaatggattaatgataactttcagatcgccttcgtaaatattgatgttgtgatccgcactgcctggctcgtacccttgacctttaccgttaatgcctgcaatctggagcgcagcacgtctgttatatggtgttgtgatgatcgtatcaccaataattgggatgatgttcccgcggtcatttgtccatccagacattgcaacttgggtatcatccaacgaatcgatgtttagttcttgtgtgcctagattagattgtcctggcccagtgtccccgggagcaagtgggtgatcggtggcaaataatgctttcccatcaggaagacgagcgtcataaacacgaccgcggaagtcgatggcatcagtcgttttgttaccattgataaaccattctgcaccttgatattgacgagtgtagtaaacttcatcgaccaaagatgaaagacggtctttaattgcactcaacttcaaatcatcgataaagtcacggtcaatctggcgaccagctgagaatttgcgatgggcaaagtatttctgccacaattcttgaatgtcagaatagaagacctgtttgttggaatgtgcccaatcttccatcaggccttctccgccgatcatttcaatactttcaacagctttattagaattctcaacggaatacatgtcactaatgtagtccttcttgttagaaatcccttgatcgtatagcgctctaaacacaggctccagaacgtttttatcccaactcaatgcactttgtaccataattttatatcccccttatattaaagctgccgatttttaacttttacgcggcaagtttttgtatttgtattgatctcttcgacagcaaaagcaccgcctgtaatgtcactggaaaggatggatagcccatcagtagaaacatcagccgttcctactccaacaacaaaaccagcgtctggcgtgccagtgtaaggagcatcgtaccagtctccttcacgcgccaaggctacttcaagaaccttatctgtgccagcatctagtttctgagttgcaaaaccagctacagcatcaccattaccagccttagtccatcgaccactagcaatctttactgcttcaccctttacaaatgcttcattattcgtagcaagaatgtgactcacacgccgttgtggcgctccgaaatcgttgtatacccaactgaatgccatatgtttttacctcactttttcatgtatttaggtgctaatttagggttcatatcaaacgcagcaaaagcgctcgccaattcctgcggcacttccgtttccaattctgctgacgcttgtgttactacttgagaccgcttattcagacgttgcttcttgataacatcctgctcagtgcgcttacgttctgcagccaaaaatttatcccggttggtcaactcataagcatgtactggcttgtacccctgctcaatgagtgcgtccatttccgctgtcagccaatccggcttttctccttcggctggtgcattctcgaccaactcagggtgttgattgaacaactcttcccaacctttgagtagctgctgttgctgttcttcctgctttcgcgtctcctgtgacttggattcgcgctctacaacctcgcgtgcttgctgtaacaaagggtgagcatccaagtaccgatcaaggtaatcggggtcaatcccagcgctttcggcatcctcacgcaattgctgtttaagtagatcaaaatcatcctgctttttttgtattgcctgttgctcgattttgtccaagttggcgaggtattcgtctgccgtttcaaacccggcgagtttggctgctcgctgcaaggcttgttcagcttcggttctacgttggcgctccttgtccaaaccaaaacccttctgtactagctcagggatttggtcatcatcgacttcaatctcttctttgttaactttgactctgagcttcttgggttcgtccgctatggctggcgtctcttcctctggctcaaattcttcgtcttgctccagcacgtcttgctcttcgcccattggttcatccttaatgatgccgaattcactcaaagctgcgttgatatcgacgcccggtgtatctggtgtttcattaggttgaacgtcctcactatggctggtgggttgttcgaatacttcatcttccatcggtacttcctcctatcggataagctgctatggctggcagcagagataagcaatataaaaggcgctaggattctcacctaacgcccgcggtattcatttgattcattagtccaccagctaccttgctggcttcaatgtccaacttctgctgttgtacctgctggttgaactccctgtcttgctgctcctgcatctgcttttgtccagtcaactcaccaagctgttgctgcatttgctggttctgctgttgcaactgaccaaactgttcttgcatttgttgtatctgctgttgcataccggattcttcttgcacacgacgattaattacatccattgactccatgcgaccattatcaatggtgtaacgaacagcctcaccatcaatcatcggaagttgtgtgactggatctaccatctgaagcatattaaacgccatttggatgtaatattctctatcctgtggtttgtcagcactgatattaaccagtatgtcgaatgcaggtacatactcctcggctacatcatgaatttcaggcacttcctcgcctgtcgttggatcaatagcagtgttgcctgtgtcatactgtgacggcgcctgagatacaagagaatccctactaacgctgactgaacgccccgttacacgcgctacacgctccgtggtgtagaactgcgccataagctcaatgtactgctcaaacacgtcttgcaaggcttcctctatcgtgtcagtcaccgtgttaagacgtgtacttgcagcagccatgagtgacttggcttgctcaccactggttacattactacttgcctgaccgttcgcgctgtcaaactgtccgggcagcttctggagcatctccagataatattgctgcatattaaggactgttgatggaacattaacgccttgcagttctctaatcttgttaccagagatcgcgccaggagctgttggaagcatggcaccctcagttgatctctgttccttccaagtgtttggcttagtaatagcgccttcctcgtacatcatgccgctgccgccctgtttagccatagtagaaactgcgagttcagcaaacttattaagcatgatttgaggtttgatcatatcccggacaaaacctttgccccatgcatcttgctcagaagggtaaagggtacgggctgtaaatggatatttgccatgatcgtaaaaatatgacttatgctcaaggaatacaccatttgagctaatgtagatgcaatgtacgccctccatattcccttctgctttggcataatcctctgaagggtctttgccctcgcttagtttcgtttctgcctgttcacggaataactctttatcatcgttactcatcatcttaggtagaccacgataccagtattccaacagtccagcggtttgggattttttcactccagttccgtaactggctccgttgtctcgattgaatccctcactactcacacctgtgtggttgaatatttcaatatcatctgtgttttcgtcagattcaacctttcccccctgtaaagggaaccgttctttgaaatattccagcggctttctagacttgataataatggcgcccatttcttgcaaattgataaaatcttttatgcgcggatcaggaaaaaacgtagccagatcaacaggaataatatcgttctgacctacaaatctattttgccctcttcccccctctactgtcgggtcaaagatggttttaaatataagcggaccgtgaataaccatacgccgtatagcacgaatgtatttttgcttaaacttgatctgcctaagctcatatggcatgtagtcgttcaagtcagatgctttctgctcgtctccttcttcctgtgcctgaaaatcagggtacggcgcccagccagtcaacttacctacaatagattccacttggctgtatatgatattgtctacactgttaggacgtttgcgcgagacagcttcagatcgtaacccgcgccagtggtctcccatgtagaaacgctgttcttcttcccagtgtccctcgacactctgtcttgcagaacgagcctcatcgaaatccacctgaaccatacccactatctgttgctgctgtggtgtattgataggttctacagatggcttatcttcttcaacaccgaatatgccagcaaatttactcttcgctttttctagtacagttgacactgcgtatcacccctttcacgcaaaataaaaagccgctagtggcgacttgtgtcttcatcatcttcatctatatcaggatcatcatggtaactcagtggtttacgctttggcttgtcatccactactacaggctgctgatacgctttatactcaccgtagtccttagccatcaacttattgctcaagtcctgtatagtctgttgctgaatcatcgtaatgcggtatacaagcaccgcagatatgcccgcgcctattgttccaactgtaaatacaccagctataaactgtatgtctgtcatacaaatgcacccatgatatacagattttcatactgttctggggtaatacatttaccttcttcaccgaactggagtcttgtggaaagtccgtatccgtttagttctccttcttcgtctaaatggttcattatttcagattgatgccttacataaacgaccgaaccagcatgtttagaaatagcatcttttatcttattgaaatgttcctccacaaggttagcgtcagtggaaattgttttaattcttacctcttcataacacccaagacctttatgactgcaataactcttactaaattggctcaaatactcattcaattcgcttattttcattttcattcacctcaccagaatgtttccgcgcttgatccgtctctatcatcgtcgtcagcatcaaaatccctgttgcctttaccctccggtatagcagcccatggcgtgtcgttgtacaccatcgtatgcaccagttccccagcaatagagattgtgtccacctgatcgtcatgtttaccacgtgggaagctcaatagctcatcctcaaagtcagttaaccatggcgaatcctcgcggtgataaaccttgcctacctcataacgtgcagctatcggcaagctacgggtaaccttgtctttatccactttgatcggcatcacactcatgccctcgcgggtcatctcctgtatcaagttggtgccaaaggtcttatcttcaatcgcctgaaatgctggcttatagcggtagttctgttccttcatcagcggcttctgatcaggacctgtaatatgcgtccggtacacgtcataaatcaatatgtcattgtctggagtaacataaaaagtcgtgacgacaaagtaatcattgatggtcttttcactgtttgcagtgtcaaccgtctggaatactttgcatcgcgacttttcgtatcgtttctcaccaacgataaaatatttggttatgacgtgctctgtttcctctttaaagtaacggaagtgcttccgcttgaagattgtaccgcctgctgcgcttggtctttgctgatacaaggcattgaatacatatgagccaacgtccgatttgatctgatcgagacgcggaacatcaaagccaaattcaggccaaagcgcctctccaggttctcggcctaagtaatcattatcctcagctaatgctgggaagttgattaccgtccaacgctcgcccttatgtgttccttcgcgtatctcgtcagcttctttcttgagtaatcgcccaactaggtcatcttcatgccatcgtgtcataacgactataatgcgcccgtcaggtgttaaacgtgtgtagagtgttgatgtgtaccaactccataatccttcacgtataacctcgctgttggcttcctcagcattttttaacgggtcatcaataatagctatgcgcgcgcctttaccagtgataggaccacctacaccagcagcattcacaccaccacgatatccatctataccccatgattcggcggattgccgggcagatgatatcttaacgccaaacacagattcacggtcaacaaaggtatctcgtgcaatccggttgttgtctcgactcagtgacagcgcgtaggatgctaagattatttcatcatttggatttctaccgatgtgccatgctggaaacttcttgctcactcgttcactcttaccatgacgcggtggcatagtgacaatcaatcgtttgatcttaccagcagacacatccattagtgctttatcaagcacgtctaaatgtttgccctctgcatccctgccctcactatcgtagtcaataaaaaagctaaaatcatgcttggctagtatctcccattgcctactgagtggtactggcttgccgtttccatagctgtttaagaagctctgcactgtctgagtctgttgtgatgatttgttcgatattgtactcatgattgtgattcacctcgccctgcacatctgcaaccattttatccactggtttatacccagctctatcgagcaaatcccttgccgcaaccaatctatctttatgctgagcagtcttatcattcatgatctctaacataacttctcgcgccttaacagcatcatcagcaaacatcattcgcaagtccttgttaaggttctgttcagttttgttaagatattgttgaacttcaacagactttaacaatctgcttccctgacttgatgctgttttctcactatacccagcagctattgcagcatgagtcgcattgttaccgttcttcaaatactcgttcacaaatagcataatttgcggtctcagctctgccatgtgtctacctcctttctagtcagttatcaaccgcatatataacctacctctgtctacttctggtttttttctaacatagacaagtttatgatttcttttaatcttttttataacctctgctgttctttttaccgcctttagtttgtccggttcttgcctgctcatttcactttcaagcttgatataaccattagaaatggtgtagttgctcgatatctgcatcattaaaccattccctagagaaatttcaaccgttcgtgaatctgtagagggtaaatcctttataagcggtgtgatataccgattaatccactttttcataactctacgtttcatttgtctacctcctctctccaaaccaactgtaacactgtaacgccatcattagcgctatacatcccggtaaccagcctatcctaatggctatcctcatgtaccatgggaactcatttagatcaaacataaagcttactgcgatgtaactgatgcctatacatagtaatagaatcatgttgcctactttctcccgtgtaccttactttaccgtcacccctcggtgtttcgggtttagattacgggatgcttattcactttttttctcttggacggctattgccaacgccaacaaagctgttgatcttgcttgcatcagtgttgctttagcttcctcagatatgtgtttactcaaacgtgttccgatgttgtttatttgccctttacacatttcaatgactttgtctttatccatttcttctacgctatatgccaactgtatccctccttataggaaaaccctctatacggctgccgcttcgctaggtgattcggtcgcttcgatgaccttcggtaaaacacaaaaaagccacagatatttttccctgcgacttcactaaacgtattgacagcaatacatattcatgttattatatattcagagggtgtggtaagcactccggaaaggagaacctaagattatggggacagcaattgtacttctactgactggcttggttaacctcgcagcggcttggctcaatttccaaactgctaagaagaataaccgccgggtaaagtaaaaagccccttacggtgcaacgtaagaaggcttgagacaccagcagggttggggagaaatccccttccttgctccctattaatcttatgcttattctaccctctgtatactttgttgtaaattataatttacaaaaaaatcagaaacaaaggaggcaccagcatggaaactgttactctcgtcatttcgttggctggcttagttttatcgttggttgctttgattcaagctatcaagaataggaggtaatcaccttggcaaatgcagctttgtctttccgattcccggaagaattcgctaccctgttgcgtacctggtcattcgtgactgaaaaggatcaacgcacactattgcaagaagcattcacggaatatgcagcaaaacatcccgacattaaagaaaaagtcgatcaaattataaatacacttaatgacccatccaagtgatgggttatttttttactatctgcaaacaaaaagagcaacggttacccgttaccctctctgtacagatatcatttttgatgtgggcaagggactttcacccttgcatgcaaactttgggttttggcttacgcctgctcactttgtttgcgtaatgcgattagctgcgtctatcttccgccaccacatcattgctcactaaacgggatgcccaccctcgcaagctattgtgaagaaacagcgtggacagcgactgcgcatttagctaccgttgcccatcgcatatttcctatactattattttatcaggctagttgcgggttgtgtgcggaaaatatggggaaattatgctggtttgaacatgaaatcaacgttttcgatttccgtgaattccacgtccaaaggagcgagagctttggttaacttattaagtgcctgtgtgtgccatttggatattgttccccgatctctgcccatgtagttggctatctggtttagtgacatcgtatttcgatcaagatacttcttcataatgactgaccgttgatcatcacttagcacttcatccaatgccttttttgttaaagtgacaatccgattgtagcgccgatcatcccatgaatttatgccaagtattttgggctttcgtccttctacgttcaagtctaaaatagtagctggcatgggaatgcctccacttttatgttgtgcgttttttgctgcaaactcataagaattataatcagttagcaactcgatcactttattcttgtccatcaatatccctcctttagctctactaatgggacaaaagcaacctctctgtacccttcatgtaccctatattcttccatcagatgaaatgatggcttggtccatcggtttatactccatccatgccgttcaaagtcgaagtataccatcaatgaacctgtcgcctcttcatcttttaaatcaatcatcaccgcatatgggtgctctattcccggatgattaaaccaataatgctgcatcacgcttttatcacgtttaagcatgtttacccttcttttaggaaaaggcagcaattaagctgccccatcatctactttttcatatgtttgttcgaatatgtcaggcttacacgggtaaaattctcctcggatgccttgaatgatgtaatctccaaaactagcagtcatgacgccttctggcgtttcaattgccaaaccttcctcaaaaacaatattaacgcatgcatttcgaccgattatgctagtggacatatcaatttcattcacccattcaagaatatccgcaactacttccttttctcgtgtcaactggcgcgcttccacaacgatcggttttttacgatacttcgccattaggctacctcttctggtcttttcaccattttttctacaataactacgcgtcttttgagttcttcaaactcttcccgcgtaactgtctgtcctgccaccgactcactaacgttccctttagccactccgtcggctgtgtcttcttcggtttgaaactgtgacggcaattctactactgttcctgccgtgtccacactctccccaggttgtgccagatcctcattagcacgttttgattcctcggctgctcttcgaaactgatccgcttcttcagcggtcacctcccggtatttacctttttccagccatgtgaatgtgattggttcatccgtttcagccagtttagcggtaaactgcgaacccttgttatccgtttgatgtacatcatagatagctggacgcgactgcttgaatttctccatctcttcagcaaggtttgttgccaagtttgtgtcaatgacacgagtcgcggctttagcgccaatagcaatttcagtacgcagatcctgtaaatgatcattcaggcgttcaatctcagttttagcagtagccaactcggacgcagctgcatcccgtttcatcgtaatgtcctcaatctccagcttagcattgcttaattccgttttagcctgagccagcttgtctgacatttcgttgttctctgcaataagctttgcaatttgctcttcatattccttttgaagctcattaatccgttctttatacccaatagtcatagtttccgttttagcctcaattgctaagcgaatagctttatatgccccttcgtcggtaaaaaagctttctacgtttactcccgccgtattgacactatccagcagatatttagtaggttgttgctcttcttgtgtttcaataatttggtctgtcatgctactacacacctcaatccgattattttcatctctatactatgattataccatatatagtgccgttatagtacatttttcgcactattacacaacatttcgtatgtggttgtcacttgactatctcaaatatttacgaatggctaccatcacaactgcgtaaatcaataacgctgctattaagtccatctttaggctcccaacttatccggtggtttacctatgaatctatgaccatccgttttaaaccacgtagcaggctcgtagagaccttttaactttctacctagtattcgttcgtccatcaccagtaacacgcctatacgagtcccagaatcgtccataagggtatatccgtctttgtggttgatccaacatgctatcatgctgcttctacctcccatactttgataacgatccgtggtcgttcggaataatacttacgtgtattaaggacaacaattcggttatcatctttccaagctattttatttagagcatcaaaaattcctttgacacaattatcaatatcaggcttgactataggtaatatttttcctttcagcgcctcatctcttttcttcttgctccagctttgcggtattggataatagaatgcgatctctgttcctacaggtcctgataatggcttatcaaacttctttctcgccaagtaaccaatcttagttttgtaggtgaggtaattttgtgctgacgggttttcccacttgctccgttgcgtcatacgaactgcacccattggcgtaatgtttacctcaaatgttatcatgctactcctccatggttttctctgtttagcctgtctaactcatgtaccactcttgcttttgatataccgacatttttagcgatctctgaacgccgcacgcctgccttagcttgctggctaatatatttgctaatttcaggtgcaagtggttcatacaggcttgctatgagcttatctgctgtctgtggtagcttctggcttttaactggctgtgcctgctcccgtatagatccacctgtacgataatgctttttcatcatgctgcctcatcctcctgtgctttctcccactctaactctgccattcctttacgtatgaattcgtcccagtctttgtccatgaggtcatagtcgtctattggattcatggggtatcctccagtggggtttcatagatgttgccgatcacttcaatttcagatctttcgagaaaattgaaatccttggttccgcataggttgatcaatagctcactgtattttcttgatctgaaagacccgtttgagaatacagcaacgtctataatttgagagcatgaggttttatctggatctctgtaccaagacaacggtctgtcataccatttcaatatgtctccctcgtatatctctttaccgttacggtcttttagtccggtatattgcatgatcactttttcgtcgtccgagaagccacgtacatattgcccatcaagagggttgaatgccgccaccttgccgtctggatcaatagttacctcatagtccatttccttttcaaacacgtcccacgctctaaatttgatgggtctactcatttgtatcctctccttcaaacggttcgtatccttccaaagcttcacgggctcgtttgccacaatcaaggttaatcaacaccttgtcgtagtccgcataaaactccagtgccttatccttaatctctatctgttgtaggaggtaggatatgtcatcatgtaaatcatcaggatatgtgttgctcatataaaaatatatttctctcgattcgtgggcttcccgtatctcttgtatcttcttcataatcgcatctctccctgtggaaaattaagatgagcaaactccccataatgttctattgcagcctcgtcatatgctaatgctgccgctctctcatttttaaagctcttcttaaaaacgcattttccatttttcattaatttagcgcaccagtattcgtaaatgtagattttcccacagcttttggttttacttttatagcggaaaacccctttatagttagacgtgccacctcgggacggttgattcacttgattctgagactttgtagcaagccttagattctcgcgcctgttatcaagtttgttgagattgatatgatctacgtcaacattttcaggcgcctttaaaatgaaacggtgcaacatttcgaatttcgaaacaccattcgtgcttcctacatagatttttgcgtaaccattaccttgtatgaaaatacgattcttcattggaaaaattacatcgtatacatcttcatcaacaattatctttttgccacgaatatttattgtcttatccatggtttagacctccacttttctttcttccatgttagggccgagtgtttttaggaaaccaagtagtttgtctgtgtattcaccgcgagtgtaaatcattaattgtcctgtttcatcattttttagatatacaaaccctgcttttccatacgttttggcataagcttcaaagtattccgcacatgagtccaacgtcttctcttgtaactcttgatttaattccatatcccttattcctctccttgccctttaggggctattattcatccgaccatttatcaaaaataaccagtttgccacccgttttcttaccaacatcccttaaaactgcaaggtgtcctattgagtcgtaatcaacaacaccgtctctaagagtgcccacattgacatttatatccccgtatgtttcctggaacttttgtaatttttcgattagttcagatattgtcattcctctatctgtcattcctctatcccctctccttgggtagctattagagctgctaaacagatagcttcaggcatggtttctctaaacacatggatgaatatgttcttagttacgatatgaaaattgcacatgttgtctcctgacttcgcttcaccaagaatgacagatccacttttctcggatgcttcattgagagtgaaagagaaccctttgctcttcatcttctgaatcacttcccatgctgcacccatgtctgtcgaataatcttttggataatggtcgaagccttccgaacttatccatccataattaataggactttcctttttgcccatcagttttacagcgacccatatattccgtccccgtgggttcatccaattccatttagctattacttcatccctggtcatgcctgtttaaccaccttccggtcttcttgatggactttgttgctaaggcattcctgacacactttaactttcaatcccggcacacccattgtcgctggtcgtttaccttcccaattgcatttctcacatacccaaattttcatgcttcttcttcccttcttattggagtctatagtcaaaatccttgaatttaccgtattgctttaggttcatcatttctgctgtccctacagatccctcacggttcttggccacaatgatttcgataatgttctttttctcggtatctcggttgtaataatcgtcccggtacaagaaggatatggtgtccgcgtcctgttcgatgtttccagactcgcgcaagtcactcatcatcggccgtttatcctgacgctgctccactccacggctgagctgagctagtgatataaccggacaatcattttcacgtgccatctgcttaaggctggaactgatgtaaccaacctcttcattgcggctgctgaacttcttgccaccttttatgagttgcaggtagtcgatatatacaatcaaatcaggatgcctcttcttcagctttctgacagctgcacgtatttcttggacactcagtcctggacgatcatctataaacacattcatttctgtcagcactgataagccaagagtatatgtctcccattcgtcgtctcgcagttgtccggttcggatgcgctcaccatctatgtagcactctgcggctatcatccggtcatacaattgcatctctggctgttctaagctgaatatagcgactgtaaggccctccttaccgtttctaacggcgttgtttaggaggaaggcagttttacccatagaaggtcttgcagccactatattgagcgtctgcttctgccatttgcccgttatcctgtctaactccgtgccaactgtactgactcctaatgcttgtccgttgtacttcttgtcattcaaaagctcgaagtgattcattagtccatctttaatatgcgagaagccttctttatcacgagactggtcaccgattttttcagcaatgctcattagctctgccgcaaactctacagggtcttcatgaccaccgctatacacttctttgacagcaatcattccggttcgcattaaatgcttttccttcacaatacgttcatgtgaagcgaagtccgaaacggatggaaccgacttgctcaggtcaaccaaatagctcataccgccaacatcctgcaaggcttgtcccatacgtgaagttatagacacaacgtctatttttttattttcttctcgtaatgaaagcatgttttcaaatatgaccctatgaccctcgtgataaaatgcatctggcattagtagagactcatatatcaaatctggagctaacaggatggagccaagtacagattgttctgcctctaagctgaagtagctcattgagcctcagcccgtttctctgccaataacctctgcatccaagcctgtctacttataccttctctgacccacggcggatcttttggtatgtctttgcgttcttcatcctgcctacggatcatctcacgcgttctctcaatttccttattagcttcaattctctcattcgcttttattaaagtaggtatgccaggagcgaagtcttttcccaggcttagataatcgctcaagttagccattacagtttcaaagtcatattgttggagtttatccacccaaatatctacaaccgatttatcaatcttccaacttgggaaatacgctgctgttttctttacgatatcaatagcttcccttttttccatctaccccaactccctttctaattcatcaaagatagacatgcgactgctttttgctcctttacctttatgtttctctttaatggcattggtataaaaggaaaatgaatggaccttgccgccgtcttcaacctttttagcgtgtttctcctccataacatttatgatcaggtctgcctgcactcccttacttagcaattcagtaaccgtaggccaatctgatggtttcaaacccatgcattgatggatacgtccgtactctttatttactttttcaaaatcattattttcgccagtagtaatttctttaagattttctttaaaagactttctttcttggtaccctaatccgggtactccccccgtactctgattcgggtactccccatactctgattcgggtacaatactctttttagggtgtactctatttagggtactgtcctctatttgccactcactaaaatttttattgaagccaatctctcggctggttgtgtaagttccttcggcgtaaacctttatcaccttcatttcaatgagcttgtccaattctcgtttcacctgagctttttttgtatctgtcgcctcagctataaatgtaagtgacattccatgacttttcctttgaaacccataagtgttccttaagatagatatgatgattccatattgagtaccgttgaattttcgttttgcaatttcctcaagtatttcattagtaatccgtgtaaacggtgcatccaaatgactggacatttaatcaccacctacatcgcttgtttgtcttgattacctgagtggcacgaccattttttcatgtactcattaactgccttgtccaaaaattgctgcatcggtattccgtgctctacgcagaataatttcaacctcttgtgttcctgcggatcgagacggtaaggaatattttttgtcttggtgtattctgccattatcattcactccttcaagtctcattgacgtcattataacacgttatcgtttattttgtaacgttatcgttatattttagttcataccgtttacttatcgcctactatacgtatgataggaataggtgataagtgatgattaaaagtaatttacctatgcttatggcgggtaaaaaaattagaagtatcaataaattagctaaggaaactggcgtgagtgccccggctttgggtcgcctatacgatgggactaacatccgtattgactattcaactattgaagcactctgcgcctattttgaaattggtattggcgagctactggagtacgtaccagacgaggactaagcccctctctgctccaatcgatccatcttttgcttgatgcggtctatctgccattcgtagtgcatgacatccgcataattaccgtatctgtcggcctcgtctcgcttctctacagcataggcgaggtcaatcttcagtagtgtgtagtcgttgtttactgccattttcattgtcctccaagtcttgtatgagccgctcaatgtattcaaccgtctttcgcaggtcctctactccattcttccgcttccatcgccacaagtatttaatacatgcacctgtggtataagcttctaagccactcagtccctttgtagcggtatttatagcagcaaggcactctacttctccctcaactcctacatcgtagtgagatgggcgtatagcgtcactcatgggcaactctccctatgctcaaagtgttcggttcaatcgacgtgatgatcatacacctatctatactgactacacctataaacaacagtacagcagctaatatagaggtataagcgtaggtcatcagcgtttcccccaataggtagatgcgatgcaaaggaatatccacatccaaaatgccatccaagggtgagccatcatccaatcagctatggtcattcctcttcaccttctgccttttcgatattccttggatcaaaataatcaactgcaatacttactccgaatggataaccataattatgtttaacgcctattcttttccccgattttgaccatttttcgaatgttgcttcgtgtagcttgcgggttttatgacgcactggttcgcctttacggtaccctatatatggctcctgatgtggtgggtctccacgctttgccagttccaaaagctctttaagctcattcggtccaaatgcgtttccaaactcactcatttccgtttcgccttcttccagatcgtgaataaacgattctaacactctgattacctctgtcatctatatatcctccctta

SEQ ID NO: 49 - DNA, 26996 bp, Unknown
  Kingdom: Bacteria, Phylum: Firmicutes, Class: Bacilli, Order: Bacillales, Family: Paenibacillaceae, Genus: Paenibacillus
agggtgtaaccttgaaagtatgtacaagtgacatacgacaagcgcatggctattcattcacacgataagtgatgaaccgaataaccatacggaagaatttacgatgtaaattcatgtttggtggcgatagcggaggggttccacacgtacccatcccgaacacgaccgttaagccctccagcgccgatggtacttggaccgcagggtcctgggagagtaggacgtcgccaagcacgataaaagagagcacagccttaatgggctgtgctctcttttatcttctcggaattagatatttaaacagtttaaaaataggatatggaaactaagaaggaataacatagaagtaacctagtcctgacgaagagtaggcttgatggatgacgtagttcttacattgaaataacaaaaacggaacatgtattaaaaatgcttcggccataccctgctggattaatgaactcgtatcccgtttctaaagctgtagggaatgttcgccatacagacgcaagtttaattgaagaaattcctcttaactcaaagtgaactgttagcctaaagagtgctcttatatgtatgagcatggatatgtactacgtacatatatgatctctgccgttgccactattatgttaataacgtgaatcggccttgattattcaaggccgattctttagtttaggggaaatgttatgtacttatctgttcatgaactcatagatttagaagggcttccttcagaagagcaattgacgctgcagaccattgtacaattttatgaggagcacctttgtaacttaatttttcattataaaattcgtcataaaaagcgtgccatcaggttgcattttagaacttttgatcttcctcatgtggttcgctgtagacccggctgcacaaggcaagggtacgggagaaaacgaattgggtagaacacacgattattcgtgatcagttgggtgcccctacggtgacactagcgacagcggagaagcatccatatctgctatccatgtacgagcgttgggaatatgaacgtatctatgcttttgatcacggaacaggggatgggacgatgcatttactgcgtaaagtggtgaatcctgaattatttgatacctacattcgtgaacggctaaccataaatagacccgatcatcaagaacggacgaagcagattcgttcgccgaaaggggtttggataaagccacgaactttcacgaaaaggacatccgcagcttcgtgtggaacgactgctacgcattacaatttggtttgtcaagcaccagatatagcacaaattccgtttcttacacttactacacagaaatttttacaaaaattcattaaaaattacaaacaatgcctgatttttagacaaaaaagggcatggtttgtgtgtataatatatttatacattatatcgacatactttaatttacttttatgtttatattgaaataaaaccattcatatatcgcatttttttcttattaaaggaatttaaaatatattgacatttttcgagtccatatctattatataaataaaatatttctcatttaatacttacatcgaaaaacatcctgtaaaaccccaacaatttctcatcacattcatctatgatgctgaattttaggttccaagcctgaaattctagtatacctcaaggtttttacacttccaagtctactcacacacctgacttttgatcacaatcacaccacgaacggaaccttattaccaattcactgccatatgtcgattactgttttttggcaatcgagttcgttattttttactgtatttttctctacttcttaatgtcaccatatatatgtattcatacataaaatgtgattttttttgtttatccatatttttttgtggaaaggggtttgatatgaatcgcatggctttggtttttcctgggcaaggctctcagtatgtaggaatgggggctacgtggcatagcggctttgcagaagcggatcgcttgttcgaagaggctgctgatattttgggatatgatctgaaagctttatgcatggcaggtccgatgacccagctatccagaacattctatactcagcccgcacttctcacgatcagtgtcattgcattccggcgttatatgcatgaaatcggaattatccctgaattttcagcaggtcatagcctgggtgaatattcagctctggtaagtagcggtgttctatcatttagcgacgctttacgactggtacaagagcggggacgcttcatggaagaaaccgttgaggctgggctgagcagcatgattgccattcgtggagcagagttgaacgtcgtggaagaaatctgtcgtcggcactccacactcgatcagcctgctgtcattgcctgttacaattcgtccaatcagtatgtcgtctctggtcatcatacgtcggtagctgttgtagctggcgagttagaacagcaaggggcccaaattacccgcttgcaggtcagcggcccttttcatagtccgctgatgcagcatgctgcggatagactgaccgcagagctgcaaaaatacactttaaatgaggcgaagtggcccgtgatctccaatgtgaccgctctgccataccccgatgttgacagcatccgtcaaggattggttttgcaaatgactcacccggttcgctggattcaaaccatgcagtatatggcgaatcgtggcgtgaaacaaggcatcgagttaggtccacgaacggtgctgaaaaatttggcgaaggaaataaacactaccattgaatttctgtccgtggatagagacttggatcgcgttgaactggaacgccgcttctcaatccgtgattgggttgctcgttccctttcactggcggtatctacccccaatgccaattggaatgaagatgattatcgaaagggtgttattttacctgttcgaagactggaagaattacttcgaagctctgaattagggagcggttcacctcctgcttttgagcaaagacaggagattttgaagtgtattcgcctggtgttgcaaaccaaacaggtctccgaaggagagcagaaagtaatgctagagcaattgaggagggatcaggatggaacagtatcaaactttaattgaaatcattcaagaccgtgcaagccgggatgagaacggaatcacctttatttctggtgataaacaagaggaatacgtatcctactgtaaacttctggagcaagcatcacaggtactttatgaattacaggaaaaagggatacaacctggcggtgagctgatcatgcagatcgacgacaatcatacctttgtgaatgtattttggggttgcctactgggtggaatcgttcctgttcctgtaagcatagggaataatgatgagcataaaatgaaattgtttaaaatctggaatacactttcccgcccttatatgattgcagatgacaaggtattggaacagttagaaaaatactcgcaccagcacgaactgctggattcctttgagcccgttaaaaaagcgactttttcaagccatatattcgattattccaatcagagtaaaggtgttgcccatatacccaaaccggaggatttagcttttatccaattttcctcaggttctacaggtgatcccaaaggagtcatgctgacgcatgaaaatttggtttacaatattcgggatatcgcaaatcaaacgggcatgagctccaaggatgcttatttgggctggatgccgcttacacatgacctgggattgatcgcatttcatttaacctgtgtgatcgctaatgccaagcagttgattatgccaacggcactttttatcagacgcccgtctttatggctaaaaaaagtatcggagcataaggtgactcaaatatgctctcccaattttggatataaattttttctcgatcagtataaacccgaaacagcagctaactggaatttgtcgagtgtccgtatgatcttaaatggagcggagcccgtatctgtggagctttgtcatgtgtttatggatgcaatgagtgttcacggtttgaataaaaatacgatgttgcctgtctacggattggcagaggcgagcgtgggcgtttcctctccacctctggacaaaaacacctttatccccattcatttgaatcggcagcagttacacgtaggtgaacctatagaagaagtggacaagtccgacaagcggtgtcttacttttgtagatttggggtatccgctggctagtacctctgtccgcatctgcgatgaacaaaatcaggtgctcgaagatggggtgattggacacacgcagatccgcggcaaaaatgtggcatccggatactataacaatccggaggctaccgcgaaggtcaaaacagaggatggctggcttatcaccggcgatttagggtttatgcggaacggtcgcctgactattactggtagagccaaggatatcattttcgtgaacggacagaatgtctacccgcatgacatcgagaggattgccgaggaactggatggtgtggatctcggaaaagtagccgtctgcggtgtacatgatacgcaaatgaggcaggatcgtattattgcctttgtgatgcacacgaaaaagatagagcattttgtaccgcttgtccaaaagctgaaaagtcatctaaattacaggggaggttggcatattcagtatgtggttccgatccggcgtattcctaaaacaaccagtggaaaggttcagcgcttcaaattagcccagagttatgagcagggcgaatttgatgaaatattgacagcactggccgaggctactcgagtcatgcaagcagctgagcgtgtagtcttacctcaaggaaagatagaacagaagctgattggaatctgccaggatattttaaatgtaaagtcgatcgggacggacgatagctactttgatatcggagtgacttccttgcagctcgttcaaattgtggacctgttggaggatcaattagggattcatattgaggtgacggacttcttttcctatccgaccatcgccaagcttgctgcatatatctctagtcagggcatgagcagcgacccggctgcaacagcacagtccgaggccaaggaggaagcaaatgtccgggatatcgccatcatcggcatgtcaggcaagtttcctcaagcggaaacattagagcagttttgggcgaatgtggcatcaggggctgacaatatcggcccgtacagcgacgaaagaagaaaagatgccgaagatttcatttcccgtctgaatacggaaggacggaatatacaaattgcagaaggaggctatctggatgaagtagacaaattcgattactccttctttaagctgactccacgggaagcctcactcatggacccgaatcaacggttatttctacaaaccgcctggagcacgattgaggatgcggggtatgggggtaagcaactggcaggccaaaaggtcggcgtgtatgtcggcttctccaaaaccagcttcgaatacgagcgtttgttgtctgaggtggaaccgggcgcgctgccgaactttgccatgggtaatttatcatccattatttccagcaggattgcatatttgctcgatctaaaaggtccggcgctaaccattgatacagcatgctcttcatcactcgtggcagtgcatttggcctgcaagtccatccttagcggagactgcgacatggccttggcaggtggagtgaagacgattttactgccgctgaaagcgggcattggcatggaatcctccgatgatcgagcacgcgccttcgacgaccactcggacggaacgggctggggtgaaggagttggagccgttttactgaagccgctacgcaaagcggaacaagacggtgacaacattttagccgtgatcaagggaagtgccattaatcaggacggtagcacgattggtatttccgcgccgaatgcgctggctcaggcagaagtgatttcgcaggcgtggcgcgatgcacggattgatcctgaaacgataagttgtatcgaagcacatggcaccggaaccaagctgggcgatccggttgagattgacggcattaccaaggctttccgcaagcatacacagcgtaagcagtttgtggccatcagcacggtcaaaacgaatatcggtcatttatacgaagccgctgggattgcgggcttgatcaaatccgtattgtccatgaagcaccaacaaattgcgccgctcgttcattttcgcacaccaaaccagaagatccattttgaggaatccccggtatatgccaatacgaagctacgggaatggaagtcgaacggtttcccgagaagaagcggactgagttcctttggattcagcgggacaaactgccatgtggtgctggaggaatatatagcgaagacggaatcagaccaagcctcaacggacagcaacaatagatcatcaccactgctgctgaccctgtcagcgcggagtgaatccgctttgcacgagctggtcgggcagtacgcagaacggttcggacgtgcggaagaactcataatgcaggatgtgtgctatacggctaacacaggcagaagccatctgaatcatcggattgctgtgactgccgcaggagcggatgcgttaaaagcgaaggtgcttcagttgcatgaacaaggcagagttgtcgaaggtgtatacaccgggaaagcggatagtacaggtgacgcagagatggtcactggaagcttggacacgttgcaatcactggagcaactggctgccaagtatgtgcaaggagcgcagatcgattggaatgccctctatgcaggtaagcactataaaaaggtttctctgcctacgtatccatttgaacggaaaagatgctggattaacgtacccgaacaggttcgaacgaaacagaaggtaccagttcatgaaaactcaacagtaaaggagtctggaatgatggggaacgagtattcagcgccagcatctgctatcgatcagcacaaatcatctattcttcaaaagttagcgaaaatgatcggtaacgtgtcccaactcagtatggaggaactggagccacaaacacattttctggagcttgggctagattccattaatttgtcccaggttcgccacagtatcaaggataccttcggactggacgttccaatgaacgaatttttcgaatcgttgaccacgctggagctgttggccagctacgtagccgagcgggtgagcactttcacttctgctgaaaccccggttcaatctgtggaaaatcgtccagaaaccactctgaatgaggttgatcatgcaactttcccgttaacccaaccgtctcatgaatccgctgttcaggctgcggcatccgtttatgccatagacacggctgggcaaacacgggctcaaagctttccaatcgctacagctcctgcggctgtagagcgaattttggagcaacagctacatctgatgtcacagcagctcgatgttctccggcatcagccatctgcatccgtaatagcttccgagtcatttaacccggaaacgggcgttttgctatcggcaagtagtgaaagtgcgcagatcatccgtaccgaatccaagcagaaagtcgcggctgcattagcaccagcaccatccgtaaaggctgttttcaagcagacaggcaatgaagccaagccgtatacgccttataaaaagctggatgttaaagcacgtgaattgctttcgctccgtcaggaacaacacctgcaagaactgattgaacgctacacggcccgtacgcgtagcaccaaacagtacacccagcagtatcgctccgtatacgctaataaccgcaatgtggctggtttccggcctgttttgaaggaaatggtgtatcaaattgtatcccagcgtgcagacggttcaaaaatttgggatctggatggcaatgaatatgtcgacttgacgatgggctttggtgtaaatctgtttggacataatccagcctttattcgtgaaaaaattgagaaagaactgaagaacggcatgtgtattggccccatgtccaacatggctgggcaagtcgccgagcgaatatgcaagatgaccggtgtggaacggattgccctatataattccggcacggaagccgtcatggtcgcgctccgtttggcacgtgctgccactggacgagctaaagtcgtcatttttgctggctcgtatcatggtacattcgacggggtgctggcactggggagcgcgggtgatgacaaggagcattcgacacctctagctccaggtatcttgcagcatatggtggacgatgtcgtcgtgcttcattatggggcggacgattctctggattatatccgcactcatgcgcatgaactggccgcggttatagtggagccggtacaaagccgccgaccagattttcagcctaaagcctttttgcaggaaattcgccagataacggagcagtcgggtactgccttcatttttgatgaagtcatcactggcttccggattcagtccggaggagcccaagcgtggtttggggtacaagccgacctcgtgacctacggtaaaatcattggcggcgggctgcccatcggcatcgtagccggaaaagccgcctttatgaacgggatcgacggaggcacgtggagcttcggggacgattcctatccgcagcatgagcagcagcgaacctttgtggcaggaaccttctgccatcatccgctggcaatggctgcatccttagcggtgctggatcatttggagaaacatggcgagcaactgcaaaatcgcttgaacagccgcacctcggcgttagcagcggagctgaacagctatttcactgacgaacacgtacctatgaaggtcgttcactatggctccctattccgcttcgtgctcaaaggcgatctggagctgttcttctatcacatgctggacaaaggcatctatatctgggagggacgaaactgcttcttgtccacggcccataccgaggaagatattgcgcgaatcgtacaagcggtcaaggatagcgtgaacgagctgcgtaaaggaggatttttaccggacccgcccccgaatggaaacggcccgggaccgggaaagcaacctgtacctgtaaccgtacctccagaggatgaagcagcagaaactattattgcgttaactccagagcaaaagcagctttggttcgcttctgtttcagatcgaagtgactctcaatctttacacgaaaccgccttgttgcggtttcgtggtccacttcagcagcaggcgttcaaccaagctgtccagaccattgtaaaccgtcatgaagccttacatatctttatgagcggcgatggggaaactcaggtgttcgctcctgtgatgaaagcggaaatcccgcttcatgattttaccagttatcgcccagatgaacaggaacaacatatccgggcatggatgatcaagaacagtgaaaccccatttgccatgacgccaggtgagccattattccgaattcatctgctgaaaatatcggatgaagagcatctgggtgtttttacgtttcatcattttatcgcggatggctggtcaatcagtgtattcattcaggaactggaacacatctattctgcgcttgttcgacatgctgactacaaccttcccgatccagtaccttttcggaattacgttgtttggcagcaggatcaattgaaagcagggaaaaaagaggcccttgctttttggtcagcagtgctagaaaagcagcagcctgtcctccatctgccatctccggtaaggggaatacaaattccgtcttccagaggaagcagacataccataatgctcgaagcgaagctcgttaaacaattgagatccgccagcataaagctaggcagcagtctttttataacgctgctatccgcctttcagatttttctacatcggctgacagggcagcaggaagtaacggtgggggttcccaccgcaggacaatcccatatggacgccttctctctgatcggcaactgtgtcaacttgcttccgatgatcagcgaagtgcgtcctgatgctacttttacggagcatgtccaaacggtcaaaaagcgcatgaatgaactggacagctttcaaaagtacagctttgccggactcgctgagctggggctgaggcatttgcctgtcattaacgctgtattcaatatggatcgaccgattccgcgttttcaattccatggactggaagcagaactcgttgagaatgaggtgtcattcagcaaatacgagttgtttttgaacgtgacagaaaagcagaaacaattacgtcttgatttcgactacaattcggatctttttcagccaaacattatcgaagcctggtcaggatatttcctgaatctgctgcattcctttgtaaaggaagaaggggctcgcgtttccgctctgactttactccgtgcgccggagaacgaacaacttcgaactgcatgggcagcaaataccgatgccaacggaaactatctttgcgtcctcgatgcctacaagcatttggcacctgttgggacagcaggggaggtgtatcaagcctcagtagcaggcctgttgggaacgacccgagaatgggcttacgtggaaaatggtggcaagttggggcatattggcaatttgaatcggactatccacattcgcggacatcgggttaatttggggcagttggagaaacacctgctgcaaactttccgattggagtcctgcgtcattacaccgcaaacggacgaagctggaaaagtctcatatataaccgcctatgtggtcgcaaacgcatcgaagccatgggaagaagaagcactgaaaaaggctgtaatcgaaattcttccagattatacgcagccccgtttttgggttcctatggatcatattcctcttctgccggatggtcagcctgatctacaggctttgccagagccgagacaagcaagcatattcactaaaacagacgccgcttctgagaaccagggcgtagaagatcaactcgtgaacatttggaaggacgttctgcatgtaacggatatcagctatgacgataacttttttcaactaggcggtgattcactaaaagcgacggtcattctgtcgagagtcaataaggaactgggtgtacacattccacttagccacatttttgagctgcaaacgattgcagagctggctacatatattgcgggtggaacaaagaagacctacgaaccgattgtatctgtgaaatcgcaagccttctatccggtatcttcttcccaaaagagaatgtacgtgctggatcagctaggaggcggaacggcctatcatgtacccggccagcttttcatagagggagatctggaggttccccgcttcattaaagccgttagggaagttattttgcgtcatgaatcctttcggacgtatttcgatctggaagacggggaagtggtgcaaaaagttcgggacacgattccattcgacataccatatacccgtatttccaaggaagaagcaaaacaggctcggaccttgtttgttcagccttttcatctgggaacagctcctttattccgcgccgaactgtacgaatttatcgaaggtggcttcaatctgctagtggatatgcatcacatcgtgtccgatggtttctccatggccgtgctgctggatgaaatcattcaacggtatcagggcagacagcttgcgaacattcagcttcattacaaagactttgttgcttggcagaagcagcagatcactgacgacgcattgcaagcgcatgaatcatattggctccagaccttgaatggcgagcttcctatactgaatatacctacggacttttcacgtccacaaacacaaagctttgaaggtgacagcttgagcgtcaccttggaatccaaacttactaacacactctacaaattggcccaagataccgaatctacgatctttatggtacttttggcggcttataatgtcctgctgggcaagtattctggtcaagaggacattatcgtgggtacacctgttgccggaagacggcatgtggatacgcaaacgatgattggcatgttcgtcaatacgctggttcttcgcaatcagccgcgatcttttttaacgttccaatcctttttgcagaaggttaagcaaaactcgctgctggtactggagcatcaggaatacccgtttgatgagcttgtagacaaactggaactggtgcgcgacgtaagtcgaaacccggtgttcgatacgatgttcagtttgcaaaatgtcggcacagatgttttggaaacaggaggcattcgttttaaaccgggagaattcaacgcgggtatctccaaggtggatttttcattacatgtgaccgaggaaaaagaatgtttgtccttcactttggagtatggcacaaagctgtttaaaccggagaccatccgacggctgggagagcattttgtgcgaattttggaaacggtgacgcaggatgtcggggtgcggttggccgatattacgatcgtatctgatgaagagaagcaattactgctaaccgaatttaatcataccgtcgttcctttcccgtaccatgagacagtccacgggcagtttgaaaagcaggtcgtacagacgccgggtcatatagcattggtgttcggaaatcagcgtctgacctaccgggagttgaacgaacgtgctaactcactggcacggatacttcaagcgcatggtgtaggacccgataagctagtcggcctgatggtgcagcgttcggcggaaatgattatcggtctgctcgccgtgctaaaagcgggtggcgcttatgtgcctatcgatcctgaatatccgtcagcccgtattgagtatatgctgagtgacagtgaggctgccgtgctcctgaccagtcgcgatctggtaggagaacaccattacagcgccaacaccctgtttatcgaagatgaggaagtatatcaaggggaaaggaccaatctggaagccactgctcagccggagcatctggcttacgtcatctatacttctggctcaaccggaaatccgaaaggagttatgctccagcatcgctcggtgctgaattttattacaggaatgcgtgaagtgatcgactttgcagcaaacaaaacgattttatcgctaaccaccatttcgttcgatattttcgttttggaaacgattctgccgctgctgggcggaatgaccgtcgtgttaggcgaccgccatcatcaggtcgatcctcaggcacttggcgagctgattactgcacatcatattgacatgctgcaaatgacgccatctcggctgcacatgctgctgagtcatgaagaaggctcccgtgcgctgcaaggtgtacaggaaattatggttgggggagaagcgcttccgcccaggctgctggaggcaatgcagaaatttaacggtccccgcatttataacatgtatggacctacggaaacaacggtttggtcggcagtgcaggaacttacccatgccaaacagatcgacattgggcgccctatcgctaatacgcaaatgtatgtcatagatgcgcaggatagattacaacccatcggcatacctggcgagctatgcattgcaggggaagggctggcccgtggctattggaagcgcgaggagttgacggcggaaaaatttgtggttaatccattctccacagacacacgaatgtacagaacgggtgacctggctcgctggaaagcagatgggaacctggagtttatcggccgaatcgatcatcaggtaaaagtacgcggattccggattgagctgggcgaggttgaacatgccttgatgagccattctgcaattcaggaggctgttgtcactgccaatgaaagccaaaatcatgaatccgtactatgtgcctacattgtactgaatacagaagaagcacccagcctgacggcaattcatgaacatgccgccaagttgctcccgtattattcggttccgtcttacttcgtgtttctggatcggataccgttgacaccgaacggaaaaaccgaccgaaaagcattgccggagcctgaaaagctattccgaccggatgtggcctatgtagcgccgcgaaatgatgtggaagaagctttggccgccgtatggcaagatgttttgggacgcgatcaggtgggcattcaggataacttcttcctactcggaggcgactctgttaaagccgttcaagtcatcgcgcgtatgcgtcttcacgggtattcactggatatccggcacgtattggagcatccgtccattgaaatcctgagcggctatgcagaagcactggcccgtccgattgagcaaagcccagtagatggggaggcgccactgacaccgatacaacgacatctaatcgattggtttgaactttatccagcatccgaggcacttcctgccgcaatgtcggtactgctgttggcaaagtcgggctttgacgagcagccattgcgagccgcattgaagaaaatcgcagagcaccacgatgctctgcgccttggcttattacaacaggctgacggggcggttacgcaagctcacaaaggactgcatgaggagctaatcacgctggaggtactgtcccttacgggaacggaaagcgaagcacgcagtcagatggaagctgaatgtcaacggattcaaagcagcctgcggctgtttgaaggaccacgaattcgggcagggcttttccgtctggatagcggagatcatcttttccttgctgtagacccgctagtggctgacgccatttcatggaatattttgctcgaagatctggcaacaggctacggacaagctctggatggggaaacgattgtcttaccggacaaaacgaacgcttaccaaacgtgggcagagcatcttgagcattatgcgaatagtaaagagctgctcaaggagcaggactattggaacaagatagagttgtcagagtggagaacgcttcccaaagaccatgaagtcattacggattctggatcggagagacaaacacatcagctccacctgcaattatcaacagacgaaacccagcatctgatgacacaggtcaattatgcctataataccgtgccggaggaagtactgctgtccgtactggggcaaacagtatccgaatggtcaggacaagaacggattgcactctacgtggagaaccctggccgagaacaggctgaaacaaattcgctggatatctccagaacggtagggcagtttacgtccgtgtatccagttgtactggacatcaaatctgcggatgatatagcgctgttgctcaagcgtgtgaaggaaacggttcggcaggttccaaatcacggattgggctacagtgcattgagatatctgaccgaagccagcaatccaacggattctaaacgttttcgtcatccggaaattggtttccgttatatagactccccacacccggaatcggtttatttttctatatcgccgctgcaagctgaaattggaccaggtaccaaggatgtgattaatggttcatcttatgctctttatatagatagccggttggaggacggaaaattaagtatccgtatatcctatgacaggaatgcatatgaagagcgcacggtcaaacaacttttctcccgcttccaaacacacctgttgaataccattcgtcattgccttgatcagtccggtcaggaactgacaccaacagacgtaggggcagatgatctggatttggaagagttcgaagagatgaaacatttttatgaaagcctataaatattcgattgagggggaaatccgatgagtaaaaggcttgaaatcgaaaaagtggccaatttaacgcctttgcaggaggggatgctctttcatacagtcatggagccggaatcacaggcgtactatgagcaagtacgaatgaccatccggggtgaactgaacctggaggctctgcaaaagagcttcgagactctggtgcagcgtcacgaaacgcttcgttcgaatatttatcataaaagtgcttcccgttcgcggctcatcgtgtttaaggagcgaaatccaacgcttcgttacgagaatctgacgaatattcccgagccagagcaagcagaggccattcgcagctacgcagacgcagaccgaaaccatcgttacgatctgagcaaggatttgctcactcgtctgactgtgcttcaaacccaaacgcacgtatatacgctacttttaagctttcatcatataattatggacggttggtgcctcggcatcgttatggacgagctgttcgcggcttatgaagcactgaaagcgggtaagactgtacaactgccgacaccgcagccttatacgggctatgcccgctggctggataagcaggataaggaggcggcgaaggaatactggcggtccatcctgaacgactatgatcagccagctgtgctgccaaccctgcctgtagcccatccgctccagccagataccgggtacttgctgcatgagcataaaataacactcacggatgaaacaacccgtcaattgcggacggtggctgaacgcaacggaacaacccttagcagtctgtttctggctgcatggggagtggtgcttggaggatacaaccaaagtgaagacgtcgtcttcggcaccgttgtttccggtcgaccgccggaacttgaaggtgttgaacagatgttgggacttttcattaacacaataccggtacgaatcaaattggatgcagatctgccattctcaggtctgcttcgtgaagtgcagcgcagcgcggttcaatcacgggcatatgactatttttcactcgctgaaatacagtcccagtcagcgcttaagcagcaactcatggatcattttgttgtatttgaaaactacccgctgcaggatatggttggccggcctgacctgaaggaacggcttggattcgtcgtggaggacgctcagctgtccgaagaaacaccttaccacttcaacatcgaagtggaggacggaaaagcgttgagctttatgctgtcctacaacaactatgtctacagcgatgaagcgatgacacggttagctgggcatttggagcatgtactcgtccaaattgcacgtacaccagaaatcctgctgcggaacattcgtctgctgaccgctacagaagaggcggaactcaccaatatatggagcgggccgattgccgactatcctgctgaaacgttccatggaatatttgaagcccagacagaacgtatcccggaacagaccgccgtcatctacgaagacaccgcactgacctatcatgagctgaatgagaaggccaatctgcttgctcaagcactgcaaaaccgtgggggcaagcgcgaacatctcgtcgccgtgatgcttgagcgttcagcagacatgattatcgctgtgttagggattatgaaggcgggagctgcctacgtacctgtcgatccgacctacccgaaagaaagaattgcttacatgcttcaggacagcggagctacgattatgctcacgcagtcttccttgactgaactattggccgatgtggattttgcgagtgaagtgctggacttgccagcgttacttcaacaagcttcacaagcggagcattcccatcaacaagcgtctatctacgtacctattcatgatcctgaggctttggcctacgtcatttacacatcgggaacgacgggcaacgccaaaggcgtgatgatcgagcatcgccattacgtaaatacggcatggggctatagagaagctcaccagttaaaagagtttccagtcaagctccttcagattgccagtatgtcattcgatgtctttgccggtgatctggccaagacattcgtgaacggaggcaccatggtcatttgcccacaggatgtgcgcaacgatcctccagctttggcccaggttctcgaacagcacgaaattacgacgtttgaagttccgccagccttgttgacgctgcttatggactatgtatatgaacacggtacagatgtcagtgccatgaagctgcttactacaggcgcggacagctttggcgttgataactatcggacgcttttgaatcacttcggcgatacgatgcgcatcatgaatacctacggtgtaaccgaagcggctattgattccagcttttatgaagaaacagctgaacgtctgcctccgtcaggtatcgtcccgattggaaaggcactgccgaatcataaagtatatatcgtggatgaggctttgcgtccgctccctgtcggcgtagccggggagttgtgcttgggcggcgcttctgtggcccgcggttatttgaaccgtcctgacctgacggcggagaaatttgtaccgaatccttttgtaaagggagagcgtctgtaccgcaccggagatctggcacgctggctgccggatggcaacattgatttcatcggtcggattgactttcaggtgaaaattcgtggctaccggatcgaacctggtgaaattgagtcggccttactccaattggatgaggtacgccaagcggtggtcacggatagaacggataaaaccggacaaaagtatttgtgcgcctacgtagcaggtacaaccgacaaatccttcttgcggacagagcttgccaagcagttgccaagctatatggtgcccgcacatattatcgtgctggatcaattgcctttgacccataacggtaaaattgatcgacgtgcgcttccagaacccgaagattttgtgttgaccgacgtcgagtatgaagcgccgcagagcgaactggaacaaacactcgcttccatctgggaggaagtcattggtgttaagccgattggtctgcgcaacaactttttcgagcttggtggcgattcgatcaaagcgttgcaaatcgcagcccgattgaacgcgaagggcctcaaaatggacatgaaggatttgttccgccatccgcagattgatttgattgctccttatataaaaaaagtaattcggaccatcccgcagggggcggtacaaggtacagtggagttgacaccgatccaatgggaattttttgagcatcatcgaacagaacgtcatcattacagtaaggctgtcatgctccagaaccccgaaagatggaacgaaacctggctgcgaagcgccgtggacaagctgaccacgcaccatgatgccttgcgcattacctttgatgaacgtgaaaaaaaacctgtcgcctataacagaggcacagccgaaggtgaacactttacattggaaagctacgatttaatacatgctgaccagcctgaggaagaaatcgcgcagctcactgacgcgttacaaagccgttttgatttgcgtaacggcccgcttgtgcgtttggctttaatccggctacaggaatccgatcatttgttaatcgtcattcatcatcttgtcatagacagtgtgtcgtggagaatcctgctggaagacttggaaacaacctaccaacagttagctaacggtgaaaagctgcagttacccgccaagaccgattcctacaaagaatgggcagcacgtctgtccaagtatgcacaaagcgaactggcgcgtcaggaaatcagctattggaatacggtagaagctcgtgaaatactttcgctgccaaaagatcatgaggtttcagatagcctgatccgtgacgggcgcaaatccgaagtgacactcagccgggaagaaaccgaaaacctgctgaaacacgcgtaccatgcttacaatacagaaacaaatgatattttactgacggcgttaggactggcttaccgggaatggagcggacatgctgaaattgcagtccaggtggaaagtcatagcaggacgaaattgattaaagacattgacgtatcacgtacagttggcaggtttacgtccgtgtatccgtttgtggtaaatgtgagcaaacccgaagatttgtcccatcaaatcaagctggttaaggacaatttgcgacgcgtacccaacaagggtttcggctatggcattttacgctacttgaccgacagggagcagcagaatagggcaacctttttttctgccaagccacctgagataagctttagctttgacggagaagccagagaaggtacgacatggcgtacctcgccactatccacgtttgccggtactgaaatcaaccctctgactaaaaaagcgcccagctttgatattcatggtgcggtggctgacgaaagactccgtattgtattcgaatacaacgcacgtgaatatgaagcatcgacggtggagcgacttacagccagctttaagaatcatctgatcgaacttattcgccattgctgtgccaaggatacagcagaacaaagcccgacggattttacatatgggcaattgtctctggatcagttcgaaaatattgcaaatcgcttgtcaaataagctgttaaaccagcaagtgaaaattaaagacctctatccgctatccccgatgcaggagggaatgctatttcattccatacttgatgaaaagtcagaggcttatttcgaacaaacgattattaccattcatgaagctatggataccaacctaatcagccgaagcttacaaaagctgattgaccgatatgatattttccgtacggtattcatgtataaggagacggatcgtccgcttcaggttgtactggaggaacgattagctgctcctgtccataccgaagatgtgcgtagtttaccggatgcggaaaagcacaggcgacttcaagccattttacaggaagagcggcaaagaggttttgatctggaaaaggaggttctcatccggttagcgcttgtacagtgggatgaggacacctcaaagctcatctggatctctcatcatattattatggacggctggtgcctgagggcggtagccaaagatttttttgatatttacacatcgcttcgggacgatactcctttaaaattagagcctgtccatccatttagcagctttattcagtggttggaaagacaaaataaagaggaagcagcagcatactggaaacaatatgtgactgattttgaaaatgaaactgtcgtgcccggctatactcgatccgttgatccttcatttcaggcagagcaactcatatgcacatggggagagcagctgacccaaggcatggaacaaatcgccaagcaaaaccgtgtcaccgtcagcactttatttcaaaccgtttggggcttattactacaaacgtacaacaacagtaaggacgtcattttcgggtctgttgtgtcgggcagacctgatgaaatctccggtattgaaaatatggtcggattattcattaataccatacccgtacgtattaaaagctccgctgaactgcggttttccgacttgcttacgtctatacaggattccttaatggagtccaatcggtattcctatttttccttggctgatattcaagcccatagtgtactaaaacaaaacctgatccagcatattgtcgcctttgaaaactttcccgtttcggaagaacttacgggcctggaaaaaaatcctaaagccctccgtgttggtgaaatagaggatattgaacagaccaattatgatttgaatgtaatcgtcatgcctggccgagagctggaaatcaaatttagctataacgcgttgacgtataacaaaaatgcgatcaaacaattggctgctcacctcatccaaatgatggagcaagttattcaaaacccaaatatccggatttcggagattgatcttttgacagcggaggaaaaacaacagctcttgtttgattttaatgatacacggagaccgtatccatcggaccacaccatacatcacggctttgaagaacaggcagagaaaacaccggatgcagtagctattgtatttgaaaatcgtgagctaacttaccgcgaattaaatataaaagctaatcaactggcctcgaagctgcggaaactgggtgttacgccggataccatcgtaggcattttgactgaacgttcaccagaaatgattatcggtattcttggtattttgaaggcgggtggagcctacttgccactggagccttcttatccgcaggaacggattatgtttatgcttcaggatagcggtagcgaaattctgctaaccctatctgacaagggtaaacagatgaacactttcgatttttccggtactgttctggatctggccgacatcagctcctacgactccgacgacttcattttttccgaatcgacaacggcagacgatctggcctatgtcatgtatacatctggctcaactggacgtcccaaaggtgtcatgattgaacatcggaatgtcatacggctggtgaagaacaccaattacgtaccatttgccgagaacgaacgcattttgctgaccggggcgctcgtgttcgatgcctgtacctttgaaatttggggagcattgctgaacggagtgcgtttgtacattgtaccggaatccgtaatcttggatgctgttcagcttggtgaagcgctggatcgatatcaaattacaacgatgtggctgacatcgcccttgtttaaccaactcacacagcataaaccagatctctttgcttcgctcaagcacttgctggtgggcggggatgtgcttttacctgggatcattaatacggttagagcacattctccgggagtgaacgttatcaacgtctatggccccacagaaaacacaacattctctacttatttcccgattgataaggaatataaccgcattcctattggtcgcccaattggcaattcaactgtttatattttggactcttcaagcaggctgctgcctattggtgctcaaggggaaatttgtgttggtggggatggtctggcgcgcggctatctaaacagggatgatctgacccagctaaattttgtccctaatccattcattccgggcgaaaaaatatatcggacaggtgatttgggcagatggctaccggacggcaatctggagtatctcggacggatagaccagcaggttaaaatccgcggatatcgtattgaacccggagaaattgaaacccagctcatgaaacatgatgcagttcgggaggcgcacgtagcggtaaaaagcacgaaggatggtcaaaaaacgctctgtgcttatatctcaaccgacgtaccgctatccaagagtgatatgaagacccatttgattggccaattgccggattatatgattcctgcccagtatgtgttcctgccggcatttcccctgacaacgaacggtaaaatcgaccgccaagcattgcctgagccagaaatgaccagcggttccgatatggaatacgttgctccaagaaatgaagtggaacaacagttggcgaacctgtggcaagcggtgcttggcgttgaaaaggtcggcattgacgacggctttttcgagcttggaggtcattcactgaaggccattcaactggtatcgaaagtacaggaatcgaacattccgctggatatacatcaattgcttcaatatcagacgataaaaagcttgtccgatcttttacaacgtgatgaagagggcggagtgaacacggatacgctcattgccaaagctcaggaggttgagcgggctattacagaagcatttggtgtccaggtgttgcttcagtccgtatccaccgataagcaaaactatgtgttcctgcaagtagagcctttttgtgtagaacaagttcaggcaatctctgaatttatccaatcttatatccatccagacctgcacccgcattatatcgttcgctggggaaccgacgaaccagatagaattctcggagctataccgacaaacgaagaacaagaaaccttgcttaaacaacaggccgatgtatggcttgccagcattgctaagttaaatacagactggaataccaatatactaagtctgaatgctattggatgctatccgcttgcaccagctcagcattaccatttgcaacattttacaggctcgggtatggctgtgcagttaaatagctacttgaacaccgagcgtttgactgtaacgattcagcggcttcttcaacgccatgaattgctaagaagcgtacttgttcaatcgtccggagcatgggaatgggagttgcgtccagctccagagcatctttttttaccgactgttgatctctccggtcagtcggtacaagcacaacgcaggcttctttcttccattgcctctaagctatttttagaaccttatgaacttacacagtcgctgcagtaccggatcgtcctgattcgcttaaatttgcgggaacatctgctattgtttccttgctcgcacatcatttttgatgctacgagcagtgacatcctgcgcagacaactccttgatgaatatcatcgtccgcagcagacggcacatgcgacagaagaggtgcaataccgggaatatgtaaaccatatccgccaaggccctcaaggaatcggggatcaggaaatcagcgagcaattcaaactccagacgtttggtgagaataatgatcgtatccacgtgctgaccgaagaacgcaactatgcggacactaccagatatcgttgggagctgaatttaagcgacatttcagagcagcacggcgttgcgaatatgttggatatttcgcttcaaatggctgtacgttttttcagcagctatttccaactctctgatgttccgctttggattactaattatggaagacaatatggcgaccgaaactattttggaaccgtaggcgagtgtattgatcatatacccgttgtgctgcaggaagatgacactgaatcctatgaaaagagtatccatacccacctggactttgcttcacgctatcatttgaactttttcaatctgatcttcaatgctgaaatggagaaagcttacccgatatccagcagcattttgataaaaggacttgaacagctgcctatcgtattcaactatttgggtgagggacgagaggatgcagaattgctcgacaatctgcataccgaaggcacacaggccaatgttaacaaggttattttctttgagtcagagcatgtaggagatattctgaaaatctcacttaccattccatatcatgagaacgaccagtatatccatcaaatcttccagactgctagtgacaggctcttgaatgctttgaccattttgcagtaaggagatgaagatgtgaatccattgtttaaggatagccgttttatccgattttttgcatctcgtactcttgccaatatcgcagacagcatttattctatcgtgctgctgtattttgttcagcaatcgacacagtcggtggcgatgaccagcttcacgtatacggccgtatctgcggcgtcgattttcagctttctcgtgggtcctgtggtggaccgttattcaccgcctttgttagccagcatcgccttgtttacgcaggctgtgctaattctggccgtcccgcttctcattcaggacgggatggtcaatctggtcgctatccttgttattgtattcattgcatcttgcttctcaacactgttttatccggccaatagtaaaatgctgccgcaattgataggctcgccggatttgattgtccgggcgaattccatgatttcgtcgacggatcaggttattaatattgtcggatatctggctggagcctcgctcatcatcgcaatggggatgaaaaatactttttttctagccggcgcgatgctgtttctggcaggctttgtatatgtcaggctcaacaagcaaattgatgctcctccggtggaagacacgaacggaaggagttcgctaaagatcgtgtactatctgaacgaattgaaagaagggtatctttttgtaaaacggcacaccttcctgagaattatgcttccgttctttgcgctgacaaacttttcgatggcgatcttggtcattgccatgccttctatcgcagtatcctatggctcgccgatctattacagcttgctgtatgtagcctactttatcggtattttcatcggttcctttctggtcagtgtattgaaaaagaacggcattaccatcgcggtttcctgggtagccatgggattggcaatctatgtcttttccctggtgcccgagatgtggatgaagctgctggcagctctgttattaggcatttttactggcatcatcaatgtgctgcaaacgtctttgattcaaattattacaccgctgccgttactgggacgtgttacagcctttttaaataccttgtcgaatgcggctctgccattaggggccttgattggaggggcgctagctttacggttttctctgagtgaggttctttttttcagtggactgattactgtactatgcggattgattatgtttctgtttaaggatatccgccagtatcagattccttctggagagattggaagagttgccccttcccacaattcataagccatgcatgtcagtgccaggttctcatcatagaacctggcatttttagtatgtctggcctcgccatgataaggctttatcatagacaatggtaaaactatcgttacatttggacaccaaaggagatacaagatggctgagcctttaaaaaatatatacacagcgaattttcttcgctctttcggtgaaagaagtataaacagcttatagctggtttgatacccagggatttattcttcaaatcatgaacgagacgtgagatgggctgagctaaaagaacgaataaatcggtataatttacatgtagtattcagcaaacctaaatgatatattattcatccggccgtaagataggctgcgatgtaatggttcaaaaattcaaaagatcgtctatgagttattatttaccagtagtatgaatcgccaatgtatgatatattatttatccggcccaagaaaagccgaatgagaaaattgatctttgaaaactgaacaacgagtgagtaaaacgattttgttcgcaaaatcaaacaagagatatttttatctcgtcagtttcaa

SEQ ID NO: 50 - DNA, 4644 bp, Unknown
  Kingdom: Bacteria, Phylum: Firmicutes, Class: Bacilli, Order: Bacillales, Family: Paenibacillaceae, Genus: Paenibacillus
cggcagcggactatccaagcaagcagacgattcacggcttgttcgaggcgcaagcggcgcagaccccggagcaggcagcattgttctgcgagggagagcaactgagctaccgcgagctgaacgaacgcgccaaccgtttggcccgtaccctgcgtagtcacggagtgacgagcgatcgtttggtgggtctcataaccgatcgttcggtggatatgatcgtaggcatcttcgggattttgaaagccgggggagcatatgtgccaattgatccgacgtatccggaagagcgtatccgctacatgctggacgactctggggcagagctgttattgacgcaaaatcatctggtgggcaacgtagcttttgacggtaaggtgctggttttggatggagagcaggcggtctatcacgaggacggttcaaacctggagcctgtatccgggccgaacgatttggcctatgtgatctatacatcagggaccacaggccagccgaagggcgttatgctggagcatcacggactgtgcaacctgaaagtctatttcgatcagacgctgcatattggcatatcggatcatatcctgttgtttgccagctattcatttgatgcggcttgctgggaaatcttccaggcgctgttctgcggagccacgttatacgtgccaacgtcagagacgattttgaactacgagcggtttgagcaatatatggcggatcatcacattaccgtggcaaccttgccgccgacctatgcggtctatctggagccgggacggatgtcaagcctgcgtattctgttcacagccggatcagcatcgtcgatagagctggtgtacaagtggaaggatcaggttccgtattataacggatacggcccaacggaaaactcaattgtcacaacgatctggccggtgtctgaggatgcgaatgcggatgaacggatttctatcggacgtcccgtaccgaatcaccgggtatatatcgtggatgcgcatggacatctggcacctgtgggcgtagctggagaattgtgtgtatcgggggaagggctggcacgtggatatctgcatcgtccggagctcacggatgagaaatttatacctaatccgtttacggacggagaagcaggatatgaacgcatgtaccggacaggtgacttggcgagatggatgccagacggcaacattgagcacttaggccggatcgaccatcaggttaaaatccgggggtaccggattgagttgggcgaggtcgaggcgcaaattttgaaagtggaagatgtgcaggaggtcatcgtgctggcacgtgcagatgagcaggggcaaaaccaactggtcgcctactatgtggcagagcgagaagtgaatgcaggtgagctacgcagcttactgggtgagaaactgccaaactacatggtgcctgcgtacttcgtacaactggagaacatgccgctgacaccgaacggtaaaattgatcgcaaagtactgccagcactggaaacaaattttcagggtagaagtgaatatgttgctccacaaacggatgcagagcaggttctggcttctatctggcaaaccgtactgggtaagaagccaattggcttgctagaaaatttcttcgatttgggcggcgattcgatcaaggcgattcaagtatcttcacgtctgcttcaggcaggctacaagctggatatgaagacattgtttaagcatccgagtgtgtcagaattggctccgtacttgagtgtggcgggtgtcagaactgccgagcagggtgagattaagggcaatgtgctgcttacgccgattcaacattggtttgcagatttggatgaaacggctgcacatcactttaatcaggctgttatgctacaccaggaccagagatttaacgagtcggcactgcgcctgacactgacaaaactggtggaacatcatgatattctgcgaacggtgttccgcaaaacggagcatagctatgaagcgtggaatcgggggacgcaagaaggtgagctatatcatcttgatatgttggacttcgacgatatacccattggatcggagctgaaccaagcaattgaagctaaagccaatgagattcaaagcagtatttctttaaatgaagggccactaatgaaagtcggtttgttccgttgtgcggatggtgaccatttgctgatcgtgattcatcatttggtagtggatggggtatcgtggcgtatcttgtttgaagatttcgcgactgcttatgcgcaagctgtgaatggagaagcaattcatttgcctgataagacggactccttccgtgcctggtctgaaaaattggctgtttatgcaatcagcccggcaatggagagcgaacgcgcgtactgggagcaattagacaaagtaatcagttctgatcaggctatattacctgaggattataagcatgatggcagatttatgattcgcgacatggacaccgtaacaatgcaactcacagaggaagagaccgttcaactgttgaaacaagcgcatcatgcatatagcacggaagtgaacgatttgctgttgactgctcttggtatgacgctgtatgcctggacgggccatgagagtatctttataaatctggaagggcacggacgggagagcattataccagacattgatatttctcgtacggttggttggtttacaagtcaatatccggttttgttgaatattggagagaaatccgacgtgtcgagacgtatcaaacaggtcaaagagggtctacgtcaaatacctcataaaggcatcggatacagtatttggagatatctgagtaaaacaggtcaaaaagggggccatcctgaaccacaggtgaactttaactatctgggagagtttgatcaggatctccaaaatagcgatattcacacttcaccctattcgtctggaagagatttcagcgaccgaattgagctgaaatctgctttagacgtggggggaatggtaacaggtggcaggttggagcttaagattaaatataatagcaaggcattctgcaaggatacgatagaggatctggttcatctgttaaagaagaatttacaggaagtgatcaggcattgcatatctcgagaacggacggagctaacacctagcgacgtactgcttaaggaactcaccgtggagcaattggatgccattgtggaacaaacgcagtcggttggagaagtagagaatatatatgcactaacaccgatgcagaaggggatgttgttttacaatttgatggattctcaatcgggtgcttattttgagcagtcctcctttgacctgaaaggatgtttaaatctggctgcgtttacagcgagtctggaactgctggtacagcggcattctgtactacggacaaatttttatagcggctggaaggacgagcccctgcaggttgtgtaccggaataaacgcagtgagttgtatatagaggatttgcgagatatggaggaagaagagcggaacgattatatcctcgaatatacgcgcaaagacaagcagagaggctttgatctagcggaggatactttgatgcgtgtcgcgattttgcgtacggctgagaaaacatatcgttttgtatggagctttcaccatattttaatggatggctggtgcttgtcgctggtgactaatgaggtatttgcgagttactttgcgattctcgcccataaacagccggaactgggacctgtaacgccatatagccaatatattgagtggctggagcaacaggatcgtcaggctgcttcaaactattggagcaggtatctggatggatatgaggagcagtctcgtttgccacaggccaaaatccagagcaaaacaggttatcagacgaagcgcctggactttgatttgggcgcgggtctaacggctggaattcagcaaatcgccaagcgttatcaggtgacgatgaatacgctgatgcagacggtgtggggcatgttgcttcaaaaatataacggtacggatgatgtggtgttcggcagcgtcgtatccggacgtccggcggagattccaaatgtggagcatatcatcggtctgtttattaacacgattcctgtacgcattcacagtcataaggacagtctgttctcggacgtgatgaagcagaatcaggagcaatccatcgcttcccaagcctatgatacgtacccgctgtatgagattcagggactgtcggagctgaagcaggatttgatcaaccatatccttatttttaaaaattacccgatggaggagcaaatcgagcagttgggtgagggggaagcatccagcttccgcattacgggagtggagtccgtcgagcagacgaactatgactttaacctggtggtcctgccggggaacacgatccacatgagctttgtctacaatgcgctggcatttgaacgcgaaagtgtggagcaaattcagggtcatctgatggaactgttgaaacaggtggtagctaacccggatatttcggtacgtgagctggatgtattgagtgagccagaacgggagcaaatcctgcgcgtatggggagatacggcagcggactatccaagcgagcagacgattcacggcttgttcgaggcgcaagcggcgcagaccccggagcaggcagcattgttct

SEQ ID NO: 51 - DNA, 96023 bp, Unknown
  Kingdom: Bacteria, Phylum: Firmicutes, Class: Bacilli, Order: Bacillales, Family: Paenibacillaceae, Genus: Paenibacillus
ttcaagcaagaactagagcaatacattaattactacaatcacaagcgcatcaagtcaaaattaaaaggtatgagcccggtacaataccgagctcatgcccaactggttgcataaaaatagttgtctaactttaaggggtcacttcatacatggctgcttttttctaataggaatcttacgtttccagtttctttaatatagattttaacttgtcacttaaatgctgtggatagaattgcaaaggaacatatggacgttgtgctgctttcaacgctttatacacgtcaatttgaccatacccgaaatatttgtcatgccctggtgtgcccaagtcaattacgctgcttctcattaattccattacctctttgttggtcagatcggggttaatggatcgaatcagtgcagcaagcgctgatacatggggactggccatggaagtgcctgacagtgcagcatattgatttcctgggtacgtactggcgatacttgcacctggagccatgacgtctacataatctccatagttagaaaaggatgcacggtgcatagaagaatctgtagcggaaacggcaaatacttctggatacgctgctggatagccaggtcgttccgtattgtcattacctgtagctgcaactaatacgacatctttatcataggcgtatttgatcgcatcatgcaaaaattcagcttgtgcgtaattgcccagactcaaattgatgaccttggccccatgatcagctgcccatataataccttctgcaaccgagtaagtcgtaccggagccagattggtcaagaaccttaatcggcatgactttgttgtaccatgtcatgccagcgaccccctcaccattattcacgagggcagaaatgatgccagcgacgtgcgttccgtgaccgacgtcatcataaggtttttcagacgggtttaccacgttatgacctgaaaggatttgaccttttaggtcagggtgatccaaatctactcccgtatctatgacagcaacaattacgtccttgctgcctttgcttaatttccaaccccggttggtttccgtagccggcagattccattgatagcgggaaaagagcagatcattggggatagagctgtccgcttggataggtgttttctcattggttagatacatatagtgaggctcagtataaagcggattccactttctcgaaaaatattcctttagctccttgaagttcatcttatccgaatgaaatacataggtataaccaagcttgcggcctggcgcacagtgtaaatctgctgcaatttcctgcagttgtcgggaatcaggattatgacggaagcgaacgacaatttcgttttcgaaataatggcttgcattttcgttgtcgtggcccgtcttgacagtaatatcgtgcaatgtgtcgggatgtacggattcgattttgtagctgccttcttttggatagggaatcaaacgcaaattcttctgctgatgcttctccacgtctcgcaatacttgctgactgactagggcagcaacgccacatgttccgtcagccgatggttctgccatgacaaaatatttaccgccttcagcctgaaatgcagcagattcgtaggatttattttgcatgacggaacgacgagccgcggccaagctgcttttaatttggggatgactcagcagacgagtttgtgatttactgcccgtatatgtgttcgtgttcccgtcgcgtgtgtgaatccactgtaacgtatgaagatgactgtgtgattgctgaagcgtgcgggtaaactgccttttctgatcagcagttttaccatcaagctcccgcatcacgtattgaatatcctgccttgcatccatgcgtgtgagggtatccgtagcggacaggtccaaagccaacattccttttttgagctgcttctcttgctgtggcaccatcttggccgtatattccggctgcggtgtatggcggtgatcacgggaaggcagcatcagtgtgatgagaagcaccccggcagctgctccgagcaggggttttaaccattttcgccgagacatgggaccgtcctccttgagtattcataaatttatggtttagcgtgaggaggttggcatgtttttatacctttcaatgctcatttgtggtaggataaatactgaaaattacagctctttcggttagaagggactattttcgggtaatcaaattgatgaacaagcaacaaataagggggagctgccttgatgtcagcagtcaacgtacaaaaattatgtgagtcggcgcaggagagactgaaaactgccgtgaaacgggtggaaacattcctcaatgagcatgctctgccacaacttgctgcagatggcaatgaggagtccgtgcttttttacaaaggccttttgtcggatctccgtcatgtccttgttttttccgaagtatcttatgaaaagctgggtgtggctttacgccgtgccaattttgacgtcgattttgcggaaaaggcattgtataacgtttaccatgactgcgtgaacagctttttttatcccaaaaatgaatcttacgcagaggatggacgctatgcgtatacaggacaagatgctattcgtttccgtaaaacgccagtgccagccgctcgcgaagtgatcatggacattacgaaaaattttgaagaattgcgtgatgatctgacttattatgaaagtgactatttgactcagcgccggatgcagactcgacgtactcatgcctaaagcattcaacggggaagatcatttctaatcaaaaactaaaacaagacaagcaagccgttttctacttgcttcctgccattttggaggaggtgaaggaagcggcttttttcgtatgtcaccaactgccatataccatgaacgcataggtgcagggggacggggggacaatgaatccgaggtgatgatcatgagccaagaggccaagccaatcgttaagtgtagcgtagccaattgccattattggggagaaaacaacttttgcaaggcggatttgatcatgattgaagttgatggtcatgccggtaagaaatttaaagaagaatatgcgggagaaagcttcagttcagaagaacgtgataaggctgccacgtcagccgcaacctgttgccacacttttaagccgaagtccgtgtaaattttattacgcgattcatttcgcatttggaggtgcagtttattatggaagatcatgaaaatgacaagcatcagagtaaagagcatgttagccgcgaacgtgtagattacccccgtcacattcatgaacgatctgccaagcgccgtaatgatcgtgaggaatatgcagcagaggttgctcccggctcagctgtgactcgacatgaggttaagggtcaagagcaggttataaacaatagtggtcgtatttctggctatattgggctagctgcaggaattgcctcattgtttatgtggtcaattgtgctggggcctattgctgcagttttaggtttttttgcttatgtgaatggcagcaaaacgaccggcatttggtcgattggtctgggggcgctagcgacattgagttattttgcttttatcccgttcgttcgttgaccctactggagaacaagctcagttttcttttgtatatccgagaaaaatcatcttagtgatataattacattaaagctgatctataaagctccgctgtcttttcgacagaaacggagctttttttcattaaaaggtatggaagtacatagtaaaaagttgtatcatagcagtaatgacaagctatttgggatataacaactatagaaagttgggaacaccacatgcaaattgatccgcgcgtgtccaagtccatgttagacatgcagctgttaaataatatgagtgctacaacccagacgggtacaacggacgctttttccggattactggaacaagtaggtcagttggaaacagatggtgctgtgacacgagaaaattcaagtgatgttaccagagacgaaaacggtttgctatggcttcaattgggaccttcgagggggacggcttcgtcattgtaccccgctccttccagcacagcaacagacggacccacaacacctacagcatatgatgatttgattaacgaggctagccagaaatacggcgttccagtagcgttgattaaagcggttattgatacggaatcttcatttaatccgtcggtgacctcttcggctggagccaaagggcttatgcagcttatggatgctacggctcaaggcctgggagtcagcgacccatatgatcctgttcaaaatattgatgccggtgttcgttatttgtcctaccagattaaacgatttaacggacaagaaaatatggcgctggctgcatataatgcaggtcccggacgggtgcagcggcttggtgtaaatagtgatgaacagttaatggctgtactggaaaagcttccggtggaaacgcaaagatatattaccaaaattcaaaatgcacgtgaaaaatatacgatctaagccctatagcttacaacgaaaaaagtgcgtaatttcaattagattaggtccgcagacaggatcaatatggggaaagggtgtcgctataatgtagcggcctttccctgttttggtctttttttgttgcagcagttatagagcggaaaaggggagtgcaatgaaatattttgattatgccgcgacaactccgccttttgaagaggtgattacaacagttgccgaggttatgagacgccactacggaaatccatcctcgatgcatcgatatggagaggatgcggataagttgcttaagcgttcgcgcgaagtatgtgctgcggctttggaagtgtatccatcagagattgtcttcacatctggggcaacggaaagcaacaatcttgctatcaagggagcagctttgcagtatcagaccagaggcaagcatattgttactgtatcgacagagcacccgtctgtgtatgaagcctgcagacaactgacaaatctgggctttgaggttacatttttacctgtcgatgcagaagggcatgtgagcgccgaacaggtttgtgccgctgtccgtaaagatacgattttagtcagtatcatgcatgtcaataatgagacgggaagggtgcaaccgttgcatgatatcggagttgcgctgaagaaacagttccctcgcgttctatttcatattgacggtgtacaggggtttggaaagctaccggttgatatccggggatggcaggctgatctgtacagtctctctgcgcataagttgcgtggacccaaaggtgctggactactattcgttcgggaaggtgtagagcttttcccactgcatagtggcggctctcaggagcagggttttcgtgcaggtacggaaaatgtaccgctgcttgtcggtatgtctaaggcgatacggttggcgggcgaacggcgagtagaggcagcacgccgtatgaccgagtggagagaacgggtggtcgcagaagtgaagacactccctcaactgcggctgaacagcggggaagaagcgccgcatattgtccacttttcatatccgggcatgaaagccgaggtaatgctgcatacgctggagcaactgggtgtggtagtatccaccaaatcggcttgctcttcgaaattggctgaacccagtcgggtgctgctggcgatgggatgcaatgaggcggaagcgtctggcggcattcgtatcagctttggtgatgaacatacggaacaggatatcgatgagcttatacttgcactgcgacaggctgtggccaagctggaatcccttgaaaggtggaaacgttaaaatgcactatgatatgctgttacttcgcttcggtgaatttacattaaaagggaagaatcggactcgttttgaaaaggcagtactgaatcacgtgaagctgctgcttaaaccctttcccggtgcttctttgcggaaggaatttggacgaatttatgtggttcttggaggagagccttatgaacagatcattcaggtgttacaaaaagtgtttggcatcacgacaataagtcctgtcaaaatggctcctgtcgagctgggtgctatcattgagaccgctgtagctttgatgcgtgagctgaatgtgaccgagggaacgacgtttaaggtaaatgcccgcagagtatggaaggagtttgctcattcctcacaagagatgaatcatttaattggttctcctatattgcgagagtttcaagcgttgagggtcgatgtacatcaaccagatattgagttacgtgtggaggttagagagcaggcggcctatatattcagcgatgttattatggctgtagggggctttccgttaggaacgaacggtaaagctatgctgctgctgtctggtggaattgacagcccggtagcaggatggtcttccatgcgtagaggattggaaatcgaatgtgtacatttttatagctatccatttacaagtgaacgtgcgaaagaaaaggttattgatttggcaagggtattagcaggctatgcgggtcggatcaaaatccaccttgtaccgtttacagaggtgcagacggcctttacgcgcactggacaggataatctgattattacgctaatgagacggtctatgctgcgaattgcaacgatgctggctgagcgtgaaggagcactggcactcgtgacaggcgacagtctggggcaagtcgctagtcaaacgttatccagcatgaatgtgattggccgctcgacagaattaccattgctgcgacctctcgtaatgatggataaacaggagatcacggaaatcgcaaagcagattggcacctacgatctatcgatactcccctatgaggattgctgcacattgtttgttcctaaatccccaacgaccaatccaaatttgtgggttgttcaaaagattgaagcctctattcgggatttaaatgtgttgattgaacaggctgtggctacaacagagacgcttgtcctggaggcaggcggagctatagaggggcgcaaagaggaagttatacaggaagattggttttaaacaaaaaggcagacccgccagctattttgggtctgcctttttattttaattaaaacagtttttgaatcattttagacggctttttctcgactggacactgctctgcgattttgaagatatcctgtgagcaaaatacctgccatgactgcggtaataaacaagatacgcagcgcagggtgctcagtaaagtagggttccagcttacgttcttcagtaatcatattagaggctgtataaccaagcacagccgatcctaaataaataatccaagggaatttattgatcaacttgataaaaagagtgcttccccatacaacgatcggtacgctgattaatagtcctagcactacaaggagcaaatgctgctgggccgcgccagcaacagcaatcacgttgtccagacccatagccgcatcggcaacaacaatcgtgcggatagcaccccataacgttgttcccgctttgacttcggtatggtcctcctggtctacgagcaacttatacgcgatccagactaacatgacacccccgatgagtaacaaccatggtacttgaagcagccagagtaccacaatggtggctgctatgcgaatgagcagggcaccaccggtaccgtacagtatcgcttttttttgcgttgcaggaggcagctttctggcggcaagtccaattacaatcgcattatctcctgcgagcagaaggtcaataaatatcacattaagcagtagccaaaagaactgaagtccggacatatcaatcgttctcatctccctgattaaacatcctaaaatcattgtatgttgtttattttaatacccgtttttcggaaatacgattcattatattgctgtttgttattgatttcaaggtctttgctcaacaaatttgacatcaatttttaataaatgatgacttatttgtcaaggcttataagcatagcctcgtcctatttcgcatacaagtaggatgggggtgtttgtacacatggagcatatcattttgctgttgaaaatattaatgattaatttggtgttaagcggtgataatgcagttgttatagccatggcgagcaaaaacttgcctgcaaggcagcggagtcaagctatatggtggggggcagtcggtgcagtcctcctgcgctgtgttttgacttttgtagctgtcattttgctgggcataccctttattcaggcggcaggcggtctacttctgttatggattgcgtttaagctgctttatgagaatgaggatcatgtgggagtaagagcagaaacaaccatatggaaggctatacaggtgattctggtagcggactttgtgatgagtctagataacgtgttagctattgcagccctagcagatggggatatcgccattattgtcattgggattgcgattagtattccgattgtcgtctggggcagcaacgtgattgcgatctggcttcatcggttccctgtacttgttttgctcggatctgcaatcctggcttttacggcaggagaaatgctactgcgtgatccccgattgggtgtatggttagcaggtacgggagagcttatacatgcatggttaccgggactcttggcaacagcagttgtcgttgcaggtatatatcgtcagttacgagctcgccatatttgaacgtagtttttttggaaaacatcggctaaaatagacatagagtttttgcgaatgccaggtttactcggtttttgtgaagactctatactcacaaaaatatacttaaaaacaatcacattaagagacctaaaaacaaattcagcaaacaaaggagaccacgatgaattccggaaaagagcgtatgatcggagtgggcattgttgccgtaggactgattattttgttggggaaactgggagcgttctcctttttgggacgaaacttttggcctttgctgtttttaatacctggaatcgtactgcatgcaatgtacatgaagcgtaaagtttcaccctttatgttgctgccggcagggattttgtcggtttatggcttcttatttttgctctgcaatatttggggctggcatttaatggcctatttatggcctttgttacttctaggtgtggcgattggattatgggagtacgccattaatgatatttcgctttctcgcaatgtatatacagggggcgtaatattgggcttggtatcggtgcttttattggttattacctccctaagaacgggtatcatatatgttattgcagttttaatgattggcgctggaatctggttggtcctaaacaaccgtggcaaacgcaaaaggtaaaacgacaagctgtgagattttatggcggtaaattacggaacgggcaataatgtcttgctttatgacatatttcaactataatataatggatatgataagagcgtcggaatgatttctgacgcttattttaaggttttcacgcgaatcggagagagaagctgtctgtacaaagcctgaaacatatagaaggctggcagggagtgggcctaaagaacgattgttagccttgaatcagcactgcttcaggatagagacactattttgatatacggaaaggatatggatacaaaccatgcatgctagagaaaacattcgcaatattgcgattattgcccacgtcgaccacggaaaaacgacgcttgtcgacaagctgcttcaacagtccggaacatttagagaacacgaggctgttcaggagcgcgccatggactccaacgatctggagcgtgaacgcggtattacgattttggctaaaaatacagctatcacttacaaagattatctgattaacattgtagatacaccgggacacgccgactttggtggcgaagtggaacggattatgaaaatggttgacggtgttttgctcgtcgttgatgcttacgaaggttgcatgccgcaaacgaaattcgtactgcgtaaagcgctggagcaaaatctgacgccaatcgttgtagtaaacaaaattgaccgtccggcagctcgtccggcagaagttattgacgaagtactggatctgttcatcgagctgggggcgaatgacgagcaattggaattccctgttgtgtacgcttcggcgctgaacggtacatccagcatggatgctgaaaagcaagacgataacatgcaagcattgtacgaaacagttgtagagcacattccggctccaactgagaaagtagatgagcctcttcaattcctcgtaacactgatggactataacgaataccttggccgaattgcagtaggtcgtgtaaaccgcggtatcatcaagcaggggcaagcagtcacagttatgcagcgtgatggtagcagtaaatcagcgcgtattgagaagctgtttggcttccaaggtctgaaacgtattgaaactgaccaagcgggcgctggtgacattgtggcgattgcgggaattaaagatatcaacatcggtgaaaccattgctgatccaaatcatcctgaagcattgcctgtactgaagattgatgaaccaacactgcaaatgaccttcctggttaacaacagcccattcgcaggtcgcgatggtaagtgggtaacatcccgtaaattgcgtgagcgtcttctgaaagaactcgaaacggatgtcagcttacgtgttgatgaaacagatagcccagacgcctttattgtatccggacgtggtgagttgcatctaggtatcctgattgaaaacatgcgtcgtgaaggttacgaactgcaagtgtccaagccggaagttatcgtcaaggaaattgacggtaagaaaatggagccaatcgaacgtctccttattgatattccggaagaaagcatgggtgcggttatggaaagtttgggctcccgtaaagccgaaatggttaacatgattaataacggcaccggacaggttcgcttggaattcttgatccctgcacgtggtctaatcggctacactacaaacttcctgactttgactcgtggttatggcgtaatgaaccatgcgtttgacagctatggaccatttgttggcggtcaagtaggtggacgtcatcagggtgtacttgtgtcaacggaaaacggcagctctacattttatggtatgctgggcgtggaagatcgcggtattttgttcctggagccaggtactgaaatctatgagggtatgatcgttggggagcacacacgtgataacgacattgtcgttaacatttgtaaagaaaaacaactgacaaacgttcgttcagcaacaaaagacgatacagttaaactgaaaacacctgttattttctctttggagcaggcgctcgaatatctgaatgatgatgagtattgcgaaattacacctaacgctatccgtttgcgtaaaaagatcttgaacaaaggtgaacgcgagcgtgcggagaaacaacgtaaaacagcacaagcaaatatgtaattgattggattggtctttggccacagcggcgacgcccgggaacgggatgcgccgctgtgtgtgttttaggattgtaaacttggagaaagctatatttctcaaaacgcaggaaaaggtgttgaagcatgagtaatctttcgaacggattgcctccccggacacaaagcgggaaaaagtccgccaaaccgaaaaaaacgaaaaagaaaaaaagctttttcagatcgtttatgaagtttgtcttgtttctgcttattataggtattttggcagcaggtggttatacctactatctttacaatcaggtagaagaagttttggatacggggatcaacaaggaagtacccaaaacacaattggcagaagctaagcctttgactatcttattgctaggaaccgattaccgccctgatcatccgacttatttgtccgacgttattatggtagctacattgaaccccaacactaaatcgtctaccatcgtgtccttaccgcgcgatacgcgtctagaaatggatggatataaacctcgcaagttgaatgagtattatccggtgtttaaggctagagagaaagaatctggcgaagttgctgaagaacaaatgaagaagatgattggcaaatatttaaacattgatattgattatgtgacggttattaacttccagggctttagagatgtagtagataatttgggtggcgtagatgtgacggttgataaaaacatgtgttatcgtgaccgtgcagatggtaccgatattaacctgacagttggagccaagcatttgaacggtgatcaggctcttgattttgttcgctaccgcaaatcgaattgtcgtccgagaacagctgaatctgacgattttgatcgtaatcgtcgacaaaatcaggtgcttcattccctaattgaccaaatgcaatcctttaacgctttgaccaagtttagtgcaattattaaatcggttgataagaatatgatgacagatatcgagtcacagcaaatgaaaaatatcgtacaaacctattggaatatttccaagcaaaatgtgaaatacaatccggtagcaggaacgtggcgtagcccgtatgtgtacattgatgagcaacagctcgatttggccaagcaagcgctacaagaggaattagctaaaaaagcaagcgacaataccgcagcttcttccaattcctgagtatgtatctttcttcctacttatgttatactcgcagcgagtaaagctcttatataacataagggggttgaggtatgtctaaagttatagtgaaccaagtctaggtccagtgagcaatcactgggccttttgtgtctaatttcaaaaatggacaggctcagaggctatcttcacttacaacttttcgttgttttatgctgctttggggttcttttttcagggaatcagcaagtattaggtacccggtgaataggtataggtatgaaacacgagattgtccacgccgctttggaggggatttaatgaagaaaatttttgtgctggatacgaatgtgctgctgcatgatccgaaagccatatttaccttcaaagaacatgaagttgttattccagctgtagttctggaagaaatcgactccaaaaaacgcaacgcggatgagattggacggaatgcccgcaatgtatcgcgattgttggacgggttgagagaagtgggtcatctgcatagtggcgttccacttccccaaggtggaaggcttaaggttgagttaaaccaccgaagttttttgaaagttcaggagatgttcggggaggtttcgaacgataaccggattttggcggtcgccttgaattatcatctggaagagcaggagcagcctgaaccacgttcggtcgttttggtcagtaaagatgtgctggtcaggatcaaggcagatgtattgggactgctgaccgaagactacctatccgatagaacaggcgatctaagtgagctatatcccggatactcggcaatacaggtgcacccgtccatcatagatgaattttactctaaccgttttttaccaatcaaaccactggaactaccttatacgctgtatccacatgaatttgtcattctgaaagatgaaatgggaactggaaaatcagctttgctgaaagtaaatcaggaggcagagcgattagagccgctgtacttaagtaacgaatcggtgtggggaatcagcgcacgtaatgctcaacagcggatggcattggagcttttgcttaatgacgatatccccctcgtgaccattacaggaaaagcgggtacgggcaaaacgctgctggcgctggcggcaggcttgcttaaggtagaggatgaacatcgcttcaagaaactgctgattgctcggcctgttgttcctatgggtaaggatattggttatttaccgggagaaaaggatgaaaaacttcgcccgtggatgcaaccaatctacgacaatctagagtatctgtttgatgccaaaaaatcaggtgatatcgacaaaattttgatgggcttgggcagtattcaggtggaggcacttacttatattcgcgggcgttcgatacctgggcaatttattatagtcgatgaggcgcaaaacttatcccgacatgagatcaaaacgattgtgtcccgggtgggtgaggggagcaagatcattttgatgggagatccggagcagattgatcacccttatctggatgcagccagtaacggtctaacctatgtggtggagcggtttaagcaagaagggattagtgggcatatcatgttggaaaaaggagaacgctccaagcttgcgcagttggcagccgatctgctataaaattcctatcgttatgacaataataaagacctcgggaatatcccggggtctcttgtttgtacacgtaaaaattcagaacaatgaaagtgagcaaaagcttatttaaagtttaattcgagcttaacttcaagcattcctgctaaagtgcgtacttctgtggctttgacataggaaataagctgctgtgggtagaaacctagatcaaaatctttttccagcttgttgcgggtcgtatcaggtagttccagaccattaaataccaatcgatctacatgaaataaaattgcatttttcgattcattttctaccgtgtagtgaccttctactcttaatttcatcgttccctgctgaccttctaccataattcgatcctgtgcaaatgtaaagttgaagtgattaaacaattcattttctgactttaaaaaacggttaaagtcctcttcgcgaatgcttatcgtaatcacttttccatttgtaaccatagcaccttgttgttgttgaatgaattgcggtaaatcctgcatagcttgagctaatgctttaaagtgcttatttacctcgtagacacctacattctcccaataagctgtcatttcgccaataagcttgcgtagagtatccgggtcattactggcgttaacgccgtcatttacacgcgactgaagcaggataatgcgtttgcgttgtgccagtaagtttgttttgactgtctccaattccattgaggcttgggtgacttgttgttctgtttttcgcatagattgataattggattcgtattcatgaagcacatcctgatcgtgactaattaataataagtagtaatcgtacagagagagaagttgccttatacttttcgcccctagcactacactcaacagcttgtccctttctcccatataatacgatcgcagcacagaacctgcacgcttccgttgtacggtcatttgctcttgctgaacggtgagattacttcgcaattcccgctgacgctgcaaaagagtctgctgctcttgactgattcgctcaatttcatggtctatctctacaatcgacaggctatcttgtaaaatctgattttcttcatgggagggagcggccagagtaggacgtacatatatgaaagttagcatcatgatagtggtcagcagggtgctgattgtgatttttactcgtttattcatttggtttccccttttatgtattcccgaaaaaaactaatggtaatgtatatgatcctttctgtttctttaaccattcattttattgtacagcagtctgagcatgcttgaaacccgaaactgtttacgttcacgtatgagttcttgcagaaatggaaatacaatttagtatcaaatagattctatgaactctacgagaggcataggaatgaataaacagcttttataccctattcaaataccggcaagatcggttcatgaagacggttatttcaggatgttgttaggagggctagaggcatgactgcaataagacaagatgcatggagtgtggaagatgacttgatattggcggaggtgacattgcggcatatccgtgaaggtgggacgcagctctctgcgtttgaggaggttggacaaaaaatcggaagaacctctgcagcatgcggttttcgttggaacagctgcgtgcgcaaacgttatgatgaagcgattagcattgccaaagcacagcgccagaagcgcagttatatccgtaagcagaacccggtaggtgtatcacaggttgcggcttttgcctcgcttgatacagtcgaaggtgggtacagaacggatggtacgagtgaggatacgttatctattgatgcagtaattcgcttcttgcgtcaatggaagggatctgtccaggaaacgaatcggcagattaagatgctggagaaagatttacgggaaaaggaagaagaattgaatcagcttcgctccattaatgaccggctgtccaaagaagtgaatgaggtgcaaaccgactatcgtgttgtgaatgatgattataaagctctgattcagattatggaccgggctcggcgcttggctttaatcactgatgatgaggaagagcttaaatccagattcaaaatggacgccaatgggaatctggagcgcattgagtaacaagattacttctgcaatattgaaataaaacgtcaactagcgctttgctgtagttggcgttttttgtatttctctagagtgcatatgatatagtagaaaaaaagatggaagcgagacgatacaaaggtgattgatattattggagcgggttcgctgggattgttgtttgccgggaggttgtctgcttcaggtacaaaagtaaggctgtggacgcgtacacttgagcaggcacgcatcattgctcgtgaagggattactgtgtttggtaaggagggacagacggcagtacatgtgtccggaaataaattgaaggtagcgccattggcagattggcaacggttaaattcacaggctccggcacgatggataatgcttatgaccaaacagggggcgattgaggaagtattagaacagatccagcctgcagctcaaatggatagagatacaggaattgtctgcttgcagaatggaatcggccatatagaacgcattagaaaggcttggcctaaagctgtaatataccctgctgtgacgactgaaggagccaagaggcagggagtagcatctattatacatgcaggatcgggtgttactgaaataggatgttcggaggaagaggaggagtcgaagaacaataattttaatcaatgtgtgctaaatcgcctggttgcagcaggatttgacgcttgcttgtcgaaagaaatcgagaacggtatgtatcgcaagttgttgatcaatgctgtgatcaatccgctgacggcgttatggcgagttcgtaatggcgagctgctttcggaccctattcgaatacatatgatgcgcaggctgtacgatgaaggcattcaagtgtatgaagctcatggtatccactgggaaaacgcatggtgggagcaaattatgaatgtatgccgggcaacggcagagaatcactcgtccatgctagctgatgtacttgcacagtccatgacggaagttgcttcaattaacggacaactggtgcagatggcagatcgggctggagttactgcaccaactcatgagttattgtggcaattaattgaaggcatgcggctaaaagaggggtgatcagttgagtcttatacaaggtactattatcactttcagtattcttcccttttttccgtttttgatcgtgtttgcggtttgtcgctacattcttaaaatggaaaaaaagaaatcgttacttacttctatggatattaccacgttttttctgatattttccgtcgcagcactctttaacgtcatttttacatctcgattcggtttttatttgattctacttctcctattactggccttgggtttaattggaggagctcaaaatcgaataaaagggaaggttgatggtaaaagattatgtagagcggtctggagactaacttttatggggatgacattggcgtatattttgctgactgtagttggtatatttaagaatatattcaacgccatgtgatataaggtgacatgaaaaggtgaaaaaatatgaattaatcatgtttttttgaaaaaaaagctcaatttgaagaaatgtaatgtagatttttttgaccgctggttgtataatctataaacatataccactttagaactagggggaaaacgctagatgaaaaggaaaagctttttagtccttttgacactcattcttgcagttggcgcactgctcgcaggttgcggcggcaagaacgataccaatggtaagggcgcacaagaaaacacctcgactacgccggctgcggccgacaagcaaattttgcgcattaaccttctttccgaaccgccaaccttcgatccggcacaagctcaggatagtcaaactaacacggttctgaaaactttgtatgaaggtctcgtacgtatgggtcctgacggcaaagaaatccctggcgtagctgaatcttggaaaatttccgatgacggcaaaacctatacgttcaagcttcgtgatactgcaaaatggagtaatggcgacccagtcaaagcaagcgacttcgtatttgcttggcaacgggtattggatccttccacggctcctgcacctccatatgcttaccaattgtactatatcaaaaatgctgagggttacaacctgagcacttcgaaaacttttaaaggcactaaagttacagactttaaagatgtaggtgttaaagctgttgacgatcatacattgcaagtagagctggagcacccaactccttacttcttgggattgacttctttctacactttctatcctgtaaatccttctgttaaaggtaatgataagtgggctgttaagaaagatagcatgatcactaacggaccttacacattaacgacttgggacagcggtcaaaagatcgaagtaaccaagagtgaaaactattggggtaaagatgatatcaagctgaacaaaattacgatgtcccttgtaaatagcggtgcaacagagctggcttcttatagaagtggacaactcgattacgcaggtatgccaaacggtgaaattcctaccgaccaaattccggctgtgaaaaaagaactgccgaatgaatttgaggctaaagggattgctagtacgtattactatttgtttaatgtaacagaaaaaccatttaacaatgttaaaatccgtaaagcgtttgcgatggctattgaacgtcaaccaatcgttgaaagagtaacattgggcggtcaaattcctgcatacggctttgtacctccaggtatcaaaggagtatctcaagaattccgtactgagaataaagatgattacttcaaagaagacttcactgaagcgaaaaaattgcttcaagaaggtatgaaggaagaaggcgtaactacacttcctccggtaacattgctgtataactccagtgagggtcaccaaaagattgctttggcagttgctgatatgtggaagaaaaaccttggcgttgacatcaaaacccaaaaccaagagtggggcgtatttatccaaacacgtaacaagctgaatttccaaatcgctcgtggtggatggtctgctgactataatgatccaatgacattcctggatatgtggacaacaggcaacggcaacaacaatgcaggttatgctaacccggcatatgatgctttgattgaagcagctaagaaagaaactgatccagcaaaacgcatggaagattttgcgaaagcggagaaaattctggttcaagatgatatggtaatgcttccgatctactactactcaaatgtttctttaacaaaaccgaatgtaaaagacattgggcttgactttagtggagcagttgatttcacaagagcgtatattacacagtaactgaagctcgattctgaagtttgatagttacttcgggatatatatgtggatagaaccatatatatcccgttttttttgtgtgtcatggtcttttccatcatcatgtaaccatgcaaataagtagattggacagtccaattctatttcgataaaatcgaatggtgtcgaaaaaaatttatggggggtgtaaacgggcaatgacgcgttatttgatcagtaaatttttctacatgctgctatctttgttcattctgatctctgcgacgttttttctcatgaaagcaattccgggtaaccccttcatgagtgaaaaagcgacttctcctgagattcaagcccggttaatggaacaatatgggctggataagcctgtatatgtccaatattttaaatacttaggtgatattgcttcaggtgattttggtatttctatgaaaaagctgaatcaaagtgtaactgacattatcggacaaacgtttacggtttcccttaaactgggttttgttgccataatcgtgtcgataattgtcggtctcttgctaggtatgctagcagctttgtatcatcgtaggctaatagataacgttgcaatggtattggctatcatggggattgcggttcccagcttcgttctggcatccttgattcaatttttcttcgctcaacagttaggttggtttaatgttatgggctttgacggtccgatggactacgttctgcctgttgcagctctatctgcttcccctattgcgtttatcgctcgactaacgcgttctagcatgctggaagtgcttcatgcggattacattaagactgccaaggctaaaggcttgaaatccattactattatgttcaaacacgttgtgcgtaatgctattctgccggttgttacctatgtgggaccaatgacggccaatattattacgggttcagttgttattgaacgtatcttcgggattggcggtattggtaaggtattcgtagatagtattacgacccgcgattataccatgattatgggagttactattttttacggtattttgctgatggtggcgcgttttattacagatattgcatatggatttattgatccgcggattaagcttactggcgggaaggagggataactttatgtctgttaaagataatgctgtgaacttggataagcttcaggtgaaaccggaagatttccagaaggtcggggcggatgaaaagcagtctgaagttattcagcgcgaaagcttatccgcttggcgagatgcttgggagcgacttcgtaaaaacaaactggctatgacaagcttgagtgttttggttctcattgtgcttgcttcaatcgttggtccgatgctgtccccatacgatgaccgcacgaatgatttgttgagcaccaatcttcctccttcggcggaacattggttcggaacagatgatctggggcgtgatatgtttgtacgtacttggatgggagctcggatttccttgattattggtttggctgctgcaatgattgacttgatgattggagttatttatggtggaattatgggttactttggtggccgcgttgatgaaatcatgaataaattttctgaaatcttgtactccattccttacttgcttgttacgatcctgttgctggttgtgctggagccaagtatcactacaattattattgcgctctgtgtaacggggtggattaacatgtcgtggattgtacgtggtgagatgttacaacttaaaaaccgagaattcgtactcgcttcccgttcaatgggtgcaggtgctggtcgtttgctgttccgtcacttgttgcctaatgcggtaggaccgatcattgtcacactgactttgacagttccaagtgctattttctctgaggcattcctgagcttccttggattaggggtacaggctcctcaggcatcgctgggttcaatgattgaatcagctctgaccgggtggatgtattacccgtggcggatgctttttccagcaggtttgatcagtttgattatgcttgcgttcaacctttttggcgacggcttgcgtgatgcgcttgatccgaagttgaagaaataggaggtgagatcatggtgagtagcaacaatttaattgaggttgaaggtcttaaaaagtattttaatgttggcaaaaaccgtgtgctcaaagcggtggacaacctgaatttctatattcgcgagggtgaaacgctgggtatggttggcgaatccggctgtggtaagtctacagcgggtcgtacgattttgcgcttgtatgaacctacagcaggtagcgtacgttttaacggtacggatatttacaaattatcaccaagtaaaatgaaagcaatgcgccgtgatatgcagatgatctttcaagatccgtatgcatcattgaacccgcgttttaccgtttctgatattattggtgaggcactggatattcacaatatggcgggtagccgtgcagaacgtaagaaacggattgaggagttacttgatctggttggtttgaaccctgaccatgcaacacgctatccgcatgagttttctggtggtcaacgtcaacggatcggtattgcacgtgcactggctgttaatcctaaattcatcatttgtgatgagccgatttcagctcttgacgtatctattcaggctcaggttgtcaacttgttaaaagagcttcaagaacgtttgggtctgacatacctattcattgcgcatgatctgtcgatggtcaagcacatcagtgatcgggtagctgtaatgtatatgggtagaatggttgagcttgcagaaagtgctgagttgtatgcaaatccgatccatccttatacgaaaatgcttttgtcggcgatcccacttcctgatccagaagtagaagccaacaaaaaacggattattatgccaggcgaccaagcaggcccgattcatgatgcatctggcagtaagacaggggcttataacctggaaaatgccacgctcatcgaagtgtctaaaggacattttgtagctgagccttacgcctgatcttgttttatgcaccaaccgccgagttattcggcggttttttttgtaggaagctttgacgtggacatgggctttcggtacaatcaagcagtaaggttttggtggagacaggaggcagacccatgaaaataattccggaaacgcttcgcggagggtcggctttggcagaagattatatacagggtacaggacgcgcaagcgacttgtatgaatataatgtgctgcacgccgatgcttatgcccaacgggcgaagtggctggataaggcggggcatctgcgattaaaccgtaaggatgtcgtagcatgtcttcgtatatacaatgagaaatacaattcgtatgaggcggttcgtgcttcattggaccgtctggaaagtccagatgccttagtagtagctggcgggcaacaaagcggactgttcacaggtccgatgctggtcatttacaaagccgctaccctcattaaggcggcgagagaagcagaggaacggcttggacgtccggttattcccgtcttctggattgctggcgaagatcatgactgggacgaggtcaatcatacatacgtaatggcaaatgacccacaagccgtcaaaatcaagctgaataagcaacctgaacgccgttcttcggttagtgccattaaagttgacgcttttgaatggaagcaagcgatagcggatatagagcaaagcttgccagattcagaacataaggctgatataatgcgcatgattgagaacgggataacggattcatatggactgagtgaagcctttgccaagttgctgggccttttgttcggcacctatggattagtactcttggattcagcagatccttcgctacgcaagctggaagcatccgtttttaagcggctggttcagcacaatgatgagttggagcaggcttatcggacggcagccacacggatcgtagattatggatatcatttacaagccgatgtgcatgaaggtggcgcgaatctcttttatatccatgaagatgaacgcctgttgcttttcaaaaaagctggactattcacggatcgacacggtctggtggcgtttactgtggatgaactgcttgaagagatagatagacatcccgaacgttttagtaacaatgtgctaactcgtcctctaatgcaggattcactgtttccggtgctggcatctgtgctgggtctaggtgagattgcttactgggcgattacacgggatgctttcggggtgttggagatgcagatgccgatactgctgccacgaatgtcttttacgttggtagagccaggtgtggagaagcatatgcttaagtatgaattaagttttggtcaagttagagacggacttgaggaacggaaaaagcaatggattgccactcaagatcagcttggaatgcaggatcagttttccggggctaaggaagcttttgtccgcatgtacaaaccacttgtgcagcagacaggtttgattgaaaaaggtttgctacggctcggagaaaccaaccgcgagaagattctggcacagatcgcctatctggaagcaaaagttcaggaagcgttgcttcggcaaaatgaaacagcacttcgtcagtgggatcgcatcgaatggtcgctttttccatttggacagccgcaggagcgggcgtatacgatctatcattttctaaaccgtcatggtctcagcttgattgatacgattatgaatgtaccattggatctgacaggtacgcatcgtgtgatttatgtatgattgttattttatataggatttatcatgaagcaaatttaaccaatatgaaggaggaaacaaagtatgacttcccattctctacaaaatagcatagttcacgatcttaaattggcccctgaaggtcatttgaaaattgattgggtagaagcccatatgccggtattgaaccgtatacgtcaacaatttgagcaagagcagccttttgctggtctgaaggtaaccatctgtctacatttggaggccaaaacggcttacctggctaaagtggtacaagcaggtggagctcaggtaactattacggggagtaatccattgtctacacaagatgatgtttgcgccgcattagttgaagatggcgttacagtattagctaaatacaatccagacccagaagaattcaagaatttgcaaatcaaggcactggaaacaaagcccgatctcattatagatgatggtggtgacttggttactctgttgcaatccgaacggcctgatctgatttctacgatccgtgggggagcagaggagacaactactggcattattcgtttgaaggctttggaaaaagaagggcaacttcactttccgatggtggctgttaatgatgcttactgcaaatatttgtttgataaccgctatggtacaggacagtcagctttcgacggcattattcgtacgactaatctggttgtagcaggaagtacagtggttgtggtaggttatggctggtgtggcaaaggagttgcaatgcgtgcgaaagggctgggagccaacgttgttgtaaccgaagttgatccgatcaaggcagtagaagcccatatggatggtttccatgtcttgccgatggtagaggctgccaaactgggtgacttctttattacagtaactggaaataaggctgtaattacaggagaacactttgatgtgatgaaggatggagctgtgctgtgtaacgcagggcattttgatgtggaggttagtaagcctgagcttgctaaacgttccgaatccattcgtacggtgcgtcgcaatatcgaggaatatcgctttaaagatggacgtaaaatgtatttgctggcagaaggacgcctcgtgaatctggctgctgctgatggacatcctgcggaaattatggatacgacatttgcgcttcaggcgcttggcttgaaatatgtgaatgatcgttacaatgaactaggcaaagccgttattaatgtaccttatgaaattgatgagcaggtagctcgattcaagcttgatagtctgggaatccaaattgacacgttaactgaagaacaaaagatctatttggacagctggaacgcgtaatcggatttttccatcacgattttcgctgcaaagtgttgcgtgtttaatgcaagtatttgtttaggttgacataatggacagagaataagccctttattccgtgttgtttcgaaacctgatgcatattgtcgggggacggcttcatgggataaagggcttttttgcatcttgtgacgcggggctacaataacagacataatggtatggatccggcttctatcactttttggtaatgaaaaagaggtctttgattttttaaagcgaatctattatgcttaggtggtggaaagtgggccaaagtgggagaatagggtaaggggtgacgaaaccaatgtttatgggggagttccaacatagcattgatgagaagggccggcttactgtaccggccaagtttcgtgaacttctcggtgcctcgttcgtggttacccgcgggttggaccaatgcctcttcgtgtatcccatggatgagtgggctgtcatggagaaaaaacttaaagcactgcctctgatgaaggccgatgcgcgggcgtttacccgtttttttttctcgggggcgactgaatgcgaattggacaaacagggcagggtaaatttaccggggaatttgtgcgaatacgccaagctcactaaagagtgcgtcgtattgggagtgtccacccgtgtagagatttggagcaagcacacttgggagcaatatttcaaccaatcagaagaagcatttaacgacattgctgagaaattggttgatttcaactttgaattgtaatttaggaggtcagccgtttgtttcaccacattaccgtactcaaagaagaagcaacacaggcactaaacatcaggcaggacgggatttatgtggactgcacgttgggaggggcaggacacagttccgtcattgcatcacagcttggccctgagggaaggctcattgcctttgatcaggacgactgggcattgaacaatgcgcgagagaagctgtcagcctatgaaggcaagatttcattagtgaaatccaactttcgccacttgcaggacaagctgaccgaattgggattgcccgagaaagacggcgtcccgcaggtccagggtattttgttcgatctgggtgtgtcctcgccccagttcgatgagggggaacggggatttagctacaatcatgatgcgccgcttgatatgcggatggatcagagtagctcgcttacggcttacgaaattgtcaatgaatggtcggaagcagagattgcgcgtattttgtttcattacggagaagagaagttttcacggcggatcgcaaagatcatgattgaacgtcgattgaacaagcctattcacacaacaggggaacttgtcgatattatcaaagaaggaattccggctgcggcacgcagaaccgggggacatccggctaaacgcagtttccaggctttgcggattgctgtgaatgatgagttgggtgcactggaagatactttgcatcaggcagtaagatgtctggctccaggaggcagaatttcggttattacattccattctctggaggatcggatatgcaagcatattttcaaggagtatttggcgaaaagcatctatccatctgatttgcctattttggaggacaaaatggaaggcgatctgaagctggtgaaccgtaagccaattgtggcgtcggagcaggaattggagcttaatccacggtcccggtcagcgaagctgagagttgccgaaaaattgtaaatttaatggagaaggagaggcgacatggcttatacacgcggtaatttggctgtaaaagaaaaagcccgtcaggaacaggttcagcaacaacggtatcgcgagaccactaaagtcgttacacgccgcagagagctgccgattcgagaaaagctgctgtatctattgacacttgtagcgtgcattgtcattgctggtatgttgattagcaggtacgctcacatttatcaaatcaattattcgattaatacggcaagcaaggacattaccaaattacagaccaatatcgcccaactgaagatgcaaaaggagcgtctggaaaatcagatcgtgccgactgcaaagcaacagggatatatcgaaccaacaagagagcccattcgtgtggaaaagcaggctgccaaatagttaagggcatagcatcaagctatgctctgatgtacatttttttgcagagaggtttgagctatggtcaaaagaataaagcttcgcacactgctaatagggggatgtattaccctcttttttcttgttctgctacttaaggtattttggattcaagttgtgagcggggagtactggcataacctggtagttaatcaagtagaaagagatcaggtgattcagcccaagcgtggaaccattacggaccgtaaaggaaacgtattggctacggatgcaccggcttatacggtagttgtcaatcctagcatcattcaggagtatgatttggagaatgaggttgtagttaagctgcaccagttactcaaaacgcctgaggatgagcttagaggacatctttctgcaaaggataaaaaggggaactacttaaaaaatcgcgagattcgtaatgggggctggaaggtagaccctgagatcaaggcgcaagtggatacgttcaaagagtatttgaaggataagtatgaagtaattggagctgtggacaccgttcaagaatccaaacgctattatccggaaaataagctggcttcccatgttcttggctatcaaagaaaagatggcacagcaggtatggggttggaagcttattataataaagagctctcggggacggctggaaagcttctgtatcagcgggatcggaaaggagttcctcttcaaggatcggaaagtgtctatgagccggcacaaaatggtaaaaatttaaagctgacgattgacgatacgattcagtattatatagaggatgccatgcaggaagctattgcaaaatacaacccgaaaacgatgactgtagtagctgctgatccccagacgatggatgttcttggtatggcaacttatccgaattttaatcccaatacatatgggagtacacccttggaatatttccgtaataatgctactcaatctatctacgagcctggctccacgtttaagattgtaaccttggcagctgcggttcaagaaaaggtgttcaatccaaatgaatcttaccaatctggtatgattcgggtcggaggctgggatattcgtgatgtaagccgcaactggggaacgttaacctatctgcagggagtcaagcgctcaagtaatgttggtttcgtccatctgggtttggataagttgggtggcgagagactgaagaaatatattaataactttggattcggcgtgaaaacgggcattgatcttccaagtgagtctaccggagctattacgttccatacccagtacaaatccgaggtcgcaaccgcttcatatggacacggacgtgttcaggtgacgccaatccagcaggtagctgccatctcggcaattgctaacggggggaagctgatgcagcctcatctggtgaaggaaatcatcaacccagatacaggcgaagttcagacgattcaaccgaaggaagtccgccaagtgattactcgggaatcggcagtccagacaagcagctatctagagcaggtcgtatctgaccaagaaattggtacgggacgccttgcttatattgacggatatcgtgtagctggtaaaacaggtacagcgacgaaggtcgtcggaaaagtatatgaccattcgaaggatgtcgtgtcctttataggttttgcaccggtaaatgatccgaaaatagctgttttggttgttatggacgaacccaacaaatcagtaggcggcggtacagcagcagcgcctgtatttaaaaaaatcgtatcccaatcgctgctatatatgggagttcccaaaacgggaaccaaaacgaataaatcaggtgccgctgttgtaaaaacagtgaatttgccaacgataccaacattaactggtcaggtgaagaaggatgcgcaaaatgcattgctcaaacagggaattgcctatgaaacggtaggcaaaggctccaaaattgttcgccagtatcctgaagcaggcgtcaaaatgaaacccggacaacgcatttacttgctgactgaggatagtgccaacatgactattcctgattttacaggtgtttcgttgcgtgacacacttcaagttctgacccttatgaaggttggtgtgcaggtaagcggcgaaggttatgttgtctctcaaaaggcgcaaatggtaaatggaaagcggattgtcagcgtgacgcttcagccggccaaagaaacggtgaccggagtgaaaccggaggtcgatactaaaactgattccagtactactgctgatgctggaacagactcgggagctcctaagggaggaatatctgctgttgcagatgaggaaaatgctgctgcgattaaaggcgaggataactgatagcttgttctaatgtccgttcttttgaatattcatgaggtaagacatgtcatgagtatttgaggaacggagggagcgcgtttgaaaaaatctaacgtgaccatgcggcggaggctggtatgggggctaatgggattatttgtactgtttgcggccttgtcgatccggctcgcctatgttcaattgggtaaaggaggcgagctctcggccaaggctgaggattcgtggcgccgcaatattccatttgccgccaagcgtggcgaaattttggatcggcagggtacggcgctgacctataatgtcagttcgccgacagtcatggcgataccagtacaaattaagaagccggaagaaacggcacgcaggctggcacccttactggatatgagtgaggataaagtgctcaagctgattaccaaacgaacagcaagccaaaaacttcagcccggcggacgaaaaattacgatggagaaagcgcagcaaattcgtgatttgaagctgccgggtatcgttgttgctgaagacaacaaacgttattatccttatggtgatctagcggctcatattcttgggtttacaggaattgataatcaagggctgacaggcgtagagaagcagcaaaacagtaagcttcggggaatcgacggaagcattgcgtatttatcggatgcaggtggtcgtctaatgcctggttcttctgaaaaatacattgaaccgaaggatggactgaatttacaattaaccattgataagtctgtgcagtccattatggaacgggagcttgaccaagccatggtcaaatttcaggcgaagtccgcattgtctatagctatgaaccctaagacgggtgaaatattaggcatggctggacgaccaagctatgagccagcgcaatacaagcaatatgcgcctgaaatctataatcgaaatctgcctatctggatgacatatgaacctgggtctactttcaaaattattacattggctgctgccttggaagaaaagaaggttaatctcaaaaatgaccgtttttttgatccgggatatattgaagtcggtggagcacgcctgcgttgctggaagaaaggcggacatggaagccaaactttccttcaagtggtggagaattcttgcaaccctggttttgtaacattggggcagcgattaggtaaagaaacactgttcaaatacattcgcaattttggcttcggcagcaaaacggggatcgacatgattggtgagggcaacggtattttgttcaaactacctcaggtcggtcctgtagagctggcgacaaccgcttttggtcaaggggtgtctgttactccgatccagcaggttacggctgtatcagcggcaatcaatggcggtaatctttataagcctcacattacaaaaggttgggttcagccgggaaccggaaaagtgctggaaaaagtagagccagaactggtacgtagggttatttcagaggaaacctccctacaggtaagggaagcgctggaaagcgtcgttgctaaaggtacaggtcgtcctgctttcattgaaggctaccgggtgggaggtaaaacggggacagcacaaaaggtgattaacgggcgttattcttcctcggagcatattgtatcctttattggttttgcaccggcggatgatccgcaaatcgtcgtttataccgctgtcgataacccgaaaggcattcaattcggcggggtggttgctgcgccaatcgtgcaaaatattttaaaggacgcgctgattgccttgaaaataccgcctcgcaccaatcaaattgccaaagagtacaagtatggagaaaatccgatcgaaacggtacctgatctggtaggtgctactgcagctgatttgtacgaagatatgaatatgaactttatgctcgtgaaatctgggtcaggcaagacggtcgtgagtcaggcgccgaagccgggctccagattggagcggggatcaacgatccgtatttacatgggggattgataggttcattttataccatactatgaataacgagagagcaatggaggaatgaaagatgcagcttcaacaattggcttcactgctggccgtctcccgtgtggtgggtgacggtacagtggattgccgaggaatcggggcggattcacgtcgagtgcaacagggagatttatttctatgtttgccaggttttacagtggacggacatgactatgctgagcaggcaattgcgtccggggcggcagcattggtcgttgaacgggaactggatgtacctgttccgcaacttgtagttaaggatgcacgacatgccatggcggttttggcggattatatgtttgattcaccgagccgacgtatgcgcatgatcggcataaccggaaccaacggtaaaacaacgataacttatctgattgaaaagatcatgaaggatgccggggtgaacaccggactgattggtacgattcaaatgcgttacggaggtcagtcttacccaatgtctggcactacgcccgaagcggtggaactgcaacgttatctcggaaatatggcagagcagggggttcaatgctgtgtcatggaagtatcctcacatgcgttggagcagggccgcgtcaaaggaactgattttcgcaccgctatatttacaaacctgacgcaggaccacctggactaccacaacacaatggaggagtaccgtgctgcaaaaggacttttgttctctaggttgggaaatgctttctcgcgggatgcatcagatagcaaatatgctgttctgaatgcagacgatccggcttcttcctatttgcaggctcaaactgcggcccaagtgattacatacggcgtagaaaaggagtctgatgtgcaggcatctcgtatcactataggttccaagggaacctccttccatgtgtctacttttaaaggagataccgatattgagcttcgaatggtgggcaagttcaatgtgtacaacgcactggcggccattaccgctgctttgctggaaggaatctcgctagtggatatcaagcgcagtctagagtctatcgcaggcgtagatgggcgggtagagcctgtagatgcgggtcagccctttgctgttattgtagattatgcccatacaccggacggattagaaaatgttcttcgcaccgtaaaggaatttgcggtcggtaaagtatggtgtgtatttggatgcggcggtgaccgggatcgtacaaaacgtccgttgatggggaaaattgctgcgcgttacagcgatcattcgtttattacttccgataatccgcgaacagaggacccgaaagtgattttgaaagacatcgaacaagggttgattgacgaaggtgtacccgcagaacgatacgaattgatcgtggatcgcagaactgcaattcataaagctgttgaaatggcaagccctgacgatgtagtattgattgcgggaaaaggtcatgagacttaccagttgatcggaaaaacggtgcatgaattcgatgaccgcatcgtagccaaagaagcgataaggggtttatccaagtgatgaaaagaacaatcggtcagattgcatctatgtgtggaggaacacttcatggagaagcggacgccgaacagatggtcgaaggcgtttttacagattctcgcaggccgcagagccaagggttgtttgttccactcgtgggcgaacggtttgatggacataattatgtgcagcagatcgtaagcgaggcaggtgcagctgcatttttatggcaaaaggatcatggagcacctccggctgagaacgctattgaggtagaggatacgttagaagcccttcagcatctagcagctgcatacttacgcgaaattggcgtttctgtcgttgggatcacgggaagcaacggcaagacgacaacgaaagacatcgtaaacgctctgctgggtacgacttttaaagtacacaaaaccgaagggaattataacaatcatatcggtttgcctttaacggtactttccatgccgcaggatacagatattctcattctggagatgggcatgagtgggcgcggagagattcgtctgctggctaatatcgctcaaccagatgtagctatcataacgaacataggcgaatcgcacttgctgcagcttggttctcgaacggaaatcgctcgtgcaaagttggagattacaagtggccttaagcctggtggtttgctgatctacaatggggatgaaccactgctttcacaagtgttggcggagtctgaaacggtcaagcctgaaggtttgaaattgtttacgttcgggctagctacaggcaatgatgactatccgactgaaatcacttcggatggagaaggtagcttattcataacagcccaatctggcaaagaggctttccggcttcccttgcttggacagcacaatgttgtaaatggtttggcagcactggcggtagcgcgtcatttcaatgtcgatgcagaccatatacgtaaagggttatcgtctttaaaactgacgggcatgcgcattgaggtcgtgaactgtcctaatggacttaccgtgctaaacgacgcttataatgccagcccggcttcaatgaaggctgccattcagacgttgtctgcgtataaaacggacggacgtaaagtcgccgtgcttggtgacatgctggagctgggacctgaggaaaagcaattccatgaggagattggaattttcgcggcaaagcacgacgtagaggtactgtatacctacggtgcgttaggcacttcgattgcgcagggtgcgcaagggttgatgccaactgctaacgtgcacgcttatacagataagcaagagctgatccagcatttgcaggttcatctccacgccaatgatattgtgctggttaaggcatccagagggatgcgactagaagaaattgtggatgcgctgaaaaacggtccgctacagaactgatgttgacgagagggagactcccatggatattcaattattactgctgacgatcgtcgtatcgtttatactggcggtcattgccgctccactgctcattccgctgctgcggcgaatgaaattcggccagcaggtccgggatgacgggccacaaagccatcttaaaaagataggtacgcctacaatgggcggtatcgtgattctggtggcttttacgctgacctttcttaagttttcagctatcaaaaatacggacttttacgttctgttggttgctacgctcggttttgggctgatcggctttttggacgactatatcaaaattgtattcaaacgctcgttaggtctgacggcgcgtcaaaagctgtttgggcaattattgttcggcgcaattatgtgctggcttctgcttagcaatgatcatagtactgcgatcggcatccctggaacgtcatggtcatttgattggggcggctggttttattatccgttcatcattattatgatgctggcgattagcaatgctgtcaatttcacggatgggctggacgggctgctgtccggtacaagtgccattgcctttgctgcttatgccattgtcgcgattcaggcaacctcgcttccggcagcagtatgctcagcagctatgattggcgctgtactcggatttctcgtatataatgctcatccagccaaggtgtttatgggtgatacaggctcgctgggaatcggcggcgccataggtgccattgccatcgttacgaaaagcgaaattttgttcctcattatcggtggtgtattcgtaattgaaatgctgtccgtagtcttgcaagtagcttcctttaaaacacgtggcaagcgtattttcaaaatgagcccaattcatcatcacttcgagctgtccggctggtccgaatggcgcgtagttattacattctgggctgtaggactgctgttggcaggactcggactttatctcaacaaggggttgtagacaaatgaaccatccagacgcatacagagatcaggaagtcgtcattatcggtctggctaaaagcggcgtgcaagttgccaaggtgctgcaccaggccggagccaagctgacagtcaatgataaaaaggatagggaacaatgtcccgaagcttctgaattagaggctttgggaatttccgttttatgtgggggtcacccagaagggctaattcatcctggagtgaagctggttgtcaaaaatccagggattccttataccgcccctcccgtacagaaagctgtcgagctcggcattgaggtcgtgaccgaggttgaggtcgcctaccatctatgtaaagctccgatcatcggaattactggctccaacggaaagacgaccacgaccacttgggtaggcaagctgttggaagcatccggcatgaatccaatcgtggctggtaatatcggtacgcccgtatgtgaggcggctgtggatgccaagtcggacgagtggatggttgtggagctgagcagctttcagttaaaaggaacaaaagatttcaagcccactgtggcctgcctgctcaatgtagctgagacccatttggactaccacggaggcatggaggactacgttgcatccaaggcgcgtctatttgccaatcaaacggcagcggatactgcggtggtgaactgggatgaccccgtctgccgggagctcgtaccctatataaaagcgaagctgcttccgttctctatgacagaacgtttgcaggaagggttgttcgctgacccgccatacatactggatgtgacggacgatattgaacgtagcatcgtataccgcgatggaaatggtgtgctgcatcccattataggcgtagctgagattggacttcccggtcgttttaacgtagaaaatgctcttgctgcttgcgcaatcgccattgctgcaggcgcagaatcagcgaatttggcggaaccattaagtacttttcgcggcgtcgaacatcggcttgaatatgttttagaacacgctggtgtagcttattacaataattccaaagcaaccaattcgaaagcaacaatgatggccttatcttcctttaagcaacccattgtactcattgccggaggattggatcgaggctctgattatacagagctcgtaccttccttgcaggaaggtgtgaaagccgttgtgctcttgggtgagacacggcataagttggctgagcgggcccagcaggctggaatagagcatgtcaaggtcgtcgataatggggaggatgccgccgctacgctcgtggaggctgtgaacaaggctgctgaatttgctgagacgggagatgtagtattactctcacccgcctgtgcaagctgggatatgttcagatcctatgaagagcgtggacgtatttttaaagaggcggcgcataaattgtaagtaggggggttggataagcccctacttttatgcaaggggtggcctcctgatgaagcaatctcgtccagcgccggatctatggcttttcgtttgtattgtaagcttattagccatcggcatggttatggtatacagtgcgggcgccgtcctcgcttttcacgagtacggggactcctactattttgtaaagcggcaattgctgtttgcagggctcggccttgtagcgatgtactttactgccagaacggactaccggatctggcagaaatatgccaaggtcgtgttgttgatctgtctagcactgctggttgccgtattaattcccggcattggtgtagtaagaggcggggcacgaagctggctcggtattagctctttcggcattcagccttccgagtttatgaagctgggtatgattctttttctcgctcgttggctcagtcgtcctgactatgatattagctcttttacgcgcggcctgttgcccccgcttggactcatgggactggcttttgggcttattatgctccagcccgatttgggcacaggcacggtaatgatgggagcgtccatgctcatcgtatttacggcaggcgcgcgtatgaagcatctcggtctgctggctctgtcgggagcagcagggtttgctgcactgattgcagctgcgccttatcgactccagcgcatcaccgcttttctggacccttggtccgatccgcttggcgcaggctatcaaattattcaatcgctatatgcgattggtcctggcgggctggcgggcttgggactcggtatgagtcgacaaaaatatagctacgttcctgagccgcaaactgattttattttttccattttggcggaggagcttggctttatcggtggaatgacggtgctggggctctttttggttctcgtatggagaggaatgcgtgtcgctataactattccggatacctatggcagtttgcttgcggtgggtattgtcgcaatggtcgccgtacaggtcgtcattaatattggtgtcgttatcggtttaatgccggtgacaggaataacactgcccttaatcagctatggaggttcttctctgaccttaatgctaacagctctgggcattttactaaatttatcacgttatgcgaggtgaacgtttatgcgcgtcgtgttgagcggcggcggtaccggagggcatatttatccggcgctagccgtagccagacagtgcgaagagattgatccggacgccgaatttttatatattggcggtcaacgaggactcgaaagcaagttggttcctcaggaaaaaattccatttgaggctattgatatcacaggatttcgccgcagcttgtctgtggaaaatataaaaacgatcatgcgctttttcaaaggggttcgcagatccaaagcattattaaagaaatttaagccagatgtcgttattggcactgggggatatgtatgcggccccgtcgtttatgcagcttccaagttgggaattcccagcattattcatgagcaaaatgcaattccagggttgactaatacatttctgagtcgctatgtggatacagtggctgttagctttgaaggctcagaaggagctttccccaaagctaaaaatgtactgtacactgggaacccgcgtgctacaacagttcgtttggctaaccgggatcggggatttgctacaattggggttccgatgaacagttcggtcgtccttgtggtcggtggcagcaggggagcgaaggccattaatgacgccatgattgcaatggctccgcaactttcgcaactgaaagacgtccattttgtatatgtaactggtgaatcttattatgagcaaacgctgggtagcatacggaatcagatcggctcattgcccaatcatctacatgtgcttccctatattcacaatatgccagaggtgctggcttgtacctcattaattgttaatcgcgcaggtgcgtccttcttggcagagatcacatcgttgggcattccgtccattctgatcccatcacctaatgtgacgaataaccatcaggaggctaatgctcgtacacttgaaaaggcaggcgcatccgtcatgattgtagaaaaggaactgagtggcccggccctgtttcaatctatagcgggaattatgaaggatgaggcacggcgaagtcgcatggcagagtcggcgtctgcgctcggcaagcctgactcagcagatattttagtaaaagaaatggaacgtcttgcccataaaaggtagtctgcagtgcagaattgggcggttgtcacacaccggatggtatttacataggataccctatagattgtgaccatcactcaggctgccggttgtcaggtgagagccttataaccatgcggggcaagcaacaaggaggtttcagtacaatgcagcaatggatgccattattagcggagcatgatatcggaaaagtgctggagcatgagccgctgtccaaatatacgacatggaagattggaggccctgcggatgcacttgtcatcccggataccaaagagcagctggcaagagttttgaagctggctagcgagcacggaattccctggatgcagttggggcggggctccaacatgctcgtctctgacaaagggatacggggacttgtgatcaagctggggccaggatttgattatgttcattttgaggatgaacagatcgttgctggaggaggcgtttcactggtcaaactgtgcgttatggccagcaagcagggcctgtccggtcttgaatttgctggtggtatcccaggatcagtcggtggggctgtctacatgaacgccggtgcccatgggtctgatgtgtcacaaatattccagtccgctgagattgtgctggatacaggggaattggctgtgtacgatgctgacaatatgcatttcagctatcgtcactccgtgttgcatgagcaacgtggaatggtgacagaggcagtgtttcggatgaagcggggcgatcgggaggaaatttcagcagcgctagcggcttttaaagaccgccgtcggctgacccagccgctacagttagcttgtgcaggaagcgtgttccgtaatcctccaggtgactatgctgctcgtcttattgagagcgcaggtctcaagggcttgaaggcgggaggcgctgaggtatctgtacagcatgccaatttcattgtaaataccggtcaagcgacagcagaggacgtgcttaccctaatgaagcatattcaaagtacaatatcatctcaaaccggcatcaagctagttccggaggttttcgtagtgggtgagcggtaaactcggaggtgatacattggacaaattggtgattgagggaggccgtcccctgtcaggcaccatacgtatccatggggcaaaaaatgcggcactacctattcttgcagcgagcttacttgcacaaggtaaggtagaaattcggaatgtgccccatcttttagacattaaggtcatgctgcacatccttgaaagactcggctgtacatgccgacatgaagaggaaacggtatacgtggatacgtcgtccgtccgaacgttccaaattccggaagatttgatgaagcaaatgcgctcatctatctttctgatgggaccgctgctcgccagatatggagaggtttccatttaccagcccggaggctgcgccataggcgagcgcaaaattgatcttcacctagagggcttaaaagctcttggcgcagagatagaggaaaaagacgagcaaattacgtttcgagcccacaagctaatcggctcggacatccacatggatttcccgagtgtaggtgcaacggaaaatattatgatggccgctgcgttggctgaaggacgaacaacgatcaccaatgcagcgagggaaccggagattcaggatctacaaaacttcttgaatgccatgggagcccgcattattggtgctggaaccgacacgattacaatcacgggggtcagtcgtctcaatccgtgtacgtatgaggtcattcctgaccgcatagtagctggaacggttatgattgcagctgcagctacacgaggaagtgtgtcgctgacccactgcaatccatcccacttgtctgctctgattcacgtcctcaggcgggctggtgttcaaatcggcatcttgaatgatataatgaccgtaagttgtatgagtcgtcccaaagcagtggagaggatcgttacctccccttacccgtcttttccgacggatttgcaatcacaggtcatggttttgctttctttggcggacggatttagtgtcatgaaagagaccgtcttcgaaagccgattcaaacatgtggatgaactaaatgtaatgggtgctgatattacggttgatgcaaatgctgcttttataagaggagtttctcgtctgtacggggctacggtagaggctaccgatctgcgggcaggagcagcgctggtcatagcgggtctagcggctcaaggacgtactattgtcgagcaggttcatcatattgacagagggtatgaccggatcgaacgtcttttccagggattgggtgcccgaatgagccgtcagtctccggtgccggagcaactggatttcgtaaattaatgcctgtaatgtccctccgttaacggggggacaaaaggcttttgtggagagaagctatgccaaatgctcaaatacctgttcttaaaaagaacagaacgaaaaaaagaacaagccggaagattgctattcttctcattttgttgtttatcgtactgctcgctgttctctttttccgttcttcgttgagtcgggtttctgaaattcgttttgatggtaatgtattttcgacccgagatcagcttcttaatcgaagtggtctggctgttggagaccagtatttcggagtcagttcatccgacatctctgagaagctgcgggaaattcaatcgatacagcaagtcacagtggacaagcagtttccgggtattattgctattcacattaaagagtttgctacggtcgcttacgagttgcagagtgacgggagccttcgtgctattctagcgaatgggacaagcgtgagcgtgggaagtagcggaatagctgttgagaagcctattttgaccaaatggaaatctgatgatccgtacaaagcgaagctgtgtgatgctttatcgcgcattccgggggaatggacagccgatatttcggaaatcattcccgcaccgattccttcttttccggatcgcatcaaaatgtacacgcgttcccagtttgaggttattacaactgtttctctactgaattctaaaatcagctatttgaaccaggtactagaaacagaagatccaggtttgatcaccatgttggaggcggattcctacgttccgttcaaaccggatacgagtgaagagggccaagaaaaagatactactcagtgatgtgaaaaaatgctagaattgattttatgggtaatagacttgcctccttcttttttcttcaaatttttatgtgactgcaaccataaattggcttctaaaaaatttgtagaaaaaagagggaaagcatggagtttgttgaatatgtacagagtgtgtttaaagaacgaaattcattttggagtcaggaggtgccacagacttgagcaacaatgacatcattgttagtttggacatcggtacatccaaagttcgggctattattggggaaatgaataatggaacctttaatattattggagttggatctgccgactcggaagggattcgcaaaggtgcaattgtagacattgatcaaaccgtgcaatcaatccgtaacgccgtggatcacgcagaacgcatggttggtattcaaataacagaagtgtatgtggggatttcaggcaatcatattggcctgcaaaatagtcatggcgtagtagccgtgtccaacgaggaccgtgaaatcggtgaggaggacattgagcgtgtactgaaggcagctgaggttattgccgtaccaccggagagagaaattattgacgtggtagccaagcagtatgtcgtggatggccttgaaggcattcaggaccctcgcggtatgattggagttcgtctcgaagtagaggctacgattgttactggaggcaagaccccgatacataatctgttgcgctgcgttgagaaagccggcttgaggattaaagatctggtcttgctgcctcttggagccggacaattgtctctttcgaaggatgaaaaggtgatgggttcagtgctggtggatattggtgcaggatctacgaatgttgccattttccaggaaggaacgattgttgccacatcaacacttccgattggtggagaatttgtaaccaatgatattgcctacggactgagaacccttaccgatcaagccgaaaaggtaaagcttaaatacggctgcgcatggtatgatgatgcggcagccgatgtcgtctttaaagtgacgcgtatcggcagtaatgtggataaggaattcaaccagcaggatttggctgctattattgagccgagagtgcaggaaatttttcaactcattcaggcggaagttaagcgcttgggttacacagagcttccgggaggttatatacttaccggaggcaccgtctccatgcctggtgtacttcaggtggcacaaagcgaactggccgcttccgtaaggatcgccgtacctgattttatcggtgtaagggatccgggctacacgagcggagttggaatcttgcataatgctattcgttactatcgcggaagatcgactagcgttagcaacagtggcggaagtaccaagaagccgactaaccgaaccaaaagtagtagtagtcccgctgcggaaggcgagcaaaagcaggggttgattgaacgcttaaaaaatatgttcagtgaatttatataacgttcattgctaattatgccaatcatggacgggccatccatgcacattgagggggagatggaatagtatgttggaatttgattttgaaatggagagcttggctcaaattaaagtgatcggcgtcggaggcggcggcagcaatgcggttaaccgaatgatcgaaaatggtgttcagggtgtggagttcattacagtcaatacagatgcccaggcacttcatttagcaaagtctgagcataagcttcaaattggggataagctgacccgcggtctgggtgccggcgctaaccctgatgtgggtaaaaaagcggctgaagagtcgcgtgagctcattatgaatacgctcaaaggtgcggatatggtattcgtaacggcgggaatgggtggcggtactggaaccggagcggctcctgtcattgctgaaattgccaaggaatgcggcgcgctgactgtaggcgtggtaacccgaccattcacgtttgaaggtcgtaagcgttccaatcaagctgaacttggtattgaaggattaaaagaaaaagtagacactttgattgtaatcccgaatgaccgtttgcttgaaattgtggacaagaaaaccccaatgttggaagcattccgtgaagcagacaatgttctgcgtcaggcggttcaaggtatttcagatttgatcgctgtaccgggtctaattaacctcgactttgctgacgttaagacgatcatgacggagcgtggctccgctttgatggggattggcgaagcaactggtgaaaatcgtgcggctgaagcagcacgcaaggctatcatgagcccgttgttggagacatccattgaaggtgctcgtggtgtgattatgaacatcactggcggcaacaacctgtccttgtatgaggttaatgaagcagctgaaattgtaacatcggcttccgatccggaagtaaacatgattttcggtgctatcattgacgaagagttgaaagaagagatcaaggttaccgtcattgccactggctttgaaggcaagccaagtcaaccggcaccgggacgtaaaccggcagccaacccggctacttccgaatcggcggaaaaaggctctcctaacttgcgtccatttggtaacactcaaagcagtgaccaattagacattcctacattcttacgtaaccgttcgcgcaataataataacgataactagtttcaattcggattgcccgcattctccctggagatgcgggcttctttctgttttccgtgtcttgcagttcaggcgcttctcctctttccgacaaaattagtcggtcaccgtccccaccgttagacagactttgaacagcatgactactatacttaatcctatcctgcaaacgctgggcgggtgaagccttggttgtttatatcgacttgatttttttggccaatttgttcattgatgctgtgttgctgatggtcaccgcctggatgagaaaaatccgtccagtgtggtggaggttgttgacttcagctggaatcggcgcaatgtatgtggtcatgatgtttgtgccggaactgtcctttttatttacattcctgatcaaactggcattatcggtcataatgctgctggtggcttttggatttggcagcatgcaaaagtatcttcgtacaatgggtgctttttacatgatcaattttgtagctgcaggtggcattttggggatgcattattttctccaaaatacgggggaattgtttaacggcatctggtataccgcttcgggtggaatgtcctttgaactcaaaatcgcattctggtttattttatgcgcatttggcggagtgatgcttttctttcgtattgtgcagtcctcaaagcagcgcacagaaaggatgagtgggtttttgggacaagtgcaggtatggattgggcaggatcatattgagtgtacaggcttgttggatacaggtaatcagctttatgatcctttgacccgaaccccggtgatggtcatggaggcggccttgtgggaatcgcatttgcccgcctcctggctccgaaaatgttctgagggtaatgctgaccaactggtgatggaactgggggacgaatcgtttagctggcaggatcgtgttcggctcgtcccctatcgtggaattaaccgcaatcattcctttatgctcgcccttaaaccagaccgggtagaggtgatgatgaatggggttcattttgtacatcatcgagtgttgattggcttggacggggggacattgtcggcagagggtaagtatcgcgccatcatccacccggatgtgacggcacaagaagagggcagtgctgataccaaccagaaacaagatgcacatattggtgagcattttacagaatcaggatgacggagcataaacacaaaatgatgtttgaaggcgacgagaaatatccaatggtgaaatgggcggagcacagctggaattgcactattttcaaaagggggagaatgatatgcgggaacagttgaaattgaagatgaaaattaggttagcattgcaattgcaatattatcgtattttatttttatttgggctgaaaagtgaagaaatttattatattggcggcagcgaggcgctccccccaccgctgacgagagacgaagaagaatatttactgggaaaactttcttctggagatgcggcagtacggtcgatgctaatcgaaagaaatttgcggttagtcgtatacattgcccgtaaatttgagaatacgggcatcaacattgaggatctcgtatccatcggtgctattggactaatcaaagcggttaacacttttgatccggagaagaaaatcaaacttgccacatacgcttctcgatgcattgagaatgagattttgatgtatttgcgtcgcaatagtaaaacgagaacggaagtttcttttgatgagcctctgaatattgactgggatggtaatgagttgttgctttctgatgtgatgggcacggaaaatgataccatttaccgtaatattgaggagcaggtggaccgtaaattattgcataaggcactggataaattgacggatcgagagcgtttgattatggagctgcgcttcggcttacaagacggagaggagaagacacagaaggatgttgctgacctgttgggtatctcgcaatcgtatatttcgcgtctggaaaagcgaattataaagcgcttacgaaaagaatttaataaaatggtataatgcatgggtatatccggaagcgatggaaacggcgaataaaaaaatgccctcaggagataatgtacattaatgttgctccttgggaggtaagacacgatgacccgaaacaaagtggaaatttgcggtgtggataccgccaaactgccggtattaaccaatgcagaaatgcgcgagttgttcacatcacttcagcaaaataatgaacgatcagccagagaaaaattggtcaacggcaatctccggctcgtcctgagtgtgattcaacgatttaacaatcggggagagtttgtggacgatttgtttcaggtaggatgtatcggcctaatgaaggcgattgataattttgacctttcgcaaaacgtaaagttctccacttatgcggtgccgatgattatcggagagatccgccgttatttgcgggataacaatccgatccgtgtgtctcgttcgttacgggatattgcatataaggcgcttcaggtgcgggacagtctgacgaatctgaactcgcgagaaccaacgatttttgaaatttcagaggcactgaatgtgcctaaagaagacgttgtgttcgcgttggatgcgattcaggatccagtttcgctgttcgagccgatatatcacgacgggggcgacccaatctatgtgatggatcagatcagtgatgacagaaataaagacgtctcatggattgaggaaatcgctctgcgggaagcgatgcatcgcctgggccagcgtgaaaagatgatattgtctatgcgtttttatgaaggaaagacgcaaatggaggttgccgacgaaatcggtatctctcaagcccaggtttcaagattagagaagtcggctatacagcaaatgcaaaaacatgtaaagtcctaatgaaatgaatgcttgaatgatccagcgataaaaacgatcctactcggatcgtttttgcgtttacaggacattttttgggctcttccgctcatatagtgaaataaaggatgtgatgcgtgtgagtgcaccggaaacgtcagtaagagcaatgaaaatttccgagtttcaaaccaaggatgtcattaacattgtagatggacgacgcctgggacaaatcagtgatttggagatcgacgtgcggcaggggaaaattgaagccattgtggttccaggcagcagtcgttttatgggctggtttggaggcggaagcgagttggtcattccgtggcgcaacattgtgaaaattggttcggatgttgtgcttgtacgactggaaggattgcaagagccgccgggtgaaggggaagaaaagttgtatatcgaacgtcaagagcggagtgaccgaaggggcttctgaacttgcagatctacgtattttagtgtgttgtgaagacacggcggcggctttttgatacactgggcagtagaggtgagaatgaatggaaccatttgtagtgaataccgaggctacgggggcaaagccaatgcaagatggcgggcgtcccgtaccggagttgttatatattcaatcttgggagcgacaggttcagggattaacagctggttttacaggtcgtcatggcggtgtcagtgaggtgccctacgctagtctgaactgtgcgtttcatgtaggggatgaccccgagaaagtcattcgtaatcggcagctcattgctgagcagcttggttttgctactgaagcatggacgtgcggtgagcaggttcatggtcatcatgttgctgtagtcaaggctgctgatcgcgggcggggctttagggatcgtgcatccgcttttcaggacacagatggacttgtgacgaatgtacctggcattttgctgacgtccttttatgcagactgtgtacctttatatttttgtgatccagtgcgccgtgtgattgggttggcgcatgcaggctggaagggaacagttgcggaaattgcattgaaaatggtacagaccatgcagaacgaatatggatctcagccgtctgatatactagcagctatcggtccttccattggttctgaatcctatgaggtggatgagcacgtgatgagccaaattcgggttttggagcatgattgcccgggtaatgataaatgggaaggttctgtttacttccccttaaccgacggaaaaacactacttgacttgaaacaatgcaatcgacacattatgatgaaagcaggaatattgccgagccatatcgaatgtactaccttatgcacgagtagccgtagcgatttgtttttttcatatcgcaaagaaggcggcgtcacaggaagaatggcgagttggattggtctggaagagaggtgagtcctcccgtgtctatggaggaacgaattaaagaagtgaatgcccgtgtagaagcggcatgtgcccgaagcggacgttcgcgtgatgaagttaatgtgatcgctgtcacgaaatatgtttcggcagtggcaatgacatcagtattggatagcaacttggagcatgtgggcgaaaatcgctggcaggatgctgcggataaatggagcaagttgggtgaccggggaacgtggcattttattggtcatctccaaacgaataaggttaaagatgtgattggaaaatttaaatttatacattcgctagaccgcttatcgctcgctcaggaactggacaagaaggcagccgctctgggattgcgagttaaagcttttgtgcaagtcaatatttccggcgaaatgtccaaatatggcttgtcctctgaggcggttgcccccttcttggaacaaattcgcgagttggagcatgtggacgtgattggcttgatgacgatggctcctcatgaagaagacccggaaaaaactcggcctgtgtttcggggattgcgtgaattacgggatacgttaaatggacaagccttgaccagagaacccatcgttcacttgtcaatggggatgtccaatgattttgaagtggcagttgaagagggagcgacctggctgcggcttggttccgtactggtcggacgagaggaggatttccattgggcgtaatgaataagttcatgaactttctggggcttcaggaagaagaggaagttatagagcgagaggttatgaatacgccggaagatcaagaaattgaaaccccaagctttgataaacgtaagaaccagaagggcactaatgttgtcagcatccattcacagaaaaatgtgaaagttgtcctgtatgagccgcgttcttatgatgaagcacaggaaattgccgaccatatccgttcccatcgtaccgttgtagtcaatttgcaacgaattcgcaaggatcaggcgctgcgcattattgattttttgagtggtactgtgtatgcactgggtggtggtatttccaaggtcgggaataatatttttctgtgtacaccagatacggttgaaattcaaggctctattacagaaatactggctgacactgaacaagaacttaacagaatgaggtgaacttttcttgatcgaggtaatttactggctatttcagatttattcgtacatgatcattgcatatgttctgctgtcatggcttcctaatgccagagagagtgtaattggtgatttacttgccaagtttgtggagccgtatttgtctccttttcgcaggtttataccgccaatcttcgggatgattgatatttcgcccatcgttgcgctgattgctctgcgttttgcgtcgtacggtttgatttctttaattggtaatttcgtctaggaggagttatgcgaactgagatttatgagcattttcacccggatgaacgggactatgtggatcgcgcttccgaatggatcagtcatgcgggagcttatcatgagcagaagctgactgattttttggacccgcgccaacagtacatattggagacacttgcttcgaaggaagacaaggtcacgattagggtagatggcggatacatggcttcggaacgaaagcgggcgctgattgcgcccgattattcgtatttggacggtgaggagatggggattcaggtcctttccatcacatctgacgatcataaaataggtacccttgagcacggtgattatctaggtgccctactggggcttggaatcaaacgtgggaaaatcggggacattcatgtactggatgatgggtgccatgtattggtagcttcagagattggtgattttatgacgatgcatttacagcaggtacatcgtgttcatgtatggacagaactgttgcctgtcgcgagtctgcgaacgaaggaagttgcattagatgcgctagatctgacggtcgcctccttgcgcctggacggtattgccagcgacgtgtacaagctaagccgaagtaaaatattaacaccgattcgggcggggcggtgccgggtaaattggaaggtggaggagaatccatccactccgcttaaagcgggggacgttatttccatgcagggttttgggcgtttcaaagtgcttgaaacagacgggatgacaaaaaagggaagattccgtgtcaaaattggtaagtttgtatagctataggcaggaatcacgagctttctgtcgaaagaattaagctatagcgaagaactggaacgattttgctctgtacagtattcacaaaacggggtatgatgaccgatagatgatagtgagcgtcgtgacgcggaaaatgtattttttgtcaatcttataggaggtggacggcatgccattaacgccattggatatacataacaaggaatttgcccgccggcttcgcggttatgatgaggatcaggttaatgaatttttggatcaggtgatcaaagattacgagggcgttattcgtgaaaataaagaactcagcactgagttgttgaacgtacaggagaagctcgatcatttcgcgacgattgaggatacgctgagtaagacgattatcgtagcgcaggaagcggctgatgaagttcgtaacaacgctaagaaagaatcccaactgatcgtgaaggaagcggaaaaaaatgcggatcgtattgtgaacgaagcattgtccaaatcccgcaagatcgcgttggaggttgaagaactgaagaagcaggcatcgatttaccgagcacggtttcgtacactggtggaagcacagcttgacttgttaagccaagacggctgggaagcacttgaaaaccgggaacgcgaagtactggagcgcgagcgtgagatgaaagaaatttactaatttcatttctgacaagcttttatcaggctttgttagggttgacttttatctttaaacaggctataactgtaaatactatactgaattcaatgattatccgtctgtcggctgatgattgttattcaaggcaacgatgttgctgatttcgatgaatttaacatgtttaattcgttgatgggaacgagtacgtcatgatttgtccctcagagagttggccttccggtgcaagccaacgttcagaacatgaccgaagatcctcccggagaagtgagctgaagcgcttaagatttatggcgtgtgtaagcaatcaccgtttgccatgcgttataatggcgccctgctgtagttgagtggggctcagagagccgtgatgagactgtatttttaatggtctgtttttacggaatcagggtggtaacgcgagcacagtctcgtccctttacagggatggggctttttttgttgctttttttaggaaatgctagagaaatcaatgatgagcagagagggagtatgacggtatgaacagagtggatgttaaagaaaaagcacggtctcgtgacctacgcatcctgagcaaatggaagcaggaggacacattccgtaaatccatcacaaatcgtgaaggaaagccaaattttgtgttttatgaaggcccaccaacagctaacggtaaaccgcatatcggtcacgtgctgggccgtgtaattaaggatttcgtcggtcgctatcagacaatgaagggataccgcgtcgtacgtaaggcaggctgggacacgcatggcttgccggtagaattgggtgtacaaaagcagctgggaatctcccacaaacctgaaattgaagaatacggtgttgaaaagtttattaaaaaatgtaaggcgagcgtgtttgagtatgagcaacaatggcgtgatctaaccgaagcgatcggttactggacagacctcgataacccgtacattacattggataataactatatcgagagtgtatggaacattttggcgacgattcatgaaaaagatctgctgtatcgtggtcatcgtgtgagtccgtattgcccggattgtcaaacgacgctaagttctcatgaagtagcgcagggctacaaagatgtgaaggatctgagcgccacggctaaattcaagctgcatagcagtggtgaatatgtactggcttggacgacaacgccttggaccttgccgagtcacgtggcgctcgccgtcaaccctgaactggaatatgcacgtgtgaagcaggaagacggtgtatacatcgttgctaaaaatctggttgaggacgtaattaaaggcgaacatgaagtgattggcacgctatccggttcagaactggttggccaaacgtataccccgccatttacgtattttcaggttgaaaagggtaatcagattctgggtgcgaagttcgtaacagactccagcggtacaggtatcgttcatatggctccggcgcatggtgaggatgattaccgggtatgccgtgaaaatggtgttgaatttatcaacgtggtggatcttcaaggtaactatgtagaggaaatcactgattttgcaggccgttttgttaaagactgtgatgtagatattgttaaaatgctgtccgaaaaaggcttgctgtacagcaaggaaaaatacgagcatagctatccgttctgctggcgctgcgacactccattattgtactatgctatggacagctggtttatcaaaacaactgcgattaaggatcaactgattgctaacaacagcgaagtcgaatggtacccgggtcatatacgtgaaggacgtttcggcaagttcttggaagaactggtggattggaacatcagtcgcgatcgttattggggtacaccactgaacatctgggtttgtgaggaaactggagaacagttcgctccgcatagtattgctgagttgagggaacgtgcgatcggcgacgtaccagcggatatcgagctgcacaaaccatatgtagatgatatcaaggttcgtagccaatgcggtaaatacgaaatgactcgtacaccggaagtaatcgacgtatggtttgatagcggctccatgccgtttgcgcagcatcattatccttttgagaataatgaaacgtttgagcagcaatttccggcagatatgatctgtgaaggaattgaccagactcgtggatggttctatagcttgcttgcggtttcgactatgctgactggcaaagctccttataaagctgtcatggcgacaggccatgtactggatgagcaagggcagaaaatgtctaaatccaagggtaatgttattgatccgtgggaagtgattgacgagtacggtacagatgctttccgttgggcattgctgtccgatagtgcaccatggaatagcaaacgtttctccaaaggcattgtaggcgaagctaaatcgaagctcgtcgatacgcttgtcaatacacacgcttttctgaccttgtatgcagatatcgacggatttgatccggcacagcatccgttcaaaccatcggcccataagttggatcgttggattttgtcccgtctgaacagcctcattttggtagtggacaaagcgctggctgtaaatgacttcctgaactcatctaaagcaattgaatcgtttgtggatgagctgagcaactggtatatccgtcgttcacgcgaccgattctggggcaatggtcttacagaagataagctggatgcataccgtacactgactgaggtgctattaacgactgccaaactgcttgcgccatttacaccactgcttgcagaggatatttacctcaacctaagcaacggggaaagtgttcatctggatgattatccgactgccaatgaatccttgatcgatccggaactggaacgagatatggaaacggcacgccgtgtcgtcgaattggcgcgtaacgtccgcaacgaaacgggtttgaaaacgcgtcaaccgttgtccgagttgattctgtccatggatcaggactttgaactgagtggctatgaggaaatcatcaaagatgagattaacgtgaagcatattcatgtggagacggacgatagcggctttgtagattttacactgaaactgaatttgaaagtagcaggcaagaaatacggcaaaaatgtcggtttcctacaaaactttttcaaaggaatgtctgctgaggatacccgttctgttgtagaaaaaggagtgttaaacgtcgcttctccagaaggtgaagaactgcaagttacggccgaagaattgctggtggagaaaaaagcgaaagaaggcttcgcttctgcttccggttatggcttaacggtagcgttgaacacagacattacaccggagctggagcaagagggctgggtacgtgaagtggttcgtgcggtacaggattatcgtaaaaaactggatctgccgattgaaaagtatgtggcgttgacgttggatgtggataatgagctgcgtctggccatcgaaagcttcgactctgtgttgcgtgagaacgtactggttactactgtgacatttggtcaagccgaaccggcagaacatgtggaagtgaacggtaaaaccatcggcgttcatattggggaataattacaagccccctgtcccataatacaataacaggcagcatataaaaacgagcctaagcatcggaaacgggttttctccgttacgtgcttcggctcgtttgctgcgttcagggcagccatgggaaaagggggattgtgcatatgacggcacgatcaaggcgtagacagggaaggagtctccgaggtatcaatggagaaggggctgccatagccgcagataaaagcaaaacaggtaatcaggcagagcaattaagtcgtgttgaaaagctgatacgtgctgtgtcagagcaaatggaacggacacgtattgcagattacgctttgctgctgaataagccttggcgattactctggctaaatctaatatcaggcgtttcccggggaatcggcatcgcactaggttttactttttttgccgctaccattatttatgtgctgcaagtgctcggagcgttgaatttgccgattatcggtgattatatcgctgatatagtacggatcgtacagcgacaattggagcttaccacctattaggcagcgatctccactttgaggttcacgattcgtcttcgtgcgtatccggctccagcagaccttcgccctcgccatcttctatataacgctgataaatggagctgcgaataacagatacattttgtccataaatgtcagtagcaataaagctttcgtatggctctacgaagcccatattatcatcacctgcttcaatttccatatcatcgtaactgtggatttctccactttcggccatcgctggtgtgttagaggtaccccaattttcgacgatctgccaagcatcttcaccgtcgaagccgttttgatcatcacgctcatccagactcgttctgccgaacgagggagcgagaaattcttcctctactgggcggcggttagacacttctgtttcgggactgtactctttacagtaaatggtatagggaacagccagtaggcgctcatagggaatgggtttaccgctggcggcacaaatgccatacgtccccttttccatggccatcagagctgattcgatgcgttctaattggaattcgtcgtgttccagtaaggaaatatccttggctcgctcgtaggtttcggtagccaggtctcctgggtggttatcaataggagaaagctcgccggtttggtcgcgttgggaatcgccgagtccgtaatggtcgttgccttgcaaacgatgctcaatttcttttttgcgttccagcagttcgttacgcaagccctgcaattgttgctccgtcaatggggacatggaatcctctccttgttctaggtttacatgcgcatgcgttgtgtgaagtatgctccatgtagcatgcaccgggaagacctcttttacataggaaattctaatcaaatgcgaaggagttcattttatggatgatttgtacttgaagcttgcgggattcgtggacgatctgagaatgcttatgctacaataaatgggttcaacaacggatataagcggatcggagtgacgaaggactgtgatttattttggtattgcgctaattatttttttgattgatcagggagtcaaatatttggtggctacgcggatggaattgtacgaacaaataccagttatcggcaatttctttttaatcacctcccatcgaaatcgtggagccgcttttgggattttggaaggtcaacgttggctttttatcgtgattacaattgtagtggtgattggtatcgtctggtacctgcgaaaaacagtcaaggctggacaaaagctacttcctgttgcgctaagtttggtgctggggggagcagtcggtaactttttggatcgagctatttcaggggaagtagttgattttgcacaatttaattttgggagctatacgttccccatttttaatgtggcagattcggcgattgtcatcggtgtagcactgattattttggatacattactggaatcgcgtcgggaaaagggaaatggcaatgatagcattgaagggaagtcatagcatgagcgaagtgaatgaaaacggcgaagccgcaggtctgtcttatgaggacgaactggagggtgaatctctggaatggacggccgattccggggatgccaaaacgcgtatagacaaatatatcgccgaagaaatgaaggaagtgtctcgttctcagatacagctgtggatcggaaacggtcgcgtgctggtgaacggtacggcgatcaaggcgaactacaagctggctgaaggagatcgtattgtattatcggtaccggagccagaaagtgtagatattgtaccggaaaatattccgttggatgtcgtttacgaggactcggacgttattgttattaacaagcaacgtggtctggtcgtgcatcctgcaccgggacactcttcgggaacattggttaacgcactgatgtaccactgtcacgatctttccggcatcaacggggaattacgtcctggtattgttcaccgtattgataaggatacatcaggactgctgatggcggctaaaaatgatcaggctcacgcatcacttgcagcacagcttaaggaccatagtgtgactcggaaatatatcgccttagttcacggtcatttgagccacgatcagggaacggtagatgctccgattggccgcgattccggtgatcgcaaattgttcacagtgacggaacgtaacagcaagcacgcagtcacccattttctcgtcattgaacgattgggagattataccctgcttgaacttcaattggaaacaggacgcacacaccaaattcgtgttcacatgaaatttattggacacccattggttggcgaccctatgtatgggcgcagcaaaggggttcgtatggatggtcaggcgctgcatgcggcggtactgggctttaagcatccatccactggagagtacatggaattcaacagaccgatccctcctgatatggaggatgttttagcgtccctgcgtagtcgctaaaacaatgacaatttgcattcctattcacaaacctgaataaatcattaagttaaaccgcctaaatggcggtttttttattgtgggataaggtatgggtaaaaacaactatggataattatacaatgaagttgtataattattagagtgcttccggtggttccggttgaacgggtgttgacacacgattttcaatctgtcatacttcttgtagttgcgatgaactttgtccaagagatggctaaccatctcacactatgagaagcaggacaaaggaaatcctgaatagcacctttaaatcagtcccgtgaggctggcaaggtaacgtgaatggatcactgatcagtgcatccgctgcggcggtatgtcttcagtgtgtccgagagatcggagaacagtggaagactgttcacacgagactccttgccaaacttgggcaaggagtcttttttgtatccgaacacgggaccaggtctgaagggaacatcacctgaggaggctggaagcatgagtaatgaaacacatgtactgatggatgaaattgcgattcgtcgggcattgacacggattgcacatgaaattttggagaaaaacaaaggtattgacgattgtgtgctagtaggtattcgaacacgcggagttcatctggcgcaacgcctggctgaaaaaattgctgagattgaaggcgcaccaattccatggggagagctggatgtcacagcctaccgggatgaccggagcagcgtagccgaagctaaaggaaatggaaaagagcttttgatgaatcctgctgacgtatcggttcatgataagaaagtcattctctttgacgatgtgctgtacacaggccgcaccatccgcgcggcgatggatgcattgatgcactgcggacgaccgcaaatgattcagctggcagtgctagcagatcgcggacaccgtgagcttccgattcgtccggattacatcggcaagaacatcccgacctccaaatctgaggaaatcgtagtagcccttcaagagacggacggtaaggacgaagtgacaatcattcagaaccggggggaacagctatgatcacaacagccagtcaacttaaagaacgtagcctgctcgggttaaaggaacttagccgaaatgaaatcgagtccattctggatcgtgctcattattgggaatctcaaccagaaaaactggttccagtactgcaatcacgctttgcggccaacatgttttttgaaaacagcactcgcacccgcttttcttttgagatggcagagaagcggctgggcgctcaggttttgaacttttccgctgcggcttccagtgtggaaaaaggggagtccatttacgatacagtacgtacgctcgaatccatgggcattgatgcaggagtcatccggttaaagccagccggggtgctgcaagagctcgctgagaaggtcagtgttccactggttaatgcaggggacggcaacaatgagcatccaacgcaggctctgctggacctgtacaccatgcgcaaaactttcggtgagcttaaaggcttgagagtatccatcataggagacattctgcacagccgtgtcgctcgctcgaatctgtgggccttgcaaaaattcggagccaaggttagcttctgcgctcctgataatatgcaagcacctgatcttgcggcgtacgcgccttatgttccgatgcaagaggcactacaggcggacgtggtcatgatgcttcgggtacagctggaacggcatgccgaagggatgttgcgctcagcggatgagtaccgagagcagtacggtttgacagagaaaagagcagcgaacttgaagcccggaacaattatcatgcatccagctccagtgaatcggaacgtggaaattgatagtgcggttgtggaaagcgaacaatcgcgaatttttccgcaaatggcaaacggggttccgatccgcatggcggttatggaacgggcaatgaaactgtagaagctgtcagtaggatcgtaggaaaagttgcagaaaactgagcggaggaatatttcagatgaaacaattaattatgaatgcaagcgtattgaacgagcagggcgaggctgaattgaaatccatcctaatcaccgacggaaagattttggctattgcaaatgcggatgctggagtcagcctacttatggaagaaggggcatctgggcaggagcgcgaaatcgaaaagatcgacgcccagggaaaattggtcatccccggtttaatcgacatgcatgtgcatctgagagaacctggctttgaatataaagaaacaattgaaacgggcagccgcgcggcggtgaaaggcggatttacgacgattgcctgcatgccaaacacacgtccagtgacggacaatgttgacacagttcagctggtattgaaaaagggacaggaagccgggtttgccaaggttcttccttacgcagccattacgaaaaacgaactgggtcgtgagctgacagattttgaagcgctcaaagcagcaggtgcaatcggctttactgacgatggtgtcggggtgcaaagcgcgcaaatgatgaaggacgccatggcgtgggccaaggcactagatatgccggttattgcacactgtgaagataacacgcttgttgaaggagcggctgtgacggacggcgaatttgccaagcgccacggacttaaaggcattccgaacgaatccgaagccatacacgtcggacgagacattttgttatccgaggcaaccggggcacactatcatgtatgccatgtcagcacagagcagtcagtgcggttaatccgccacgcgaaatcttttggtatcaaggtaacggctgaggtatgcccacaccacttggtattgtcagatgaggacatccctgggctggatgcgaattggaaaatgaatcctccgctccgctccccacgtgatgtgcaggcatgcatcgagggactggaagacggtacgattgacatcgtcgtaaccgaccatgcagcgcacagtgaggaagagaaggcaagaggtatggagctggcgccatttgggatcgttggatttgagacggccttcccgctgttgtacacgaaattcgtagctaccggacagtggacgctggactttctggtgcgtcgtatgactactgatccagcgcgtgtcttccgcctggatacgggacgcctggaagaaggagctccagctgacctgaccatgattgatctggagcaggagcaggcagttgatccgcaaacgtttgccagcaaaggacgcaacactccttttacaggctggaagctcaaaggctggcctgtgaaaacttgggtagacggcaaactggtatggtctgctgacgaagcaaaataaatagaaaccactaaaaaaatagaaccttatagcaggaaacaatatagaggagtgagacgggatgcaggcaagattgttacttcaggacggcacgctgtttacaggcacatcatttggtgcggaaggtgataaaacaggcgaggtcgttttcaacacagggattacaggctatcaagaggtgcttactgatccctcttactgcggacaaatcgtaacgatgacttacccgctgattggcaactatggaattactcgtgatgactttgaatcggtacggccttatgtccatggctttgctgttagacattacgagccagcgccaagtaactggcgtgctcaatacagcgtgggcgatttgctgaaggaatatggcatcattggcattagcgacatcgacacccgcatgcttacccggattattcgccatcacggcacgatgaagggcattttgacgactggttcccagccgctggaagaactgaaagaaatgatgtctgacttgaccattgaagaactgcgcaatcaggttcctatgacttccacacctcatccgtacagtagtcctggcaacggagagcggatcgtattgattgactacggtgcaaaaagcggcattttgcgcgaactgaataaacgggactgcgatgtagttgtcgttccacatgatacgacggctgaggaaattcgccgcttggacccggacggtatccagctgtctaacggccctggagatccaaaagacgtaccccatgccgttcgtacggtagctgaactgttaggggaatatccgattttcggaatttgcttgggacaccagttgttcgctttagcttcgggagcggatacggaaaagctgaaattcggacatcgcggtggtaaccatccggtgaaagaactggagagcggacgctgctttatcacatcgcaaaatcatggctacacggtgaatgaggattcgatccaaggtactgagcttgaagtgacacatattaataacaacgataaaacgattgaaggtcttaaacataccaaatatcccgcgttttcggtgcaatatcatcctgaggctgcaccaggaccttacgataatggctacctgtttgaccgctttctggacatgatccgtgagcacaaaagaaattatccaaagcaaccgcgtcaggctgctatcgccgccgcagtgagaggagagcgctaatatgccgaaaaatacagaacttaaaaaaatacttgtgatcggttccggtcctatcgtcattggtcaggcagcagaatttgattacgctggtacacaagcttgtcaagcgctcaaagaagaaggcgtcgaggtagtactgatcaacagtaatccggcaaccatcatgacagacaccaacatggcagacaaagtatacatcgagccgattacacttgattttgtaacacagattatccgtcaagagcgtccagatgggctgcttcctacgctgggaggacagacaggtctgaatatggcagtggaactggctcgcgccggagtgctggagcgtgaaaacgtcaagctgctgggaactcaactgaattcgatagaaaaagccgaagatcgtgatctgttccgtgatttgatgcgcgagttggaacaacctgtaccggagagtgtaattgtaacaaccttggaagaatcgttagaatttgctaacgaaatcggttatccaattatcgttcgcccggcttatacgctagggggaacaggcggtggtatctgttccacagaagaagaactgcgtgaaaccgtcagctctggcttaagatacagtccaatcggacaatgtttggtggaaaaaagtatcgcaggtatgaaggaagtcgaatatgaggtcatgcgtgacggcaatgataactgcatcgttgtctgtaatatggagaactttgatccagtcggcgtgcatactggcgacagtatcgtcgtagctccgagtcagacgctgtcagatcgcgaataccagatgctgcgctccgcttctctgaaaattatccgcgccctcaatatcgaaggcggctgtaatgtacagtttgcgcttgatccgcacagctatcaatactatgtaattgaagtaaacccgcgcgtaagtcgctcctcggcactggcttccaaggcaaccggatatccgattgctaaaatggctgccaaaatcgcactgggctacacgttggatgaaattgtgaatccggtaacgggacaaacgtatgcttgctttgagccaacactggattacatcgtgagcaaaataccacgctggccatttgacaaattcatttctgccaaccgcaagctgggcacgcaaatgaaagcaacgggtgaagtcatggccatcggacgcacattcgaggaatccatccataaagcggtacggtcgttggaaatcggtgtacaccgtctgcatcttaagggagccgaacagctgtctgatgacgtactccaggatcgcctgattaaagcagatgatgagcggttgttcttggtagccgaggcgttccgtcgcggctggcagcagcaggagattcaagatttgacgaaaattgactggtggttcctcgataaggtagagggaatcgtcaagttcgaagccatcatcgctggagagtctgagctgacctacgaaacactctatcaggccaaacgtaaaggttttaccgaccgctcgatcgccgagattcgcagtatgggccaaaacgacagtatgataaccgagcgtgaggtacgtgaatttcgtctagctcaaaacctgcgtccggtctacaaaatggtagatacgtgcgcagccgagtttgaagccacaactccgtactactactcctcttacgaggtggaaaatgaagtgattccatctagcaaagagaaagttatcgtactcggctctggaccgattcggatcgggcaagggattgaatttgattactccaccgtacatgcggtatgggctattcaaaaagcgggctacgaagcagtgattatcaataacaacccggagacggtatctacggactttaacacatccgaccgcctctactttgaaccgctctttttcgaagatgtcatgaatgtcatcgagcaggaaaaaccgattggggttatcgtccagttcggtggtcaaacggccattaatctcgcagctccgctgagtgcggcaggcgtgaatattttgggtacgagtctggaaagtatcgatgaagcggaagaccggaaaaagttcgagcaacttttatctcgtttggctatcgcacagcctaaaggcaacacggtcacatcggtagatgaagcagtaggaaccgcacaggcgctaggctatccggttttggtacggccatcctacgtcttgggcgggcgcgctatggaaatcgtgtactcagatacggaattgctgcggtacatggaagaagcggttaaaatcaatccagagcatccggtgctcatcgaccgttatatgctgggtaaagaagttgaggtcgacgccatctgcgacggcgagacagtattggtaccaggcattatggagcatgtagaacgggccggggttcactcaggtgactcgatcgcggtgtatccaccacagcacttgtctgccgagctgaaacaaaaaattgtggaaattacaatcagcatcgctaaggaattgaaaacgatcggtctggtaaatatccagtttgttattcatcaagatgaggtgtacgtgatcgaggttaatcctcgctcctcgcggacagttcctttcttgagtaaagtaacaaatatcccgatggcgaatctggctacacaggctattttgggcggtaagcttaaagatgcaggctattcagaaggtctatggcctgagagtaattatgtctcggttaaggttccggtattctcctttgccaaactgcgccgtgtagagccgacgctgggcccggaaatgaaatcgacaggtgaagttatgggacgcgacattcagtatgccaaagccctgtacaaaggacttgtgggggctggtatgaaaattccatccactggggcgatcatcattacagtggcggataaggacaaggaagaagctgtcgagttgatgcagggcttttacagactgggctataaaattattgcaacaggtggaacggcggctgctatgaagcaggccaacattccagtgaacacgatcaacaagctgagcgaagggaacccaaacatcctggatatgatccgtacgggtgaagccaactttgtcttcaatacgctgaccaaaggcaaaacgccagagcgtgatggattccgtatccgccgtgaagcagttgagaatggcatcgtctgcatgacctcattggatacagtacgcgctttgctaagaatgctggaaacgatcaatttcacatccgaatccatgccagtcctgagcaaataatgcgttacgaatagatgtgaggaaataagtagcacagggaaggacattcatcagcttcggctgacggatgtcctttatcacgggcaaatgtacccgaattgacgcgaaaaggggatgtagaacggtgaatggagcatttcagcagatggcaggacggctgatggttgcattagattatcccaatgcacaacaggctgagcagttaattcggcagctagaggggattccctgttatataaaagtaggtatgcaactgttttatagtgcagggccagcttttgtagaacagctaaagtccagaggatactccgtatttctggatttgaaaatgcatgatatccctaacacggtgcggggaggggcagagagcattacccgcctaggtgtggatatgttcaacgtacatgctgctgggggcgttaatatgatgtcagccgctaaagctggtgcagaagcagctatttccgcagacagctcgctttccatgccgctcattattgcagtcacacagctgaccagcacggatcagacgactatgaataaggagttaggtattcctggtacggtacaggatgtagtggttcgttacgcacaactgacccgtgaggcgggattggatggtgtggtagcatcccctttggaagtgcctgccattcgtgctgtatgtggatcagaatttaagacgataacccctggcatacgcccggcaggtagtgctacaggcgatcaatcgcgtgtgcttacacctggacaagccattgcccaaggcagcagctacattgtcgttggacgtcctatcaccgcagcagcagacccacgcgccgcagcggaacacattattaaggagatgatacaagtatgaccacatttaataatatacccgagcaaattgcatcccatctgttacgtatccaggcggtggcattgcgcccgcagcagccttttacatggacatccggcattaaatcgccaatttactgcgacaatcgcctgactatgtcctacccggaggtgcgcgagctgatcgcagactcatttgctgccctcattcgtgagcaatatcccgaaaccgaagtcattgcagggacagctacagcagggattcctcatgcggcctgggtggcgcaaaagctaaatctgccaatggcctatgtaagggacaaagccaaaggacatgggaaagagaaccaaattgaaggccgcatcagcgcaggacaaaaggttatggtcatcgaggatctcatttctacaggaggcagctccattaaagcagcgcaggctgtagcacaagcaggcgctcagccgttagcggtactagctattttcagctaccagctagacaaagcgactcaagcttttgaagaagcaggtgtggagctgcaaagcttgtccaattatacagctctgatgaatgttgccttgcgtgaaggaaccattcaggaagaagagatggaactgctgcgttcttggcgtcaggacccggcttcctttggcaaataagatgagctataggggacaacagagctaatgattagaacgattcgtactcattgctaactattgtagattgttatggctcaggccgtgtaaatcgaattcgatccggttacactactcctaccatcatgtgaaaagagggagctcggatgtattggatttactatggcagactgtacacgactaaatttcaggcaggatgtctggcaaaaaggttggaacacgacggctggatgtatggctacaatgatccccgcgcagtggaggtgtaccgctcgcgcaaaggtcgttatggtgtccgatttattccgtaagtccacaaaaataattttataaaagaaaattttcgaaagactattgacgaaacacaagaaaatgttgtatattaattaacgttgctgttatgaatatgtaacgtgaatatacaaatttttttgagggcccttagctcagttggttagagcggtcggctcataaccgattggtcgggggttcgagtccctcagggcccatttcctcaaaaacccttgcgtagcaagggtttttttgttgtttatagagggttagaaaatggagggaagtagcatttataaggggcgattataatttgctaacatatttgttaacgtgaatttattgtcgaggtttatcgcccttactaagctgcatcacaaatggtaaatctgcaggtaagaaatcatattggagtattgtttctttgttgacccaacgtaattgatcatgatctattaattgaatttcaccagatacccacgttgtccaaaatgcaattaattttattgaaccatgaccatatgaataaacagactctccaaattgttgaccaacctcaatatcaattccaagttcttctttgatctcacgtttaatacattcttcaagtgtttcatcgatttcaagctttccaccaggaaattcccacttaccagcatgtttgttgtcggggcctcgtctggtgattaaaaattcgtcatcattgtgaataatggccgccgtaactaatttcatcgccgacacctcttataatatacataactttaaacttgtcttgtccaacacgagtttgtactaaatcaccaataattacatcagctatccatttctgatccccattaattatttagaaattgtcccctttttaattctacaatttaaatctacagtatcatgttaattccttggaatatgacgatattttacatcttttgtaacgagagctttaatctaagatcttagttcggtttttttccacatagtatcatctgtatccaacggatcagatgaacccaaaccagtaatgcggcgtgttccgccatgttgacttggttttcaaaatccttgctgaagaacagatttaaagcattcaattaattgttctttggatatggtaatcatacataagctcttcagataattgttattctcagtataacagaagctatactttgttatgctatactgcacgttagttgataaaacgacagccagtttatcgtctgccgtcttatcgtgtttattgaactatcgttttcaattagttgaatcataagttatatgtaaaacaactacgtgtaatacccataggcgaaaaaacaatcggaaggaagttatccaaccgactgcttctttgctagcatattaaagtcctgtacccttgcgagaaattatctgttcgacgaaattgttggatttgatcaagtgttagaatatcgtcgtaacgtctctctaaatttcgaatcccacgttgccacaccacacgaatcttcatccacgatatttttcttcactccatctcctctgactcaaatatgaattggaagaaggttgttgcaatccgaaggtatcaatcaaaatcatcttcttcttcaatctttattatccgtcctgttttggcaactacctcaacctcaaatattttgttttgtggtgtcaaaatgaaaatttcataaatgaaaattccattctctaaatccatgcctacatgaacaacttgcccaggcacatttctaagggctatttcttgtgcttgctgtagtgaaattctttgtctaaatacaggaccagaattatagccaataccatacatacaaaatcattcccctttaaaaaattagttcattcatccatatgtatcaaacaggtttttggtgcaaattttacttagttgccagctatgaaggatctgaaaataaaaagatcactggtcatgggaagcaccagtgatctttttgctaatcctagtgtttgaatatggcttggtgaaagtgttgatcatctagtagctacatctaaaattaataaacttaatctcaacttaatctcaattttatcataataataaattgttcattacataccgcaggaggatgactatggtggttgaaaaaagaacagcaacgcgttaatattatgtatccaaaatttaaattaatggaggcacattcatgaatgacatattagcttttgtgatattacttattttcatagtcatgtcaccggggattgattttgcattaatcacaaagcgaacactcactgatggtaaaaaggatggtatcaaaattgcactaggtataactactggtgttcttattcattcgggcctcgttttaattggattcggtttaaacatgatctttagaattcaaagaacaggacattgaatagctatgagaataggggttgacatcagcccgtccataaaaatagcactgccccaataaacggacagtgctatttttaccgtttttatcttaagataccttaacagtgtataccattctcaatttaccgttaccgccgtaaatctcaactcttgcattcgttgcagtagtggtggttaccaccccggaagcggagacggtgacatttccgctcgccactttataagtatctcctgggtaatttgacaacgcataggaataattacgtggcaacgtagccgttctgtagtatactccgttaacttctacgacaggcgtaattaccggagaagggcctacagatgcggacgcgctagggacgataatactcccgataagtcccagagacatagctgttgataataatattttcttggttttcataaaaaaatcctccttatgtatgatgtgagctcctaaaatataccatgtaaagttatagacctcactccatttgacaaaatttgtcaaaataatacaataaaacgattctaaagtcctattaaatacaaaatataacaattaaagaattttattttaagctactgtacttttgaactattctcctagctgtatagtctttgatccacacggaataaaaaacggacgtcagagtgattagctccaagtccgttttgtgtttgtatctagttagttcttgaaatcagtttacaagttggtgtgcaagcctctcatcgctgtctagattcctttctacgatacgctgttttaatgcagacagttccgcacactgtcgaatggcttccgctacaagctgggcgacctgtttggctccttcgtcagaaaaatgggtattatctgttacaccagcggggtaattaggatgcgcttttttaggcaaatgcataaatagctgctgtgactctttttcacccattgaacgataaagctgctgagaagcttcaaaaatatcgagcaggggtgtcttggtttccgcggctacttttttcatggcagcaggataggctcctacagccaacggatcaggttcaccgtctgcggtgaatcggcggcggcttacagaggtcaatagcactggaattccaccacgctcccgagcggactgaatgtattgaattaagttttgacgatactctccatcaggatcggtatagcgagtggggtcttcttgtttctcatcgttgtgtccaaattgaataaacagataatctccagcttgaatatctttttcaatatcagctaaccggccttctgctataaaagatttggtgcttcgtccattgacggcacgattgtccacatgaacagacggtgccaagtagctttgcaagtgttcgccccagcctgtcatcggtttttcggtagcccctttttgagctgcagtggagtccccagcgataaacagtcgagttgtcatctgttgccttgcctgagcatatccatgtttttgaagccaagtttccgccagattaagccattgatggcattcatggttgtcctctgacagtcccaatccgtgtcttccttcctcaaatacatgcagttcaaacggaatatgttctctggataatgaaaaagcgaacaacagactattttctactggtacagcgccatcattagctgtagtccacatcaaagttggaggtgtctgtgaagttacttgctgatcggatgaaaaggcttgaagctgctccggcgtcggctgttcacctaaaaaatgtgtacggcttccgatatgtgtataaggctcatgaaatgaaattacagggtatcccaacaacagaagatctggctttactgtccctatagtggagacaatggaggccaagtgaccgcctgcagaaaaaccgataagccccacttgatcaggaatgactagccagtcatgcggtgtttggcgaatccattgcagagcatgttctacatcctccaacaaagaagtaatctcgaaatcgccgacttgatactccagcacacccgcatgaatacctagatcattcaaccaccgagctataggctctccttcatgtgaggccaaatgctcgtagccaccgccaggtaataccaatataaaaggacgagcttcacgaactgctacgggatagagggagagaaaggaagtgtctgacagaaattctccttttataatcggttctttaggactaacaacatgtaacataagtaactcctccaaatttctttttaactgccgcaaaccaaacaaaatcgacttaaattggaatgatacggatgtaaaaaataatgcacacgtgaaaaaaatgatttaaaccttgttatgaaagcgctataattttgatgtgaagcaaagagccagagggggagcgcaatgaaaaaaggaagaatgttctacactatttttattacgattctggttttgggagtaggattggtggccagttttggcagctacatctattttacaacaattagctccgttgtggagagagtttccaataccaagcaaagctacatggcacagatcagaaatagtctggagcagaaaattcaaacgattgaatatgcttttaatacgtatagcacgaccagttcctttaatgatgttgtgaaaaatcccattacagaaaaagattttatagcgtatcggaatgtgaatactcagctcaattatattgctacgatgggattagaaggaacggaatactcactaatcagtctggatcagaattggagaatctccaatggaagcctgtcctatttgacgaaagcggaacgagaaaagctgattagtacctatatcgaccaccaagagaaggggctattctgggttaaaacagataaaggaattcgttttgtgaataccttgcctgtattctctaagaagaagcaagccattgctttgtcggatatttcgctgcaaacgttaaatcatacgattcaaaccgaggatcatatggctgtttttattttgaataaacaaggcgatttaatgtatgaaacccagcctgctgaacaattattgtccacccagcagcttcagcacatttcagaagctacagtgaagccgaacaacacaggtatgttaactttggagaaaacggatcagcagcctgcacgacaagtcatttacgccaaatctgcctataacaattggacttacttaacggtattggataagaaagaaattgcggatgcctttcaaacgaccaaattcggaatcatcatgatgggacttgtattaacgctcttaatggtggtagtggcgtacttcattgccatttactttacaaagccatttcagcaaataaaacgaagcttgcctaaaaatcctaatttcgctttcaaaaatgaaccttctaaaaatgaaattgaatggattattaattccatcgacaacattgtaaccgagaaggaaagcttggaaagtctcattcagtccgaaatgccacagttggaaacccaattgattctcaacctgttccgcaaacgtatttctgcagaggaattggcacgaaaaatgccacgcctgggttatccgcagatcgagaatcaaatgtatattaccttgttagtccaactggataatctgggagatcgagagccctcggataaagacgttttgctgctggctattaacaaaatcgtagaagaaacgattccagagcagcagcgaatgcttcccatcattttgaacgataacactcaggccaccatattaattttgacaggtaagagcgaacaggaaatgagaaagcaagtcctagatgatgcgacccttttagttcgaaacgtaaaagagtatttgaatgtatccatcagcatcggcattagtacggtgtatgataacttattagaaagtaaagaagcctgtgagatgagcaagcaagctttgcatcaccgtttaaacttaggcaaagagtcgattattttttatgaagatatttccatggtcatttcaggtccggtgctgcttcattatcctacggaattggaatcaaaactgtttgatgccatccgaataggggacgaagagcaggtatatcataccgtgcactctttattagaggaaatgatgataaaaaataatcattccatgaactttgaagtgctgttggtacggtttgtgaataacctcatccaattggagcaactattagggattgaagtgctgctgacgcaagacaatcatgccttgtatcatcgtttgctggacatccgtaacccggaagagatagaacgtatgctaatagagcaagttattttccccatggtaaaaagcatgaaagagaagaccaaccagcaattccgttgtctctcggagaaaattgctgctattatccgtgctgaatatgaccaggaattatcattagaactcattggagaccgacttcattacaatccgaattatttaagcagtattttcaaaaaagaatacggaacgacgtttagtgaatatctgatgggctaccgcttacaaatgggcaagaaatggctcgttgagacagatatgacgattaaagaaatcgccgagcgactgcaatatcataattcgcaaaactttatccgctcttttcggaaaaaagaacaggttacaccgggagcttaccgaaagatgaagcaagccaattagccttttaccgcgcctaataaagctcctttgacaaagtgcttttgcacaaatggatatacgattaacatcggaacggtcgcaatgacaatgaccgccatcttaatcgtctgcgcaggcgggatgacatctacagcagttccttctgcctgcataccactggaaacgattacaatttgtcgtagcaagacttgaatcggccatttggcagaatcattgatatagagaatggcgtgcatatacgtattccagtaggcaacagcgtagaatagagagatggttgcaatagaaggcagggctaatggcaacataattttaaagaagataccaaaatcgttgcacccgtccatcttggctgattcctccagatcatctggcagcgcctgaaaaaagttacgcatgataatcaggttaaacgcattaatggccacgggaagaatcaaggaccaatacgagttgataagccccatgctttttacaaccaggaatgtcggaatcatccccccactaaacaacatagaaaacacgacaatgaagttaatcgtattgcggccaagtagatatcttcgggataatccataagccataaaagcagtaaatatcatacttacaactgtaccgacgatcgttactccgaccgaaaccccgagacctctaaaaatggtgggagtcgacagaatatagcggtaggcatccaaggaaaaagtaactgggaataaaatgaacttcttggctatcacctcttcggttgaggcaaaagagctggcgatgatattcaaaaaaggtaagagacaagtgagggcaatgagaatcaatagtgtactgtttacaatgttgaaaatacggctgcccagcgattctttttttcgtaatttttgttttcgtaatggctgtgtcaatgtggttgacctcctcgtaatcgtttacatgtcaactttatcaagaggaaagaattccgtatataatcaaatcttgaggtgttctctaatcatggaaataagcggatgctcattaggttgtgtagtaatcattagctaaggtgataaggttgaaaagtaggctgcacacccagttttgtaaacgctatcatttgatgattatatgcggaatgccgaaaatcgcatactcttgaaaacgtatacaggaacgtttgaaggaggtcgaactaatgaaagtttcaagtgtccccgcaccaaacatgaaaatgaaaaagaacaaaagaacgacggaaagccttttacgaatgcagaaacacaagttgctctatttaatggttttacccggactggtgtacttcattatttttaagtattttcctatggggggattggtgattgcatttcaggattatcaagcttttcagggaatcacgggcagtccatgggtaggaatgaagcattttattcgtttgtttaccgagcctacgttttttatgctgcttcgcaatacgctggttttgttcgcattgaacattgtaatcttttttccattgcccatcattttggcactcatgctgaacgaggttaggaagatgttttttaaaaacattattcaaaccattatctacatcccgcactttatgtcatgggttatcattgtttcgatttcttatgtattcctaaccgtagatggtggggtgctgaatgaaatgattgccgcgctaggcggtgagaagatcagcttcttaacttctccccaatggctgcgaaccgtctacatcgggcaagtgatttggaaggaactcggctggtctaccatcatttatttatctgcgattacagtggtagatacgcaattgtatgaggcagcagagatggacggagctggacgcctgagaaagacatggcacgttaccttgcctgcgattcgcccggtcattattacattgttaattttgaaaatcggtagcactttggatttgggctttgagcatatgtatctgttattgaactcattaaatcgcgaggttgccgaaatctttgacacctacatttatactgcgggtttaaagaatggacaattaagtttcagtacgacggtaggactttttaaaggtgtggtaggtttaatcctgattatgggctccaatcgactggccaagaaatttggtgaagacggcgtttactaatgacgacgggaaggatgcaaaatggtacggtttgtagaaaacatgaacaaatggtgcatgcgcctgctgcgcctggtctaccttaatttgctttggacggttgcgacgattctaggcttgggttttataggtgtcggacctgcgaccgttgctatgcttagtattttaaggcagtggattcggggcaatgaggaagtcgccattttctcgacgtttgtacgttactttagagaaagctttaaagaagcagcaatcattggcgggctttacagccttgtgggttacgtactctacgtggatatagtcaatgtctcgtcctggtatgttcgtgtggtgacgcttattggagcctttttgtatctcatctctttggcctacattttcccgctactggctcactatgattggaaaggtatcagactgaaggtcaaaatgtcgatagtgattggattttcgtatttacaatatacgcttgttctttttgtagccattgtcgtgctttttgcattgattctaggcttgtacccaggaattctaacttttgccggagcaagtattatgggttatctcgtgatgtggatgacgcatcaggtgttcagcaaaatagagcgagaggttctggtgaaagaggaagatatggcataaatatataaacagaagaggagcaaacacgatgaaaaagggaatcacgacgaaaaagggagtatcgggccttcttgctgtactaatggtcatgagtgtttttttagctgcttgcggtgacaagggagctgaggatcaaagcggccaaacctatgatccgaagtccaaactggaatttacctggttaaacgtattgcataccgcttctccgcctacagaaacgatcaaaagcaaaattgaagaatacaccaattctaaaatcacgttcaattgggtgcctgacgcttccaaagaagagagaatcactaccgcgcttgcatccggcgaattggccgatatggtgacgctgacgatgatgacaaattcttcagtacgaagctctttgaaatcagggctattctgggatgtaggaaagtatttggatgattatgaaaatttgaagaagatcccgcctgaagttcgggaagccgcatccattgaaggggtactgtatggcgttccgttccagaagaatctggctcgggcgggtctagtcattcgtcaggattggctggatcgcttaggactgaaggtgccgacgacactggatgagttgtatgaagttgcgagagcgtttacagaagatgatccggatggaaatggaaaaaatgatacgactgggtttgttgacagatcagatctacgctacagcagcttcaaaactttaagttcctactttggcacacctaatggctggaaagtagatgaaagcggaaagtttacgccagaatttgatactcctcaatatttggagaccttaaagtattccaataaattatacaaaaatggatatctctctaaagactttgctgtaaccgctaaaacggatcagcagcaacaatttgcacaaggtaaagcaggtatttatacaggcatgatcgatatctctaacctcagaaccttgtctcaaggcctacaaaagggactgaagctggtaccggttaacaagatttcgaatggagatggcaaataccatgtatggtctgaaggaagcggggtaggaggtttgctggcatttccaaaatccgaagtaaaaacagaagctgagttgaagagactgctgcaatttgtagatgatttaattgacaaagatgtatatatgtatatgaccggtggtattgaaggcactcattataaaatcgaaaaagatggagccttcaaaattacgaatacagatttgtggcaagcagatgttcagccgttttcaagctccagaccaagtgaagtgacctataacttaaaagatgccaatccagaaaaggaactggctaatgaattagtccgtgaaaataatgaatttgctgttctggacccaaccgtgccactggattcagtcaccgctaatgagcaaggaacagagctggagaaaatcattaccgacgcctccttcaaatttattatgggcgagcttgacgaagccggatttaaagcagccgtagaaaactggaaaaactccggtggatcacggattactgctgagtatgaggaagcgtataaaaaaacgaaaaaataatagctgagtatggctgttgcccccagactccttgaatgatttcttggatgttgaaacccgggggcagcttatgctttcccaatacaaaatggatctaacatccacaaaatataaagacaggagagaacgaaatgcaattgtataacattgtagattatggagcagttcaggatggtacgacgttggctacagaagcgattgcggctgccattgaagcggccagcaatgctggaggaggaaccgtttatgttccttctgggacgtatctgacaggagctatctttctgaaaagtaacattgagctgcatgtaagccctggcgcaactctgtccttcagtacggaactggctgattaccctgtagtagaatccagatgggaaggcgttcagcgggaagtgcatgcgtcatgcatttatggacagaaccttgagaatatttcagttacaggtagcggaacgctggacggaaatggccaaccgtggtgggaaaagcaccggaatcatccagaggagttacaatatccgagacccaaattaatcagttttgaccgttgtcagcgggttaccattaaagatgttatgttaaaaaattcccccagttggactgtaaaccccatcgcttgctataacgttacgattgataatttgtccattcttaaccctgcggactcccccaatacggatggcattaatcctgaatcctgttccaatgttcgtattagcaactgcaatatagatgtgggcgatgattgtattgccatcaaagcaggaaccgaagatacacaagagcgaattccatgtgaaaatattacgattaccaactgtacgatggtacatggacatggcgcagtcgtactgggaagcgaaatgagtggtgatattcgtaatgttacgatcagtaattgcgtgttcaagcaaacggatcggggtatacgtctgaaatccagacgaggacgtggcggaaccatcgaggatattcgcgtcagcaacattgtgatggaagatgtaatttgtccatttattctgaacctttattatttctgcggccctcggggcaaagacaaatatgtgtgggataaaaatccctatccgattaccaatgaaaccccatgctttagacgaatccatttttccgatattacggcacgacaggttcatgcggctgctggattcttatacggacttgcagagcaatatattgctgaaattacattttccaatattgatatttctatggctaaaaatgcaattcccggtcgtccggcgatgatgacagggattgaagatatgaacaaccgtggtttttatctaggtaatgtgaaggatattcgttttcaacatgtgacgattgagaatcatgaaggtcctgccttttacattgaaaatggagaagacgttgaaatcaatcgttgtcattcgaagaatacagctcagcccgaaaagctgatagaacaagtaacgatacaaccttctgaacgaaataagatgaattaggagggcatgaaaggaggtacaacgtggataagttgcaagcattgttgggcgaccttccggcagatcgccctgtaacggcaactctgctgaatcaagaagagcgcgagggataccgactggagtgtctcctgctcgacttgaacgggatcgagtctgtacccgcttatgtagctgcacccttacaagggaacggtccgttcccattggtcgtttttaaccattcgcatggaggcaattatacgaacgggcgcaaggaactgatccatagcagctcttacttgcagcagccctcgtttgctacaaccctgacagacatggggtactgtgtgtgctgtattgacatgtggggcttcaatgaacgtgggggcaaaaccgagagcgagctggtaaaggaaatgctctggcagggccaagtgctgtggggcatgatgctgtatgataaccgtcgcttggtggattatatgtgccagcgtgaagatattgatgcttcccgtatcgcaacaatcggtatgtcgatgggtggactcgtggcatggtggatggctgcgttagatgaacggatacaggtgacggttgatatttgtggacaggtagatgcccatacgctaatcgccaaaagggggttggatcatcatggtttctattcctatgtccctggcttgttgaagcattttaccaccttggatattcaaaagcggatcgtacctcgtccacggatgagtataacaggtcaaaatgatcggatgtgtcctattgagggagtcgagcatttggcaaaaggtctgctggaagcttaccaggaagcaggtcaccctgagcattggcagcctgtgattgcgggcggtggacatatggagacgttggaaatgcgaacggcgtggcagttatttttagctgaacacctgtaaatcaaatgaaaggatcggggtaaccatgctagttggaaaagaatccttttgcgatttccatacgattcaggaggcgattgctgtattggagcagtcggattccaacgaaatggaaacgctaactattttatcaggtacttatgaggaagaggtgcgaatttaccgttcatatcttcatattataggcatcggacaggtagagattcgaatggatcggtatgccaaggagcaggatgaagcgggtgaggaaatagggacctttgccacacctactttatttttaggtggtagccatctgatcttggaaaatctcacgatttccaacacggcaggacagggagaagccattgggcaggccgttgcggtatacgctcattgtgatgaaacggtctttagaaactgtacctttaaagggcaccaggatactttatttacaggccctctacctcctgcaccgaaagaacgactccagtttggtggaatccatttgaaggagcatcataggcactatcggcagctctaccagcattgttatatagaggggacggtggactttatttttggtggggctaccgcgtattttgaagattgcgagattcgcagtttacgccatcatgacaaccaaacgagctacgtcacagccgcctctacgccgcaaggacaagcgtatggttatgtattcaaccattgctacttaaccgcagaagctgatattaccccggtttttttggggcgtccgtggcgggagtatgccaagaccgtatttgtcgattgtaaaatgggcgatcatattgacccacgtggctgggacaattggaacaatgtcgcgaacgagaaaacggtctgttatcaggaatataacggacccgatgaagttgctacgttacgtaagcaacgtgttccgtgggcagattgttttgaaacgggaacagaagtatggagcaaggaacaggtatttgatgaagtcacattttggaagtaaggagaagtgaggtctcatgatgatccaaaatcccatattaaaaggctttaatcccgatccgtgtattacacgagtcgaggatacttactatattgtggtgtcatcgtttgagtggttgcctggagtacgggtgtaccagtccaaagatttggcccattgggaacattgcacagatattttgaccgatcaggttgatttaagaggaaacccgaaaaattgcagcatttgggcaccgcagcttagctatgcggatgaccttttttatctgctctatacggatgtgaaaagcaccaaacgtccgttcaaggatgttcataattttgtgatgacggcgcctacgatccaagggccttggtcggaacccgtctatcttaacagtagcggatttgatccgtctttatttcacgatgaggacggacgcaaatggctgttgaacgcattgtgggattaccgtatgttggaaagcaataaatcttccggtatcgtcatgcaggagtatgacagcaagcaacaacaactcattggcgagcctgttaaaatctttgattgtactcctttgaagaaaacagaagcgcctcacatctacaagcaaaacggttattactatcttgttacagcggaaggcggaacgggtacggggcatgccgttaccgtagcacggtcgaagcagatatccgggccatatgaagtagacccgcacaaccccatgcttacgtcacgtgatcgactggatttcccgttacaatgcgcaggacatggcagtcttgtacaaacaccggacggcgaatggtacatggctcatttatgcacacgtccagtagaggggaaatatgccattttaggacgggaaacagccttgcagcaagtgtactggaatgatgaaggctggctgcgattaaccgctgggggccatacacctcaattggaagtgcccgcacctcaagggaagttctcggttaatcaagagcagcagagttatattttcgaggattttttcgagggacccacattagataaaacgtggaacacattgcgtatcctggcggatgatagctggtgttcattaagccagcgccccggttatcttcggattctagctggagaatccattcaaagtctgttccagcatcatgtgcttgccattcggcaaacggatcatcatttccgggtggaaacagcattggagtatcagccaacaagctatttgcaaatggcggggcttctactgtaccttaatgaagaagattatttgtacgcctatattagctatgaggagggacaagggaaggtactgcgcataatgcgatgtgaagccaacacatttaccttagttccccaagcgattacgcttcaggacgatcttcctatacatttagctgtggaagtccatgcatcccacgggcaattttattatggagtcggagacaaacctgcgtggaagcggctttttgaaatgcaggatatcagctttttatccggtggttttacagggaattttgtaggtattgctgctcatgatatgcaacaattccaaggaagctacgctgatttttctcatttcttatatcagggtaaggatcatctttcctcataaaaaacatgataatgaatatgttgaaagcaccttaatgggtgctttttttcatggtttctgcactttaccttttcacattataacttcgcaaaatctccaaaaaagcggtgcttgctttcgtttcaaatgtcgaagaaggagttaggaaggagaattttcgaatgaccggaagattatgaatatccagtacttttaatgtgcccagagcaagttccttctgaatgacccattgggacagcaaagaaatccccaagcctgcttctacagactctttgatgatctgtgtactgccaaaattcatcatatgagaaggggagaaccgaagccgtgcaaacatcttttcagccgcttcccgggttccagaaccttcttccctcagaatccagatgtcctcttgcagctcacttaaatccacttgagatttacccgccaaacgatgattttgcggaacgacgatatacattcgatcatcagcaaatgattcaatgtgtaaatggtcatgctgaaattctccttcgataatgcctacatccagttgattatggatcatgagtttttcaatttcctgagtgttgccgatggtaatcgagggctgaatgagtggatactggattctcatttgcgcaatcacgtgcggcagcacatattcgccatatgtgtagcttgcgccaatcgacaggtttccttttgccgtatgtatcagctcgtccaccaaatattgcatccgtgtatggagacggataatctcctgagcatgatgatacacaatttcacctgctttggttaagcgcacatatttattactacgctccaggaggcgggtccctacgctacgttccagcgtttgaatatattgacttaccgctggttgggtcatgtgtaacacctcggcagctcgtgtgaagttttgtttctccgcgaccctaacaaatacgattaaagattggtccaaagcccattcctccaaatacgtcatatctatttacttattatcattattataatgatttatttttcttatgacaaaaaacatattaagctggatgcatgtagaattggaggggttcaccatgaacagtcatacacaacacaccaaattattttcgaacagagggcgattattccagcgtatatttggcattatcttcacgatgttatttgctttggcaggctacggcctgaacgaattgccaggttttcattatgtaggtccattggccggtgctatgtttctcgctattctgtaccgacagttgtggggataccctgaagctgtgcgctcgggggttgagttttcagcaaagaaaatactacgtggagcgattgtgttatttgggctgaagctgaacatggatgttgtcattcatcatgggttgggtttacttttgcgtgatgtgggcaccgttgtattttccatcttttttacggtttggctggcaaaacgttttaaggcagatgcttcgctttcgcttcttcttggtattggaacaggagtttgcggtgcagcagcgattgcagcggtttctcccttgttaaaatccaaagatgaggatacagccataggagtaggactcattgccttggttggaacggtatttgccattttgtttactgtgcttcgtccctggcttcctttgacggatatgcaatatggaatctggtcgggcatcagtttacatgaaattgcacatgtggccttagctgcagcgcctgccggacaggatgctcttgcaatgggtttattagccaaactggggcgtgttttcttactcataccgctcagctttgttttaatggtttggatgaaacgaactggaaaaattcgtacagacgctaaagtggagtttccctggttcctcatcggctttatggctacaagtattgtgggtagctatgtttttgggaaatatattgtagtttcatctagtctgacgaacgaaatttctcaagttaccacctttatgttaacgatggctatggtaggtatggggctgaatgtgagctttaaggctttgcgggagaaagcaatgcttcccttactggtactatctgttacctcgatcattcttatagggttaacatttttaacagtgtgaacatgaagtattcgtttggtgataagattgctagtaaactagattaataaaactgaaaaaagctctgcttgctgtatagctggcagagctttttagtacttttgtatgataagactgaaatatgtactgaatcaatcgtaacttttaccatatgattcgcgtctatcaaaatagaggtcctgagaatcatagagtgcaagaatttcataagcgaaaatatagagattggtaggttacataatgaagaaaatttgtttatttgcttttttgtttctgtttctactagcatttccaagagaaagtcatgctgcatcttcgagttcacatcttcagttggatggtaaagatataagtgttggcaaaggtgttcagattcaagaagtaaaggggaatgtactggttccactccgtctcattgtagaggaattgggttatagcgtgaattgggagtcgaagacagggaccataactatacataagcaaaatcttaacctcagtcttcaggtcaacaatcccatagcctctgtcaatgatcatcaaatgggattggctgtagctcctttgcttaaagaggggacgacttatgttccgcttcgctttgtatcggagcagacaggaatgaatgtgacctggaacaacgagcttaaaaccgtgttcctgacgactcctcctacttcaagcggcaatagcgagtccactcatgatcatcctactactccagctgtaagtaatcctaaagagagtgcgcgcacggctataaaccaaattagcttcgctaatcaccaattaactataactgttaatggaaaagtaacccccaaagtaaccacgttgactcatgcagaccgtattgttgtagatataccggatacaaagtttgctgaggaatttccatcctcgcaatcttttaacaatggtggacaaggaaggttttcagtcacagaagatccagatgtttcccaagtaagatactccatgtttagtacaaacccagcctcggtacgcatcgtggtcgatcttaatcagagtacaccctttcatgtactcaatgcggatgatggtaaggtggttatagcgttggatcagcaaacagaggagccatcaactaccgagaacgttatacctaccatacctgttgtacctgagatttcttccgatggacacgcgcaagggattgacgtctcacactataatggcaatattgattggcagcaagtggcggcggcaggcaagacatttgcttttattaaagctacagagggcacaaaatatcaagataatcaatttttagtaaatgtgcagggtgccagagatgctaacatcctggttggcgcttaccactttttgaacgctactactgcggatggagctcgtcaggaagcagctaattttgccagggctatagattcagcaggaggcaggctggatttaccccctgtgatggattatgaaaataaccccaaaggtcttactcctgcacaaattagtgaagtggcgcatgcttttttggatgaaatggagaggcttaccgggcgtcagccgatcgtatacacgggcaatgtctttgcttccaagtttgatcctacattttctatgtataagctgtgggtagcccgatacagcactacgcaaaagccgaccgcagtcccagcttggaatagctggtgggcttggcagtacagtagcacaggcagtgttccgggtattcaaggccaagtcgatttggatgaatacaacggaacgatagatgaactccgggcttcactggcaggagagcttgattagcataatcaacgttataatcaatcctcgcgaatccggaataggatctgcgaggatttttaatgtctaatttgtttagttgggcatgatccatacgatttcgctgattcgaacaaagaatttttttccgtatacatctaaaatgacatgatcaggcttacaatccactacacatccatcaattctgccacgtgtggtctcaagtacaacgtacttgccgatcaccgattttaatgtttctacgacgtacggatctacagggtgcaccacgacgtggtgagaggtaggatggtgggggaaaggttgattaacgttgtaattgagcatttgatttgaattcaattgcttcactccttcaagattagttgtgttatcctatgctcctgcctaggaaaggtgtaggctaatgcccatcagcaaaaacattcataacattgccgaaaagcccggtccgtaggaaagctcaatacataagctatgttgtaccttgaattgaaggaggcaatgaccatgagtgaatgtgaaagaggttgtggtggcggttcagtagggggctacccaggagtatggacatcgacaggagctattctggtactgttcattctgctcgttatcattacgaagtctttatgggtttaaaatgaactgagtagcttaaccccccattggtatataaccgatggggggttaagtgtattagaggatggaacgtatgtaaaacacctcaaataacagcgtacaagccctacacaaactgtgccgggctgggcagctgtcatttgagttacattggcatctatagacaggaacggacaatggatcaggattaaattaacgcaatcgccagcagggtgaacaggctcaaagttaagatttgattcccatacccgtagccaggataaaaggcagacgtttgtacacgtccgttccgttctgtttttaagtacacattattacgatccacatccataatggttccttcgtacttttttccgtcaatggtgagaatacgcacctttttattcatgcagttcaaacagttgtagtaagcgtccattccatcaccccctcttatacattggcattttatgagagggacggtcttatggtaacggcgaacatacagggaaaaggtattcccttcaacttaagacctgactagagttagcctattcttgatagggattaaaagagaagccgggatatccgttagtataggcgtaatctctttgggggacgacctgagggtgtgatgaagcatcagcaagccttacatgtatccctggttttcgggggggctgctgcttgcagtcattgggaggaccgatgatgacaggttttttaataggggcgagcgcttcctgaaccttattctcatccaggcagtaagtatgagccagaatgttatttggcgttaggcgcaaaatgtcagatcccagtatgaattcaggggtcggggcatcaaaaatcgtcaacaaatgagtgttatccatcgtggcgaccagataatgccaccatccttgagggacgttagccacttggccaggtgtgatcggaaaatgtcgtaactcacgggtaaaggggttaatcagtgacacggttactgctccagagatgcagtagaccagttctgtggcattttggtgatagtgaggctccacaacattagcagtgctgaggcgaatatccagcagcgatacatttgctaatgtattcagctgctggatcgacagctcgttgatcgaattttgagcatccttctgaaacaaaacattgtcgcttaaatcataggtgaattgtacagtaggagaggtgtaatccatatatgaattcacgcgtcgtttccagcctttctgttaatcaagatttgatgatcgtacgctaccctatgcatacgcctatatatgtgtgcgcgcaaatatgatttgaattagtagaaatcaggctccgatcccgggaaagttgaagcgaaaaatagcgaaaaaagtcacgtattcaagtgtggtcagtacatgattcattgcttttaatacacgtcatccctttagggatggcgttttatttgcttgggtagtcttaggaccagagccggatgatacgtaaatgcggcttgtggtatactgcaacggacgtgtgaaagcttgattgtcccattccgtatgtagccacgcgtcatttctgcagctaggcataagttatgtcataagaaacatcatcggataaacgtccctgagttgtacaggccggaatggttgcaccggacagaacatgaaagaggaggttgtctggaatatgaaaaaattatctattttaatcctgtcctgcgcatgtatgttaggtactgtattgtcagtcgcaccaggacaagcacaagcacaaacgtcagctttgaagaaagggattcaaagcgaacgggtgctggagcttcaacagcagcttcattcgctcggttatttcaaggctgggtttactgggtactatggttctctgaccagtaaagcggtggctcgttttcaacgagataatggtctggcacctgatggagtagccggagcggcaacacaagccaagctgaaatccttcggagaggtgcgcgtaaccgcgctggatcaactggctcgtatcatttattctgaggcgcgcggagaatcgtttgaaggtcaagtggctgttggcgctgtcgtattaaaccgtgtgcagtccggcgagtttccaagctcgatcccggacgttattttgcagcctggccaattcaccgctgtacaggatggtcaataccgcctgaaaccaaacaagacggcataccgtgcagccagacaggcacttaatggtgctgatccaaccaatgggtccttgttttattacaacccggccattgccacagccaaatggagtaaaagtcgcccggctgtcatctcactcggtcgccatacgtttacgaattaattgcaaatgagaatacgcaaatttccagccgtcagttgcttcttctaggagcagtgacggttttttatattcacaaatttgtaatattttagtggcgatttatctgatttaatattaaaaattctacctattattccgatactcttaatagacaaaaaaatgaaatcaaaggagtctttctaaatgagtcaacatccttacactatcgaagtcgatcaagccatgaaaacggtacatatggcggtgaatggagtttttagccaggaggagtatgatagctttgtaaaagattatgtagccaaaacttcatccattcaggcgtcaagctttacactcaaggtagattgtacccagatggcacttttgggtccgggagaagtggaaaaattgaagggctcatttgtacgttacaaagaaactggatttgccaaagtaatctttggcatcagtcttcaacaaaccattattaaaatgcagcttggtcgagtagcacgtgaagcaggattaaacaacgtagatattgtcgtacaataatgcgctgacgtatgtgtaagggggaaacctgatgagccatatcaaaataaaagcactgggtgtgtaccatccgccccattcgttggataacgaatattatgttcgccattttgacgagcggggcaaagatattcgacgcttcatggagcatatgggtagaaaacagcgttatatcattgatgatccgaacgaaaacggcctaacaatgggaattgcagctgcgcaaaaagctctggaacaagccggtatgacaggccgtgatgtggatatgatcgtgttctccactcaagttcctgagtcactgtttccgatgaatgccttatttgttcaccaggcgattggggcgagacatgatgtggccgtgatggattccaacgcgaattgtgcagggatgacagtcgctgtcgaccaagccagtcggtcgatgctatctaatcctgacgtgcgggcagcccttattatcggttcagattataattcactcatttccggtccggaggatgagattacttatgcgaactatggagatgctgcatgtgcggctattttggagcgtacagaagaagacaccggttttatagattcaatgtattttacggacccagtcaatatagataaaattttgtacccggctcaggggttagcggcaacactccaaaggaacgcccccggaaaatatattcagtggcttccgtttgacgccaatatggccttacctcctacatttgatctgcttgaacgcattttaaaaaagaatgggttgacgcctcaggatgtacgggcttattgtctgtctcagttctcgttagcaaatgtattgaagattcaggatcacttggagctagaggatgcccaaatgatttatgtgggtgatcgatatggttacacaggtaccagtagcccgttcattgcgctatatgaaggtattgaatcgggtcgtatccggcgcggtgattatgtgctgttctggacgattggagctggataccagctggttgctatgttgtttaaatattagttatgcgaagaccttgcagctgtaaggtcttttttgtgtgtcacacaatgacaattgtaatgatttggttgtgctatgtttgattattttgtaaaatttaaacattgaattaaaagggagagcttatattgcggacatcggatagcatgacaattatgacggaaaacatggcacacaattcataataggagctgaagagtcattaaaatcgaaaatttgttttatggggaacgaataaaattggccgcagtcagggaagaagatgccgaagtgatgttcaaatggggtgaggatgcgaagtatctgcgaaatgtagatacggatttggcgctcccctacacgttgaaacagatggagtcagaaggatctccccgctctaacgaggtctattttcgattaagaacattggcagatgatgtcttgatcggatttgttgctatccacgggattgagtggaataatcgcagcggacagctagcaataggtataggtaatacggactacctcggcaagggctttggggcagaagcggtacgtctcattcttcgttatgcgttttatgagctcaatttgaatcgggtcggcttggatgtgattgagtacaatacacaagcgatccgaacttatgagaaggcggggttccagcttgagggtagagttcgttccgctgttcttcgtgatggtaacagttatgatcgtatcatgatgggtatcctgtattctgaatggagctcgactgttcaaatataatagatacacaatttgttcataaaatattccataataagccttttaataacgtgaaaagaggtttatagttaaggggtcacatgcccaaatcattattaatttgagtatgagtcaaagctgaggaggaatttacatggcaaacgttgtaaggtccgttacttcacccaagaaatttatttctggacaaaatctactctcgtcgttaaatgactatattaaggattatggcgataaagcctttgtcatttgtgatgagttcatacttgaaagggcccaaaaggaggcaggtgcttcgattgaagcagctggtaaccaggtggtcttcgagaaatttcaatatgaatgtacaaaagaagagattgatcgtaaccgcgaattggtgcgtaaacatggttcgaacattatcatagggattggcgggggaaaaacattggataccgccaaggcaacggcttattatgaaaagctgcctgttgttattttcccaacgattgcttctacagatgctccttgtaccgcgcttgcggttatatacaaaaaagatggctcttttgatgaatatctgttcctgcctactaatccagacgttgtactggcggatacaggcatcctggcagcagcgcctgcacgtttctttgcagctggaatcggtgatgcactggccacttattttgaagctcgtgcctgctatcaggccaatggagataacctggttctgaacaagccttccactacaggactgggacttgctcgtctttgttatgatacgttgctggaaaatgctgtgaaggccaaacgtgctgtggatcgtaaagtatatactcgtgcggttgaggatacgattgaagctactatttatctgagcggtgttggtgcagaatcaggtggattggcagcagcacatgccattcataatggcatgacggctgttccttcgctccataaagcacagcatggtgagaaagttacattcggtttgttaacccagctagtgctggaaaatgcaccgaaagaggaactggaaaccgtgattaaactggtgaaggatgtaggccttccgttgacgcttcgtgacttgggtgtagaggaatttgttgaggctgaatggcgccaagtggctgaagctgcttgtgcatcgaatgatacaatggtcaacatgccgttcccggttagtcctgctgacgtgtacaatgcaatcattgcagcgaatgcaatagcagaatcctatcaagaatagtttcttcctaaatcacgaaaatgggtttacaaaaacgggtctgtcacatcactggcagacccgtttcgtttacgtgcactaacttgtgaaacaaaagaagggaactgaccccataac

SEQ ID NO: 52 - DNA, 58412 bp, Unknown
  Kingdom: Bacteria, Phylum: Firmicutes, Class: Bacilli, Order: Bacillales, Family: Paenibacillaceae, Genus: Paenibacillus
caaacgggggtcagtcccaataggacctgacaggttcttttttgttggaaaatcgttctgatttgccaatactttacgtataatgaagaaaaaaataagaaaatccttttatattctcgtcataagacgacaacattgcaggtatgtattcatatataatagttttgttcatgactatacatacatggttttgtaggaaatctctttccggtgaccaagaataataaagtgaggttagtgctgaatgaacaaggagacagaattaggggtgaacaaccctctttttcaaaacaacgcacggaaagtagacaaagccgctatcgacttggacatccgggacattttgctccaatgtgggttcacgatgccagaatggctagaaaacgacactgatggaaccacataccggaaggacaagcgcgagtaaattccaacggctggtcttacttgagcgagacgtgaagcaatcggaagctttctttattccatcattcgttccattcggacaaatgcaataaaacgtttggcttcttcctcagacaaggtacgtccgtcaatggtcaggttgaaacgttgcagaatatcctcgtcggacagttcaagctggtccacaaattccctcacatctgaatccaatattgccgccggatgggtcgtacgtcccaccaagtagtcaatcgttaccccgaaaatatcagcgagcttggtcaggatctcaaaatctggcttgcgcctatttttttcatagtgagaaagagctgcccgcgtaattccgagggattgcgctagttcctcttgttttaatcccttatgttctcgtaattcagcgatgcgggtgccataattcatctgtttttcctcctgaaggcaaggttaagaaaggtaaaaaagcaattttacgcttgacaagatacgttttgtatcataaattagttatgtaagttacataacgtatctttatttcatagttttcacttatgtcttcgtttatataccctaagaggccaccgatgattgagcattttgtgcttattcgctggctggaccttctatgcgctattatacaacattttactatagattagagggtcatgcatcgttcttttccccgttatgcagaggatcagtacaagcgttattgcatcgaaaacaagtcaatcagggaggactggtcttgtgcagttgaaagagtacatccgtttgatccgtaaaagaatgtggttgattggtagcatcgtactgctggtatgtactgtagtgggcataaaaaatgtatattttaccccgcagatttatgaagctaccgcaaagctcattatcaaccagacgccacgaccggatcgtgcaggtgtcgttgattacagtgtagttcaaacgaatatagccttaacgaactcctataagcaaattatgatctcctcggcgattatggatcaggtggtcgccagcttccccgaccttaaggtcactccgtcagctttggcgcaaaaattaagagtgaacaccgcaggtgattcacaggtcatggatgtaacaatccgcgatttatcgtatacgaaggctgtgaaaaccgtcaatgcggtagccaaagtattcaaacggcaaattccctctatcatgaaaatggacaatgtcaccatcctaagcgaagccagtctgaatgatccagcagttcccgtgaatagtaatcccgctatacagatatttattgcttttgccacctctttattgttgggaataggtttggcatttttgctggaggtactggatgatacatttaagaatgaagaggatattgaaaaagaactcggtctgcctaccctatccctgattacgaaaatgaaaaaagaagataaacgctctgacagctccactacaactcctaaacaggtaggtgaagggcaatatgccgcgattaatcaataatcagctcgttacatccctacatgctcagtcttccgtttcggaggagtaccgcatgcttcgcactaatatccagttttcttctatagacgagccgattgaggttatgatggtggcgtccgctcaagcgggtgaagggagaacggtcacgattagcaatttggctgtaacctatgcgcaagaggggaaaaaggtgctgattatggatatggatctgcgccgctcctccttgcaccatatgtttggtttgcgtaatcatacagggctgacacgggtgcttgccaatcaacaggcatggcaggatgtggttcaggaaaccgggattgaccatctgcatgcaattacagccggaccgaacccgcccaatccgtccgagatgctcagttcccgtagaatgaatgctctgctggttgagctaaaagaacattatgacgtgatcttaatggatacgccgccgttgctgtcctttccggatggcttaattataagcgctatgtgtgacggagtcattctggtggtgcaggcagggaaggtcaaaaaggatgtcgtcaaaaaagcaaaagcgaatttggaaagagtaaaggcgcgcattctgggtgtagtacttaataatgtgaagcgttcgaatacccgcgccgagaggggtatggaggaacgcaatctgacatgaataaaaaggaggagaatgagagtatataaaattcttttaacaatgtataaataataattatcaataaggagcgaggtgatgagacgtgtcttcttcccgctcgaacgaggccgaagtgctgggcgcgtcagtggatgtatattcggtcgctcatgggcttgaacggcggcaaggatggaacgtatacccgttcgtgaagcgaagcatggatattatattgtctttcattggaatcatcgtgctatgcccggtatttctgcttgtcattctgctgattaagctggaggacccaaaaggcagtgcattattttatcaagtacgtattgggaaaaatgagcgtccgtttcgcatgatcaaatttcgttccatggtgtctgatgccgaagccagattgtctgcactgctggtggaaaatgaaattgagggtgcgatgttcaaaatgcgggacgatccccgaattacccgtgtgggtcgctttcttcgcagaacgagcatcgacgagctgccacaactgttcaatgtactgcgtgggcagatgagtctggtaggacccagacccccgttgccaagagaagtccataattacacagtgagggataagctgcgtctgacggttacaccaggctgcaccggtctatggcagatcagcggtcgtaatcatctaagctttaaccagatggtagaactggatttggagtacatatccagacgcagtttccgcacagatatgatcattatgctgaaaacatttcgtgtgctgctaggctccaaggatgcgtattaaagtctttcattttcacaaagaaggtaggggataagtatggatcttcattccaacatatatgtagcagggcataacggactggtgggttccgctattgtccgagcgcttcagaatgcgggttaccgtcatattattactcgcacaagccgtgaactggatctacgcaataaagaggccgtagatcatttttttgaaacagagcctgtggattatgtatttctggcagcggccaaggttggtgggattttggcgaataacgaatatccggctgattttatccgtgacaatctgcttatacaaacgaatgtgattgatgcggcataccgggcgaatgtaggcaagctgttattcctcggctctacctgtatctatcctaaatttgctccgcagccgttgcgagaagaatatctgcttacgggtgaactggagcctactaatgaggcctatgcgattgctaaaattgccgggattaaaatgtgtcagtcttacaaccgtcagtatggaactcggtttatttctgtgatgccgacgaatttatacggtccgggcgacaattttgatctccagacctctcatgtgctacctgcgctcatccgcaagtttcatgaagccaagctgaatcaatctccgactgtagaagtatggggctctggtacgccgcgccgagaatttcttcattctgatgatctggctgaagcctgtctgttcctgatgaacaattatgagggaaatgaaattgtaaatatcggcgtaggtgaggatatctccatccgtgagctggctgaacgagtgaagaatgtagtcggctatgagggagaaattacctataacacctccgcccctgatggaacgccgcgtaagttggtagatgtatcccgtatttccggactgggctggtcggcgcgtatttcactagaagagggattaaagtctgtgtatcaggcatttcaaggcctggatctggttgaacaataaaaaacggtgggggaattggaatgaaaaaagcgctgatcacagggattaccggacaagacgggtcctatctggctgagttgctgctgtcgaaggattatgaggtatacggggtgcgcagacgaaccagcacaccgaactttgaaaatgtagcgcatatccagaatgacattcattggctttccggcgatatgaccgatctggcttcattgatcgaagccgtccgtcagtccgacccggatgaggtctacaacttggctgctcaatcctttgtagcggcctcgtggccgcagccgttggctacagggcagattacagcgctatctgtcaccaatatgctggaggcggttcgaattgccaaaccggaagcgcgcttttatcaggcgtcaagcagcgagatgtttggtaaggtgctggagacaccccagacagaaacgactccgttttacccacgtagtccctacggtgtcgccaaagtgtacggccattggattacagtgaactatcgcgaaagctttgatatgtttgcgtgctctggcattctgttcaatcacgaatcgccacgccgaggactggaatttgtaacacgtaaggtgtcggatgcggtagctcgtatcaagctagggttgcagcaggagctgcgcatgggaaatttggattcactgcgagactggggttttgcaggcgattatgtaaaggcgatgtggctgatgcttcagcaggatcaaccggatgattacgtcatttccacaggagaaatgcattctgtacgtgaactgctgcaaattgccttttcccatgtaggtttaaattatgaggattacgtcgtgatcgatcctcaatttgtccgtccggcagaggtagatttattgctcggcgattgtgccaaggcgaaagaaaagctgggctggcgattggaagtaggcttcgagcagctcattcatatgatggtggatacagacttggagcgggtaaaaaggcaggctgcagttgaggcttctgtcgtcgtgtaagagatggagaggccacccgcctgggcgggggtctcttcgctgtacatgattgcagctgcattgacagaacagcaggttataaggctgtgcgaaaggtcattttttaagatggagtaaaacctatgacattagtcaaaaaacgcgccaaaccgcgcagaagtttgctggtgaatacatcctggctgttcggtgacaaaatgattcgcatggtgtttggcctggcagtcagcatcatcatggcgagagtgttgggaccagaggaactgggaaagtggaattatgcggaatcctttttcgggatgtttctgattttcacgacccttggctttgattctatattagtacgcgatcttgtcaaagaccccaaggatgagcatgagctattggggacggcggttctgctgaaattggtaggtactctgatagccattgtactgtcctattccttcatttcactgctcagaccggaagatagttcagtgcggttgatcaatctgatcctggctacggcctcgatatttcaattgtttgatatcatcgactactggtttcgtgcgcagatgctgtccaaatacacggtcgttgccaagaataccgcttttgttctcggctccaccctcaaaatcattcttttgttgtccggtgttccgatatggttggtagcgttgtgtgctcatggagagtttctgttgggaagcttgctgctgctgtatttcttccataaggaaggacgacgtgtgaaccgatggacgttccgcttaaccacagctcggcgaatcatgaatcacagctggccgcttatattgtcatcctccgctgtatatgtacaggcacggatcgatcaagtcattatcggtgaactgctggggaacgctgcggtcgggcaatactccgttgcactccgactcatcgaagtgctgggcttcattccggtcgttctgacgacggcctatgctccggtggtgacgcgttccaagcagaaaggaagcgacgaatacagacagacattgtccaaggtgtatcggctgatgtttatatgctttcttgtgacctcggtacctttattttttctatcccaatgggtagtggttgtgctgtatgggagagaatttaccgaagcaggttcgctgttgtctctgtttgcgattcgtctgtttttcaccaacttcagtgttgctaaaagcttgtttattaccaatgaaaatttgtttagatacacgctgctgacctcggtggtaggggcggttacgaatatcgctttcaattacgcgctaatccctttgcttggtgtccgagggtcgttagtggcgacaatcttgtcctttacgatatctgtatttctattagatttgctgtttaaggaagttaaatctaatttaggttggatgataaagtccatcctgaccttctggcgtgttcaaattacagtaccgaaagttggagagaacaatcatgatacccattaaaccgtttgttcggcatgaggaacagtgcccgcattgtggaggtaaggtacgtggtggagaggtgatgtggcagggaatccatgtatgtgtcagtactgcgtgtgaggggtgcggacgcgaatatctcgaggacatgagggtcggtcatgccacgtattcaccttatcgtgtagaaatgcctgactatattttgaccggtgatgcgaagtcgagaaaatggctcggagagcctttgcggcaatcgttgatgaatccttcctatgacttagcagtcggcatgaccgtgcataaaatgaaagcttctacacgtgtaattatcgtcaacactatggattatttgtatggtcatgcgttactcaagctgctcaatgtgcaacgcgaatacgagcaatccccggacctgggaattatcgtcattgtgcaaaagtcgctggagtggatggtgccagcatatgtgtctgaaatttggacggttgatgtgccattcagcagggcacgtaacttttatcctgtactacatcatcggatgattgaggaactgatgcgttttgatgaggtgtatgtcagcccggcatattcacatcccaatcagtttgatattgagcagtttacaggtgtttcccgctatgacgagggacgtgagtcggagccgcgcattactttcgtatggagggaagatcgcttgtggagcggcagccatcatatcgcaagagcggtacagaaatttccgcagctcaaacgtgggctaaaaccgctaatttatcatcagcgcagtaaaatcatacggctgttccgcaggctaaaagaaagcttcccagatcatcgttttacagtcgctggacttgggcgtaccgggagcttcccggcatggatttctgatgagcgtatcacacgcttcgaccgggaaagtgagctgcgggtctgcgaggtatacgcagccagccgattagtaatcggtatccacggctctaatatgctgctgccctctgcgcatgccggcatgaccattgatttgatgcccaaggaccgatgggggaattacgctcaggatattttatttcacgaaacggatcatcggcttacggcctacaaataccgatttgtgccgatggaatcgagtgtgtctctagtggcggatatggcagctgcccagctcaaaggggcagatcattttaatatgcagatgacggaggaaaggcagcgtgagcattcggtttggaggggagagactgcttcggggcgggtttgatcctggagcaactattgtggatggaaggccgcttcggggcggatttgatcttccgatcgctgttgacgagggattccctggattgaataggccctgtaagagggcggaatcccacgtcaaaggcgaacactgacgcttctccagattcaaatcctcaccctccgctacccaccgccgccaaaaagaatttcccccagcccataaggtggaggaggtaagagccgcctggcgatagcttcgccttatcgccgcgaacttctcgccgggcatgcatgccggcgaaattaatgctctgtaccgttctctgtcagggtgacagcgtttggtggatagcaatcttttagcaggcgacaatctagccatcgttaaggtcttgtgtcagcccagtggtagtagctctatgctgttcaatcatttatcgctaatgtgatcggtatacaaggtagcgcgcagtcaacgccctgcgtgcattcgctcgcgtatatccgcgcagcggggggcacttcatgcccagcattccttttttgaaatggggtgactttatggacccggcggtcagtagcggagccgtccatttgaatctgaagaagcgctagcgttcgcctttgcagtgggattcttacctcggaatgttttatatatccaggaatcccactgcaacagcgatcggaagatcaaatggaacgcgcagcgttctctgaaccctccatgctccataactcacccaatatgaaatggcaggagccctgatgatgattcaaaaaatattgtatctccgcaattttgccagcaaagtgaacggggactcatacaatttacaggaagtcggtttgggcaaagcactcgttcgaaaaggctatgattgcgatattgtttactacaacgatcgtaaagaaacccatctggaacaggtctaccgtcacgaaggatgcaccttgcgtattatctggctccacgggtttaagttcttaagcaacagcatctacagagatgttctcaaagattcttttctggatgcctatggtctggtcattactacagaatacaaccagatcatgacctatctgctttctcgcaaatgtcctgataagctggcgttgtatcacggcccataccgagataacacgcacgcgctgatccgcaaactgtacgatattatgctgctgccgaaggtagcaaaatctctacgccgtacctatgtgaaatccgatcttgccaagcgctatttggagaataaaggttttgacaacgtggttacgattggggtcggactggatcgcagtaaagtagagagagcattcgatagtggcaccagtaacaacagtgaagacataagcggagaacgtgaggaaaaccgtgaggtcgcgaatgagctgcgtcgaatcggtgatcgtccggtgctactgtatgttggtgtactggaggaacggagaaatatacggtttatgctgactacgttcaaaagggtactccaaaagcatcctagctgccttttgttaatggtcggggaaggacggaagacggacacagaccgctattggacatatgctcatgaactgggaataacggacagtattatacatttttcaaaagtggagcaacgtcatctgtggcaggtttacggagcggcggatgtgatgctgtttccgacccaatacgatatttttggtatggtgctgctggaaagcatgctgtttcgcgtcccgattatctcttcggtaaacgggggctcggttaccttgattgaggacggagtgagcggagtgatgctgagaagcttttcagaagaggaatggtctggtcggataggcgatttgcttgataatgctgagctgagacgaagtatggcggagaaggccttccttacggtcgagcgtatgtcgtgggatcgcattgcggatgaaatagtaagccatcaagggatcaaacctacgagttcgaaccacgctatgcaatcaacgcaggaaagaggggcaaccacgtgagccaaaaggtcagcagacagatgaaccctcctgtgagcaaggtgctgatcatccataacttttatcagcaaagcgggggagaagacaaggttgtcgagcaagaatcagctatgctgcgttccagaggaatagagacagagcattactatgtgtacaacgacagcattcaaagcagagggctagcgaacatggcaaagctggcggtagaggcggcatggtccctgccggaattcaaaagaatcaaaaagctgcttttacaggtgaagccagatgtggtacatgtgcataattttttcccggttatatccccttcggtctatcatgcttgtgaacggctggggattccggttgtccagacactgcataattacaggctgatttgtccggcggcaacctttatgcgagggaataaggtttgtgaaaaatgtctgcacggcacgctgctgcattccatccgtcatggatgctatcgaggttcacagcttcagacgattccggtagcggcgatgattaagttcaacgatctgatcggcacatggcagcacaaggtaagtcgctatattgcgctgacggaatttgcacgggacaaatttgccgaaagcggtattccactggatcgtatcgcggtaaagccgaattttgtccatcataaaacagtgaaaacccagtatgacccgaatgatcgttatttattgttcgtggggcggatttcagctgaaaaaggggttcgcaatctgctgcaagcttggtcacagttggaagatcgggggggattgagactggtcatcattggggatggtccggaaaaggctgaattgaccgctgcttatccgcaggaagatgttcggtttctcggtaagcaggatggagacacggtactggattgcatgagccgggccatgtatgtcatggtgccttccatttggtatgaaggatttcccatgaccattgtagagtctttttctgttggaactccggtattatgcagccggctcggtgcactggaggaagtcgtggaggacggggtgacgggtttccattttcaacatgatgatttggaaaatataaagactgtgattcgctgtgcagtagcttatgaaaactatgcagctatgagacagaaggtgttggaaaactacgctgcacgctatacggaagaagtgaatgtgaagcagctgatggcgatatatagggaggcgatggaggagcgtgattatgaagcagctgccccaatatagagtcggaaggattgcggatgcagatattgcagcacttacgtttcaggagacggtacacatgctggaacaatgggcagtcgaacgaaaggacggctatgtttgtatttgcaacacgcattccattgtcacagccgggaatcattccgagttccacgaagcgctcactcaagccgatttgtgtactcccgatggtatgccgttggtatgggcgcttaagctgtacggatttgagcgtcaggatcgggtagatggtcccagtctgatgctcaagttgtgcgaacgtgcgccacagacgaaggtaagtatatatttttacggcagtacgccggatacgctggatagcttaaaagaaagagtagaacaggattaccctggaatccgcatcgctggcagcttttcaccaccatttcgtgagcttcatccagatgaggaggagcggatcattgatgaaatcaatgcgtctggcgcgcatatcatattcgtcagcttaggctgcccgaagcaggaaatatggatgcatcgaaacaaagaccgcattcatggcgtgatgattggagtaggggcggcctttgactatatcactggaaaggttcgtagaccgccactagcgatacaaaagctggggctggagtggctgtaccgtctgatctgtgaaccgaagcgattatggaagaggtatgcctataacaatccgatgtatgtataccgttttctaaaatcttatcggcaaaacaaacggcttacgctttatcataatcggcttgcaggaagagatatagagaagtgaagtcggtaaaagcaagcatgtaaaagggggagttgctttgaagttatgtgtaattggtgcagggtatgtcgggctggtgtcgggggtctgttttgccgcactcggaaataccgtcgtctgtgtagatcagaatgaggataaaattcatcagctgcgtgcaggtggggtgccgatttatgaaccgggattaaaggctctaattaaagataatgtagaacaaggccgactaagctttacaacagatacggctgcttcggtggaggcagccgaaattgttattttggcggtcggcacgccttcactgccaggcggagaagcgaacctgtcctatattgaagaagccgccggcgaggtggcagatgccatgaatggctacaaagtaattgtcaccaaaagcacggtgcctgtcggaacgaacgaacgtattcaaaattggattgcgagccgcacaaattatccgtttggtgtggcttcggttcccgaatttttacgtgaaggttcagcagtcatagacaccctacagccagatcgaatcatcatcggagcttccgatccgcatgtgtccgctgtgctgactacactgcacgagccgctgacgacaaatatcgtaaccacggatatccgttcggcggagatgatcaagtacgcgtcgaatgcttttttggcgaccaaaatttcgtttattaatgagattgcaaatatttgcgaaaaggtgggcgcagacgttacacgcgtggcacacggtatgggactggatcagcggatcggttcctcctttttgtctgctggtatcggctatgggggttcctgttttcccaaggatacacaagctctgatccaaattgcaggtaacgtggactatgaattcaagctgctgaaatctgtggtagaagtgaatcaggggcaacgttttaacgtgattcgtaagctgaaagaggcactgggtgatctggagggagcaacgattggtatatggggactggcttttaaaccgaatacagatgacgtaagggatgccccggcgctggatatcatgcaatcgctactggaggcaggggcgcaaattcgtgcgtatgacccgatcgctaccgctaacttccgcagactgctgtacagctcggaagtaacgtgggctgatagcgcacgagaagcggcagagggatgtgacgcactgtgtctattgacggagtgggaggagtttggtgatatcgggttgggtgagctgaatgagcttatgaagtttccaattatgattgacggacgcaatgtgtacagcgaggagcaaatcagacaatccgcctttgcatactattctgtcggcaggccacagatgaacaatctggatgtagatcgtcatcagtctgtagtgaatccgtaaaggggaggctgcgcatgaaacgatggctgaaggtgacattgggggctgcggcgttattggtcgtaggggctactgcctacaccgcttatgtgtatcattcctttaaaacagcggcgaatgcgatgtatcatccgcgcagcatcgtgcagcctggggcggtttctacccttgcaacgggcggagcagggcgatctgtaggtacagacattggatcaagtacacccaatccggcagccatctcccagttcaagccgttcaccgtgctggtgctgggcgtagatcggcggcctcacgatccaggacgatcggatacgatgatcgtcttgtctgttaaccctgccgaaggctctatgttaatgttcaacattccgcgtgatacgcgaacagagttgatcggcagggggcgtgaggacaaaatcaatcacgcttttgcttttgggggcgtggatatgtcgatccgtacggtagagcattttttgaaccatccgatagattactatgtacagatgaacatggaagggtttgcgaaaatggtggaccttatggggggagtcgaggtttataatccacttgattttcaatatgagggccatcattttgcgcagggtaatttgaacttgaacggggctgaggcgttggcctacgcccgtatgcgattcgatgatccacgtggggatctcggaagaaatgcccgccagcgggagctactcaagcaaattctgacccagtccatcagcaaggaagggctgttgagggtaaagccgatactggaagcagcgggggagcagattcgcacagacattacctttgacgatatgaccactttcctgacccggatcggtccgtccctcaagcagacggataccgttgaactgaagggacatgggcgtaaaatcaacggtgtatattattacattgtggaggagcaggaacgccagcgtctccatggagtgctggagaagcacatgcttaccacggccatatcgccttaggtaagccttatgtagacgggtgccctatttgggaggtcacccgttattttcttctaaagacttctaaacaaggcttgtcccacatacatctgtagagaattcggtatagtccaacagagggaggggcaatgtgtgctgtttagaaggagagcggcttcggcgttcgtccgtaagctattatattttgccatcatatgtggattgttatggctgctgtggctgggtctgcgtggggtgatgtctacaggcgagggcgatcaagcggtagaagcactgaacgagttttacactatggagcaatcgggaaatttcggaggttcatgggagttttttcattcgcaaatgaaaaagaaattcgagaaatctacgtatgtacagcagcgtgcgcacgtttttatgcaggatatggggacggatacgttcacgtttgaactgggggagccgcaggctgagtatgacattcgtaccgatccgaatggagaagagttagggaaggtttaccgtattacggtcactcagcattacaagacccgattcggtaattttgatatcgtacagccttgttatgtgacacaggaagatgagaaatggcgggtgctttggatatacaaggacaaggaatagaggttgcgtggtgtttctaaaaggttaaatatggtacaatacttccaaaaccggaaatgtacagtaaaatggataacagcttcactccggatggaaggagtttcatagtatgcagcaagcgacaggacaggttcccgtcatacgtatggagggtgtgagtaaaatcatttcctcaaaagcgatcgtggatgatctgacgctggaggttccggcgggacaggtatttggtttcctcggacccaatggtgcgggaaaaacgactaccatccgtatgatggttggcctgatttcgatcagcaagggcgacattcatatttgtggagacagcattaataccgattttgagaaggccgtttcccatgtcggcgcgattgttgagaacccggagatgtacaagtttttgacaggctatcaaaatttgcagcattttgcgcgaatgtctcctggggtgaccccagagcgcgtggatgaagcgattcgtttggtgggactcggaaaccgaattcatgataaagtaaaaacctactcgctcgggatgcggcagcgacttggggtagctcaggcgattttgcatcgaccgaagctgctcgtgctggacgagccgaccaacggcttggacccgcagggtattcgagaactgcgggattatttgcgtcaattgacccgtacggaaggaattaccgtgttcgtatcaagccatttgttgtctgagatggagctgatgtgcgaccgtgtagccattattcagagcggacggctggttgatatcaagcagctgaagaatacaggggaggaagtgcagacggcagaaattgcttttgaggtaaatgatgccgagcaagcttatgcgcttgctggagcagggcgcgtcgaaggcaatcaactgctgcttcacttggagcgggaacagatcgcagagatgaacagcctgctggctgcaaacggaattaaagtatatgcgattcgcccgattgcccgtacgctggaagatcaatttttggaagtgacgggaggcgggttcattggctgatttcttcaagctggtacataacgaaaatctgaaaatttacctgcgtgtgcgcacatggattatgctgggtctgctggcggtcatcacggctgcgattccgatgctgatttccctggtttccgatcaggtcagtgtgtgggatggaattgcgttgacgacgttgtttacatttttcctcaatacgacgtttacggtcattgtagccgctgattcggtggccggcgaatttacatggggaacgattaagttgttgctcatccgaccttggactcgcagcaaaatattgttgtccaagtatatatccgtgattttgttcagtttgctcggaacgatcattttgatcttgatggttacgctgtcctcatggctgatgttatccaaagatgcaccagcgggttctgttccgctgttcagtgatccgatatcttatgtaacgctgaactttttgtatagctatatcgccttattcgtgacgatggcctttgcatttatgctatccgcagttttccgttccagtgccttggcgattgggctgtcgttgttcatgatgttcaccaaaacagtctataactctattggcttgttcagcacagatcgttatgaatggactaaatacgtattatttacacatatggatctgaaaaaatatctagatatgccgccgggtacagtaagttccagtctaaccttttcgctcaccgtgctggccgcctattatgtgatttttatcgccattgcctgggtggttttcgtaaaacgggatgtttcgacctaaatggaagtgccatagagtaacacaaaggacgttcaaatgcctagcatttggacgtccttttattatttcaggaatttgcaaaatcctcatttaacactattttatcctgtatctatgtcatttttgctacacattctgagtgtaggggtatattgtaatctattttcagcaacaatcaatcaatagggtcattttgcgtttaaagaggtagagagaacagaacagaggggggccgcatgatatgctgcaaaataatcgtttttttcgcctgactactggtattgtcatgctattactcatcatttacttgggcaccaaagtaagctttatattcagtcctctcgtatctttggtcagcttgctggttgtgccgttgatgctatcttttttcctctattatttattgaggccgattgtagatgtaatggaacgtagaaaaatcaaacgatctatctccattttgctgatttatttggtcattggagtgttattgtttgttttctcatggggtgtgtggcctacgctgcgtgatcaggtaaccaatttatttgaaaatgcgccgaagctcattaaaagtctggttgatcaattgagccaatggcggcataatcaatccttgagacaagtgctgcctccgggtgaagacccgctgtcacaactgtcagatacgttgaacgaagctttttcgacactgtctgattactcggtaaagctggtatcgttcgtatcctacttttttatcgtattggctacttttcccatattgctctattacatgcttaaggaagggagcaaatttggccctaaaatgctaaacttctttcctaaaaaatatcacaaagacgcgttagaggtcatggaagatatcgatagcgcgctcagcagctttatcgtgagtcgggtgctgatcaatgtcgcgttgggtgtgatgatgttccttggatttttaattataggtttgccttatgccttgctgctcgccgttatttcgatttttcttaattttattccctatgtgggggcagtggctgcttctatacctgtagttattattggatttctcgaatcaccttcgatggcgctctggtcgctggtcgtggtgattgctgcacagcaaattcaggataattggctgtcacctatagtttttggcaagcagctggatattcatccgttgacagtcgttattttactgttggttggtggcgacctgctcgggattctgggcatcattttggtgattccattgtatatgtgcggaaaaattgtcatacgtaaggtgtaccaattgtttttggaacgcagagtggaggatattatggaatgaatggagaatgcactgggtttaatggagtgagtgtatattgattttatcctgcttcggattgcagatcggcttggctgtcctccctgtttttgctgaaactagattgggtttcgtcgtttgactcatccgtagaagttgacaactctacatccttcgttcggttcatttgacttgtgccgtccagtacaccgccttcagatatgaccaatgcagcggtcgccgtatttccgtacagttcacctgtcggcgtaatggtcagtcgtccttctgtagtaatgctgccgaacaccttaccggcaagaatgacgtcttgtgcgatgatgtccgaacgtaccacagcagattctccaatgacgacagtacgagtgctgcggatatcgccctgaaaatgaccgtcaatccgaatattggcctctgcctcaactgtaccttcaaagctggtgccattagcgagcagtgtatccatagctggggcggagagtttttttttggattccttgaacatgatggttttcccccaatcttttattgtaaggattttgaaaagtcctcattgtacatacagtaatggatcgacaggttggttatgcttgacgatctgaaaatgaagatgaggtcccgtgcttctcccggtacttcctaacagaccgatggtctgtcctttgtggacacgatctcccggagccacctgcatgccgctcaggtgcatataccagctctggagtccgtcaggatgctggatgatgatgcacttgccgcgggctccgctagaagcagcctccaagacggtgcctgctcctgctgcatagacaggatcaccggtttgtccggcaatgtccacgcctgaatgaaaggcagacctacctgtaaaagggtcgctgcgatagccgaagctggaggtcattcgccgtgaacctacaggccaaacggagggattcccttgttcggcaagagccagcctacgggtctggagtagctgtgcggcttgtttgcgctccagattctgctgcacggcatttgcttgctgaatagagcggggaaccgtacgttccaccgtgtccaacagagattcgatctcctgaaaatcatccattgcctggcgagttaggagggcagtattttcatgcactgcgatcagttcacctccaatatggccggaagcatcccaggagagcggcgtcatggtctttttatggttacttgtggcagatgagtttccgtgtttacgaatgaattgctgcatttgttgttccagctctgttacgcgctgaaggcgttcacgaatattggtggcttgattcgtcagttccatgacttcctgccgtagtcgcccaatggctgcatccttgtccgctaccgtgacctccatctgcaaactctggacagcaagattcgtttccatttgggagataatatgggaagaacggatttgcagcccgatcacgagtgtagagatagacgcgatcacaagagtcgggacgagaatgacagcggctgtagagcattgtagctgcttgggcggttgctgtgcatcccgaataacaagcagggtcatccggcgatttaggcttccttttttcataatcgctcctttccggacatcgctcctatagtgcttggttactatctattcagctaaagaggcaaacatgtcaaaaaaattggagcttagtataaaacgtagatgaggattttgcaaaatcctaagatatataaggaggcttagacatgctgtggttgctgttggctttaattgtttttatttttcagaccgggacgatcctgctctttgaatttcgcaagccgtccaaagcggtagcctggctctttattttgttttgcttcccgctcattggctttgtcgtgtactactttgttgcacaggattatcagaagcgcaaaatggtccgaaaagggggatcgcagctgtttcgtgaatttcgcgagcgtctgtgggcgcaatccaaagtgattgaacaggtggagcaaatgcataatcctcatttcaagcatcaggagcgtctgtttaaccagttaattcgcatgtcagaaaacccgttgactggatgtaatcgcacacgtgtgctgacgaacggtgaagaaaccttcgaggctatgctgacagcgatggaacaagcgcaacatcatatccatgtggagttttacatatttcgggccgatgaaattggaagaaagtttcaagaggtcatgatccgcaaggcacgtgagggagtaaaggtacgattcattgtggacggtgtaggaagttacaatttgccttattcctttattcgtacctgtagtgaggcgggagtggaatttcattattttctacctccgtttttcgccactttggatcgccggattaactatcgcaatcacaggaaaatcgtggtggttgacggcatgattggatttgtgggtgggattaatataggcgacgattatctcggaaaataccccaaagtgggattttggagggatacgcatttgcagattgaaggagatagcgtctattttctgcaaaatgcatttcttagcgactggaagctggcctcaggggagagattgatggatgtgaatttttttcctccacatacctgcaccggggatgaggaagtacagattttgagcagcggtcccgatcaggtatgggatacgattcaggaaatgtgttttggtgcgctcacggttgccaaaaagcggatttggattacgacgccgtattttattcccgatccggggattcatgaggcgctcaagctggcagcagtcagtggcgtagatgtgaaaattattattccctaccaatctgactcgaagctggttcatctggcgtctttatcctatgtgcaagaactgttggagacaggggtggagttctaccaatatcgaaaaggatttattcacgccaaagtagtgattgtcgatgatttactcggctcggtcgggaccgccaatatggacatgcgcagctttttctataattttgagttgaccgctgtagtttttgctaattcagcgctggaacggctttcggcagattttgtagaggacatttccaactcctcacgcattgatttgaacgtgttccgcagacggcctcgatctcagaaaacagctgaaattctaactcgcatgctctctccactcctttaaaggcgattttcgacgtttttatcgctataatcccactttattgtgatttatgtgctctttgctaacttttttgcgcaaaatcgcagttttatggtatactattcatataacacaagcgcggtaaaggagaggggactgcggatagcagcccctttttcggtccaatataccatactgtaacggggggatttatatatgagtgtagtgagcaaggaagtccaaaatctgtctgagatcacagatgtgaccggagagttgaccaagatcagcaaaattccagctaatccgaagaacaaagtaaaacgcctgtttcagcgtgcagccatgattgtggttggtgcagctctgatggcagtgggattggaaatatttctggttcctaacggcgttattgacggaggcgttacaggtatttccatcatggcctccaagattactggctatccgctcggtattttcctgaccctgttgaaccttccatttttacttatcggctacaaacaaatcggtaaaaccttcgctttatccacattattcggtatcgtcgttatgtccatcggaaccgcgttacttcacaatgtaagtgcattgactcctggcgaaccgctgctcggcgctatttttggtggcgtcattctcggtgttggggtgggtcttgtgattcggtccggcggctcgctggatgggacagagatcgtagctattctcgtcagtgaaaaaactcctttttcggtcggtgagatcgtactgttcgtaaatatcttcattctgggaagtgcaggttttgtgttcggttggccgaatgccctgtattccatgattgcttattatatcgccatgaaaatgattgatattacgattgaaggtctggatcagtccaaatcggtctggattattagtgaaaaataccgtgatatcggggatgccctgacagaccgtcttggacggggcgtcacttatctggaaggtgaaggcggctttacgggtgaaagcaagaaagtgattttcgtcgtcattacccgactggaggaagcgaagctgaagagcatcgttgaagattgggacccgcacgctttcgttgcgatcggtaacattcacgatgtgaagggcggacgctttaagaaaaaaggaatacactagcgcaaggggacaatttctcagcctaatggctgtggggttcgtccccttttttgttcttccaagcatggatcaagttcggtgtgccttggtgcgcatatgcttgaggacgtcttctacgggctggggaggaaccttgtcgatcaagtcgcctacctggtttagtcgttcctcaatattcagcaaatggtagtcaagtggtgatacatcttgccgtacctcttcccaggttagcggagtagagaccgtagcgccggggcgtgcccgcggggtataaggagcggccagagttttcccctgataatgctgcaaataatcaaaatagatggctgttccacggtccttctttaaccgttcgagtgtgaacagatgcgggtgcttttctgtcacaaactgcccgactaatagcccgatgctgcgaagttcgtcgaaggttatgcctgtacggatcggaacgataatttgtacacctgtagccccggatgttttggggacggaatccaaaccaagcgaagccagtacttcaccgacaatagaggcggcctccataatacgtggctccacctctctggatggatcaaggtctatcatccattcacagggcagcttgcttcccgcttcatgtagagaggggtggaattctaacgcagcctgattaccaagccagagaagttgtggcaatttgccgagcacaatatattcaataccgtcatgcagagcggtttcaatatagtccggccgaggacgtggggcatttttttgataaaaaaaatcaccatgaatcccatgtggccagcggatgacggtcagcagacgatgatggcaatatttgagcaggaagggagccaataccgcgagcttgcgaagatatagcgccttagtcacgcctgcttcaggccacagcggtttatctgggtttgtgataggaatttcctgaccttcaatggtaattgtgcctttaacagcttgtcccatagtgctacctcctttggttaatatacagcaaaatctttatttataggctgattgttgagctcatagatctacatatggtttaacatgaacgtgaagtgctgaatttatccatcaaagggattgacaagatacactatgtatcataaatttataataaaaaatacgatatgtatctattaaagtgtcttgagcagaggtagaggaggagtttgcttgattgaaaagcaaggcggagggctggtattcctgttaagtgtccctcggagtggaagctcgctgcttaccgccattttgcaaaaccattcccgcctgtttgccacgcaggaaatgtggtttctgctcagtttatatgatcttcctcagtcacatgcacggccatatggaggaacagggatacttcggcaattttttgaaggtatggtcccccccgacgtattggagcaggcctctcgttcgtatgcacttgaaatatataatggtctgcttcaaggaacaacagcagatatgcttatcgacaaatccccgcgttactatacggttttagaatttatagaccgtttattccctgctgcccgtaggctatggcttatccggaatcctttggccattgtggcctcattcaaaaaggttaatcagctacggcatggacgttttcaactgctggaagaactggggtgcccgcattttaatatgaaaatgacggatattacggttggtttattccgttatgctcattattttgctacacctcatccacttgcatacccgcttaggtatgaacagctcgtatccaatccaacgatggagatcgagaagctgtgcgattttctggggatcaagtatgagccggggatggaaaagtacggagactttgtggatacgcccaaatccagtcttttttatagtatgggagcgggtgatccattcgtaggagagcatgagcaggcgcatcaggattcggtacatagctggcaacatttgttgagtaaaacggaaattgagctgtattgcagaagcattgggtcccgcatgtttaggcagcttggttacgcggaagcactggagcaggctgaacagatgactggagtccgctttgaagatgagccggatatagagctgctgagtcgacgtacacaacaattcctccagcaaagcggctttgaatggaaggcagcttatcggatgctggaagaacaggatgcagataacagagaactcgtgataaatgcaacccgtcatgctgcacctcaagatccggcaaggatgcatgtggaccagatcgtgaacgatcggcggattcaatccctggaaaacaggttggcacatagctatgaggagcggaaccgtcttatcgctcagctccaaagctatcaacgcccaaatcaaagtctccgatatcgcagcctctttgcccgtaagctcgggcgcttggcgtctgtagtgttatcaagtataggaaaagaaaaagggggaagaacgtgagtgcgattgccggaatctatagctttgggcatgagtccgtatgcaccgaagaaggcgggaaaatgatgcaagccctgcgaaaatatcccgctgaccgcgtatgcgcttggtgtgaaggctctatttttttgggttgtcatgcccagcatgtgaccccggaatctgttcatgagcgtcttcccttccatgatgagctaagagatttggcaatcacagcggatgcgattattgacaatcgttccgaactgtttgaacggctgggagttgagcagcaacggagacaagatatcacggacagcgagctgattttgctggcatatgacaaatggggagtggatgcagccggttatctgataggtgattttgcctttgttatttgggatgccaaggaacatcgattatatggtgctcgagatatgacaggcaatcgtacgttgtacatctaccagtatgaccgaggattcgcgtttagcacggtagtcgctccgcttttggccctgccctctctgcgaaaagaattgtatgagccatggctggccgaatttttgtccatccgcgccatgcaggaatccgtcgatatcggaacgaccgcatacaagcatatcaaccagcttcctcctgcacattggttcactatggaggagggaaagcgaacccttcataaatatgcatgtctggatgaggtagagccactgcggctcaaaacagggggcgagtacatagaagctttccgcgaggtgtttacacaagcggtcactgcccgactacggacgcatcgcgctgtaggggctgccttaagcggagggctggactctggagcggttgccagctttgccgcgccatctctgcacttgcaacaaaagccgctgcatgcttacagctatgtgcctgttcaagattttacagactggacaccgcctacattgctggcgaacgaacgaagctatattcagtctacggctcgctatgtgggcaacattcacgagaattatatggattttgaggggaaaagtccgttttcagaaattgatatttggctggaactcatggaagcaccctacaaatattttgaaaactccttctggatcagaggtttttacgaaaaagcacaggagcacaatgtcggtgtactgttgaccggggcacgaggcaactttaccgtatcgtggggccctgcactagactattatgcccggcagtttcgtcgtttgcactggttgcaatcctttcagggattgtggcggtacagcaagcttacgggcaggcgtatgtcacatctactccccgtaatgttgaaaaaagcgacttcacttgaatctcattcatggttgcggcgtagcaatcgaagtcccgttccttccctgattcacccggagtttgccaaacggatgcatgtagaagatattcctgtattgagcggaacaggttggataaaaaatgccgatcagacgagaaaagagaagttctcaaatttggcgattgccaacaaaaatggtgtggtcgcgaccaaactttcactacgttatggactatgggaacgtgatccgaccggggacagccgggtaattcgtttttgcttatcggtgccttttgagcagtatgtgcaaaacggtcgggaccgtgccctcattcgtaaagccatgcgtgatcatctacctgatgacgttcggttgaaccagcgggtacgcggcgtgcagcctgccgattggctacatcgtatgcttccttgctgggatacgtttatgggggagcttcaactgatgtgtcatgatttacgagcggctgaatatctcaatattgagttaataaagacggctatggcgaaacttcgccacccccgccctgaacaggcgtctgatccaaatatacgactactaatgcatagcctgatcgtgtaccgttttctctgtggattgaactgattcagattgatccggacggacagttcgtcattcgttggaggggaggtgatgaaatgagtaaaaaagaatggcaggaaccgacgatagaggtgctggatattagccagaccatggcggggaaaggctggagacagattgattgggtgtccgaccacgatgccgatatttataatccaagctaatagatggttatacatgtagccgatgttggactggaagccaaacagctcggccgataacgattgaatgaacgaaaatagcataatccattggactcgtattcaatacagagccgtctttatttctttcgggttagaggtttgcccaagaaataaagacgggatttttaaggacagaggagtgagtcctaccgtgcatgacaggagtgcaaatgttagttggacgaaatatacagcctttggactcaggattgccagtgaactgaatctgcctgagctgctcctggcagcaccggaagcagtagaggatgtagtcattcgacaggctgatttgattgcatggagtggtcagctggaacaggccaattttgtgatgctggatgaacgatttatgttccaaataccaggcacggccatttatgccgtcagggaaggcaaggaaatcgaggtaaacatattctccggggccgatcctgacaccgtgcggctatttgtgctgggtacatgcatgggtgttctgctgatgcaaagacgaatattacctattcacggaagtgcggtcgtcattggggggagggcctacgcatttgtgggtgaatcgggtacggggaaatcgacactggcggctacttttaggcaggcaggttatcagatggttagtgatgacgtgattgctgtagaagctacggcttcctcagccatcgtgtatccagcttatccgcagcaaaagttgggattggatagcttgctccaactggaggctttacgggagaacaagcatgcacgcacaataaatcacatacggtccctaacggatggcaattctgtaatgccacaatacagagatctgcgtatgcttgcagatgagctgaataaatatgccgtacccgccgtagatgaattttttaacgatccgctgcccttagggggcgtatttgagctagtggcagattctccaatccgtgcgtcgatgcgcgaaggggagttagtggcagttacggaacagcccttgaacgttctggagtgcttgcatacattactacaacatacatatcgtagggtgattattccgcgaatgggtttgagtgaatggtcgtttgatacagcggctaggatggctcgtaaagtagagggctggcggctgctgagggatagttcagtctttactgcgtccgaggttgtacaacgggtacttgatatcattcgtaaggaggaaaagagttatggcagccactaatccagctaaagaccattatcgcgtcatttacggtgaagaggtctacgtcagtgatatggacggggaaaaagtgatgatgagcattaacactggtaaatattacaacttaggcttcacaggagggcgaatctgggaactggcagaatctggtccttcacttggcgatatcgtaactgtcctgacgaacgaatatgaggtggacgaggaacagtgcagacagcaggtacacacctttgtggctgagttggagcgggaaggactgctaaagcttctacgggagtcggtataatatgcggatacaacggcttcttctcctgtccccagaggtcaggagattgttgccggaagcctggctggagctgggatgggcgaggctacgccagcgtcgttctttaggggattactcaaggatttggggcataagtatggaagaaactccatggcagtgtgatgtcaggcaggagaagtccattaagcagatttcgcacgctgtggagctggcaagccgttatactccttggcgcagtagttgtcttgtacaagccgctgcggcaatgacattgctgggacgtagaaaactggactgcacgctgtatctgggcacagccaaaaatgccgctggccgcttggccgcacatgcatgggtacgtagcggaccgatttatgttacggggaaacgggagatggaagcatttacggtggtggggatattcgggagacgtgctgtgacggatacaagtacaaatatggcagataaaggtagttctttactttaacgcgatgagacaaaagaagtccaaagaatcgaaggagaagaatgcatgcccaccaagtctgttttggaacttgcgaattggaatgaggatcaggaattaacgttgttactctctctattggggaaagacgtttctcattggcaggataagactgctgctacccagctgcgtgagatggattgggcccgctttttacgtctgaccgagcaccatcgagtggtacctacggtgtatctccaactgaaaacattgaatcatccgttcattcccgcagaattgttgcgaaaccttcaggcgcaatatcatcgaaacacgcttcgcatgcttcatcttcaagcagaagccgggcgtctgaccaggctgctcataactcatggaatccgtgtgcttatgctgaagggtcctgctctggcacagcaattgtacggggatgtttctctgcgtacctccaaggacatcgatttactcattgcccctgacgatatggatgaggctgagcattggatgaaggaagccggatatgcgtccaagagcggagaagtgcgtgtccttggcagttggaaatggaaggaccatcatgcatcctacctccatccgcaaaaacgggtagagatagagttgcattggcgtcttcacccggatgggggtggggaaccctcttttgacgagctgtggagctgtcggcaaatgggtaaagctacaggagccagtcggatggtaccgttggcacctgccgacaacaggactgcgatgacgtcctgtatgtatacgcttggcagcgagcatcaatttctgtacttgagtgcgcatggtgcgcgtcacggctggttcaggctgcgctggctggttgacatcgacaggcttgcggcatgtgctgtcgattgggaggcgctactgccgatgatgcgccgctacgggggcctgcctgctggcgggcaggcctgggcgctcgccgctgcgctgttgggtacgccgataccagagccgatgcgtccggtatcggctacccggcaggcgcacaggctcgcgctgagcgcgctggccttcatgcaggccagcgttcccgcaccatacccgattgcccacgggtcgggtacaggtaggcttgctccatcagagctgctgcacagcagagctttggcggagcaagcggaggccgcccctctggatggcggtccttcattgtgtagtacctgtggcgaagcagccatgcttgccaccattggcgttactagcatcacagaaggtgacagtaacgacgactatagcccgatgagcaccgctaccagttgtgcccccattactccagctgccgcctccagccaagtcatgaccagaaacacggcggctgcccatcagccggtcagccgcacttacttgctttccttaaaagagccaagacacagactaaggtacctcatcagccgtttgtttccttctacgggggattcggccgtttttccactgcctcgccagctgcattttttgtatatccctttacgtccatttctttggctgaagcggcgattttcaaagcactgactcgataaggagtgtgcattatggttcacctgcgattatatatgacaaagctgtatagcgtgaacggcggtgcgttatttctcaatattggatgtatgatcattgttagcctgctggagggttttggcatttatatgcttgttcctatgctggcggccatcggcgtatttgtcggtcattcagggatgccatttctgtctgatggattggatcattttttggcgtttattcctaaaagctggctgttgccggggatgttgatggtttttgtagtgctgcttacagggcaggctttgcttcagcgttaccaatccatcctgaattcgcggattcagcagcgttttatgcgttctctgcgagtagacgtgtacacttcctttatgaaggcgcagtgggctttttatttgcgtcagcgtaaatctgattttagccatgtgatgacgactgagctggcgcgtgtcagtcagggaacgaatttgcttcttcaactgactacagccgtcatgtttacgctgatccagattgcgctggctttttggttatccccctctttaaccggactggtatttctgagtggattggggctgtttgtcgtgttccgccgctccattcgaaatgccaaacaattaggtgatcgtacgaccgagctatcgcaggtttattttgctggaattacggatcacatgaacggcatgaaagatattaaaagcaatctgttggaagcggcgaatatccattggtttcgctccctgacacaacgaatggaggataatacgacccaatttgtccggcaaaatgcgaccacacagttttttcatcgtacagcggcagctgtttttgtcgcttgtgtcatatttatatcgttgcagtggctgcatgttacatctgaaaaactgattgtgctgattcttatattttcccgcttatggccccgatttgcccttattcaagcgagtctggaatacatcatgtctatgatctccgcttttgaaagtgtcaccaaggtgcaacaggagtgcgaagctttctccgatccatcggtattcaatctatcatctgcagctgtacggcaacccctgtcccttcgtcatggaattgaatgcagccatctgggttatcgctacgatggtgcagcagagcctgcgctgcgtcgtatcaatttgttcatacccgcccggggaatgacagccattgtagggaaatcgggagcaggtaaaagtacaatggtcgatgtcctgatgggttttttacgtccaactggggggcagattacaatagacgggcttgttctggacgacgaattgctgccccagtggcggcagtcgtttggctacgtgtcacaagacccatttttatttcatgcgactgtccgcgaaaatttgatgctggcagataaggatgctagtgagcagcaactatgggaggcgttacattttgcagccgcagacagctttgtatccagattgcccgaagggctggacacggtcattggagatcgcgggattcgtctgtctggaggagaacgtcaacggctagtattagcacgggctgtcttgcatcatcctccggtacttatactagatgaagcgacaagtgcgctggatggtgagcatgaagccgcaattcaggcagcactggaacggatgaaaggtcaaatgacgttgatcgtcatcgctcaccgcctgtcaaccatcagacatgcagatcaaattgtcgtactggatcaaggcgaggtcatacagcgggggaactaccgccaactggagcaagaggagcggggggcgttcagtcagctactatcgtatcaaagcagtctcaccgccaccccttagccagacttttctataactcagcttaagtttctttacgtttggcagtgcttcttttctttttgactggagtcggagagatgttttcgcctgcaacagcctgctgtgctgttggggctgctggtttacgcgcaggacgttttttcgcagcagggccgggatcggtaacgacaggttgcactgcctcgatgctggcctgaagggcggccattaaatctactacattggtctgaggctgtgttggggcgattcgcacctcttcaccagccactttatgctgaatgagatccagcagacgctcgcggtactgatccgtatacttcgctgcatcaaaaggtgtagatagctgctcgatcagcatttttgccatggttagctccttctctttaacctcctcctgccccggtaagttaggcacttgagcaatggggcgaatttcatcggggtaaaacatcgtctccactgccaaacattcatccaataccctaatagctgccaggctgcttttagagcggatggagatttgggcaatcccgattttcccggtatccttcatcgcattcatgagcagcttatacgcattggagccagcttgatccggggacaaataataggttttctgaaagtaaatcggatcaatttcctgcaaatccacaaaatctaaaatgacaatatttttatccgcttgtccgctaacttgctccagttcctccttgtcgaacatgacaaattttcctttttcatattcgtagccttttccaatttcctcccattcgacctccttgtcacaaacgggacactttcgtacatagctaagtgggcttccacactccttgtgaatataacgcatggaaatgtccttatcctcagtcgctgaaaacattttaacgggcacatgaaccagcccgaagctgattgcgcctttccagaccgtatgcatatcgccagtcccccttttcttaaatccttattttgcacccttcgattctgacaaccccgggatatgagcatagatttttcacttagtatgcttcgtacaagtgattgtatgaggtgcaaatgaaggctgcgaattacttctgcttgcgcatggttacagcaattttggtgcatagtaaggcatatccaattcaaaaggaggtacacaatttatgtccggaaaatcctatcctcggcaaatcaggcatcgtgtgggtcaaaaccatgtcgcctttcggggacccgccggaggcgaacaggatgcattgccgccagagtttgccctttcccatggaatccaaccgccttttcccatagctgtggctcatgtggatttggatgctgtagtttcaacttcgccttctcatagcatcccttcattagatgttgaacggattatagatgaagactaggtgaactatatttctgaatgaatgcagacaacaacaatcaggaggggaagaatagcatgaacgtggaacgagcaaaagctatttatgattcgcccgataccattgccgtacaattggatggtaaaccgatctggattgagcatgtagacgaagcgaacggtatggccactgtacagataggcagcagacccaccaatacccaaaccgtccgggtggatcgtctggaagaacaatagaagaggagcaccaaaacagatttttttccatagtatggggtatagctgtagaaagatcttggacagctgtagtctttcatcgcagaatgctgcttgaaaggtcccactccaacaaaaaaaggctcgcaattgctcaatgagcaattagcgaaccttatttgtaataataaatgcagtcgagagagcatgttaaacgccagacaagttaatttgaaggtgcagctggttcctttctatgatgacctttatactgctatggctctcaaatgtggtgaaaccatcagtttagcctcggttgctaattgaacgtcttccaccgacaaacccggagcaatttcttttagcagcagccctttacccggaataacatcgatgacagccttttcggttactatggtctttacaacatttacagcagtcaagggtagcttgcattgttccagtattttcggcgcgccatttttgttcacatgctccatggctacaatcactctcttggctccaactaccaaatccatggctccccccatacctggcacctttttccctgggatcatccagcttgcaaggttgcctttctcgtcgacctccagagcgcctagcacggtgatatccacatgccctccgcggatgatggaaaatgaaagtgcactgtcaaaaaagcatgctccttccatagttgtaacgtagtttccgcctgaatcgatacaatcgagcctttcttttccctgagccgctttggggcctacaccgaggattccgttctcagcctgcagcataatatgaatgtcctcggggatatagtccactaccattgtaggcaatccgacaccaaggttgacaacttcaccatttttgaattcctgggctattcttcgagcaatgaattctctgttattcatgcgttttcacccacctttacaattgcgtcgacaaatattccgggaacgttgacatgattggggtcaatttcacccgtctttacgtattcgtctacctgagcaactacatactctgccgctgtagccataaccatattgaagttacgtgaagagccgttgatgacaagattccccgcttcatcagccttatgggctctaattaatgccacatcggctttgagcggcagttcgagcaagtattccttttcatcaattttgattttctgttttccttcctctacaacggtgcctacacctacaggtgttaaaaccccgcccaaaccggctcctcctgcgcgtattttttcagcgagcgtgccttgcgggaagagttggacctccgcttctttcgtcatcaggagccttcccgtttccggattggagccgatataggatgcaaaaatccgctttactctgccgctttttacaagtttatagatagataattccggtgtgcctgtgtcattggaaacaatcgtaagattgctggcaggattggtgtcgacaagcgcacgaaccaggtcctctggaaagcctcctgccagaaaacctccgaccatcaccgtgtctccgtctttgaccttcttaactgcttcttcagcggagattactttgttattcatggttccttctccttatatatatatttttaggaaagcaaactttattggagatagtcgtagaggactcttccatatggaagcgttaaatcagcaataaaatgtttcccgccaatataagctttaaccggcaaatctgccactggagcgttgacatgggggatcaagcttaatctggcaggccctgaccaggcgccttttaccgtaatgttctcgagattatacgctactaattgagcgattttgggggtaccgtcaacatcaggaattagctttaaattaacttgcgtttttgcgatggcttttgccgtttccttttcatcaagaatgttatatttgaaaggcatagttcccgtggccaccaggatgttattataatgcaatgtacccgtcagcgtctccgtttcctccacgctcaggcgaggctttgcccattttttcggaaatccccagacttcgcgtccccccagaatagcaggcgcgttatccaaatacatttgggcaacaaaattgcagggttctccatgaaaagtacacggaatgacaataccactttcctcatagcatcctaaaccggaagaatcgggcatcttgatccattcataggagaccgtattgcttccatccggctcaagaggttctgggaccgcctgtctaatcgcagcgggatcggtctcataggtaatgataaaaaattcccggttgatgaagcggtatggtgggcgcccgtagctgccgctagccgcaggcatagattggagtgaaagtacatctttttgattcatagcgatctcccttccttttaagagatagttctaaaagtcatcctgaacacgcactttaaatgagcgcattttcaaccagcatcgctattcccattcctgttccgatgcataacgaggcgatgccgtagcgtgaagatcttcgcaccatttcgtgaaccaacgtagtcaatatcctagcaccgctggcaccgacaggatgcccgatcgcgattgcgccgccattgacattcaccttctcaggactgacccctagctctttcactaccgctaatgcttgtgaggcaaacgcttcattaatttcaaaaagatcaatggcatcaatggatataccttgctgcttaagaagtgtcgaaatggctttcactggccccattcccatatatgcagggtcaacgccaacaagtgaataacccttgatatatgccaatggctttaatgcatgttccttgcatttgtcttccgacactacaagcacggtcgccgcgccatcattgattcctgaagcatttccggcggtaaccgtcccgttctccttaaacgcaggttttaattgagaaagtttttcttgcgttgtatttcctcttatgtgttcgtcctctgtgaaagaaatagtttcttttttggttttgatcatgaccggaacaatttgctcttcaaaaagcttcttgttttttgcttctacggcttttagctggctttgataagcaaattcgtcctgttcaagtcttgaaattccatatttctcggcaacattttctgcggtaattcccatatggtaatggttgatcgggcacgtaaggccgtcggccactagggagtctaccaactcaccgttgccaagtttgtagccgtttcttgcattccttagcaggtaaggggcgttcgacatgctctccatgcctccggccaagacgatgttgccttgttcagccaatattgaattgtaagctaaagcaacggcatgaagtcctgaaccgcaaaccgtgtttatcgttgtttcgggtacatcaatagggataccggcttttaatgccgcctgtctggcaggattttgtccattgcccgcctgaagaacatttcccaaataaatctgatcaatcaaagaaggctctaatttactttgctgaaggcatgctgtcatcacagttgctcccagttcggaagcgcttagaggcgcaagggttttgttaaaagagccgaccgctgttctcaacgggctgactaaagctacttttttcattaaaaactcacattcctttcgctgtgttcaagacacaatacatccatgattgcacttcaattcgtaatttccgctcttaacctacgagatgtagcgactgcaagatacatttgcatgcgggcatatcatggtgcctaagacagtgagtgtgacggttcgatcgccttctctcattggaaattaaaaccattttcatcatagttctaatgcagattttgctcaatgtccaaatatttacacatatctatgtacagatgtttatagggccatatagtccacaataaataggccattctaacgttttctgttaatttcttaatttttctgaaaattatgatcataaattgaattttctgttaaaaacgaaagttccaatccataggtgaaaaagttttcttcgaccaatatcttctaactcatcgctggataataaaaaaagcctccagaattttctgaagacggctttgcctttcaacattcatgatcttcgtcctagtgtgccagtttgcttctcgttaaaggtgtcactcgaaagggcggtttttcgcatgaactaaaaaagaagccgacttgcttgaaagcaatcggcttggaacataaaacttcaacaactcacgaaaaatgtacatcttccgtcgcgagtaaacgcacaaaacgattgccaagcatcccattatgatgagctacaatttgttcactgctcagcaccttgctatcaaatgtactatgcgcatccaacacgagcacattgttctgatatcccagactataggcgcttcggcaagtcgtgtcgaggcaaaactcggtctgcatccccgcgattacgagttgatcggcccccagttccttcagtacatggcccaattcggtttggtagaagctgtcccaggatgatttacggacaattcgttcatgaggaagaggacgcactacgtcggcgatggcccagcctacactgttttctcggaaatcctcatccgtttcatcggtatgctgtacaaaaatcactggtgtacctgtagctctggctttgtccaaaagctgctgcaaatgcgctacaacttcctgctcacgatacagcttctcatcatacatgaacatcgcctgctgaacatcaatcatgagtaaaacggtttgccccatcgtttcaatccctccctgtgtgtatcatctaacttacaatagcatgtcttcatgccttgcggcgacataaggtgaactatataataaagaacaagttggaacggtccgattcggacgaaaggtgattaaaatatatgacaatttcgcaggagcagtttacgttccgttctgtctcagaggcacagaccgggtcattggcaggttttttggcagccaaagcggttcccggaacggtgattgtgctggatggagatctgggagcgggcaaaactgctttttccaaggcttttgccggccatttaggtgtgccgggtatcgtaaatagtccaacctttaccctcattaaggagtacgagggccgattgcctttgtatcatatggatgtgtaccggatttcccagaacgaggcggaggatctcgggctggacgaatatttttacgggacaggagtatgtctggtggaatggggtagtattataccggatatattgccggagcagcggcttcacctgtatatagaaacaacggatgtgggggagcgcttgattcacctgaccgggtacggcgagccttatgaacaatggtgccgcagtttgcgggagaatggagtttgaaccatgcaaagagagcatacagatgtgaatgtaaagccgcgtgagcggtttttgacgttagatacagcgacaaccgtgatggcggccgctctgatgaacggaagagaattgctgggagaaagcaacgtctatggcgaacgtaatcactccgtgcatgtgattaccgagctggaacgactgctgaatgaagaagggctgacacgagatgatgtagatggtattgcagttggtgttggaccggggtcttataccggtatccggattgcggtgaccgcagccaaaacactcgcttgggcctggggtatcccggtgacgtccatatccactttgcatgctttggcgtggggtggttggaatcgtggtatcgagatgaagggacaagaagataaaaatgagtctgtgaataacggttcaaccggagcgcaggcagcagactggattgtgcctgtgctggatgcgcgccgtggtcaggtttacacggggctgttcgccgtgaatacagttgacgacgtcgagagtccgcaacggctggagccagatgcaattcgcttgatgactgcttggaccgatgacctgctgcaacggctggaggctttgccctctgaagagcgtcctccagtcatttggctagtcggtgaaacggcggttcacgccgaaacagccgagcgcctgcgtgcttggagcgagctacgtatcgtaccttatgagctggagggaagatgggttggccggcttggggcggataagctgcttcgtcaagaacatgacgagctacatacgctggttcctaattatacccagctggcggaggcggaagccaatctgcttcgtcagcgctgaagagagcggtgaacaacatggcaaagaacatacagcgggaagagaaacttgagtttcgcttgatgcaactggatgatattcccgatgtgctggagattgagcatgaagcgttcacgctgccgtggacggaggaagcattccgcaatgagctgacgatgaatcatttcgctaaatatatgattatggaactagacggacgagccattggttacgcaggcatgtggacgattatggatgaggcccatattacgaatattgcgattcgtgaggcttatcgcggacgcaagcttggggacaagctgttggatgagctgatgcagacggcctcttatttagggatggaacgtatgacgctggaggtgcgggtaacaaaccggatcgctcagggcttgtatgagaaaaaaggctttaagcccgcaggtgtgcgcaaaggctattattcggataataacgaggatgccgtgatcatgtgggcggatcttcccgcacatggggcatccggtgaacaggaaggaagcgtgcagaagcaatgacgcaagaggaaaaagcaggtacaggctccgcctccggcgagccttgctatatactggcagtggaaacgagttgtgatgagacggctgtttccgtcgtgaaaaatggcacagaggtgctctcaaatttgatttccagtcagattgaaacacacaaagcctttggtggtgttgtgccagaggtggcttcacgcaaacatgtggagagcatcacctacatgctggacgaggccatgcaaacatcgggaattacccctcgtgagatttcggcggttgccgtgacacaaggaccaggattggttggcgcattgttggttggaattgtcgctgccaagagtactgccttggcgttcggcaagccattaatcgggacgcatcatatcgcgggacatatttatgccaatcagctggagcatgatatcgtatatccgtgcattgctctcgttgtgtcaggaggacatacagagctggtgctgatggagtccgaaggtcattttcaactcattggtcgtacaagggatgatgcggttggggaagcctacgacaaagtagcgagagcgattgggtttccgtatcccggtggcccgcatgtggatcgtgtggctcatgaatcggaggaagtggttactttgccgcgtgcatggctggagccggattcttatgattttagctttagcggtttgaaatctgcggtgctgaatgtaattaaccagacgaaaatgcgcggagaaaccgttcatgtcggagcgatcgcaagaggctttcaagagtcggtcgtcgaggtgctggtggaaaaggcgattcgtgccatgcgtgaatacggtgcgaagcagcttctgctttgtggcggtgtggctgctaaccgcggactgcgtacagcattgcgggagcgctgtgagcgcgaaggaatcgagctgcttgtaccatcgatgaaatattgcacagataatgcagcgatgatcggcgctgcggcctacgccaaatggaagcgcggggaatttacctcattggatatgaaggctgatccagggctgtctctggaagaatggtctgtccaaacttaattgaagaagaatgagcaagacacggcacagttgagtcgtgtcttttttgtccgccccaaaactatcataaaaatataaattcaagaggataaaatacaggagtttgagaaaatgaatggcagcctctcattcactcgcattattcgtcacaattgttcacgatttttcatgatccatcaaaaaaatctggaattttgatattgcccgaataatgatgtgatttgtcaagttgtgaacaaagttatccacatataccgctttgaatgtggataaccgagtccgaagcaagcaggctaagactttttggagatagcaagttgggggatatgtaacacctttagttcttgtgaaatctgtggataatgtggataaaagggtggataaatttggttttcatttgaaaatggctttttatcaataaaaaaatggcccaaaaggccatttttcaatctcattcatacacatgaactgtggataatcttgtgtacaaaaatatagaagaggaaaatgtgaaatttttaaggctaagattttatgcagtagtttttattcttctaacagctcttcccaagaggtataggtttcagtcaattcctgtttatgggtgtcgagttgtgcctgaatattctgaagcgctgtgtaatcctgataaatctcaggcagggtcatttgttcctccagccctaaaatttgttcttccagcgttttgatctggttttccaatgcctccagcttgcgttgacggctacgttcctcgcttttggcttgtttgtctgccgcataggtggcggcgcgtgatttggatgtggtctcgtctgtcacggatgcagaggtagccgatgttttgccgcgtgtggcctgatttgcctccagagcttcctgcgcaatttcctctaactcctgctttttggctacatagtcatcataattccccaggaaatgttctatccccccaggatgaagctcgatgacacgttccgccattttgttcaggaaataacggtcatgggaaatgaacaacagcgtaccgtcatagtccatcaaagccgcttccagcacttccttgctaaacagatccagatggttggtaggctcatctagaattaacacgttggcttcgcgcagcatgagcttggccagagaaacgcgggctttttcccctccgcttaatgcagctaccttttttagtacatcgtcaccgctaaacaggaaattacccagcactgtacgaatacgtgcttcttccatatgagggtactcgctccacaactcctccagtacggtattggcggggttcaggttcgtctgctcctggtcatacaggccgattttgattttcgtgccccagtggatggagccagcagcaggtttaagtgatcctgtcagacatttgagcaacgtcgattttccgatcccgttcggaccaatcagtgccacggtatctccacgttttaagtcaaacgatgcgtgctggaataaaggctttttaccttcataccccacagagaggtcacgtacctccagtacttccttacctgacatatgggctgtttcaaaggaaaaatgagcctttttcaaatctcccatgggccgatccatacgctccattttatctagctgcttgcgccgactttgagcgcgtttggtcgtggaagcccgcacgatattacgttgtacgaatgcttctaaacgggcaatttctccttgctgcttttcgtaatgcttcagattcgtttcgtactcggcagccttcaactccatgtagcggctgtagttgcctgtatatcgagtagaacgatggcgttcaatttcaataatcgtcgttaccagtcggtccaggaaataacggtcatgtgatacaaccagcagagaaccggagtagccgcgcaaataatcctccaaccaggtcagtgtttgaatatccagatagttggtaggctcatcgagcataaggacatctggtgcgagcagtaggatccgcgctagcgcaagccgagttttctgtcctccgctcagagtagctacgggcgtctcaggtgcaaatgaaccaaagcccataccgtgcagcacgctgcgaatacgggtctccatttcataaccaccgtgatccttgaaccagtctgaacgacgtgcatagcgttccagcagatctgcgtagcgtttttcgttttgagcattggccaggtcagcgatgtcctgttccatttgccgcagttcccgttccgcttcaatcaggggagtgaacaccagcatcatttccccccagatagaacggtcagaattcaagccgctgttttgcgccagataaccgatgctggtctccttcgccttgaaaatttgtccgctgtcataggatatttcaccagcaatgattttgagcagggtcgatttgcctgcaccgttcacacctacgagtccaatacgttcacgttccaatatttgaaggttaatcccgtccagaacgggctcaattccataagatttagtaattccggttacttgcaatagcatagcgtatcgttcctccattacattttgcacagttctacctgctttcttcacaggtaccttccttccagtttacatgaaattacccactattgcactgctttcaccctgtaaacccttgagccgcgtgtagtcaatttgtataaacaatgataaacttaaacgagaagtgaaaaagaatgaaaaaaacttgcaacgtacagcacttactgacaaatgggacaatagtaacgttttaaagattatcgacgattgtgcgggagggcggatgtgatggatgtctgtaatgtgaagaacgcgctgcgtttgcagcaacgggaagcgcgtgactccatggacccgctgacaaggcagaaggcatcggctgtggcctgtcggcatgcaatcgaggcatgggagcagcttagaatagacagaaacggagataagctaaccttatttagttatctctcttttggcagcgagatttcgacgactcccctcattgagcattgctggtcacagggagatcgtgtcctggccccaagagtggatccggtaactcggactatggagctgagggagatggatcagtacggagatattgtacccggcatctggaacatccctgagcctgctttgacatgcaaggaatggtcgcctgaaatgtggacggaaattgactgggttgttgtgcccggcttggcctttgatcgtcgtgggggcaggatcggctacggcggaggctattatgaccgctttaccgtacaggtagaggcagagaagcgtaacaacagccatgtaggtccgctttatgtctcgctgctgttgccgggacaattgctaacacaggtgcccatggagccaagggatttgcgagtggacgtgctgtttactctggatggacgcttagattgtgattattgacaaatgatgaatgaagtaaagttgggtatgtgaaaggagttgtgagggagtcgtggattcctttactcattttaatgaacagggacgggctcggatggtagatatttcgggtaaaacgtctacgattcgtacagcagttgccgtgactcagattacgatgaatccggctacattgacggctgtaaaagaaggaagaatcggcaagggtgatgttcttgctgtggcccaggtcgccgggattcaaggcgcgaaaaaaacgtcagactggataccgatgtgtcatccactggccctgacaggcgtgaacattactttttccgataatggacatgatgtgcttcatattgaagttgaagtgaagaccgaaggtaagacaggtgtagaaatggaagctttgacagcggcttcagccgcagcgttaaccgtgtatgatatgtgcaaggcgctgcaaaaagatatgatcatcggccctaccatgctgcaatccaaaacaggtggcaagcatggggattttcaaagggaggaccaccgggaaccttgacatagacaacattgtcgccgagagggtactgtgatgtgatggaggatgcagcgtggctgtttctgattttcagaagagaaagtattctttcatgataggagaagggtgatcttatggtgtggaaaacggcgatcctaacagccagtgataaaggggcaaggggagagcgtgaggatacaagcgcacaggtcatccgggaactcatcgaagaagaactgggcggagagattgtggaataccggatcgttcccgatgaaccggatgaaattattgcagctttaatcgaaatgaccgattattttcatgcggacctggtactaactacgggtggaaccgagctggcgatccgtgatgtgacaccggaggcgactaggcgggttgtggaacgggaagtgccaggcatggcggaagccatgagaatgatcgtgatgcagaaaaatccagcggctatgctattccgtggaatcgtaggaatacgcggacgtacactgatcgtcaatttgccaggaacgcccaaaggtgtgcatgaaaatttggcagcgataatggaccaacttccagaagcgctgcttatggtgacaggccagttccggtagaaggcagcacatcgtgtgtggtatgatacctatagaatttataaggccgtatacggacaaagattgttattttgtccgtcaacataaggaggattactacacatgcccaatattggagcaccgggttatattttgttaattattctggcgctgctgctatttggtccgaacaagctgcctgagttgggtcgagctgtagggcgtacattccgtgagtttaaaaacggggcacgcgatattttatcagaagatgaacggactgagcgtaaagacagcaaagatagtgtggtcaaagcatcaccaacgacgtcttcagaagttcaacctcagcctgaggataaacgcttgtcatagatttagtgatcgattcttgatctagtacaataaacaaaagcctcttcttcagtgaagggctttattttttaggaggcgctgctgcgttccgttcagaaaggaggagtggacttgaccccatcagagcatgaaatgccgctaatggaacatctgggagagcttcgccgcagaattatctatgtgctaattgtatttgtattggcactggctggtggtctgttcgcggcgggttctgtctatgactggcttattcgctccggttcggcgcaagcttttcagttaaacgcgttttccttttgggacgggatcggtatctacatgaagatcgccatgatcatcgggattgcggtggcgctaccgtttgcttgctaccaactgtggaagtttgtcagccccggcttaagaccacaagaacgaagtgcgactttgcggtatgtgccttatgtgctgcttttgttcatcattgggacagctttcgcttatttcattattttcccgatggcaattcagtttacatcgtcggttaccaaaagtatgggattacaggaaacgtacgggatcgcacaatatttcacctttatgtttaatattgtactacctgtagcgctgctgtttgagctccccctgcttatcatgtttctgacggggattcatgttttaacaccaatgcggctccgcaaatggcggaagatttcttattttctgcttgtgttcgttgcggttgtcattaccccgccggactttatttccgattttttggtggcgattccgttgctggtgctatatgaagtgagcgtgtatttgtcttcggtcgtgtaccgcaggcagctgcgtgcacaggaggaacgtgaggcccaattgcgtgtagcttcagaataataaagcaggacctgaatggctcagtaaacaatttattcgggtccgcgctacatggcaattgcagataatgaatggcatttgtatatcatggctatttatagagcataacagcagcagcttagctaccttaaatctaaccattagtcttgagttatcttgagttaacggttatttttcagatagatggatataatcgggaagggctgtccataaaaattcccataaaaaatacattagggacttgaaattcaatcccaagttgagtatcataaagttggttgttagcactgatgactgtcgagtgctaatacatacaacataacaaccaaattacaggataaaacacttaataaggaggctattttttcatgatcaaacctttgggtgaacgcgtattggtggaagcaattgagcaagagacaacgacttccttcgggatcgtacttcctgactctgccaaggaaaagccgcaagaaggcaaaattatcgcggttggcgcaggcgcattgaaagacggtgcccgtattcctctggaagtaaaagaaggcgaccgtgtcattttctctaaatacgctggaacggaaatcaaatatgaaggtaaagaatatttgattatgaaagaaagcgatatccacgcgatcatcggttaaccggaacccggacaagacctgaatataggaattgaaacaaatcattcataatccatagggaggtttatcacaaatggctaaagatattaaattcagtgaagacgctcgtcgctctatgttgcgcggggttgacgcattggctaatgctgttaaagtaacactcggaccgaaaggccgtaacgttgtactggagaaaaaattcggtagcccgctcatcaccaatgacggtgtaacgattgcaaaagaaatcgagctggaagacgcgttcgaaaacatgggcgctcaactggttaaagaagtagcaaccaaaacgaacgatgtagctggtgatggtacgactactgctactgttttggctcaagccctcatcacagaaggcctgaaaaacgtaactgctggcgcaagcccaatcggtatccgtaaagggatcgacaaagcggttaaagcggctgttgctgaactgcaagccatctccaaaccaatcgaaagcaaacaatccattgctcaagtagccggtatttccgctgctgatgacgaagtaggcgaactgatcgctgaagctatggaaaaagtgggcaaagacggtgtaatcactgttgaagaatcccgcggttttgcaacagagctggaagtggttgaaggtatgcaatttgaccgtggctacatttccccgtacatgattacagatacggacaaaatggaagctgtactggacaatccgtatatcctgatcacagacaaaaaaatcacaaacactcaagaaatcctgccattgcttgaaaaaatcgtacaacaaggcaagccactcgttctgatcgctgaagacatcgaaggcgaagcactggctatgctcgttgttaacaaactgcgtggtacattcaacgctgtagctgttaaagctccaggatttggtgaccgtcgtaaagcaatgctgcaagatatcgctgccctgacaggcggtcaagtgattacagaagaactgggtctggacctgaaaacagcttccgtagaccaactgggtacagcacgtcaagtgcgtatcactaaagaaaatacgattgtggttgacggtgctggaaacaaagccgacatcgacgctcgtgttagccaaatccgtacgcaactggaagaaactacttccgagttcgacaaagagaaactgcaagagcgtctggctaaattgtccggcggcgtagcagtcatcaaagttggtgcggcaactgaaacagaattgaaagaacgcaaactgcgcatcgaagatgccctgaacgcaacccgtgctgcggttgaagaaggtatcgtatccggtggtggtgtagcgctcctgaacgtatacaaagcagttgcagctgttgaactgcaaggcgacgagcaaacaggcgtgaacatcgtgctgcgcgctctggaagctccaatccgcaccatcgctgctaacgcaggtgaagaaggctctgtaattgttgagcgtctgaaacgcgaagaagttggcgtaggctttaacgcagctactggcgactgggtaaacatgatcgaagctggtatcgtggaccctgcgaaagtaactcgttatgctttgcaaaacgctgcttccgtagcagcaatgttcctgactaccgaagcggttatcgctgacaagccagaaccagaaaaggctgcaatgcctgatatgggcggcatgggtggaatgggcggaatgatgtaataggtttgaaaaaacctataataccgctatttaaagggctcccgagagggagtccttttctataaaatcacataaaaatcacattctatgcaaccagtcagatttgaaggatgtctgcgaagtgatttttaatcttctcattggcattttccttcattttctccgtaacgtgcgtatagactttcaatgtagttttagcgtcatcttggctaacttgcttcatgatcgttttgagatcaacttcatcttcagtcagcatcgatagtgagtgtcaattatattaaatttacgaatacataatgtagatttgggtggagttagagtgtatttacgcatattattatcagaattgtaaagtgtcttggttattcgtacgtaactcatttaactcaaagttaaagtccgtatcttttaaagcacagagttccccagatcgtatccctgaaaaggtaagcaagtgaaagatttcaatgtcatcaggtaagccatgttcattaactgcatttaaaaattcagccagctcatgttttactaagtaaccatcctcgattgggatattttcaatttcctctagcgtaaacattttcgccgggataactgctcccgaacatggattatccaatctcattttgttttttattgcatatttcataatcatatttgcagttacatgtacgccctcaatggttgtcttagcatactttttatcatctaaatcgtttaaaatattctgatactgtttatgtgtaaccttgtctattatgaccttagaaatatatcttagtaggatcttaatctctttttctctaactcttacggtatttttcctttactttgctcttggaataagttttcaaccaatcccaggctacctgttcgaacgttagcttcttgattttctttgtatctattccgtgatttttttgggcttccaagactttctgtacccgctcctcagcttgttttttagtatcacctcgacgtgcaatctgatttctcttactagttacgggattaggtagaccgtctactgtacaaatccacttatagccctgtttgttgtttgctttaattttagtgaaagatgccatacattctatctccttatataggtacaaatgttcgctttaatagtgaaaagaaaagcccggaagggctttagctgtgaatgatttgaactaattttattgtacaaaaactccaaatgtttgagaattttctttatatttagaattactcagctctgcttgctctaaaaataattccgtacttggtcatcataattttatactcaatattattctttgtaattttcttctcgttttcggaggttttattagaaagagaacttatcaaacctgaattgatgtctactacctcgtctcgagttaaatcctgatttataagaatagtcacaatgcccattacatttgaaagtcatctaaaccatctccatttttccctggtaccattaaagcctcgataaacattgtaagcaggacccagtgtgtttgggtgaagaatgctgccaccttcgactgggcacagtgccgtttcaaacatgaaccagtcttttatgctcatatgaaaggcaaatctcctgcttggtacggtgatcggacacagacaacggtatggaaggctggcctacccgttgaggacccgctcctcgagacagtatgggaggtttcgaggggcgatgtgaacaagtacgtccatcccacccaaaagcctcttgatttgctggccatcccaatcaaaaacagcaaccaacgcggtgacgagatcgttgatttcttcggcggcagcggcttcacgcttatgacctgtagcagatggaccggacattggaaatggacccgatcttctgcgatgttattaagaaacgattcctggagagcactggtattgagccagtcctgttgcatcgggctaaacccgtagcataggaaaaaggaggacgcgctaacgtcctccccccaatccagggtatcccccggctgagatagcggcccgccacgcgtggcattttgcagacatccgctatctcgcattccagtatataggaaagccgagggatacgacattgggaacagcagacgaacaatacaacacagcattacaacgcgagattgaaatcatagaaggtatccttgaaagcaaggcgcagtaccggaagattgttaaggctggcatagctcagtgggtcaaagacctgcaagctggaaatattaaaatgcagacggtcaggacttggatcgtctgattgagctggatataaagcttcaaaaggatgagttgtaaaagaacataataatcttgttagttaatgcataaatatggatttattaaacaacgttaagattttattgtaaaataaattagaaacatggaatcttttagtagaatgaagtggtagttaatatattaaggaggaatagaagtattatgaagaagaaacatttaattgcgtcagccttatctttaggtttgctaggaggagctattgctgtacccagtgcgatctttgcggattcagatgctgcaactaattccgcaaatacatcgacgtacgcgacccacgatgaggtgaaaacacctggtaatcatgatataagtctttttagaacaaaagatctttttaatgtgaaccttgacggcaagtcgccattaacagagttctccatagatcctggatatggtcatgttaagattcgtgtaagaaacaacaccaaagctacgcttacttttaccttaaagcatgtcgacagtgggaaagattattttaccaagtatgtgggtgctggtgatacatttaattggtatagcacggatgggttttcaagcggattgcgctcaggaaaatatgaaatacagtggcgtgccggcggagcttatgtagacgcctcagcatgggctatatcagccactaacccagatgaactttaattaaaccaagctataaagttttgtataagaaaagctaactggtagctcgcttgattggagaagtttttacttatactgcaacgaagcaaggaaagcttcaggccattcggtttgaagctttccttgcttcgtttataactcaaaggagaaatgatattggtgaaaaagaaaaaaatatttttttcatcagccttatctattagtttgttgggggctgttgttgtgccgagtgtgatctgtgcaagttcagatgcgtctgattctgcaaatacatccagtattgcgagcaaaaatgctggtaaatcaactattagtgaccaagtcataactcctcaaaaatcaagagatgtttttgatgacattttcgacaaaaaggacccagtatcacgttttgtattagatccgggatacgggcatcttaaaatttttgccaaaaatagaggtggttcaaccattacctttagcctggtgcatacagacagtggaaaacaatatattgttaagactattggcgctcataaaaaattgttctgggatagtgtaaattctttttcacaagggctgcgctcaggaaattatgaaatacaatggagagctaacggcgacattgtgcatgtcacaacatggggtgtatcaggaaatgattctgcaactacatccactacggcgacccaagatgctggtaaaacaactactggtgaccatgtcattactccacaagctactgatggacaaattgttattcgtcagtagctggatttaatgattctgctgattttgacgttaaaggaggatatggatatgtaagattgtacttgagaaacacaggagacactactataacttttactgtgaatcagggaagtgcatctggtgcggaaaagtacagtggaacagtaaaacctggtaaaacattcgatgacatattaaataaaagcaaggcatggtccacagggaaattttatgttagtttaagtagcggttctggttccatgtctggaaagctcggagttcggactagtactaatacgaatttttaaatatatttctgagaattcgccttacttttcccatcgaccggcagagattcaaataaccggaggcaatgaagttgaaacctttaccgtcataactggacatgagcgcacagggaaacccgtctcgaaagtgaaacgggtttctttttctactatccttccgcgctattgggagagaaaatttgggagacggatagcaagcaaacagtcacctacaaaacgcccgaggtgacgtggaagctgatggagcaatggaagggtaagccggttgtgctcaattttgaaaatctgtttgtaatcccaccctgctggctaaagccagtggggtgttttttgtttacaggagtgctcttatgacaaacgcagtatttccgcatgattcgcaaaaaaagattgacaactgttaagtgctggacaaaaatagtaaatgattataaaatactgggatttctgtatgaagggtggctatgatatgaagcatacacctacgattcgagcagaattagatagatacttacaacaaaagggtttgagcatagcgcaatttggacaacttgcaggcatgaataggggaatagtaagtgctattgtgacagggaataagtcaatgtctgttaaccagcttgatctaatcactgaggctatgggtttaccagaaggggatttttacgatctgtttatagaaaactacatcatcgaccatcctccgaatatgaggcgaatcgagccatttttgtttcgctgtgcggagttggacaagttggatgcgatccgtcgagtggtgggagccatcatggacaatctactatattcacccaagctatttgaaattgcagaagaattgttggcgcagggacgacatgaggctgcgctactgctctatgagggtgtggctgaagcggagaaatatcaacattctgagcgcttagccatctgccaataccgcatattcacaattcagattggtgacgaccaaagccgcaaccacaaggcagctatactatttgagccttatgtcgagcgcctagatgatttagaacaacttgatgcgttaaaggatttagctaatgtgtacaggtctttgcgtaaatgggacaaggttgatgaaatagcaagggtgatgagagctaaagctgaaatccaatacaattggaaacatcaacagaagaaccaagaacgcaatgaggctgctaagaaactaagtcgtccgatgtttgtgtacatcacgtatgccgacttactatgtgcgagtgtctgtgatgcccgaggcgattaccaacaagctctacaatatacatacgcctatgcggacttggattgggttaaagagactgatgatgatactctctattgggtagaaatgtatcaagattgggcacgatgcaatatttatgtaaataagctcctgtcaggagatgtcagcgtgctctcagattatgttgaatacatagcagaaacagcagataccatggaaggtgagaaactttcaaagctgttaaacgttatgatagctgctaatcaatataatttggatgttgatgatgtactttcaaggtttaaaaaagagattgatgcctttactcaactcccgacatctactgatatgtacagccaacaagtagtacccgactacattgcatggtttggttacgaaatggcctactattatttaaacagagaaaggtacagtgttggttttaaacaattgttatttgcaatggtaaagtcacatataataaataatgagacttactttataaattgtattggcctgtttatgcgtttccaagtctatgcgactcctgaaatcaaaacagagttctccaatctaattgaaaaggtgtggataggtaatgttgagaaaaatgggactgttaattgttgcgagtagctttttagttttcatcactgtacctggcatccagatccttgtgcaagttggaggttcctaaacggcagtacagcaatcctcgctaaccttaattggtcgacggggatttttttgttgaaggaattaccacatcgttcatcgaatgaatgaccgaggtgatcagaatgaatcatacatataaagtgttaaagttggacatagaactgtttacagctgcattaagctaggtaagagtatatgtagtaaagccgttaggtgaggaaatagtagagatcgtagactatggtggagtagtcgaaagaatttcttctgagtcagttaaaatatcaggaaaagcattatatgagggggcagtttgagtttagagtaagtaagtagtgctataggcagatgtaaataaacacctgatttatcccgatataatacacgcaatgatttgtcaaaaaggcggggatctagttgatggttttattgggttttatagctgtactttttattttatttttttcactttggatatcagctaggcgcaacgaaagagcacctaaagtaattcgtcgggcagtagttcttgataaacgtgttagattagagaatgattcaccttcagaagattatttttttacttgtgagtatgaaaacggggaaagagaagagatagaagtcgatgaaagtgagtatggggttattgttgttggggacacaatcaatgtaataagacaacgtaaactgttaagagtagaaagggttgtttaatagactcacatgataattggtataaaattctaatttagagtagatgtaaaagactctgctgggtatctggcgagtcttttttgttttgcgacatgctttgcgatacttcgacatgaatctcctattagtataaagaagatttaaatactatggaagtgtcatatgataaaaggatttgtaagaggattaattgtatttttattggcatctattttttccgttcagggcgtttacgctgaaccggcagcaatcagtcaacaagcagctgggtatacgttggcaagttcacgttaccctgaaaccggggcgcatattagagatgcaatagcagctggacatttcgccgtttgcacaattgacagggatggagctgaagaaaaccgtagggaacctctgaagggctatccaactaaaaaaggctatgaccgcgatgaatggccgatggctatatgcgccgatattcgatacataactcctagtgataaccggggagcaggatcatgggtaagtcatcagttagataagtatgctgatggagctaaggtaagattcatagtgaaataagcgtgagggactctacagagtgtggctgatagagtccttttatcatgcccaataaaaaataaatatgcaaatatttggatcatatttatagattagcaagtttatgtttagacagtgtgaaccctagataatatgatgtggttacacaaaacaaaaggagattttaaattgaaaaaaataacttatcttgccccacttatgctaatgtttttcattgcgtttactggaatagttcatagtgaaactgcaagtccagtcaaagtgacttcaataacagcaagtgatactaaaatcaataagagtactatttttactgttactggtgaaaacctacccgagctttttggcaaaaaaaaggcttcaaaaggcggagataattataacaattttgattttaatgatagtaaaacatcttgggggaaaaacccaactgatgaatatggagtaaatgttatctcaagttctacgaacgaattgaagtttactttagatggaaatatttctaattacactgctgcaggactgtttaaactaggtttatcacctaatgataaatcacctacgcctatagattacccatactattatcaaggttcgtatgatttaaaatcaggagtattttatcctgctcctctaataccagaacaacttaaaggagttggaaaggattcttctgctttgttaagttggaataagaatgagcaatctgattttaaaaagtataatatttatcaggatggtaaactcgtaacttcgattgaaaatccaacaacagaacttgagataaccaaacttattaatgggactaagtatgaatttcaaatttccgcagttgatgtattaggacatgaatcttttaaaagcgatccaattactatagttcctaatggggataacaccgaaccaactgatccagagcaacctactgaaccgtctcaaccaacaggcaatcgcgcaatcatggtagttactatgacaaccggattggaaaaagaattcgacctcagcatgaaagaggtaaatgactttattggctggtatgagagcaagcaggctggttctggatcagcttcatacgcaatcaacaagcacgataacaataaaggtccattcagcagccgaaaggattatatgctgtatgatcgtatcctgacgtttgaagtaagtgaatactctaaataaattaaaaagctctgctaaccttaagggaactgaccccataac

SEQ ID NO: 53 - DNA, 228358 bp, Unknown
  Kingdom: Bacteria, Phylum: Firmicutes, Class: Bacilli, Order: Bacillales, Family: Paenibacillaceae, Genus: Paenibacillus
gcggaagattccctactgcggcctcccgtaggagtctgggccgtgtctcagtcccagtgtggccgatcaccctctcaggtcggctacgcatcgtcgccttggtaggcctttaccccaccaactagctaatgcgccgcaggcccatccacaagtgacagattgctccgtctttcctccttctcccatgcaggaaaaggatgtatcgggtattagctaccgtttccggtagttatccctgtcttgtgggcaggttgcctacgtgttactcacccgtccgccgctaggttatgtagaagcaagcttctacacaaccccgctcgacttgcatgtattaggcacgccgccagcgttcgtcctgagccaggatcaaactctccattaaagaccaaccgaagctggtttatagaaagagcgataagctcattttgaaactgacgagataaaatatctcttgtttgattttgcgaacaaaatcgttttactcactcgttgttcagttttcaaagatcaaacattcattgtctgcctcggcgtttctttcaacccctcagcaacttttatagtgtatcatatttcctagagttatgtcaacactttttttttcaaaagtgtttttcactctttttgataacacttgaagcgacaagaaataatatatcatactttctttatattgtgcaactgtttttttaaaaatacttagttaagtaacaatacactcgatataaagctctctttgcagcattaggttaatgatttccccatctacttgaatcaacggacgagtcggatgatctcgatcagcaaatataatttcccctgtacggttatcattgaggcgcaccttggttccattattgaattgggttagcttatgaataaaaacttgtacgacacttgggtccagctttccaaatgattctgacttgatttgctccagaaccagatacggtgattgggcaggccggtatgttttctctagagtcatagcatggaacacatcagctactccaacgattttagcgtagatgtggatttgttcccctttaagacgcagtggatatccagtaccgtccactttctcatgatgctgaagagctgccaaacgcacaccttcgttaatggctttcacatttttaagcagctggtatcctagtgatgtatgactacgtatttcttcttgctcttcccacgttagtttggagggcttgtacagaatggccgggtccattttagcgttccctatgtcatgaagcaatccagcaaaagccacctgcatccaatccttttgaggtaatccgatccattgtgcaatggagtaggaagtaagggaggttagcacggcgttgtgaaaaatatagtccacttcgatcatggcaggcggagtataggtcattacattatagcgctgaatgtgcaccagtaaggactccaattgtcctcgcagttcatatatagataaattagagacgagtaccgattgaaatgcgttcttaacgagcatcaccattttgtcatactcatcctgaaattgttcagattcatctcgcccatctaacgaaggaccttgcgattccgatattccagatcgaacagtcgtagactcgccactggattttgtaagatcatccgttcctacctcaacttgctggatcaggaacgcctgtaaaatctccaagtcacgcggtagcagaatgcgcccttttggtagcagcaagctgcccatttctgtaaatacatcgctttgcaatctaagtcctgcttttaattcgggtacgggtacagttgtcatggtcaacctctctgttctcacaacagctgctccagctgccagttatgatgtcattatattacttgggattgatcctgtacattcattttatgccatttaaagcatacttgtctgaattcgttagccagaaaaagaaaaaggctccccgaccaaatagtcagagagtctcttccatctaaaatttaataactaatgttgtttccatatgcaggctcttattcgccctcagaagattctgggtcgttaccttccgtatcttctgtattcatttcgagagttggttcaacagatgatagagaggagccctctccagcttccccatcctctaataattcttcaagcagttcatcctgctcctcattcttgttcgctcgacaaacagttgcaaccgaatcatcatcgcgaatattaatcagccttaccccttgtgtattccgacccatcgtggagatttcccccatgctagtccgaatcaaggtgccactagctgtaatgatcatcagatcctcttcggtttttacaaccttgagaccgacaaccggaccatttttatccgtaacattaatcgtcttgatccccttacctccacggctttggatacgataatccgcaacaggggtacgcttgccataacctttggccgttacaatcaggatatccaggctggtatctacgatgtccatacctattacagcatcactctcatcaaggttgatccctttaacccctgtagcgctacggcccatagaccgtacatcactttcagggaaacggatagacatgccttgtgctgtaccaataatcatttcctgctgtccgtccgtcagcttcacttcgatcagggcgtcatcttcacgcaagttaatggcaatcaagccacctttgcggatatttgcatagtcgtcaagtggtgtcttcttaatgattccatgctgggtcgcaaagaatagatagctatcctccacaaattcctcgattggaattaccgcattgatcgactcaccctgttcaatctgaatcaggttaataatcggtgtcccccgggctgtccggctaaggtcaggaatctcataggccttaatccgatataccttgcccttgtcggtaaagaataacaaatgatgatgtgaattcgtaatgaacagatgctctacgaaatcctcatctttggtatccatccccactacaccacgaccaccgcgcttttgactgcgataggtagtaacaggaaggcgtttgatatatcccgtatgggttacagtaataataacatcttcacgcggaatgaggtcctcatccagaatactctcttcacccactgtaatttcagtgcgacggtcatcagcgaaacgttccttaagttcattcagctcttcgctaatgatgttgagtaccagatgctcgttcgccaaaatctcacggtattccgcaatcttttgtattaactcgttatattcgttctcgatcttctcacgttccaaaccggttaagcgttgcagacgcatatccagaatagcctgagactgctcaagagtgagcgagaaacgctcaatcagtccttcacgagctgcttctgcagtttgggaagaacgaatcaaggcaataacttcgtccagatgatcaagggcaatgcgcaagccttccagaatgtgtgctctagcttcggcttttttcagatcaaattctgtccggcgacgaataacctcgacctgatgtttgagataatgatacaagacatccttcaggttcaaaatcttcggttcgttgtttacaatggccagcatattaataccgaaattcgactgcatggccgtatgtttaaacaaattattcagaacgacattcgggttcacgtctctacgcaactcaataacgacacgcatacccgtacggtccgattcatcccgaagatccgtaatgccttcaatacgtttgtcacgtactaattcggcaattttctcgaccagacgagccttattcacttggtaaggcagctcatgcacgataatccgtgctttattgccaatctcttctatggtggtcttcgcacgcatggtcacagatccgcgaccagtctggtacgcctgacgaataccagagcgtcctaaaatataacctgctgtcgggaaatccggcccttgaatataatccataagttccatcggcgtaatgtcagggttttcgatcagtgcttgtacaccatcgataacctctcccaagttatgcggaggaatattggtagccatcccgactgcaattccgccgacgccattcaccagcaagttaggataacgtgcaggtaatacaacgggctcgctctcttcaccatcgtagttcggcataaaatcaacggtctctttgttcaaatcacgtagcatttccatggcaatcttggacaaccgtgcttcggtgtaacgcatcgcagccgccatatctccatccacggagccaaagttaccgtgtccgtccaccaacatataacgcaaggaaaaatcctgcgccatccgtaccatcgtatcatatacagccgtatcaccatgagggtgatatttaccgataacttcgccgacgattcttgccgattttttgtaaggcttatctggcgacatgcctagctcggacatcgcgtacagaatacgacggtgtaccggcttcagtccgtcccgcacatcaggcaaggcacggctaacaataatactcatggcataatccataaaggattcgcgcatttccactccgatatccctattgatgatttgcgagttattttgatccgccatgctggtcctccttcttatccttcaatacaatgctctctatgtgaaaagcctaacaagatactgcctatacactccgctctctgcgcaggattttggctgaaatcctcatctgtgtaattatattactttcacaaaaagagcacaattaaacgcattgtcctctttacagcgtaaatccctcgtcattctctttctgcgtgtagcagattgctatctcttgtacaactcacaagccctgatcataacaaattccccagagctggggattagcccccaccctaagggccttttccacatacaatacgtatacggtcagggttcacttagcaaaattccgaaaaacgccgtatttctctattatatcattgttttacgcgcttgtcctttagtttcccttgttttgtcaaagtgttgcggattccaagtacatgactcatatttcgaaaagaaagggatgagattacttgtctattcagcgagtatccagtaagtggaccaaaacaaatgccattctccccaatccgacattggcggcttatgtaccagaaacacggttgtacacatttgatcacttgaacgaaatgttggccgtgtatggtactgtctatattaagccggataacggtacttatggaaaaggggttatgcgggcagagaggctgacagagccgcttccaccgacagaagaaggaattatcgaagagagaacttggtatgtgcttcgctatgaagtagataccttcaccttcgaaagtctagaagatctgcataaagtggttacttcccgcatacgaaaacgtccatatctgatccagcgtggaattccacttcttcagcatgaagcacgccctttcgatctgagggtattaacccagatgaatttgagacaccaatgggaaacaacgcttattgtaggacgcgtagctgctcctgacaaagtcgtcaccaatcatcacagcggtgggacaacgcgctttttcaatgagctagtcgctccatacatggatgtaaaggaagctgtacgactggagcaaaaattatcaaaaatgggcgaacgggtagcctggcagttgcaaaaaagatacccacgtttaagggaaattggattagatgtgggactggatcagcaaaattatccgtggattctggaggttaatacgagaccagcaattaaggtgttctcttctcttccaaacaagagcctctatcataaaatattcagatatgcagtaggctacggccggtactcttcatccacgggtaaaaccatacgctctaagaaaaaagcctaaaacaatgagttcaaatattcaaatacacccgggctggttaatgagaagaaaagggacgcccatttgggcgccccttgtgaactcctacaaaatactacctaatgagcacataaaacagtcactaggaaggaacgttaacattaaaaatcaagatttttcacgtacttcgcatgttcttggataaagtcgcggcgaggttctacattatcacccattaaggtattgaacagtgtatcagccaacatcgcgtcactgacagttacctgaagcatagtacgactctcagggtccatcgtagtttcccaaagttgggtcgcattcatctcacccaagcctttatagcgctgtacattgtatttcgcgttttctccaaattccctgatgatctcatcacgttccgcctcggagttcgcataacgtacaactttgttacgctccactttgaatagtggtggctgagcaatataaatatagcctgcatcaatgattttacgcatgtaccgatagaagaacgtcagcaacaacgtacgaatatgggcaccatcgacatccgcatctgtcatgataatgaccttgtgataacgggctttggcgatgtcaaagtcgtctccgatccctgtacccattgctgttaccatcgaccggatttcatcactggacaaaatacggtccaagcgtgccttttcaacattcaggattttaccgcgaatcggcaaaatagcttgaaagtgacgatcacgaccctgcttggccgatcctcctgctgagtcaccttcgacgatgtacagttcactaatcgaagcatccttagaggagcaatccgccagtttgcctgggagcgaactgatttccagcgcacttttacgacgtgtaagctcacgcgctttacgcgctgcttcccgggcacgtgctgcttgtaaagatttatcaaccacccggcgggaaacagacggattttcctctaggaattcctggagtttctctgcgaatagggattcgacaatccctcgcacctcactgttaccaagctttgtcttggtctgaccctcaaactgtggttctggaattttgacggagataatcgccgtcaatccttcacgcacatcgtcaccggtcaagttggcgttgttgtccttaatcaagccatttttacgtgcataatcgttaataatccgggttaatgcactcttgaaacctgattcgtgagttccgccctcatgggtgttgatgttgttggcaaaagaataaatattctcggtatagctgtcgttatattgcaatgccacttcgacttgaatcatatcacgcgagccttcgacataaatcggctgttcatgcagcgcttctcttttttgattcaaaaattgcacatattcactgattccgccctcgtagtgaaatgtatcgctggcgcccgtccgttcatcagtcaagctgattgcaatacctttgttcaggaaagccaactcacgaatccgtgtctggagcgtatcatagtcatatacggtcgtttctgtaaagatttgatcgtcaggataaaaagtcgtttgggtacccgtctcgtctgtgtcaccgatgactctgacatcatactgcggagcaccacgatgatattcctgctcatacagatgtccgtcccgtttaacatgcacgatcattttgctggagagggcatttactacggatacaccaaccccgtgcagaccaccggataccttgtaccctccgcctccaaatttaccacctgcgtgaagcacggtcataacgacttccagcgcagattttttcattttggcgtgttcacttactggaataccgcgaccgttatctgtaacggtaatgctattgtcttcgtgaacgacaacttgaatgctgtcacagtaacccgccagcgcttcgtcaatgctgttgtccacaacttcccagaccaaatgatggagacctttggcgctcgtggagccaatatacatcccgggacgtttccgaaccgcttccaggccctcaaggacctgaatctcgcccgcatcataagacggttgattcatagacatgcctttcacctacttctatagattctatggttaagcattggcaacaaactggtttgcccgctttttgagtgttgttgaggagatgggggaataatacaccgtattctgagtcactacgatggacttggcttcctcttcgccaatcatctcgacatgcttctgctgttgggcgtggttcacgtattgcttggagattttagaggatttttcaatcgagatatcgaaaatagccacaagctctgaagagcggatgattttttctccacccagatgaatatacatagcggtcactcactccttagtgttccacatgcccgtcgtggacgtgataaatattggcatccttgagtcgttctgcgttcaaagtctcaaccccggttgccgtgataaaggtctgtaccttgctttggaaagtctcgatcagctgagtctgacgataggggtccagctcggacaaaacatcatccagcagcaggacaggatattcaccaatttcttcatgaattaactctatttcggccagcttcaaggacagggccgtcgtccgctgttgcccctgcgagccatacgtatgcacttctctgccgttaatggcaaaggccaaatcatcacgatggggtcccgccaaagtcatgccacggcggatttcctgttccctcatttgggataactttatcataaatcgctccaataagacagcttcatcttcttcctctggctcactgaaggagggaacataggttaattttaactcttctgtcccacctgcaatcccttcatgaatggcctgagcccacttttgtagctttgttataaattgtttccgctttttaacaattttaacaccatgctcaacaagttgctcattccatacctccagcatcagctgcactgaagccatatccttaccccaagcttgcttgagcaggttatttcgctgcaccaatactttctggtattgctgcaaatgatacagatatcctggcgcaacctgtccaatttccatgtcaagaaaccggcggcgaacccccggtgttcctttgacgatttcgagatcctcaggtgcaaacatgaccacatttaacgaaccgataaaatcgctcagttttcgctgctccagtccgttgatctttgcttttttgccttgtgtggataacgcgagatccagtctgattttcccgtattttttatccacatccgcagctaggtgagtggaagtagccccgaaagagattaactctttgtcgcgggacgttcgatgacttttggttaaagccaatacaaaaatcgcctctaccagattcgttttgccctgcgcattttgtccgattagcaaattaacgggaccaaattcattcagctccagctgttcatagttccggtactgctgcaaaacaatgttgttcacaaacacatagggtcccccttgttactccgtacctaaaaggagtccttgccacccaggcgatcatgctcctgctgtaacttcgaaacttccattgtcctctacttctacggtgtcacctgggtacagttttcttccgcgacgttcttccggttcaccattcacacggacttgtccctcttgcagcagggctttagccatgcctcctgtggatacacaatcggctaattttaaaaattgatcgagcttgatgtattcggtctgtatagatatctgtttcaaggcttgttcatcctttcgcttgtcctcgggtgggttaaagctaaacgtcagttggttgtgcgatatggcaggatgatatacagcgcattgctggaatctgccggttttaaaataatgggactcataatgccggtaaaagcaatcgtcagctgctcgctatcaatcaccttgagcacgtcgagcatgtatttggagttgaacgaaattttgagcggctctccctcaaatttggacacagttacttcctcacgcactttgccaagctcagaggaactagaggaaatttccaagccgccattttccagcgactgcatttttacaatattcgttttttcctcacgggacagcaaataagcacggtcaattgactcacttaaactttttgtatccacaatcagttctgttttgtaggaggtcggaataattctagaagtatcaggataggtgccgtccaagatgcgggaataaaatagcacccgatctactttgaataatacctgattgtccgctactacgatatccacaagcatattttggtctggaataattctgctcagctcatttagcgttttgcccgcaatgacaacattgctaaagcgcaagccttcagacgtctccaaatgagcgctgcgggtggcaaggcggtggcggtccgttgccacaaacttcagttccccctcagccagattccacaacacgccggttaaaatcggtgtcgtttcgtgggtggaaatggagaacaccgtctgtttaatcatatttttaagtaaatctcctggcacagagatgacttgattttcttcaatgttgggaagcaccgggaattcttcagggtccaagccaacaatctgaatttcagttgcaccggacgagataaaggtttggaattggtcttttacctccatacggatctcctgagacggcaactttttgataatttcgacaaagaatttggctggcagcacaacactaccgggttgttcaacctgaacaacagtttggtcaccatcctccatcggaataaaggattgaatggagatgtctgtatcgctggcggtcagcgttactccctggtgattcacatccagcttaataccgctcagaatgggaatcgtagtccgacttgatatcgctttggatacatgttgtatagcctcgttcaaaacgtttttcagaatgctgatcttcataagttcctcctacgggttttaatccttcaagcacgcgttgacgcgggccttatttaggtgatgtatatctttaaaatatattagtaatagtaataggcgcactgaatatgtggataagtcactgtaaccctaataaaatcaagcctatccacatgtgtataaattgtgtataggctctgaacttgttcaggttggatttttgattttttctattaggttgttgataactttaaacagatcctgatccacttgaatggatttggagattttttcgtgcgcatgaatgacagtcgtatgatcacgcccaccgaaagcttcgccgattttcggcaaagaatagtcggttagctcacgagacaggtacatggcaatttgtcgtggaaatgctacagccttcgtccgcttacgcgctttaaaatcctccagccgtagattgtaaaattccccgacttgatgctgtatatcctgaatcgtgatcatttttggacggctggacgggataatgtccttcaacgcttcagccgcaagatgacttgttacatcctgatttgttaaggaagaataggcgacaacgcgtattagcgccccttccagctcacggatgttcgtatcaatttgattagcaatatacatcatggcctcattgggaatatccaggttttccgcccgcgcctttttccgaagaatagcaattctcgtctccagatccggcggctgaatatccgtaataagtccccactcgaagcgagagcgcaaccgttcttccagcgttggaatttctttaggcggccgatcgcttgagattataatctgcttgcgttcctcatgaagcgcgttaaacgtgtggaaaaattcctcctgcgtcgattccttgcccgcaatgaattgaatatcatcaatgagcaaaatatcgatgttccgatatttattccggaaactttccccgcggttgtcccggatggcattaatgaattcattcgtaaacttctccgacgataaataaacgaccttgctggtcggattgtgctccaaaatatagtgcccgatagcgtgcatcagatgcgtttttcccagccccacaccaccgtataaaaacagcggattgtaagctttggccggcgcctcggcgacggccagcgatgccgcatgggcaaaacggttccccgatccaatgacgaatgtatcgaatgtatatttgggattcagcatatgggacacagcttcttcatgaacgaccggctgctgctgaggttgttgctgaaggtcgacctcggcgggcttgttctcttcaataacgaacttgacctctagctgtttgcccaaaatttcataaaccgttgctccgactagcttggtatagcggctttcaagccattccacggcaaaagttgtcggtgcagaaatcacaatggagtggtcatttagtttcgctgccttggtagccttaaaccaagtgtcgtaactcggcttactcagcttggtttgtataatggatagaatttgctgccatagttcagaggtatggctgtccacagacgtcactccttttaaatcctgacattttaccgaattaagctgcagagagctgctctcggcgcttcggcaaaacgcctaaaatcccaaaaatgttgttgaaggccataaaaagacataccgccgcctaaatcatgcggcagtgtggtgagagaacgcagcacaaaatgaccctgaaaaatagctaatggaaattccgctgctgatcagcagaagagaggcgatatttctcaggagggaatgtgcggcacgatccgttctcttgatcccgcaggccaaaacgggactgcaatatgtcgaaatcaaatgaaaaatgtagaatatatccccagaatcccaaatccgcacaaaaataaaaagatggataaattgaacttgttcacaactttatccacagggtgttgataatatggagggtaaaacaacatattcacattcaaaagtaatatcatcatagcaaaagaagccttgtatttcaatgactggtggttatttatccacaaattcaatctgttgtgtacaatttttattcacaacacaagatattgtttataatttgttcagttttcgacaataactcttttttactctaaaatgttatgcacaggttatgaccatttaaatcacaattcagttctttttgtggatctgtgtataacagccgttgccttttggtcacagaggcttatttttctgttgaaaatttccggtaacgtttccgacattatttttgaacgaacccgataacgtcgatctgaaaataggatggattcaaatcaaagaatgaaggaattaaaaagagcagtttttggaggagtgaaaactaccaatagaatgctgatgatggaggagaggcgaaagaaattttttgaaataagggaataaaagagcgaagtgagtgagcgggggaaggggaggaggcttcctgattcgaaaaagagggagaggattcacaagtacattgactttggccgctatttgtggttaaatgtacaaaggtgttttttgtggagattgctacgttaggtatattccatataaaacgtattccttgtaaggaggtgcagcacaatgagaccgactttcagaccgaatgtcagcaaacgtaaaaaagttcacggcttccgtaaaagaatgagcacgaagaatggccgtaaagttttggcagctcgtcgccaaaaaggtagaaaagtattgagtgcgtaatgcgtgcataaagaccactacggtggtcttttttttcataattgaggtattcagggatcggatcccttcttctagtgttgtaaaaatgtagtgaaagaagagggagaagtccagcatcctgtcctatattagatgaagcttttgaaaacggatataaaataagcgagattaccatgttggaatgttgtccatacttcttactatataaaaggtaaaggtaagcttaccgacatgtgtaaaagagatgagcaaggagaagcgccgtgcaaaaaaaattgcgtctacgaaaccgggcggactttgggcgcgtataccgccatggcaaatcttttgccaaccatcagtttgtggtgtactggttccgccgcagagaggtagagcagttccgcgtcggaatttcggccagcaagaagatcggcaatgcagtagttcgcaaccggatgcgtagaatcgttaaggaaattgtgcgccatcatgaacatgaattggtggagcagattgacctgatttttatcgttcgtaaaggtgcggttacaatgtcgtatcaagagctggagaaaagcgtgctgcacgttctacgcaaagcctcgctgctcaagtcttcacgccgatagtcagtatctttgtcctacaggatatggtatgatttacgttggaatggattggttaagaaaggggttatgaagtgtcgcgtttgaagactcaacggggaaaatggttcctcctgattgccttattggcacttgttgctgtgctgtccggatgtgcccagacggcccacaattcttacacgacggcagacttggccaatggatcgttttggcaaagatatgtcgtttactggttttcgtatgcgctagatacatttgcccaatggttctctggagagtatggcctggccgtactgattctggtgattatcgtgcgaaccattattttgccgcttacactcaagcaagtacgtagttccaaagctatgcaggccattcagccgcaattaaaagaaatccaagcgaagtacaaggatacgcctgaaaaggtccagcaagagacgatgaagttgttccaggaaaacaaggtcaacccgatggcgggctgtcttcctttggtagtacagatgcccattttcatcgcgctttataatgccatttattataactcagcattgcgggatcatgacttcttgtggctccagttaggtaaaccggatcacttgtttatcctgccgattttggcagcgattacgacatttgtccaaacttggatgatgatgaaaatgaatccgacgccgcagcagggaccgatgcaatttttgctgtacgtctatccggtgctgattctgttcatgtcgtacaacttcccatccgctttgccgttgtactggttctacagtaatatttacacgatcattcaaaactatttcctttatcggaataaggataaagaagcagcactggcgaatgtgaaaacagccagtctcgcgaaaacaggttcctccaatagtaagaaaaaaggtggtaaaaacacgaagggggctaaaaagtcgagatgaccaaagtcgtgacatcaggaaaaaccgttgaagatgctgtaagacaaggactctcccagctgggagtaagccgtgaacgggtaaccgtaagcgtgttggaacagccgtcaaaaggattcctggggtggctcggggtcaagaaggcgaaggtggagcttacgctgctctctgagccgtctcctgaaaccacacacgcggctgaacttcatgtatcggctcaagcaccttctagcgtgggacaggctttatcaaaagaaactgggcctgttgcacaggaagcacagatgaacatggaagcaccctcgggacatatagatgcttatgaagaggcggtgcgtttcatccgtgaaacagcagcaggaatgggactggacgttaaagtcgatgtccgccaccgcaaggatgaaagtacactggatatctccggtccgtcgctcggtatgttgatcggccgcagaggacagacgttggatgcattgcagtacctgacgaatatcgttgccaaccgtcattctgacaagttcatccgaattgtgctggatgccgagcaatttcgtgcacgtcggcaaaaaacgctggaggatttggcagatcggttggcgaaccaggctattcgttatggcaaggaagtggtactggagccaatgccgtcacaggagcggaagctgattcatgccaagctccaacagcatgcgctggttagaacatacagcaagggggacgagcccaatcggcgcgtcatcattgctaaaaaataatccgacgcaatggctctctgcaagatgcagaagccattgctttttttcttatatttctcgctgaaacggctgccgtccttgatgaaggacggcaatgtcgtttctacttgataggaggtagaaactttatgctgagtgatactatagctgccattgcaacggctgtcggcgagggcggcattgcggttgtacgagtcagcggtccagaagcggtcacagaagtggaggctttgttccgtagtaaaacacctctaagcaaggctccaactcacacagtacattatggacatattatagatcctcaaagccaggaaaaggtggaggaagttttagttacagtgatgcgggcgccacgctcttttacgacagaagatgtcgtagaaatcagcactcatggcggggtcgtagccgtcaaacgggtgatggatttactattactgcaaaatatacgtctggctgagccaggtgaatttacgaaacgtgcttttctgaatggtcgtattgatctgagtcaggcggagggtgtcattgacttaatccgctccaaatcagataaagctttttcggtggctttgaagcaggtagatggacaactgtcccagaatattcgtcgtctgcgtcatgtcttggtggagacacttgctcatattgaagtgaacattgattatcctgagcatgatgttgaatcttttacatctgacttaatcaaggataaaagcagtcaggttatgacggaaattgatcggctgctgcatacggcggagcagggaaagattttgcgtgaagggctgactacagcgattgttggaaggccaaatgtgggcaaatcgtcactgctgaacacattggctcagggcgagcgggccattgtgaccgatattccgggcacaactcgtgacgttattgaggaatatgtgacgattaatagtattccgctcaagttgctggatacagcagggattcgtgaaacgatggatgtagtggaacggatcggagtagaacgttcgagaacggcggttagtgaagcggatctgctgctcatcgttattaacgccaacgaaccactgcatgaggatgaaatggcattaatggaacaaatccgcggtagacaagcgatcgtcattatgaataaaatggacttaccggcccaagtagaccgggatttgttgctgcgttatgttcccgaagagcttatcgtaccgatgtctgtgaaggaaaatgagggagcggaccgactggagcaggcgatatccaagttattctttagtggcaagctggaatcagcggatatgacatatgtcagcaacgtacggcatattgctttgttgaagaaggcgcgccaatcgctggtagatgcctatgaagcagctgatcaatttgtaccgatcgacatgatccagattgatgtaagactggcatgggagcatttgggtgagattgtaggcgatactgcgcatgatgcgttgatagatcaaatattttcacaattttgtctgggcaaatagaacattcaagtatggctggtataagcctgctatcgttatagatatacaagagcatattcggcgtgaagaccggaatgtataaggaggtaagaaaggtatgggttaccaaggaggcgactatgacgtaattgtcgtaggcgcgggccatgcgggtgtagaatcagccttggcagcagcacggatgggctgtcgcacgttgatgatcacaattaacctggatatggtcgcgttcatgccctgcaacccgtctattggcggtcctgcaaaagggcacgtggtgcgagaaattgatgcactgggcggcgaaatgggtcggaatatcgataagacatttattcaaatgagaatgttaaatactggtaaaggtccggcggttcatgcattgcgtgcacaagcagacaagttctcttatcagcatgcgatgaaggaaacgatggaaaaggaaccgaatctcaccttacgccaaggtatggttgaagagctgattatggaagacggccattgcgtaggtgtaattacgaagacgggcacagagtatcgaagtaaagcagttgtcctaaccacaggcacttatctgcgcggaaaaatcattatgggcgagctgatgtatgagagtggtccgaacaatcaacagccttcgttgagattgtctgagcatttgagagagctgggttttgatctggttcgatttaagacaggaacgccaccacgtgtgcacaaggacacgattgattttagcaaaacggaaatacaaccgggtgatgatcaaccgaagttcttctcctatgaaacgaagtcttcggataatgaacagcttccttgctggctgacatatacttcagtagaaacgcatcagattattaatgataacttgcaccgtgcgcccatgttctctggtctgattgaaggaacgggaccacgttattgcccatctattgaagataaagtggtacgtttcagtgataagcctaagcaccaaatctttttggagcctgaaggtaaaaacacatctgaatactatgttcaaggcttgtcgaccagcttaccagaggatgtgcaattagctgtgctgcgttcgattccggggatggaaaaggtagagatgatgcgcaatggctatgctattgaatatgatgcaatggtacctacgcagttatggcctactttggaaacgaagaaagttcctggcttgttcacagcaggtcagattaacggtacctctggttatgaagaagctgcgggccaaggaattatggcagggattaacgcagctcgtaaggtgcagggcaaagagcccgtcgtattggaccgttcgcaaggctacattggggttctgatcgatgatttggtgacgaaggggacgaatgagccttatcgtctgctgacgtcgcgtgcagaataccgtctgttattgcgtcatgataacgcggacctgcgattgactccgatcgggcatgatattggtctaattacgaatgaacgatacgagcgctttttggataaaaagcaaaaggtagagcaagagattgagcgtttgcgcttggcgaaggttcgtccggttgatataaatgagatgctggagcaaggcggatctgcaccaatacaggatggcagtaatttgttaacggtgctacgtcgaccagagatcagttatgcgcaagtagcacaaatctcaccttcacctatagctcttactgaggaagaacaggagcaggtggaaatccagattaagtatgcgggctacattgaaaagcaattgatgcatgtggagcgtctgcaaaagatggagaagaagaagctcccagaggatattgtatacaatgaagttcaaggactggccattgaagccaagcagaagcttgaaaagatccgtccgatgtcgattggtcaagcatcccgtatttcgggtgtaactcctgcggatatttccattttgctggtttatctggagcattataaccgcgtaacggcagcaaggggatcataatggacgcgatacaacagcaatttaagcagcggctggcagagcatagtattgtgattaatgacagtcagttagatcagtttgaaacatattaccgtgtgctggttgagtggaatgaaaaaatgaacctgacgggtattactgagcgcgatgcagtgtacaccaagcatttttatgattctctttccctggccttttatgttccgttaaatgatgtgggaagcttggctgatattggatcaggtgcaggttttccaggcattcctttgaaaatatgctttccgcagattcagttgactattgtagattcattgaacaaacgtatacaattcttggcccatgtagtagagcagttgggtttggaaaatgttgaactggttcacagcagggcagaggaattggggcgtaaaccaggataccgcgatagctatgatctagtgacagccagagcggttgctcgtctcgccgtattgaatgaattttgtttgccgtttgtccgtgaagggggacactttgccgcgatgaagggtagtgatcctacggaggaaatcaaggaagcctcctacagtttgaaagagctaaagggaaaaatcaaacatgttcaggctttccagctacctgttgaagatgcagccagacatatgattattattgagaaaagagcggctacaccacggaaatatccacgtaagccgggtactcctttgaagacgccgttagtgtaattgtttgaaagaaagtgaatgtttcacgtgaaacattcactttttttatggctgacagactctttacataaaagacactttgctaacatgcgttcttgtttacatgggggaagaagatggatagatagttgtcaaagaggttgcataatttattatctgatccttccgaaaagctgatagagacgataggattatggctggaaaagtgatagaatagagataatcgttttaatgtaagttgactgctcccgtacccatgaattcagatatacatatagggcagtgggacaacaaatgtcaggggtgtacgtggagtgtacccgcttacggcgctgtttcatataaaagggtctacgatccgcgtaaggaactgtttttcacgaagcgctgttagtatggtgctattatgaaattaggtggtattatacggaatgaaagaacaattttccaagctatttggtttgacggagcgatctactggggacgaaataaaacaaattccagttcgggatattgtcagcagtccttatcagccccgtaccatatttgacgacgagaagattgatgagctatgccagaccattaagacgcatggtgtaattcaaccgattgtcgttcgtttccgtaatggacaatatgagattatagcaggggaacgtcgttggagagctgtcaccaagctgggtatggaaactattccagccattgttcgtgagtttaatgattcacaagctgcatccatcgcgttgattgaaaatcttcaacgggaagggttaactgcgattgaagaggctgtagcttaccaaaagctgattgatctacatcagctcacccaggaaagcctcgctcaacgacttggcaaaagccaatccactattgctaacaagatacggctgcttcatctgccggagagagtgaaagaggctctaatggaacggaaggtgtccgagcgtcatgctcgtgcattattgtcattagagactgaagaactacagtacaaggttttagatgaagtcattgccaaggaactcaatgtgaagcagacagaggcacgagttgccttttataaacaagtatccaccaataagaaatcgaagcggatttcctttaccaaggatgtccggcttgcgctgaatacgattcgtcaatccattgatatggtgtctggctcaggcttggatatcaagaccaaggaatctgatcatgaggatcactatgagattgtcattcaaattcccaaacgtaagtaagggatgaagcgtacaggcggcagcaattgccgctttttctgtctaacgccgaataaaaccgcagcatactcaattctattctgaaattgccgttatccgtaagttaaggactaagtaacgtctccatagagcgctttgtagttatggagtgtagcaggattccgattaaattatgaggtgaatgaagtgtcaaaaataatagccgtagccaatcaaaagggcggagtaggcaaaacaactacttccgttaatttgggcgccggacttgcttccctcggcaaaagggtattgctcgtggatatcgacccgcaaggtaatacaaccagcggtgtgggtatcaataaggcggacgtggcaaattgcatttatgatgtactcattaacgaggttgatcctagcgaagctattatgagtacacaggttgagggattggatattattccggcaaccattcagttagcaggcgcggaaattgaactggtgccgaccatttctcgcgaattgagattaaaaagatcgcttcaactcgttaagcataattatgattatatattaattgattgcccgccatcgctgggtattttgacgcttaattcattgacggcttccgattcagtcattattccaatccagtgtgaatattacgcattagaaggattaagtcaattgttgaataccgtgcgattagtgcaaaaacatctgaacacctcactgcaaattgaaggtgtgttgttaaccatgtttgatgcccgcacgaacttgggtattcaggtgattgaagaagtgaaaaagtattttcaaagcaaggtttatcagacgattattccacgcaatgtgagactcagcgaagcaccatcacatggccagtccattattacgtatgatccccgttcccgtggggcagaggtatatattgagttggcaaaggaagtggtatcttatgagtaaacggttgggaaaaggacttgatgcactcattccctcccttatggtcaatgaagaagataaggttgttgacattccgctcagccagttgcgtgcaaacccgtaccagcctcgaaaaacgtttgatgaagagtccattaaggaattagccgaatccatacgtcaacacggtgttatccaacctattattgcacgtagtgtattgcgaggatacgaaatcatagccggggaaagacgttttcgggcgtctcaattttgtgggaatccgactatacctgtagttgttcgcaattttacggatcagcaggtgatggaaattgccctgattgagaatttgcagcgtgagaatttgaatgctatggaagtagcagtagcttatcagggattgatggatcaattttctttaactcaggaagagttgtccatgaaagtgggaaaatcacgttctcatattgccaatttccttcgtttgctcgcattgcctgaagaagttaaagatcatgtttcacgtggaacattgtctatgggacacgctagggctattgttgggctcaaagatccagacatggtgaaacagttagcacagcaatgtattgaacagcagtggagtgttcgcgaactggaggaagctgtacagcagttggatcataaacctggtgaggcgaaagccaaagcaaaggtgcgaaaaaaggacccctatattgaccatatggaagagtccctgcgtgaacgctttaaaacaactgtgaagatcaagcacaataaggataaaggcaaaattgaattgaattattacagccagcaggatttggaaagattactggagctattacagtagtttgttgaaatatggacatgtctccttgtgcaaaatggaaagtgagatatgtctttgttttgtctggaattgcaggaattagaatggttttgatggataaactaatagccttgtgttatttgtttcgctgttctcaaacgtataaaatataagtatgcaggtacatgatttttgaggtagaggagtagaagcaagcatatggctgaattgaatggactaatcatggaacagcttgccggaatcgttgcagggatcgtgcttattttgctcatcctgttgattgttattatcgtgcagggtgcaaagctgaagaagatgcggcgaaagtatgaaaccatgatggcaggcagcggtgtcgagaatttggaaacgctgctgattgatttgaaggtacagatggattcgattgaggatgagcaggaaacccatcgtgcaagtatgaaatcactacgcagcaaactgactggcttgaagggacatataggcattaaacgctataatgcctttggtgagagaggaagtgatttaagcttctctctggctattgtagacgacaatcaggatggtatggtattaaccggcatttataaccgagatggttcatatgtgtatgccaagcctctagaagcgggacaatccacctattccttatcacctgaagaaaaagaagccgttactcttgcgcagcaagcaggacagaacggtaatgccactccttaatcgcggagtataggctaccagcaatgatatctgataatttcattaccaaatttagtctcgtattttgtagcacgaagtattccatgaagccgccgacgttaacgataccagtcaaatggatatcgccgaccggcggtaattctttatttacgcctgctcccggcttgagagggccttctgaaacctgaatgcatccaacactggaggtttgtccaagacatgcatctataccaatgatataaggctgttcataccggtcttgtatgccgttcagcgtcgtttgcaggttcatggcatgtacaggctcctctaatgtaccgtataggttaaacagagggcttttgtagcgtgctaaatgcgtacctacgagcggacccaggcaatctccagtagaacggtcagtgccgatgcaaataatgacgatattttgcagactcggcgcctggtgcagatggaacagcagacgatggatgatggctgattggatcccgggatctgtgtgtgatatttttaagcttaggggttcttgccccggaatgaagtcagatggatgagtcatggaatcttcctttcgctctgtaatggagtgtgcgggttacgctcgctgtaccttggagaataacatttagcctgcgggtaacatttatgctcaagatagtagctagtatatggataaacttgtgcttttatactcgaaggaagtagattattcatagccatatgtttgaagtcagtagataagcttatatagtaggaatagaattcgggaagcaggaagagtagttcccttgtttaaggaggagtacagcatgaccttaatacattggttggccggtaatgtaggtacggatgacgtagtgaaagatgcgattcaatggaaggatgctgtatggaaatggctcactgatagtacgatgtggtcgacccttttgtttgtgattttgaaaatagcgattatttttatcatcacacgtatctttattcgagttattaataaaattatagataagtcgatgcaacaaaagggagataacggcaggttccgattgaatacaagacggttaacgactgttggggaactgttgaaaaatgtaaccaatattgtatttaatttcattttgattatgctggtgctatcgcaaatgggtattaatctcggccctctgattgctggagctggagtgcttggattggctgttggttttggggcacagagtttggttaaggatgtaattaccggattctttattatttttgaagatcaatttgccgtaggagatgtcattcagacaggtactttcaagggtacagtggaaatgatcgggctgcgtacaaccagactggtgagctggaagggtgaggtatacattttaccaaacggctcaattacaacggtaacgaacttctctatgtccaacgcgttagcggtagtggatgtgccaatgaaggccgagcgtagcctagaggaagcagttggtttggtaaaacaggcaatccaaggtattgaagagtccaatgtacagatacttaatataccggatgtgttaggggttcagtccatgactacctcagagtatattgtgcgtgttgtggcagaatgtatgccgaatacaggggccgtggtagagcgtgatattcagaataacatcaagaaggccctagaggatgaggaacatcgtcaggcagccttggagacagcgataaccctagaaaaagaagatgaacaaggaagaaaagggggagagaagggtggagcgtaagtcatttgaactaggggacattgtacagatgaagaagcctcatccgtgtggaacgaatgaaatggaaattatccgcatggggatggatattcgaatcaaatgtgtcggttgccagcatagtgtgctgattccgcgtgccaagttcgaaaagaatatgaagaaagtgctgcgatcaaaggctaatgccgacgagcaaaacacagaagcaaattgagccaagaaagatgaatggcgatgaaccagaatcagcttgcgtcacagttgcaatgatgatataattatccttgctgcggaaaggtacccaagaggtctaagggggctgactcgaaatcagttaggcgtcgcaaggcgtgcgtgggttcgactcccactctttccgccactaacttcattaaataaaccaatctcttacgtctgtgacgtaggggattttttgtttgtggaataaaaggtcaacagactgtgataaagtgaaaagcactaagataaaccatgagggtaagatggaagaaacgattacaaatctattggggaatgaataaggcgttatagcaaaaaaagtgctcctgacagcagagaaacattgccgttaggagcactcttttgttatagctggttaggcgggtaatgatagcgttttgttttttttgagccagagatcatcagaaggatcgctgcaatcaaatggagagcccagcctacaaagggtatccaggccagcaaagaagtgagtactccccatacggagccgtagatcgcctcctgattgcgtaacgacaggataagtgttactgcgtgtaggacaagcataaatcccagagccgagtagccggtccccatgacaatagctccccccacaatcggtacggcaagcaccaattcgaatatacctgatatccactttaatattcgagaatagctcatctttaaacctccgtagatagtaggtctttgtacttggatatattctagcagaaggagctgaattaatctgcattttaccaggatatgcaaaaagtccgataatgcaacaaaggaggaccacaaaggtcctccatcgtaggcgatacatttttaacaggatacgatctgtccaatcacatcatgaaactcggtgtactgacaagcaataccgtgttgaaaagacagtgtccttttacacaaacctaacgcttctaatgcccggaatggatctcctaacagtttgtccggctacgtcatccaacggaaccacacctctctgttgtatcgcctaatcataatatggccaggattccgaggaaatatacattagtggacacgagctttcgtttttttcttccatttgcgattatggttggcggtctcgggaaatgaatcgcctctttccagcgttacttgctgtgggttttggatttcagtatggaagctcttttctccgacctccatgtatacgccgtcgtttggggccttatcccctggttcgaactcagtcttttcacccatacggtggtgcctccttagataaatgaatttgaactgcaacggttattgtgcgctgtcttgaacagaaacatgcgaaatcgggtatacagatagtgagtgaattaaaggatttcctttatatatgcgaaatttttgatgttctataaaattgtataaagctaatgatatgcagtgtatttagccgtgttaggcttgtgtattgaatttgtaggttgcattcagttgctcgatttggtaaactgttttagtgcgagcttaggctcgttccttgctctcaactgagattgagggccttatgtccataaggaggtgtaaagaatgcgcaaatatgaagcgatgtatattattcgtcctgacattgaacaagaagctgttcaagcgacagtcgataaattccaaggtatcatctctaacggcggtggcgaaattacgagtcacgatgtaactaaacgccgtcttgcgtatgagatcaagaaattccgtgatggttctttcgttctggtaaacttcacagcagaacctgctgttgttactgagcttgagcgtatcatgaaaatttctgacgaagtaattcgttatctcattacgaacgacgtagcttaattattgtacgtgattatgtaatgaacaacgctcaaaggaggggattggattgttgaaccgtgtcattctgatcggtcgtttgaccaaagatccagagctgcgctatacaccgtctggtgtagcagtaacccagttcaccctggctgtagaccgtccgtttacgagtcaaggcggcgaacgggaagcggatttcttgccgatcgtaacctggcgtcagcttgctgaaacatgcgctaactatcttcgcaaaggtcgtttaacggctgttgaaggccgtgtccaggtgcgtaattatgagaacaatgaaggaaaacgtgtatacgtgactgaaattgtagctgataatgtgcgtttcttggaatctaaccgcgatggcggtaacggtggcggcaatagcggtggagctgcgcgtgaggagtctcctttcggaggcggtaacagcaatagtggacgcgggaataataactcgcgaaacaatcaggatcctttttccgatgacggaaaaccgatcgatatttcggatgatgatttaccattttaattgggaaaggactgacaaagaatgggcttcagacaaagagaaggcggagacgataacaaaagaccagctcgtcgtggtggtcgcaacaaacgtcgtaaagtatgtttcttcactgtgaacaaaattactcacattgactataaagatacagacctgcttaaaaaattcatcagcgaacgtggaaaaattcttcctcgtcgtgtgactggaacaagcgcgaaatatcaacgtatgttgacaatcgctgttaaacgttcccgtcaaatcgcattgcttccttacactactgaatagtagtgggcggaaaaaagagacgttcccgatcccgggaatgtcttttttttgtgatcttttatattgacaacaagtgccatctattgtaacttactaataatacaatccatgtttacccataaactatagtataccttttaatggcttgtgaaattacaagctcctcaactcgccagagtaaacatttcggccttctggaatgttattttatattacatgtaatcttattttttgtcattttccacaagtaaaattcataaagtttacataaatagatattttgcatttttatattacataaaaaaagatattgacgtgatattattttacacttaagataagccttaataaaaatgtaatggttgttaacgcacaaaattgaccagaggtctaaaacacgtgtttacgttattaaagagagtaaggaggatgtgcaaacttcattttcaaacctcaagctttaacgaatcaccgcaggaatgagacaggctgttaaataaagaaccgactaagggggattaacagaatgatgcagacgaagaaatgggtttctttgcttatgatgcttacgatcgttggtgttctgtttgcaggatgtagcggaggtgccaatgaggcacagccacagcaaggcaatgcgggcaataaaacagagggaaatgaagcaagtgcacctgttacggagggcgttattaaagcaactgatctgtcgcaaaaccctccgggagcgactaatcggaaagataacattgtagtaggtatgacatcacctaaaggggtattcaacccgctattctggcaaacgacttacgatttatatgtagtcagaacagtatttgattccttcttacaggtgaaggcggatggtacatatgaaaatagtttggctgaaaaggttgatgtatcgccagatggtctaaaatacacattccatctgaaaccaggtgtgaagtatagtgacggtactccagtaaccgtgaaggattatgcttttgtactcaaagtgctgcatgatccgaattatgatggagaaaccgatgtattgtcttttaagattaaaggcggtaaagaatatcacgatggaaaagcaaatgatatctcggggatcaaggtcattgatgataatacagtagaggtcaccgttacagaagcaacagcgtatacgaaggattttctgggtgagcaatactttatgccagaagcttattacggaaaagggttcaaaaagggtaacctggacagcattaaggcgcttaataataagccaatcggctctggtcagtatgtgctgaagagcttttccccgggtcaacaagtcgtattggatgcaaatccaaactacttcaaaggcgcaccaaaagtgaagtcagttatttttaaaacaacaacagaagaaacgaacctgtctatgctgcaaacaggtgaaacggacatggataacatcacagttacggaagacaatgtagaggagttaaaggcgttgggcttcttggacgtgaatattatgccgacaaacggctatggatatattgcgtttaatcacaaggaaaagaaatttcaggaccctaaagtacgtcaggctttaactattgggttaaaccgcaaggagattgtgcagggcgtgtatggtccatatgcgaatgttattaacattccacaatctacagaatcttggtcttatacggatgaaggcatcaacaaatatgaatttgatacagctaaggcgaaggctttgctggatgaggcaggctggaaggttggtgctgacggaattcgtgaaaaggatggagaaaagctgaccatcaacttctctgcgaccgctgataatccagtagtagaggccttgctaccgatcatgtccaataactataaggagctaggcatcaagctgacttccgaaactttagattttaacgccattatggataaaaaggatacgggcaagttcgatatgttcttcgcggcttggggcttaactccagacccggatacaacgacttttattacgaatggtgcacaaaatgatatcggctattccaataagaaggtcgatgaactaacgcttgctggtaagcatgagctggatcaagagaaacgcaaacagatttacaaacatctctatcaagagttgaacaaggatctgccaactatttttatgtaccaacgcagagatatgtggccagttaatggacgtgtaaccggcttggaaattacaccatacaaagattttgagttcactctgcataacgctcagatcgctcaataagggttgccaatcgtatgctcagctctcacgagctgggcatatcactttattcgtctggaggaatgaatatgaagcagtacattattcgaagactgctgcaactcatccccacacttattggcatatccattatcgtatttgcgatttcagccatggtgccgggtgattatattacagccaagcagaacccgaatatgacggccgaaaaggcacagcagctacgacatatctacgggctggataaaccggaataccaacgctattttatatgggccggtaatatgttaaaggggaatatgggagattcattacagcataagcagccggtaacgaaggtcattggcaattatgtatggaactcatttattatcgctttttttagtcttatatttagctggttgattgcggttattgcaggggtattttcagccaagttccaatattcgttattcgataagtttgtcacattattcattttcttatgtatgtcgctgccttcattttttattggtctattggtcatcaaaatatttgccctggagtgggggattctcccggttgggggcatgaccacagcagggatggagccaggctcatgggcttatatggtggatgttctcaagcatatgttcctgccgacactcgtacttacgatgctgagcacaggaagtctgacccggtatttccgtacaggcatgttggaggtcattcgtcaggattacattcgtaccgcacgcgccaaaggcctgaaggaacgtacggttattttcaagcacgcactgcgcaatgcactgattccagccatcacactactcggcttcgagcttccggccttatttggtggagcgatgattctggagaaggtatttgtgtggccgggtgtgggtcaggtctatctggagtcgatcagtatgcgggattatccgtttatgttgggcttcacgattttcctagcggtacttacgcttatcggtaatttgctctctgatgtattgtatggcatggcagatccaagaattcgcttgaagtaggagggatactattgtccgcagaaacagtcacgattgaaacgaatcaaaaggcggcgatccgtcctgaagcgtctccatggagaatcgccgttcgccgttttaaccaaaaccgtctggctttggctggtctcgttatattaattctgatggttaccatttgtatatttggaccgatgatttcaccttatcatttagatgattacaagctagctgacaaaaatttatcgcctaatgctaagtactggcttgggacggataagtttggtagagatattttgctgcgtacgatgctggccggtcgtatttccttgacggtggggctggtcgccacgtttatttcggtcatgatcggagcgacgttgggtgcgttggcgggattttatcgtaaaggcgtggatacggttattatgcggattgccgatattttcatggcactccctacattaccgctgcttattattttaggtgctgttctgtcggatttgaaggtcgatccgtcgaatcgcatttattttctgatgctcattatcgggattctgagctggacgagcttgtcccgtctggtcagagggcagattctcacgctgcgtgaacaggagtttatgcaggcgacggaagcgctaggcttgagagaccgccgcaaaatattccgacatttgctgccgaacacgattcctaccattattgttacggctacgcttggagtagcgggtgcgattattacagaatctgcgctcagttacttggggattggcgttgtgccgcccacaccttcgtggggaaacatgatatcagctgcgaataacctgattgacttccgcaaacggccttggatatgggtcccaccgggaatgtgtattctcattaccgttgtagcgattaacctgattggcgacggtttgcgtgacgcgctggaccctaaaatgaagaagtaggagacgaacgtttatggaaaatgctttgattgaatttcgtaacctgaaaacccactttcatacctctaacggaactgtcaaagcggtcaatgacgtcagttttaaaattcgtgagggtgaaacgctctgtgtggtaggagaatcaggctgcggtaagagtgtaacagcgatgacgatgatgcggttgattgattctccccacacctcagacggacaaatctggtttgagggcaaggacctcctaaaactcaataaaggtcaaatgcagcaaattcgcggcaatgacatctcgattatttttcaggagcccatgtcttctctgaatcccgtgcttacgattggggaacagatcacggagccattgctgatgcacacattaatgagtaaaaaagaagcacatgctcgggcaattgagctgattaatttggtggggatttcacgttcagaggaaatatttcattcctatcctcatgaattaagtggcggtatgcgccagcggatcatgattgccatcgcattaagctgtaatccgaagctattgattgcggatgaaccaacaacggcactggatgttacgattcaggcacagattctggatttaatgcgggatttgaaggataagcttaaaacgtccattatgctcatcacgcacgacttgggcgtcgtggcagaaatggctgattatgtagttgttatgtatgctggaaacgttattgaagaggcgcctgtcattgagctgtttaaaaatccgcaacatccatatactcaaggcttattaaaggcgaagcccgtcattaatcagaaaatggatcgactctattccatcccaggacaggttccaaacccgattgagctaggagaaaattgtcattttcatgatcggtgcgcccattgtatgcaaatttgcaaggatcaggctcctcccttgaatgaaaaggagaatggtcataaggttgcctgctggctatatgagaaagaaggagggcaacggatatgagcgagcctttgattcaagtggaagggctgaaaaagtatttcccgatcacaggcgggatttttcagcgtactgtcggacatgtgaaagcagtcgatgacgtatcctttaacattcataagggtgaatccttcggtctggtaggagaatcgggttgcggcaaaagtacgattggacgtacgattctcagattgatggataagacagagggatcggtacgatataaaggcgaagacttgcacgcgttaaacaaagagcagatccgtgcgcttcgtccgaagttgcaaatcgtctttcaggacccttttagctcactgaatccgagaattaaggtcggtgaagccattggagaggcgttgctggatcacgggttgattgatcgtagtgagctgcggaagaaggtcaatgaaacgctgaacatttgcgggctgtcctcgtatcattatgatcggtatccgcatgagttctctggcggtcagcgccagcggatcgggattgcacgggctttgattttgaatcctgattttattgtggctgacgagccggtatctgctctggatgtgtctattcaggcccagatcattaacttgttaagtgatttgcagcaggaacgccaactgacctatctgttcatctcgcatgatctaagtgtagtcgagcatctgtgtagccggattggtgtgatgtatctgggttcaatggtagagctttcctccaaggaggaactgttcagtaatccgcttcatccgtacacgaaggcgctgctatcggcagtaccgattcccgatcccacgatcaagagacaacggattgtgttgaaaggagacatcccatctccggccaatccgccctcaggatgcaagtttcatacacgttgtcctatggcagaagcacgttgtaaaacagagactccggtataccgcgatgcgggcgatcagcattttgtagcctgtcactttgcctaaaatataataattaggaagcaaaatatccgtcatcctgaaagcagaattgacggatattttggcgtggaataaaaaaggtaaaaaaattgtatctttttttcgaaaaattgcagacaaaatggatttttcatcgtctaataaagtatggaggttatatacgatgatgaaaaaacattggttacgttgggctattgtcgtcccggtacttattatattgatttttattacgcttggaccccgcctgttgatcggaaagccgaatgtggatgcagaggctgcggtgctgatggacatgcatactggggaattgctgatggatgtgaatggtgatacgcctatgccttccgcaaatatgtccaagctcatgactgagctattggtgctggaggatattcgggccggacggttaggctggaatgatgaagtgcgaattagccgttacgccagtacagtgggcggtgtaaatctctccctccggtatggtgaaaggatgaccgtatccgaattgttccagagtatggttgtgtattcagcgaatgatgccgctgtcgcgttagcggagcgttcagcagggaacgaatcagcttttgtgaagcgtatgaatgggaaagctgcccaaatcgggttgtcatccgatagtcgctttagcaatgcgtctggggcaggtcagagtgaactggggccgaatcaccctgaggatattcagggagaaacgaaaatgacagcaagcgacacagcaaagttggcctcctatttgattacgtcacacccggagattttgagaacgtccagtcgtacgcagatggagttgaaggataaaggcatctacattagtaatacgaactggatgctgccttccttggctggaccgtactcttacgcgggaacggacggacttaaagcagggtacacaagcgatgctggatactgcttcacgggcacagctgagcagcatggaagacggctagttgctgtggtgctgggtgcaccgagcaaggaagagcgttttgagcagacacggaagttgttcgattatggtttttccctgtcgacttctttcccggtgagactgcaaaatttggtgaaactggctccacattaaggcaaaaaatgattttgaaagctacataggatacgaatataaacatgaattggggctttgaccgtgaggtcgaagccttttttggtatgaattcgaggagctgaccacgccatgatacttttgacaacaaggtagtagaccttttatgctttgaggggaagtttcagcttcatgtgggaccaatttggtttaatgaagagatgggatttgtgacggaaagaaggaaggtacctgttatggagagaagacataagagaaggaccagtggaaagcccaaaaagaaaaagaggtttaccgctctatatatttcatgtattgttttatttttgattgcagtgggaggctacctgttccgcaaacagctgacactggtggcttttgattggtttgtatcaccgacgttggaaagcaagctggagaaatcctatcagccgcgacaatccggggaacagcagcagcaagagacagtagcttaccgtaaggaacccttttcggtgctgttactgggtacggatcaaaggccaaatgaaaaggcgcgtggtcgttcggatacggttatgtatgcagtagtacggcccgcggaatcgcgtgtgcttttggtttccattccaagggatacgtacgtacagattgccggacatgatccgaatcgcgatggcgaggatgattttgataagttggggcatgcttatgcgttcggaggcgaagatatgtccatggctacagtagagaagttgatggagcataaggccgattattatgctacgattaatttccagggtattcaggaggcggtgaatgcagtgggtggagttgtgcttccaatcgacaagcccattgagaataagaacccgctgcatatcaagttccgtattgaggcgggaaagccgctttataatggtgaggaagccatgtattatgttaggtatcgggaagatagcgacttcaaccgtacaaaacggcagcaaatatttttgaacgctatggcggataagctgctgaatatcaacggaattaccaagatcccggagctgctcgatattatgggagccaattttaaaaccgatatggaacctacttttattactgggcttggcaagcaagctatttcgcaggggaatccacaaattttaagttttacgattacgggggaagggttcaagaagaagggcctgtattatgaccgggctaatgaacaggaacttgaatatgccagactcatgattgccaactggctagattccgatacaaccccgcagacgctgaggcttcccgacaagcaggacattcagtgaataatcaatggatttatatttgattttgagggggattcgtttctcatgaatatcgcttttttcttgcttcccaaacaggaagttgcttgtgtaacggcggatgctactttacggcaaacgttagaacggatggagtatcaccgttttacagcggttcctattttggataaagaaggtagatatacaggtacggttacagaaggtgatctgttgtggcatatgaaagagtccgaggggaaaatcacctttgaaaacgcttctaagttcatgcttaaggatgttccgttgcgggttacaatgaagcccgtatccattgacgcgaacatggaggatttaattaatttggctaaggtgcagaactttgtgcccgttgtagatgatatggaacggtttattggcattgtacgtcgcagccagattattgagtattgtgaaaaatttgtgtccagggaatcgcttaatacttcaagctaaaataagcagcaaagctggtccgaaaataacgatttaccctatggggtaacagttattttcagaataggatatgctataatggagaataaagctttttcagaggggtgtgactcttcatcatatgcctaaagaaatggatgtagttaaacgagccaaggttattgaatggcttaaaacagaggtgcttgaccaagtctcccgtctgtttaaggcgatgtgggaaggcagtacagcccgcatcggtgattgtttggcgagtttggtgatgagcagttatattttggggaggcgccttggagtgccttaccgtgaattggatgatctactcatcgacaagctaagaaagcacagaaaagaaggacaccagctggaggattggtatcaggacatttccgcactggaagaacatatgcgtaagaggtgaaaacgttgaaattccgcttggcaactgtagcatggagcgtcatttatttgcttctgctgctgactctattgacaccattaagaatcattaccgtatttttgctgattgtgcctggcgctgtattgttttcatcgctgcctttcaaaggatttctggtccacgtcataccggtgctgttaattatagcgctactcgatgtgtattcgctgctccccgcgatttattttctgattccttcaataatgatgggacggatttataaaaagggaggacctgcttttcaagcgttgatgaccggaatgggcattattttagccgagttgttggttgttctgtttatcgctacgtatgcctttggatttgatctttcgcagtaccttcgtgatcaggctgcgatatcggcaagtattgtacagcaggttttgagtgctaatccgatgttttcaaacatgaattggacggcagaggacacgcagaaactcggcacaatgctgattggaaaaattccgtatgtgctgatcgtgacctcgttcatattggcggtgattacgcatgctttggcacgtccggcattgagcagtctcgacgtatcggtacgcaaaatgaagcctgcccgcgagtggaggctaccgcgcgcgctgatctggtattatctgctggcaattgtaattgaatggatagcagggtcttccgatagcagctggattcaaatggtttccattagtttgctaccgctgattcatgcatgttttattatccagacgattggttttgtatacttctggacgcatagccgtaaaatgagcccggtgattgcgttgctgctgtcgctcgtcgttctggtgttccagccgctccgcattataggtattattgatttggcctttccgctgcgtgaagctattacaagatcaaagaaatagggtgaacagtcatgcctaaatttctacaaaaacgctggcacggctatcagacggtctgggcgtttttactgctgctggtgcttgtcatatgtatttccatgtacaactgggaactgggtgtgatgggactgctgctgtcattcttgctcggcgggctgatgctgaagacggaattggattttcgtcgggaactgaatcaatatatcagcggtctttccttccggatcaagcgggtggaaggggaagcgattagtgcattgccgttcggcatcattttatacagtgaaaatcgaacggtagaatggcacaatcggtttgccggggagatgttcgaggagcaatcactgattggtgaatctcttcaagatttgtttcctcaactcgcaggtgctctaagcaccaagaaggaaacaaaggagcctgctcgtgagctgaaggtggagctacagcatgatgagcgtcattatcagtttctgatcgtgcccgatgagcgtctgatatatttgtatgaagtcacggagttggcggtgctacgcaagcagtatgaaaacgagcgattagcgctcggtatcgtcatgctcgataatatggacgaggctgctcaggggatggacgatcagcagcgcaccgcgcttattgcgaaggtgtcaagcgagattacatcctgggctaatcagtacaatatttatttacgtcgattatcttctgagcgttatctcattatgctaaatcataaagcgcttcaggagctagagcaaagtcgattcgtcattctggataccgtaagggaaatgacggcggatttgaaagtaccgatgacactgagtattggcttgtccttcggtgcagagagcatcaaggagctaggggagctggcccaatccagtctagatatggcgcttgggcgtggaggcgatcaggcagcagtgaaggcgggacaacgcctgtccttttacggaggcaagtccaatgctgtcgagaagcgtaccagggtacgtgcccgagtcattgcacatgcgctgcgtgatctgatgcaggagagcgaccgcgtgctgattatgggacacaaaataccggacatggatgcagtgggagcggccatcggtgtgtggaaggctgcggcgctttacaatgtagaggcacatatcgtactggataaatccaatccgtctatcgaccgaatgatggagcaggtaaacaaggatgagaagttatcgcaagcgctcctgacgccagagcagtcgctccagctaatgactgagcacagtctgctggtcgtggtggacacgcacaaggcctccatgacgattgagccgcgtctagtgcagacggccagtcgggtggtggttgtcgaccatcatcgtcggggcgaggaatttattaacgattcggttctgatctacttggagccctatgcgtcatcggcctgtgagctggtgaccgagctgctgcaatatatccatgagaaggtccaactgacaccgctggaggcaacatcactgctggcggggattacggtagataccaagcatttttccctgcatacaggctcgcgtacattcgaggcagccggctttttacgacgtagcggggcagatacagttatgatccagcgcatgttaaaagaggacctggatgaatatattgctaaggcggaaattattaagcatgctaaaatgatatatgggcatatcgcaattgcggtaactgagcctggacagaaaataccgcagctcctgattgctcaggtggcggattcattactcaatatgacggatgtactggcctcctttgtggtcagtgaacgtcctgacggcctggtggggatcagcgcccgttcactcggacgcatgaacgtacaggtcgtcatggaacggctaggcggcggaggacatctgacgaatgcagcggttcagctggattgcccgctggaggaagctaagcgcagagtgatcgacgtgctggccgaaattgatggggaagaggggttatttgaatgaaagtgatattcattaaagatatgaagggccaagggaagaaggggcaaattaaggaagtgtcggacggttatgcagcgaatttcctgttgccgcgtggtgttgcccgtccagcgacagaaggaaacatgaagacgctggaaaatcagaatgctgctgaggaaaagcgcaagcaagaggaaaaggaagaggcgcaggcgctcggcaaaaagttggaagagacaacggttcagctcaaggcgaaggctggtgaaggtggacggctgttcggcgcgattacaagcaagcaaatcgcggaggcagtagctaaaacgggcatcaagctggacaaacgcaaaattgagctggaagaaccgattcgtacgttgggcgtgactcaaatgaccgttaagcttcatcctgaggtcaaagctacgctgaaagtacaggtgacagaagaataattatgggcggcgaattttttgatcggattcctccgcaaaatctggaggctgaacaggcggttatcgggtctattttgctccagtctgaagcactgattaccgcaatggagcgggtgcagaccgaggacttttatgataaggctcatcagatgatttacgaagcaatgattgagctgggtgaatccggacagccgattgacttggttacgctgacctcgaaaattcaggacaagggacagctagaggatatcggcggtgtcagttatctggcgaagctggctcacggggtgccaacagcggctaacgtggattactatgcccagatcattgaagaaaaagcgatgcttcgtcgcttgattcgtgcagctacacagattgtgagcgaaggctatagcagtggcgaggatgtcgctggtatgctgagcgatgctgagcgcaagattatggagatatccaacgggcgctcaggtagtggctttattgccatccgcgatgtcgtgatggaagtgtttgaccgcgttgaattgctgcatcagaataagggcaatacgaccggaattccgtctggatttgttgatttggacaagatgacggcgggtttccagcgcaatgacttgatcattgtggccgcccgtccatccgtaggtaaaacagcgttcgctctgaatattgcgcaaaacgttgcagttcgggcaaaagagacagtagccatcttcagtctggagatgtcggccgctcagctcgtgcagcggatgatttgcgccgaggccaatctggacgcgaacgtcatgcggacaggtgaatttaaaggtgacgacgattgggcgaagctgacgatgggcattgcagccttgtcagaggcggaaatctatatcgatgatacgcccggcatcactgtggctgatatccgtgccaaatgccgtcgtcttaaggcggaaaagggactgggtatgatcgtaattgactacttgcagctgattcacggacgaggcaaagcaggcgagaaccggcagcaggaggtatcggaaatttcacggacattgaagcaaatcgctcgtgagcttgaagtgcctgtaattgccctctcccagctgagtcggggtgtggagcagcgtcaagacaagcggccgatgatgagtgacttgcgggaatcgggttctatcgagcaggatgctgatatcgtggcgtttctgtaccgggatgattactataatcaggaaacagaaaagaagaatattattgagattatcattgccaagcagcgtaacggcccggtcggtacggtagagttggtctttctcaaaaattataataaattcgctaattacgagcgtgcccattcggatgcgttcgccggataacatattagtatcattagaaaaggctctttcgacgcggatttcgcgatctcgaaagggtctttttttatagaattcacgtattttcatataaggaatgaaactctcaattacgaacaatactattttcatgtaatataatgttcgctttttatttgactttaaaaaatggtgctgttacacttatagtgctgcttcaacgcagtggggagatcattacgcccggggctttccgaacctacggaatgtctgcgacggacgttttttcctgctgtccgagaacgctccatatctgctcgctcaggcggttgaagttggatatgcgtagtgtgtcagctcaaaatcagagtgtctgtgggcactccacggaggaatgaaacatgtcaactgtagtcgttgtgggaacacaatggggagacgaaggcaaaggtaaaatcacggactatctggcggaaagcgctgaagtggtggcccgttaccaaggcggaaacaatgctggtcatacgattctcattgacggtaaaaagtacaagctgagcctgattccatccggcgttttttatgaagataaaaagtgtgttattggcaacggcatggtagtcaatccggccgctcttattgaagaaattacttacattcatgataatggcttttccacgaaaaatctggtcattagtgaccgtgcacatgtgattatgccgtaccatatgacactggatgtgctggaagaagaccgcaaaggtcctaacaaaattggtactacccgtaaagggattggccctgcttatatggataaagctgcacgtaacggtattcgtattgctgatttgctggatgcagaggaattcgaaaagaagctgcgccatcaaacgaaagaaaaaaatcaagtgattgaacaagtatatggcggcgagccattggatgtagaagcaatactgaaacagtatctggaatatgctgaatttatccgtccttatgtaggcgatacgtctgtcgtgttgaatgatgcgattgacgcaaatcaaaaggtactgtttgaaggtgcgcaaggcgttatgctcgatatcgaccaaggtacgtatccatacgttacgtcctctaacccgtcggctggcggcgtatgtattggttccggtgtgggaccatccaagattcaacaagtcatcggtgtagctaaatcgtacacaactcgtgtaggtgatggacccttcccaactgagctgaacgatgaagtcggcgattacattcgtgaaacaggtcatgagtacggtacggttacaggtcgtgctcgtcgtgttggctggtttgacagcgtcgttgtgcgtcatgcccgtcgtgtcagtgggttaacgggtctttccctgaactcactggacgtattgactggcctgaaaacggtgaaaatttgcacaggttacaagtaccgcggtgaggtgattacgcattatccagctagcctgaaaatgctggcggagtgcgaagcggtatatgaagaaatgccaggttggagcgaagacatcactggtgtgaaaacgctggaggaactgcctgagactacacgcaattacgtacaacgcgtgtctgatctgacaggtatcccaatcgctattttctcggttgggcgtaatcgcgatcaaacgaatcaggtgcttccgatttatttgtaggacaagaataatatagctattgatatacgttcaaagagagaggctgttagcagcctctctctttttttattctgtgaagtgttaaatggtatcttcccctttacataatcttatcttccttgtcgatttgtgataacaaaccctctctataatccaaatagaaaagagattcggacgtctagacgtcttgagagggatgaattatgaactggtatcttcgctcactcggcacacgcaaaattgtggagttcattgtgcttatcattttcgtcatttttttcctaggtcctctgaccaatcttctccttttggcggtttcgggaaaatggcagtatcctgcacggctcccgcagagcttgtcactggaatggtggaagtttgtacttacccaggatgatgtactcagctcgatttctctatccttcctgattgcgattaccgttacggtctgctccattatcgtatgtattcctgctgcttatgcctttgcacgaatttctttcccgttcagtaagtggttccttttctcattcctgcttacgcatgcttttccgaaaatgggtttgtatgtgtccattgccgtactattctatcaattcgggttgatgaacacctttgcaggcattgtgcttatccatatggtaaacacgctcatgtatatgacctggattccatcctctgccttccgcagcgtacatcgtgcacaggaggagtcagcgcgggatgctggggccggaccatttcgagtgttttggaaaatcacctttcctatggcgctgcccggcattgtggtcgcctccatttttacctttcttgcttcactggatgaagcacagggaacactccttgtcggaacgccggactataaaacaatgccagtcatcatgtattccatcattgctgattatccaagcacaacaggtgctgttttctcagtcattcttaccctaccaacgatcattctgctattggcagccaagcgttttgtaagtgccgatgtactggcaggcggatttcaggtgaaataacgtaattggtcaaaagaggagtttgcaaaatcctgaaaaaggagcctaagctaatgcccattcaattatccattcaagagttaaccaagcgcttcaagacaggagacggagtcaaaggcatttcacttgacgtgatgaagggagagctggtgacactgctgggaccttccggctgtggtaaaacaaccgtgcttcgctccattggcggctttttggacccggacagtggcgacattcagattcagggtaaaagcgtactcaagctgccgcccgaaaagcgtccgacggctatggtgttccaaagctataatttgtggccgcatatgaccgtgtatgacaacctggctttcggcttgaagattcgaaaggtgaagaagacagagattgaccgtcaggtgaaggaagcgctagcgctggttcggctagagagcgcagagcgtaaaacgccgggacagctctcgggcggtcagcagcagcgggtagcactcgctcgggctctgctgctaaagcctgatgtattgctgctggacgagcccttttccgcacttgatgccaaattgcgtatggagatgagagaggagctgcgcgatatccagacccagacggggatgacgatggtattcgtcacccatgatcaggaggaggcgctgtccatttccgaccgaatcgtcgttatgaatgcgggccgaattgagcagctctcttcaccgcaggagatctatgacaagccacagtcactttttgtagcaggttttattggccggatcaatttattaaagggggtgagtacaggtcgcagtgtctctgtgagcggaataccgtttgcacaagagcatgaatacacaggcgaatctatggttggtgtaagaccagaggatattgttctgacgacggaagaaaagggttctctagccggaacgatcagacaagtgatgattctcgggcattatgcggaagtttcgctggatagcggtacccatcatctgaaaatgtttgtgccgcgtgaacgagcgaccgagttacgcagtggagagcacatcagattcagcttcagtaaaattgttacttttccagcagcacagtgaagattcacgatcaacctctatatcgcatcaatgtccatcacgaacgcatcatctggtgatgctgcgaacttgtgcaactatctaaaggaggcaacaacgtgtttgggaaaaagaatatgggtctggttttggcaggggtacttagtttatcgttgttggctggctgtggaagcggcggtaatgccgctacggctacgggggaagccaagtctacaaaagcgggagccgctaccggaacgacggaaatctccctgtacactggagggtctctgaacgtcaaagagctgtgggaaacgttaatcaaggattttgaagctaaaaatgatcacgttaaggtcaaactggtgtatttgccagcaggaaccggaggtgcatctacactggaccgtctgatcgcagccaagaaaagcggacaaaccgatacagatatcgacctgtacgaaggcagtctggatgacatcactaaaggggtaggcgaaaaactgtgggaaacggtggacgctgccaaggttccaaatttgaagaatgtggatgaaacgtatctcaagcaagtcaacaatcaggccattccataccgtgcttcttcggttgtccttgcctataacagtgcaaaagtagcgacacctccgaaaacagccgaagagctgtacacgtggattcgccagcatccgggcaagttcgcctataatgatccgtccacaggtggatcaggcagctcatttgtgaacacggttatctataatttccttccgccagaggcgatgaacagtgatgatccggcaaatatgaaaaaatgggatcaaggtttctcactgctcaaggaactgggcccttcaatgtaccaaaaaggagtctatcctaagaagaaccaaggtacgcttgatattttagcaagtggagaggtagacatggttccagcctggtctgatatggcgctcgaacaactggctaaagggctgcttccagacacggtgaagctgacacagatcgaccctgcttttacaggtggcccctcttatctgatggttccttcactttcctccaaaaaagaagcaacccaggaattcttgaattatatactgacgcctgaagcgcaaacggtggttattaataaaatgtacggctatccggggattaagtggaatctgatgccaacggaactgcaagagaaattcaacagtgtatcttctggataccgcagctttaacagcggagagcttcagcaggaaatctacaaacgctggcaaagtgaagtagcgggcggttgagcatgagttcattgtccaaaagggggatgctggggcttgctctggtcatcccgtcttttctcattttgctggtcgtcgttattattccgattctttatgccgtgaaggaaagcttgattgatcaatatggaacgggctacggtctggccaattatattcggctgttcacggaacctgccatgcgtagaaatatcatgtatacgattaatgtcacgttagtctcgacggcccttactctggtcatcagctatgctttggcgatttatctgagattcggcaaaggagttgtcgtgaagtggataggccgcttgtattttattccgatgtttgttcccggtgtaattgcaacgtatgcgatcattaccatgtatggcaatcacggttgggctgcacgtcttttgctgccgctcggcattgagacgattcctaggattatttatgactacaaagggctggtgctggctaatttgtggttcaacattccgttcgcaactatgctgctcagctcggcacttgccagcattccaaacgccgtcgtcgaaagcgccagagatgccggagccagcacgatgcagctgtttgggcgctttattttacccctttcctacaaaacgatgtgggttgcggtgaccttcattttcatgggaattatgggtagctttacggctcccttcctgatcggtgccaactcgccacaagtgctgggtgttgcgatgcagcaggtgttttccagctatcaggagacgcatacggccagtgcaatggcagtgtttatgtttttactgtgttcttttatgggctacttttatattcggacaatggtgaaggatgcggatgccagctagaccgccgttatacactaaggaggttacagggatgaacagccaagcagaggtgcaaattaccgggtttagtgggcgagtgtgggaaaaggatctgctggattgcggttatcggattgccttacacaaggcggaggttgagctcagcccgggaaacgggttccggtttaggttctccatgccagaagacggatacgcggagcttgatctgttcgccagatcagacagtgactgggctgcgaaagatcgagaatctgccttcgtacgcctctacctgaatgaagcctataatcaagatgtcattttgtactatggcagcagtcagggagtgtatacccgtttgttgggacatctaaaagaaggcgattatgaggtctatgctgaatttcgcgaactggaatcggctccgcttgtatctcgagcatggatcgatggggttgaactgcgctgcgtggctgattcctctccaagatcgctgatttatcgccataccccgcttttatatggccgcaatctctcacatccctatgagaatcgctttacggatacaccgcttgttttgttctattccgtggaagggaatgaggagaagacagtcatcgaatatcagatgatgttcagccatgaagatgagggaacgcccgcgccgctgcttatgagcaaatggggaagaacgaccgatatcgaatggatgtaccgcgtcgagctggatgcggaaggcaatgttctggaagctgttttccagggggcacatcatattacgactgcgtttaatggcaattatgatctgggtgggcatcctgttctccaatccgcaacaactaacggaaactttaaggatgacatcacatcggactatcgttttatgctgccgcctgctttccagtggaaaccagaggaagagccacgtgaggcggtcatgagccgttttccttttgcctatcaggtcactgggtgggagatggaacgtcagcaggagctggaaataccgtcacaagcctcttccattacacttgcacaccagcgtagctatgtgtttatccagacttccaaacgccccttacgggattcagacagagaattgtctccagggttcaagcctggcttcaatcggcgcgaggaagatgcctgtgtcgatgtccagcttcgccttcacggctcggagcagtggtattcatcgtgccatcatgatctgagactcggggattttagagccgcttatgagggggcagagtcacatttttctaccacgatcaagctgtctggagaggctgtgctcgaggatatagctgaaatcagagccgtattgctggaaggcggtgcggacagcatggaagtagccggcctgtgtgcttttacgttaaacgaggataatctcccgcagttcccgggtattcgtacagaccgggtgattaagctgacgcggcttcaacccgtgggtgttttatgggcggcagacaaagacatgtcgggtgatgaagaacatcctgtgaatgatatggtaaagcatgttgtggatgaactgtctagccaggatggggagtcatgagcagactgctgtatgtggagggaacggtcgacagaacctgcacccagagccatattacgtactccttccatattccacagccgactgaaacgattcgtattcacttctcttacacgcctaagttattggaggatcaagagcaagcacgaggaatcattgaggaaagcatgtgcaaatacggatacgacgagccggggcattcatccgatctgcggaagaagtatatcccgctgcaaaatttattaacgctgtctgtcgatgattctctccgtcaccgtggaaatgcgcaccgtcccgagatgcagcaggagcattggctcggttcgtctgcggcttcgccgggattcctcgcaggagataatccggcgggcatgtggcggattacggtcagtctgcatgccgttgtaaccgagacgcttgcctaccaaattcatgtattgggggaggaagcagcatatgcttaaatggattccggctgagcttcacacccatacgcttcacagcgacggaaagcaaacgctggaggagcttgttcaaagcgcagtggatctgggacttgagtgcatcgctatgacggatcacaacacgcaatcggcacttgcggatcaggaacaggttcagcggcagtttggtctcccgatcatttcagggatggagtggacgaccttttacgggcatatgctgacgcttggggttgaccgctttatcgactggcgtgtgctgggaccagatgacatccatgaggggattcggcaggtgcatgagcagggaggcattgcagggattgcccatccgttcaggatcggaagtccgatctgtacggggtgcttttgggaatacacgattcaggattggcatgaggtggattatatagaggtctggtcaacgcttatgccgtctattaagcgggatagccagcgggcgtttgccatgtggaccgatttgttgaatcaggggtatcgcatcactgcggtaagcggtcgggactggcatgtatctaaaccggatgatgcgcttccggctgttacgtatctgggggttcgtgatgaagcagaagagcgagaaggcttagcagaccgggcagttgaggcgattcgccacggttcagtgtcagttacgatgggaccgttactgacgatgtgggcacagattaagggcagagaacttcgttatcacatcggcgaatgtatagagctgactgtagaggattcactatcggtgacggttcaattggatgtggaagcaagagcagcccattacaaactcaagcctcagaatcttcgtcttctgctgacaagtagtcacggaatatgctccgagattcagatccctgctcacacaggagaatatacgctatcattgcaagatccgctaggaaagggctggataagagccgagctttacggttgcatggaagactgcgtgatgatgattgcttttacgaatccgatttatatggcttaacataatagaaaggctgggcttcggacggtgtcaacaaaacaagagaacataaagcagcgtatagaagaatatatgaaggttaatcaaatgggtccgggggatcggctgccgtcggaaactgcactttcccaatcgtttcgtgtctcgcgtacgacgctacggggagctattcgccaactggaatcggaaggtaagctgcttgtaaaacacgggagtggcacgtttgcgacttgcccgctgccgagtattccaagctccctcgaccgcctgtacagcatcggggacatgattcgttcggcagggttacgggaagacgagcagctagaatccattcagagaatctcggtttgtcctcctgatattgccgaacagatgagattttccaagaatgagcccatgattgctctagagcgtacacgcactgccaacggagaggctgtagcccactctatcaactggatgccagagaaattagccggacccattgtggaaggtaactctttttcaggctcgctttttcagagtcttgagttcaaggcgggggtacgaatcgtcggagcgtattccgagcttaccgttcccaactatgacgatgcacatatgacgcgtctgttgaagcatccacaggccacggtattactattaaagcagcttcactatgatgaaatgaacaggcaggtgctgtattctctggattatgtccgcagtgacattttccgtttctgggtgcgtcgtacgcgctgattcgatcagaaggtggcatctcctattgaattgtgctagttttacatattccatgggttaaaaatcgtcatatctcgtcaatactgatctatatgcacttcatgatgatacacacatggcaggatgcgtataaggaggtaacggcatatgaggtggcttggatggctactcaaaaaaggaatgacagtcgtgttggttagcgcactgacgctggcagtgacaggtgtagtcgttaatgcttatgttcaatcgctgctgcggcagtttaacattcagcttgatcatcagcccatatggggattgggttggctaaagggcagtgcgggtacggatcaaagcacagacacggggaagaacaagacgacgggaagtgactcgggaagtgtaacaccgcctgatgatgcgttgcctgtcatgggacagggcttagaagaaagcggaagtgaggctggtggcgtagccaatggcaaggcatctcaggagggtgccacgtcggcgggaacatcaggcaatgagtctcggaagcaggcagaaggtacaacagctacacccgaaacgagtattgaaggccatgatttggttattacgcccgaccatttgacggagaagaagaacaatttaccagcggcacagaagcaggagatttttgcgattctgatgaataagctgccgccggaggagatgcagaagatatcagctgcgatggaaggcggtctcaccgagcaggagcttcaggatattcagcaggtgcttgcaaagtatttgaccaaagaggaatataacaagttgatgtctatgcttaaatgagtattttgcaaaatcctgaataaataacgttgaattcaggggaaatgtttatgctccaaataggactgtagaatccgcgccatgcgcggatttttttgcgtgtcaggaagtaattggggtgtagttgaattctttgtaaaggctatgttaaagtaaacagtgttgtgaaaaggttaaatttttgaaaccttttacgcaactatgcaatggtagatagcgactaatatcatagatgcttgtgaatacaggctagattcatagtgtgaaagaccaataacgaacgcatttatatagagataagatatgctgaaaaggagagagtcatgaaggttttgaaggagcaggattcaccagacagcaggaatgcagattcaaacgttgcagacaagcctgctgtggaagcggggaaaatagcaaagtggtggagcggtcggagaaaatggttgagctggacggcaggcggtgtggtgattgcaggcagtcttatttttgcgagtaatcagtatgtcggagctaacacagttccttattataaagtgtatgtaaaaggcgtcgaggtcggaaatatcttgaatgagcaacaacttaaacagctgtacgcaaccaagagcaaacagtataaggataagtatcccggcgtcgatatggtgctcaatacgagcgcggtaacgacagacattgagaaggcatataaagcggatatcgacagcgcagccacgctgaagaagctggatggtatgctgacagcgtatgccaaaggggtagaagtgaaggtcaacggacagacggttggcattgtaaaggataaagcgactgcacaggcggctttaaagcaagtacagaagaagtacacacctgtgggtgagggaacatctacaggcatcaaggggctggttcgcaaaacatccgtgggcagcagccatgcgagtgctagtactaaaacccctaaagcatggctggagtctgccagtatccgtgagaaaatcgcgtacgagcctgtgaaagcagacccgaacaaggtactgacagaggcagaagcagtcaaagtgttgactgaggggcgtgaggctcctatcacgtatacagtgcaagaaggcgattctttgtcgtcgattgcaactaaatttaatatgaccgcttgggagattaagcagaacaatcccggctcgcgtgagctgtatttgcaaattggagatgaattgaagcttactgctccaaaggctccggttacggtgcgaacagtagagaaggtcgtcgaacagattgccatcgagcctgaggttgagattcgccagagcgatgaactgaaggcaggggttaccaaagtagtcagaccaggacaagtaggtcttaaagagatggactatcgtttgaccaaggagaacggtgaggtcgtgcaagaggaatggctcggtcaaaaggtgctgcagccgtctgttactgaggtggttcttagaggaacgaaggtcgtgggagaaggctcaggacagttcgcttggccggtgtccggcgcatcgatgtcgagtagctttggcgcacgctggggacgtatgcatgagggtgtggacttggtcggtagtgctgacattcacgcatcagatgaaggcgtggtatcatttgcaggtcagcagaatggatacggcaatgttattatgatcgatcatggcaacggctaccaaaccgtgtacgggcatttgagcagcattggcgttcatgtaggacaggtggttcagcaaggcgaatcgattggagtcatggggaacacaggacgctcgaccggaacgcatctgcattttgaaattcgtaaagataatacgccacgcaatccaatgacgtatttaagatagattggatgtttatatcgagagttacatgatttatgaggatcaaggggaaaggccatgtttttctgcatgcttaacagtaggtgcaggcatggttttttttctgcgtaaagaaaagggtctggagaagtaatggaatggcgcacgggtatgatagaatagaataaacatcttataggtactgacaaacgaaagttaattatagattatgatccgtgaagagaggtgaacgctatatgcagggaacgattctagtagtggatgatgagcagcccatcgctgatattttgaaatttaatttggaaaaagagggttaccaggtgatttgcgccttcgatggaatcagcgcggtggatatcgcggtcaagcagcagcctgacctgattctgctggatctgatgctgccgggcatggatggcatggacgtatgccgcgaggtacgtgggcatcagctccagacgccgattattatgctgaccgctaaggacggcgaaatcgacaaagtgctggggctggagctgggcgcggacgattatgtaacgaagccgttcagcacacgggagttgctggcacgagtgaaggcacagatgcgcagacagcaacgtggcggggcaggcacgtcggaaagccgaccgcaggaggataagcaggggctgcgcgtgggcgacctcttttttgatacagatatgtatacagcttacaaaaacggaacaccgcttgacctgacacaccgcgaatatgagctattgcactatatggcgaagaatgctggaaaagtcatgacgcgggagcatttgcttcaggcggtatggggcttcgaatactacggggatgtgcggacagtagatgtgaccattcggaggttgcgcgagaagattgaggagaacccgagcaagccggagaccatcctgacgcgccgtggtcttggatatatcgtgagcgggggcaaaggtggcctgcgggcatgagatggctgtctttctttcgtaccattcatgcaaagctgattattatctatgtgttgcttatcttggtggctatgcagctgattggggtctattttgtcagctcgatgaagaactctctcacgagtaattttacgcaggatttgcaagcacgggcggagatgctgtccgtgctggcggagcaggatctgagtggcagtgacggcaaaatggaagaagacagcgtggaaagcctgcgtgcacgcgtaaataatttgtttgatttcagcggcgcggaaattcaggtgctggatgccagcggcaaagtgttaattacttcccaagggtcacacgccgattatgttggacgcaaaaatacgcagacagtggtcagccgcgcactccaaggtatccgtgataacgaggaatacatggtggacgaagataatgtccgcaagaaggtcgtcgccaagcctgttatcagccaaggcaagattgtcggcgcggtgtacatcgccgcttcgatgaccgagctctacgatacgatgaaacgcattaacaatgtgtttctctcaggtatgctcattgcgctggcgctaacggctgtgctgggcgtggtattggcccacacgattacgcacccgattaaggtgatgacacgtcatgcaacagaggttgccgagggcaaattcgatcagcggatgcctgtatttggggatgatgagatcggcaggctcagcgtggcctttaactatatgacaggccgtctgcgtgaggcactgtctcaaaatgaagaggagaaggagaagctctcctccatcttgactaatatgagcgacggtgtggtcgctactgatgacaacggccgggtcattctggtcaaccgtcgggccagcgccatgctgggcgtgaacgaaaacgaaatgaccggcaggcatatcgcggtactgctggggatcgacccggaggaaaccgaggccctgtatagcggatcttcggcctccacgctcttgcagctggagccagccggtcaggatgaacccatcgtcatccgtgtgacattcacgccgattcatcggcgggaaattggcattacgggaacgattgccgtgctccaggacgtgacggagcaggaggagatggagacgacacgccgggaattcgtagcgaatgtatcacatgagctacgcactccgttgacgaccatccgcagctatgctgaagcactggatgacggcgcgatggctgaaccgcagctcgcggagcgtttcgtgggcgtgatccgcaacgagacagagcgtatgatccggttggttacggatttgctgcatctgtcacggcttgattccaatgaagcgcctttgcggatgcagcctgcggatgtgatggagatgctggacgaggtcgcagatcggttttcttttcaaatgaagcaaaagcacattcgctcagggatgttcgtagagcagggaatcggtaaggtcgtgatcgaccgggaccaaattgagcaggtgttggacaacctgatgtccaatgcgttgaaatatacgccagatggcgggagtattcggattgaagctcgccgcaacagtgagggaatgctgtccatttcggtacaagacaccggaattggtattcccaaaaaagatctggaccggatttttgaacggttttatcgtgtagacaaggcgagatcgcgcaatatgggtggcacgggactggggctgtcgattgcccgggaaattgtaaaggcgcatgggggccagatttttctggaatcggaatacggtcagggaacctgtacgacctttacgctacccatatcgagtgaagggagggaagcacagtgaaggaacgtttgaagtcctggacgcttattttgctggttgcttccagcctggtacagacttattttttgatttaccgccttccaggcagtgattctgtactcacttcagaaacgaactatgtcaaaaccgaaagcatggggcaggagaaaaagattgagaaccttgtgtttcctgataaaatgctcattcaccaaggtgagaagaagcataccgttttttatccgggtgttactttttacgatttaatttatacacggctggaaagccggagctttaacaacttccaacgtcgaagtatccaatcggcggactgggcgcagattcgcagcgaaaatgaaggcatcgaattatctttttcaggcggagtcccggtttcattactggaacgggtcatgcgtctgacgccggattctgtgtttcagggagagacgattaaccgcatttggatctatatagacgaaaaaaatgccaagccacacgcgctctttttcagtgccagaggcgatgtcgtgtatgaggcgaaccagttcgacatgacggtagaggacattcggcagcatgtgaatttcggtgaaaatgccccgttgtacgagctggtggataatcagtactacattcccgtgaatgacctggaaacagtgcagcctgtggtgtatgctgggttgtttacgacggagcaaatgcagcggaacttgttcttcgatccggggattacgcgcaatattcaggagaaggacggttcccaaatttacacggacagcaagcgcagtctgcaaatcaagcaggagcaacgatggatgagctataccgatcccagtgcgccaggggcaagtggaagcagtccaattagggatgtgctggccgcagttgattttgtgaatcagcatggcggttgggatgcttcgtaccaaatgaaattaagaagcagcgatgaaaatcgaacgactgtgatgtttcagcagtattatggtgcttatccggtgctggacacaccatcgttccgctttggtacaatttcgctgcaaatccagcaggaaacggcttctgtctatgaacgttcgctactgtatctcaagggaggagagcaatcctcgaagaaggttatgctgccgggtggcgagcccttgaagaagcagctggagactgtagcaaaagggaagacgattcgtgatctgactcctgtatatcaaccggagctgaccaatgatggattgaagcttgctcctgagtggcacgttacgctcagtgacggttctgttgcagaaattcatgctgttcctgtaacgacagcatccaacacaacacaaacgaagccagaccgggagacaaagaggtgacaggaagggggaacgggaatggattggagccgcgccaagaacgtattgatttgtacatttttgctgctcaatgtggtattgggttaccaattgtggcatgatgcacaggaaacggcagggccgaatctggattttacttcattggatgaaaatacgcagcgtttaatggaagagaaaagcattcaggtgctggctccgattcccggcgataccccgcagctgcctaaactttcttacacatacgttcatagtggagaaaaggatgatcgtgtgcagctggtgaagccggtggacagcaaactggtatttacccatgacgcgctagttgaggcattggagccacaaatcaaggatatcgataactttcagtatgatccgttggatgttcaggaggaattggcatccggacaagcagatgcttttgtacttcatccgctggttcagggtaaatggcctttatttaatgtgaagttggctctgttttacagcaatcagaagattacagggtatcgcaaaattaaggtcgatctccagccttcggatgaggcaaagaaaatgctgcctgcgtccaaagcactggcaaggctgatcgacggctatttgccgcgtgatacgattgtgaaggatatccggctcggttattacggacagacctttaactccgatagccaagtagctgcccccgtgtggcggtttatgctggacaacgggaaaggtgtgtattatgtgcagatgaacggagatgtcattagtccaaagacagaacatacagaagggtcttgaacagatatggggatttcatttaccgtgctgtcgagcggttcgaccggcaacgctaccgttgtgcggaacgaagacacgacattgctcatcgacgcaggtctcagcgcgaagcgtattgacgaattgctgaaagaacgcgatctgagcggagaagagttggatggtattttggtcacgcatgagcattccgatcatgttaaaggactaggcgccatggcgcgtaaatataatttacctatatatgctaacgagaagacatggtttgccatcagcaatgctgttgggcaaatcgcagacgataaccgcagaatattggagacaggcgcaacgcgggaatttgagtcattacgcgtggagtcttttggcatatcccatgatgcggctgagcctgtagggtatagcttttatgatggggcagagaagctcagtgtagcgaccgatctcggctatgtcagcgacaaagtgaaacaggcgatatcagacgcggatgtattggtgctggagtctaatcatgatgtggaaatgctgcgtatggggcgttacccgtggaacatcaagcgccgtattctcagcgatatcggtcatttatccaatgagatggcgggcgcgattcttagcgagctgctgacaggccgtacgaagcgaacgtatttggcacatttgagccgcgaccacaatatgatggaacttgcgaagttgactgtacgtggggcgatggaagaccgcggctgtttttacaaggacagtgaatttcgattgtgcgatacgtactatgatcgtcctacaccttgggataaggtaagtgagccataaagctgtccagctcggcggctttgcgttctacctcttcacgggtcactacgcctttgtccaccagtagttcaatcaatgtacttagcgccagtgtattgcggtaatgctcgtctttcaaatccgcaagcttggcagccatacgaacttcatccatagccgaacgatgtgaattcatcatatattcctcctgtaaaaatattttagaaatggcgtgcaatgagcttggttctgcctgtggttttgctgggtgctgtgatacaataaagctaacaacggaaagctttctgaaggaaggctctcatcgaaagtataggcagctttaagcggacgggaacaggccagaacgtctctatgagacgatcattttgtaatagaatagaagacttgttactattgtagtccattggtttggaaatcattcctcttttttcctctattcggagtcagattcggcgtgtatgctaatttatgagattcggttgcttaggaaggcaccatttgtggtgattaataagtaggccggaacgattggttgctggattccgatgataagggatattcaatccatttgagatgttcaacggagcaggttctctgtagcataggttggcgcaagcccgaatagccctaattttttagtgagtgtcggtgcatgacaacgaaggggagaggattagcatgggcttgtttgaggacgatttttattcaacgaaggtatccacacgtgcggctaaaaaaatggcatttaaggcgcgccgtggaggacggggacgttggccacacaggaagcgtggagtaagtccggtgcaagctgctgttattagcggtgctgtcagtgcagtgattgccgtgcttctgttcagctttattacaggtctgccctccactacagcggtaaccggggccagtcactatcccttgcggcaagcagcgggtgatccgtatgatcggattgtgcaggcggcagccaaggtgcgcccagccgtcgtcagcatcgtgaacctgaaagaggaagagggtaaaagcacggaacaatccgcgcttggatcgggtgtcattttccgagtgagttcgggcaaagccttcattatgacgaataaccatgtggtcgaaggatcagatgatctggatattgtaacggtagacggtgtcagaaaagaggcaaagctgatcggaaaggatcgcattagtgatatcgctgtactcgcagtggacgataaaggcattagcacggtagcggatattggcgactccagtaaacttcgtctgggtgagacggtcattgctattggcaatccgctcggcctgggagacacgcttacctccggtattgtgagttatacgaatcgcatcattccgatttccattaaccaggatggcgtgtatgactgggagcagcatgtcatccagaccgatgcggcgattaatgagggaaacagtggcggcgcgctggtcgatctggacggacgtgtgattggcatcaatacgatgaaaatcgctgatacaggtgttgagggacttggcttcgccattcccgccaatgaggtgatgaagacggtgaatgaactggttgaggacggcaagatcacccgtccttatctgggggtatacacggtcgacctcaataatgaatatgcaccgctggatgaaactcagcgcaaggagctcaagttgccggatagcgtgaaaaatggggcagtcgttctggaggcccatggtcctgccaaggagggtggcttgaagctgaacgatgtcattactgcgtttgatagcgaaccgattaactctacgcttgatttacgtcgctacttgtacgataacaagaagattggcgatgagctgaaagttactttttaccgggcaggcaaggaagaatcggtgacgttaaaattaacagataagccggaaggctaaggtttaacttataggcttaactataaaaaggcgttctccggctcatttccgggaacgccttttttcgatcttctgctgcgccttagtttaagatgtcgttcccgttatacgggttccgctcttggtgatcttgtatgtcaccacatcgccgctccaaaaatggaacttaagcgtgacttcaccatcttttacactattaaaaagttcaggcagcagtttgatgccattggcatcataggcaggcgcaaaggtattgccaaattccttataaggtgtccaatcctgtggaccggcattgccaccattcgtataaacagcttccatcgtggcaagctggctaccgtggaagtccgttggaatgctaaaggcttgtgtagttccttcgatagcacttagttttggagtatcatacacgacgactctaaaattccaatccgcccccttgttaaacttagcggtaatgacggcattctccccatatttaccggaagtggtcaggctagtgagcaagctggcctttaaggttaatgtgtctccgctcagcgcataatcggtgccctgtgtcagttgcttgctgcccacactgagtgttttcagctgattgccgttcaggtttaaaatgaccttggcatcctgagcaggagtgcccttcttcaagtgaatgaggtcactggctgcattggaggaacgtccttttaggctggacttaatgacattgaagagttcagggtcagaccatttgtacgttgtccggttcaagtgctggccgttatcccagagcatacctgttatttttttctctttcatataataggtcaggaactcgaagaattttagcttttcgccctgttcaataacgcctgtatttttatcgaagccgagtaggccgtattcaccaacaatgactgggattcccttggctacaaaggtgttatagacgttatcaaaggtttgaataatatcgttcttggtatctttctcaaatgtagtatatccggcaatgttcacactgaaaggccagaagccataatagtggacggttgcaatcaggttgggatcgttcagcttggttatcgtgttgtacagctcgttgattttggcctgagcaggtgatgtatccaagccaggcagaacaagggggcgagtggcatttttaccgccagaggcacggacaattttgtggaaggatacatttagttcttggagcatctggttcattttcgcttcatccgatgtccccccttcagagaaacggggctcgttaatactttcaaacatcagcttgttaggttgatctttaaagcgctgggcaatttgtgtccataacgcgttatagcgagccagcacttcatcatgtttgggctccatactgcttacccacgtccatgaatcatgatggacattgatcatgacgtacagattggcatccagtgcccagcgaacaacctcttccacacggttcatgtaggcagactcaacggtatagttgggtgctgctccaatgtgcttatcccaggtgacgggaatacgaatacttttgtaaccttgggcagcaatttgctggatcaacgcctgggtaatgcgcggattgccccaggctgtctcatccgctccgacagcatccagcgagtttcctaaattccatccgggctgcatggcttccacatacgattgcatgctgctcgcagccgcagcttgcggtgcttgtccgtcagattcggcagcagcggcaacagatgcgaacgtagataacaatagggtgatggcaagcgtcaacgacagcaatgaaacgggtcttcgttttaacataacaggcccctttacaaagttatttttgaaagcgctttccaataaaacactaccacactatttgaatatggaatacctgtataattcatgtaaaaatcatgtgttaattagatattttaattttgtaagcgttattattgaaaaaatacagaaatgagtgtagaatctatggccctacgtggattgtagtatagcatcggatttgtaaatacaaaagaaagaaggagatgaatatgaataagtgggacacggaagaggccattcgacgctgggatatgcatgcagaaaactttactgccaagtacactgaggaaggagatcgatctcgcgaggtactgctaaatccggcattgcaagcttgtatgggacctctcgggggcaaaaaagtgctggatgccgggtgtggcgaaggttatctgagccggaaaatggccaaggcgggtgcatcggtggaagccgtcgattactcgacagagatgctgaagcttgcaagagagcgaacgccgtcagcgttgggaattacatatcaccatggcaatctggaaaagctggagatgttcggggaccagagctttgatctgatcgtgtccaatatggtcatccaggacttggcccattatgagcaggcgattgccgaaatgcagcggttattagttccagggggccgctttattttttctattctgcatccatgctttcagacaccgcagagtggttgggtgaaggatgagacaggaaaaaagctgtattggaaagtgaatcaatatttcaacgaaggtccactggagcaagcaatcccttatgatcaggaagaaaagtttttatactttcaccgtacgctgggcagctatgtacagaccattattgaggcgggtttactgttggaagggatgatcgaacccaagccgtctgccgaaatgttggagaaatatccccattttcacgaggacctgaatgtcactaattttcttatttttacaaccagacgattggggtaaaaagcaagccctttcctttctgcgtcaagtgtggtagaacaaaagaaggcggttttggcacacctacaacaggaagagcttcaaacggaaagggatgcaactggaatgtacgtggtatgtaaagagcatgtggaactggcaattgatatgttcgtcgatgaatacgaggatgcaccggatgtcgtcgatctcaaggaaacgaaattttcggattgggaccctccagtgaagtgcaaggaatgtgagaagaaagcagagtttttggtcgtctaaaaaacaagcacgggcgtttcggggagaaacgtcctttttgtatatcaggatttattgcaaaaataccccatacatagagctatatatttattcccaccacgtgctgagacaggagtgaacgatggatggaccctttgctgcattcactatttcgtccccttcaagtcaatggaagtgatctctccacgtattatatcgaacaaaagccgtctgctgcgctgaaagcttacgtggcctgttattgggagtccggtccggctaatagggtggtagaagagaatctagcagcttcgtgcgaagacaccgctttgttaagcttgccgcaggaagaaaccatggagcgggtattacctgacggctgtacggatattctattagaatacgatccggtgagtaagcgtcaggaactctcgtactgtgggacatttacgcaaccgtttgtgtctgccagacaagcagggtccgagacacgtatttttgccgttcgattttttccgggcggggcacattattttcacgggatgccgactcacttgtttacaggcggtaattaccgcttggaagatctctggcccgaaagcatcgccgtcataggtgagagcattatggaagcacagaatttcaatgaacgggtgcgcataatggatgagtatcttaaccagcttctgctgcgccaacgtacgaacgattgtgacctgatgaaaaacctgctgcatcgcatctttgtgagcggtgggagtgtggggattaaggagcttgcggactgtgaggcgatcagtgaaaggcagatcaatcgtaagtttggacaatggatcggaatcagccctaaaaagttcagtgaagtcgtccgcttccagagcgttcttcacagtatccaaagcggcgggggtctggattggacggagctggcattgaagcacagctttttcgatcaggcgcatttaatccgcgattttcgcaggttttatggagattctccgcttactgcggctaaggatttacggaagttgtccgatttttacaatacacgcctagaggcatcgactatactcaaaatataaagaagaatggcaaaggagagatgtgaatatgagtggaacgctgcaagttcgagatcatctgctaaatgagctggagacgggagtacggacgggggaagcattgatccgtaaaatacgcccagaggattggaactttcgtccgcaagaaaatttccgctcactactggagttagtacatcactttgtacttattccagcttcggatcttgcgataatgcaggagaagtctgagggtgaagtgggaagcattgaaaccagcctatccggggtggaagatcccgagcgcttggctgcgactttcaggcagaattttgaagcttataaggcttacattctttcgcttagcgaggaagattatctaaatcgttcgacgaaggccttttatatggaacacggacatctacaggttcaatggcagattgagactgtgacccatgtgttccatcatcgttcgcagatttataattatctgaagcaactgggacatgaagtgagcttttttatgttgtacgcttgagtatttttgtgaatatttatggagggcacctgtgcggtgctcttttttggttgtaattaagcttttctgagatggtatagccttacttgaacgcccgtgaaacttctttactaactcgtctgagaatgccgatttgctcctcattcaatctgctggtcaacgcaacaaattcatctattgcctcttgccgaatcgtttcgtctttagtcatatgttctttggaaaacatcaattcactgatagacacgtttaaggcagttaacactttctccaaggtatcaattgaaaagtttctttcgcctctttctaatgcaccgatgtatcgatagtccaagcttgcgatgtcagccagtttttgctgtgtaagtccctttgcatttcgaatagcacggattcttatacccatttgcttgcgtaattctgtcatataaccacctcataacaagcttatggaagatgcagtataaaagtcaggtcaaaatatatagtaaaaatggtttatattacgcattttaagtagtataattaatttgtttagtcactcctcacgagtggttagcaactctaaatcgataatgaggatatactagaggaggtaatatttttgcaagaggacattctaaaatcactcaaaccggacatcattgttgaaatgttagagatggccgtggcttttgaaaattggaagaaggtgatggagacggcggatattttgtaccaatgtgtacagcgtatctatgaagaacggcagtatcataaagcaatgaaattatccatcccgcatgtcaatttagaacgtccgttggtatattattttggattcagtcacctgatgtgtggaatggctcaccagaaccagggtgcatatgagcaggcaagggagtgcatctataagtatgctgagctggggtggatggaggatttaaaggaagaagacattcaggttgtcgaggaattcaggtttatagccaaaactaatttatatgcagtagatattttgtccgggaatatagagcttgttgaggaatacgtagcctttttgcaggataatctagaggaaatactaccggggctgaataccatattacaggcagcgcttatgtatcatttggatgtaggagatattttacatacgtttgcagagcagattgatgaattcgggagttatgaagacgcagagaacgtatcttactattatagctactgctatcacttggctttgtactatcggaagtgtggcagattacaggatgcagtgggacttactttgcgggcgatgcaactagccgatcagtcgggcaatgatggtcaatttaagaaatgtacagcattgtttgaatcattgcgtgagtcagcgacagcggaacaaatcagccaatatcggcagctgctaatgcagtgtcttgatgaatatgaaacggataggcatttcactgtgaagagcataaatgaatgatccgctataatctgaacagggaataggctcgtagtggagaggaaatagataggtaagagacgttgcaggtgctaaaataactatgttaaaggtatgtttttaagttagggatcgtaaatacgattttacattatcattcgacatagataggggtatggaatttgtttattcagcttataggtgtaggcaagttaaaagagaagtatttggtcatgggcattcaggaatacgctaaacggctagggccatatatcaagttccaaatgatcgaagtagcggatgaaaaggctcccgatacactgagcgaggcggaagtccgacaggtcaaggagcgggaaggagagcgtatccttgctcatgtgaaaagtgaagcacatgtcattgtgctcgccatcgacggcaaactgaggagctcggaagaactcgcagaggaactggacaagctcggcacttacggcacaagccatgttgtcttcgtcattggtggaagccatggactctctgacgaagtcctccgacgtgcccagcagaagctgagcttcggaaggatgactttacctcatcagctgatgaggttggtgctggtggaacagatttatcgggcggtgaagataaatcgaggggaaccgtatcataaatgacggctaaatttaaagatgatgtagaacagttttgattagtaggttaacttattatggggttttattgttcagccctattaaaagaacttttaatgtcgaagatttacatgacgtgtagtaaaatagtagtacatgtctcattttcgttgaattatccagttttataagaaatgaatctgttggcgcatttagaagatgtaataagcgagattcaagacccacgttcaacccttcacaagcagtaatatcctgtcttgacttcccttgccgctgcctttcgcgatagcttcgccttctaagggtatctaagtagttacggtttttcaatgtctttataaatagttcttcgtaatcgttaaattacagattatattaaaggaggttagctgtatgagttttaaagataaagttgatgaattgcgtaatcaggcgcaaacaacacaagctgcaaacaaaattattgatcagctcaaaaagttagaaaatagtaataatgaagatacttcttatcgttggatttgggagcttattcagaatgcaaaagatgtagttaactgcactggaaaagttgatattcttgttaattttgatgaatacagaaaaattatagagtttaagcataatggaaagttattcctgacaaaaaatattgtttttcttattgaacaagtttctacaaaagaacgaaatgaacttgataggaaagaaaagaaaataacaggaaagtttggaacagggtttctaacaactcatttactttcaaaaaaagtaaatgtaactgggtatttgtgcgatgaagatgagcctgtacaccaatttagtattgatattgaccgctcaagcgataatcagacaaaaatcatcaagtcaatcgaagatagctgtgagcaacttaacaaaaatgcagtaaaaattacaaaagaaataaatgaaagtgattttaatacttgttttacatatgagttagacgttcttggaattaagacagcaaaagcaggcttaaataatcttgttgcgtcaattgcatatgtttttgcttttgtcccagagatagaatcaattactattcaagctaatactgtgaaaggcaattataagcaggtgctttctcgtggttataatgttgatgttaatttgagaaatgcacaggttattgctgtgtgtgatactaaaagaaagaatccaaggtatatttttgctttaaaagatgaagcgttaacaaacttatcaattgcggtcgaactgatagacattggcgaaaaagcaaacattcaacaattaaatgaaaatttacccaaactattttgtgattttccgttacttggaacaagtgatttttcttttccagtagttatcaacaatccatattttgaacctacagaacctcgtgatggaattgaattggagagcagagccgaagaaaagcaatttattaaagacaataaaggggcattagaaactgctgtcaaactttataaaactgcattgagtttttttgtggaaaataattataaaggtgtttataacattgtaaaaataaaagagcagcctcataaaacttggctgaatgcagaatggttcgataataaaatacttgaacctataaaaatagaaataaaatacttaaacttaattacaacaaatactggcgacaaaaaaccattgtttgagttaggggataaacctgttgttttgattcctaaaaatcgagagaataaagaggaaatgtttaaactttggtcgttatcaaatgctttatttcctgaacttcttccgaagcaagaagagttagatgcttggtgttgttcgctctgggatgaatgtaaaaacatgggcatagacaacatagtgcaggcaattgaaagttctgaaaacgtatcttctttaagaaataaattaaacgaacaagatgtatttgtttggttaaatgagttctacaaattactcttaacaagtgaagatgagagctgtaaaaaaataatagaacaatctgaggtttttctcaatcaaaacggtaagttctgctgctggaatagagtttattttgacaaggaaattgatgatacatacaagggggtttcattattattagatatagacgttaaagataaattacttcataaaatggtcgcaacagaaattgcaaagcatattgaagtaacagagtatggatattcggaactgttttctgaaaccacacggtgtttacaaaacgaacatcaaaatcgtggagatttctttcaaagaatactatgcatacaaacaaatgaaaggccgaaacaagatgactttttgaacatcgctaaaaagttttataacaatactacatgggagattgttgcttctaaaaggtattcgaaacccatttttgaacaggcactaaattattgggttataaagttgtgtgttgatatacagaaaagtaaaactttagatgtttttgctgacgaacactttttgaacaacgcagatggtgcgatttcttttataaatcaatttgtgttatttttagaaaaaaatgattataaacatttggcagacaagtatcttattcttcctaaccaaaatggctcgtttaaaagaagcactgagctacagctcgattcgggagagattcatgaaatggtgaaagatgcttacttctttactggggtagacatcagaataaaattgcttatgagtagtatatattttccgttacctgaaaacacagcaaccaatctttacccattagcagatgcaataacaaattatattgaaaatcacaagaataagcttggtgaagataatgatcaagagagattggtttttcaaaatttcttttcatacttaaagagcacagaggataaaacaattagaaatgcttttaaaattctgtacagcaatttatattggttttataatgatgacataatttccgacaacatgcaaaaggctgagaagtatgagcagttgctatctaaacatggtgtaaaaagtttccaagagttagaagaactattaaaacaagctacaagcaatgtgcaatcagcagaaataattagtatttcaaaagaacaacttgcacaaattgggattaatactgaagatgagttgttgcaagttttaaatgtgttattaggagaaggagaaattactgattctcaattaggcgaactgccaagtggtatgtccatagaggatatttccaagaaattcctacacagttcaaaaaacaataggttttcacgtgaatattatgaaaaaataatgaatcgtgctatagaaaaggttttttactacttgaaagaaactggaagatatgtcatgtctgaaaaattggaagagtggaaaaatacaagctattcaaaaaccgttttttgggcaaagaaaaatggtactgatattcgcattgttgtaaggccgagcgatgacgataaaattattttcttctatgagcaagaagttgctgcaatggacgataccaattatgaactttggactgacaataacgatggaaatacacgcatgattacattgggtgacattattaaaacaacgggtatttcagtcataccgcttaaaaatcttaatccaaaataatagaaagtgggggctaccgtcttgacaccaaatgaagtattaagcctaatagcaaataataatcgtgataatatttattgtgtatatcctgttacacctgatgaaactattggaagattaatctctgcgctttcaaattgtggtggaggattaattgtttttggtgtgcaagatgatggaagaaaactaagggttaaaggatacaaatttaacgtagatattgattcgataaaagcgaaacttagcgttaacgttaatttaacactttttgatttgccacacgaaactgcagcgcttaaatgtattaatgtcgaaaagtgtgaaaatgtggtagtgtttagtgacgcaccttacacacttgaccataataggaacgttgcagagcttaatataaaaaaagtgtttctatcgtattcgcacaatgatacttgcattgctgatttagtagaagaaaggcttaacttttttggaaaaggtagattggctattacaagggataaaagaacgttagaatataaaagtgatattcaaaaattcatgcagacggtttcatctcacgatttcatggtatctataatatcagatagttatttaaaatctcaaggatgtatgtatgaagtttcagaattaatgcggaatagagcatttaatgataagctattgacaattattttatctgaaacagatgaaaatttttatcctaaagacaaaaaaccaaaacaggtaaaagcagatgtatattcactaaatcgcttcgagtatttaaaatattgggaaactgaaaaaggaaaagtaaataaactgaattcagaaataagcgatttagctcttaaacaaggattagttgatgaaattaaacagataaacactatttcgacaaatatttcagaactaattgaaattttcaagaaaagtttaggaaaagactttactgaaattaatcaaaatgagttttcggatatattatctattctactttcatagaatgaaaataatatattttgggctacgaagaaaataaatgggtaagttgatacgtttgttcatggttgctgataattcatatggattgaaaacaatggaaatatcaaatgtgataattaaaccggctcttcgctctgctatggatgaataaagttttagtgaatgaatttaattagcctgaaaatactgtgaccctatccgactattaaaggatagggtcacatttatggtcgctgaatagtgatgagaatatcaacgagctttacaaccagagaaccagaagtgttgatatagagttctgatagataccaaccaaataactaatcttttggagggttcagatgaaccgccaatttaatttccaacctaaaaaagcgtcagtggcgacaattgcgtcaaatggcagaaggtcaaaggacaccaatgacacttcccgcagatgtttcgagtcaagggctgttgcggcagtctcattgaaggcaaaggagcatcaaaaatttagccgttatagcgtgtaaggtgaaccttatcataagtagggcgaatttgtgaaagacaataagaagcagttctttgtctgcacgtggaaatagtctcaaagagttcttgcttcatcgggactattcccatcagcgtgatcaaagatcatctccgggcaaatcggcctgctggccttgaatgcagccatagaagcagctagagcgggcgagcagggtcgcggatttgccgtagtcgcagacgaagtccgcaagcttgcggaccagtcagaagcggcaacgaagcagatcgaaacgctcattaccgccatccaaagtgaaaccagcgaggtggtgtcttggtggtaccttcctaatttacagttccataccattaataatgaacaattgctttaaagctaaaattggtacttctttggggattggcggtgcaatttttgcacaaattacaggtcgattaatcgagtctatcggttggcgaccaacctatatggtattaggtgttgcctgtagccgtattaattttaccttttatcattctcgtcatacgttcaaaaccagaacaatttggttatgttattcactggtcttttcggtttagcttcgatagtaagcttccaggtaccaaactttgtgcaatccattggatttacagctgcaatggcagctacaggagtaacttgtgtaaccattggtcaaacaggcggtaaattcataataggcgcggtcaacgataaattcggtgttaaagcggctctatttactggtattggtggtggtatgcttggggttgtagtttctgattcattttgtattgctatgctttatattggtgcattactacttggtattggattctcaggctctactttacttccgccagtggccgatacgataaatttttctcggtattcgtaccgaagtttaaacatccaagacatagagcgcttacctgcggtcccgattttcctaatgaaagtcttcgcattttatttcatctcgcaatcatgtagagtttctttccttactaactctagcaattcataattaaccttataataacactatagttaataattgtaacgtttagcataggcattattcgttatgtgttaataaagcagcgcagtaatccgataaattaattacgacaagtttccttgtatattcgacatcattagacaaaccgggggcagtggtttttatgaggaatagtaaagtatcgggattatccgggaagtgggcacgaatgcggagcaggttgccgcatcatcggaagagctgacagccagcgcggaacaaacgggacaagctatggagcatgttgcgtccattacagaaaaattagccgaaggagcgcagacgcaggtgaacagcatcgaagccggcgttacgcttgttcagaagatggatggggaggctacgcaaaattgctgatcgttccattcatgtcaaggaatctgtggatgtagcatcggaactggctccaaagggagtcaggcgattgaatctgcaattcatcaaatgtccgctgtttcaaataatgtaagtgagattttaatggagggcgtaatagatatttatgctcttaacttggtttctagcaattatacgatttccgcataactttgaggtttagaaagtggcaaacgatgtcgaatattatttcatgttacctcgagagggactagatgggagtgaggcataatgagaggtaggaagttcacgatgacgatcaggaacaaggtaattctaacgatcgtcgttactgtaatcactagccttgtgatcggaggcgttgggatttacaatctgaagcgggtacaatcctcgcttgaggagagccttagtattagggcggaagtcattgatcttattcgtacagcggatatcgacctatatcagatgctgttggcagaacgatcgctgtacagttatgaaccagggtcggaacaatttttgaaacagctagaagattacggaaaacaaaaggagtcggcaaagaagaagcttaataagtataagtcaattggaactatttttgataatgaggaaaagttgattcaagactacgaagcaacggttgcagcgtatgatttggtctccaagaaagtgattgacggattatcgtcaaaggattcaactgtccgtgaaagggcgaatcttctttcttatcaggagggcagcgaaaagtttgatcagatggaggacgctttggatcacataggtgatctgtactacgatgataatcaaatcatgttggacagcacacaaaaacaatacagcttcctgcgattggtcagtatcctcttaacattggcaggcttgatcgcttcatcgttgcttggttatttgatcattcgatccatccatcatccgatccgttatttgcgcggacgtgtgcgagagattgcggagggcaatctggccgtcgatatacgtaccttctcccaggatgagcttgggcaattaaccgctgattttaatataatggtatctcgtatgaaagaactcatttcgacagtaagccaatcgattggccatgtaaatacttccgctcatgaactcacctttattgcagagcaaacaacggcaaccggcgaggaaatgacgtcaggcattaatgaaattgcagttggtgcttctgagcaagcgtccttgacagaggcaacgagccgtgaaacgatggcgctatcggacacgattgaaaaggtaaatgtaaggaacaaaaaaatgaccagcttgtcttcagaggcagaaatcgtcttaagaggcggcatggataaagtaaagaaattacatgaccacaatcaccaaacgacagaagcaaaccaactggtcgtacaacatattgaaggcctggcagaacagatgcttacgatttctacaatcgtacaaacgattaatgaagtatccgagcaaacgaagctcctcgcattaaatgcgagcatagaagcggcgcgtgccggcgattccggaaaaggatttgcagtcgtcgctacagagattcgcaagctgtcgaccatgacttatgaatcaacagagagaattaacacaactattgcacgcctcaaggcagaagtttctcaaacattgcaggtcatgaatcagacagaggtgattatctccgaacaatctcttattgttcaggagtcgggaacggtatttgaatcgattatggatatgctaaaggaaatcatcaactcgattcaagagatggatggggatatagggcagatgaatgttagtagggaacaggtcatctcatccattatcaagatatccgatgtagctcgagacgcagcttctgccacagaagagataagttcggcttctaacgatcagagtcaagcgttttcccatctgcatagtgcagctgaacaattgaaacaatcaagccaacaagtgagcgaaatgatcagcaggtttcgaattgtacaagaataattcgtgctgagagtaagaaaaggagctatctgactacggatggctccttttctgctcccgttgatggaaagcgtgcgcaccgtctcacctctaggggggaatggtgaattattcggagtgttgatgcgtatctccatccaatgcgatcatcacaaccgttagattttatatggcttctgtctaaaaagcatcaccacaagggatagctaaaacttgccgttgtagatagcacggtgactgtatcataagcagggcgaaacttgcagattaaaatagtgtagattcgaagcgaagtttttccctctatcttatatctatgaaaaaacaccctttctcaaaaccaactcctacccactctcccgatttctatgctttaataaaatgagcagtatcaacaagaagcgttgaaagtgggattctatgaagcgactaacgattggcctgttcgcccatgtggatgcaggtaagacaacttttgcggaacagctgctgtaccatacgaacagtatccggtcgcgggggcgggtggatcatcaggatgcgtttctggacagccacgacatcgagcgggcaaggggtattacggtgttcgcagatcaggcggtaatagaatataaaggagacagctattatttaatagacacgcccggacacgtcgatttctccccggagatggagcgggcgattcaggtcattgattatgccatcctgattgtaagtgcagttgaaggtgttcagggccatacggagacggtctggcagctgctgcgcaagcatcggattccgacgttcttctttatcaacaagacggatcggatcggcgcggatgtaggcagaaccgaggcggatatccgtcagcagttgacgggggaagtatgctgcattacacagagcttcgctgacggcatagtcggcgagccgctgcgggagaccatggcggagcgggacgaagccttgctggaagcattcctggaggggagagaggattgcggcttctggctggaggctttgcagaggatgatagttgcgagtcttctcttcccctgtgcttacggctctgcgcttcaggatacaggcgtcattgaatttctggatcagctgcatctgttgacgacaaccacttatgacgagaatgcttcgttccaggggcgggtttataaaattcggcacgatgcaggcggagcgagactcacgttcattaaggcgctgggtggtcggctgaaggtgagagaacagcttagttacgagagtggcggggttcaatatgacgaaaaagttacgcggctcttcttgtttaacggccttaaatcgcagccggtggagcaagtggaagctggcgatttgtttgcggttgccggcttgtccgccgccggggctggacaaggcctggggtcgatatcggacaagttagcttacgagtcggaaccgacgttacaatcgaaggtattattcgacaattcgatacatgtacagaaggtgctcggtgcttttcgcacgctggaggcggaggagccgtctctgaacgtcgtttgggatgagaaattgcaggagatttctatccgcgtcatgggattgattcaactggaagtgctggagcagcttgttagagagcggtttagctttgctatctcttttggacaaccggaaatcttgtataaggaaacgattcaatcggctgtgaaagggtacggccacttcgaaccgctaaggcattatgcggaagtgcatttgctgattgaaccgggagaaaggggcaatggcatcctgttcgatagcaggtgtcatgccgatgatctgaatgtcagctatcagaatctgattcggaatcatctctatgaacgggagcatcacggactgctgaccggcatgccggtcaccgacgtgaacattacgctactgaggggccgcgcgcataaagaacatacccacggcggcgattttcgtgaggctgcctttcgagcactacggcagggtctggagaaggcggacaacgtgctgctggagccctattacgatttcaaaatcaaggtcgctatcgatgaaatgggcagggtgctgtccgatattcagcgtgcttcgggtatttttaatccgccgcagacaaccggaacgcaagcggtggtcacgggcagggtgcccgtgtcgactttcatgaactacagtgccgaattcgcatcctttacgcatggacgaggcagtatccgctgcgtgttcagcggatacgaccgctgccataatacggaggaagtcatagagcggatgagctaccgcaaaggggcggacccgctgtatacatcctcctccatcttttgcgccaagggggcgggttactcggtgccatgggatgaggcggaagccaagatgcaccttgaattagaacctgaatgagcttgctctaatggagatgaaactccaggtaggagagcaaaaccccatacctcagtggcggtaaaaatgttgtagtgaatgcaaaatagttcaaaagggcattcgcgtttcttgagggagagttgtaaaatgcctaatgaaaatcaagcgaatatttacttgagagaacagattgtattctttattatgcgggatcggccctatcgaacgaacatagtgcaggctggatcggtgggaatgcacccgacttctttgatgatcaattagatctcatccacgaaggtaaccaaaaatatgtttttttacttgagcctcgtccatccctttaaacctgagagcatgatttcgattttcatccctgaagactatgaggagtatttggaaaacaacatttatcctaattgcccgatcaaggtggttgagcatcccatttcgactgaaagcgtcaaagatatgtttactaacccgggtcttataaagcatgtaatttcaaacggggaactaagccatgacgaaaagtcgatggatcagccttatttgatcaaagtaggcggaaacccgagacttattcaaaatgaagactattattttgcgaagctgaaggaggagtcattctcttttttatttcaggtagatgaagatggttatcccgaaaggttgcttcaagaggattacaattatccttttggttttgggtcactatatattttcgccaaaatggagacgactgagatacaacatccagtagcaggtttttggcaattctcttgatttagtgtggggctgtggttagcggtgttattcttgggaggacttgaacggcggtgagatcatcaagcgatttttggcgtgcgtatgtcccattcgcacaagcagacagcccgcccctggcgtaaactgaattataatcagtgagcgaggtgaacttccatggcacaatcgaaagagatgcgtgcacgggctaagaagtttcagggccgtccggtctgtgtcaccctgcacagcggagagacttatgtcggctacatcaccgatgttaattacggcgggttggtacttgccagcgctggagtccccccacgcacttcttccgggaagcaaggctcccgatctatcaaacgcagagctggtacgcatgccccgggcgtccgtctcggcaaccggaaaagcggcgcgcgcaagccgtctggccgttcgcgctcccgcaagccggacgccaaggtgtcggcatttctgccgatgatgggctcgctgttaggcggccttggcggctccactgcgggcgcaggagggcttggcagtatgctcggcggcggcttgcggctattcggcatgatccagaaatttgtcccggtcgtgaagatgggctacggtatgatcaagtccattcgcccgtttctcggcgccgttaaaggcttaatgcccctggccagtccggccacgccggataatgaataatcgtatccctgtggactttaagtcccctttgagtggtcaaagggggctagctcacaccgtcattttctaacaagaataaaaatgatcacggtcttcgtcatcaaatttgccaagtgtccgtctcctaacaaattcgtgttggcccccatatggattccattcatatggatttttttctgtggtactctaaggtggttcagtggtgaccttaagagaagctacaatgaaagattacttaaagatacatatcattttaaagaggtacgacccatagaaaaaataataaaattgctggataagcaaacaaaggaaacctggctatggtcaacaggagggttcaaatatgtggtttaggaagaaagaaacgcaactggatcgaataaaaaacaaactgagtcaagctttgcgcaaagacgcggatttctcggtgtttggagcatcctcacatcaatatagggttaaagagaagcttacagcaaaagagctggcggactggcaagcccacaatcaggttacccttcctgagccctacgcgcagtttttaacgaaagtgggcaacggaggcgccggaccctattatggaatctattcaattggaaaggcaacttcctacaccgagcgccaggcactccttgcaaaatccgttctgcatcccgggatgaccaaagaggaatggaaccatctgattgagcccctgaccaaggacgaggacattcccgatgaggaatacgacgccacctgtaataaggtgctgggcggcatgttgtgcataggcacccaaggctgcgaatacgacatgtatctcgtacttgaagggaaatacagggggagaattgtgtacacctccgatttccatcccgatcatccctttttctttgtctatgaagacagctttctggactggtacgagcgctggctggatgaaattattctggattatgatatcgggtggtttggtagtcgaatgccgggtgatgagaatgcgctgatccagatttatcagagcgctccaaatgaagaaatccaagccaaagcgcttaatggaatgttcaagtttaagagagtctctcagccaacccttggttttttgaaaaatactgcggagcaaagcctaaaaaatcggactacagccatttggctcatctgcaaaacttcttttgacgcgggtagaaaataccttctggagctgttgcaatcggatgggcatgagggttttctgcaagctttacagattctacatactttcagaaaaactgtgaatttaacggattttattccagtgatcttgcaaaggcttgacaggattcacgacccggaaacgttgcgttatgcagggtatatcttggaggattatggtgcgattactccccagaactttgcgcctttcttgtgccatactgacccgaaaatgcaaaccactgccatctatgccgcgcgcagttgcgaaaacaagctgggaagctgggagatcattgaacagatgttgatggggggcggcccggaggttctgaataactcgattttatactggggcattattccacatgagaagttgctgccttactataaggaggtatggccgcaatacaaaagcaatccgaatttcagagaaaaatttatcggttgtttgcgagaactgcatttgccagatgattatttcgacaaagacgaatggtgaagaaggtgtacatggattatccagctcaccttcgatttaatttgacgtggcggagcctgaacattccgaaatcggatttacgaggaaaccaaaaaaataaaaaaagctactgacatcccgttgtcagtagcttttttgtacattaggagtatgcgaatagcgcagtgtttggagatggggcgacctttctcaaaatcttatcatagaggtggaatttatttatgagcaatatcaattgggaagtggatccggaccacagttccgtcgagttttcggtgacgcatttaatgattagtagaattaaaggagtattcgagcatttccaagcgatcttgagttttgaccccaacgatttaacaacgatgggtattcaggcttccatagatgcaaatagtatcacaactcgccaatcgcaacgagatgaacacttgaagagtgacgacttccttcatgcagccaagtatccaaccattacgtttcaaagcaccagctgcgtccttgctggcgaaaggcaatatgaacttacgggcaatctaactctgcatggagtaaccaaacccatcacttttcataccgtttttgaaggacttaacaaagaccctcgcggccgggaacgtgtaggatttcattcaacagccagtatcgaacgcaatgaatttggtttgacattcaattcgcctctggaaaaaggtggggttattgtcggaaatgaagtgagaatcgagctttatatcgaggcaattagaatagattagcgatcctaaaggccatccttttagcggggtggtctttaaacttgccgctacaggtaggatggtgaaccgtatcacaaataagggcgaaaatgttgaaaattggagaggtaatcatgggaaatacggataagtttgaaatgatagctaatatatatgacacttctgaaagaattcaaattgcaaaggtattatctgatgccattcgtgaatatgtagttgacgctaatagtaagaatgctattgattttgggtgtggaacgggtcttgtcggaatgagcttgttaaatgattttaattctatgctttttctggatacttcacaaaacatgattaatcaaataaagcaaaaaattactgatcttcatattcagaatgcaaatacattatgttttgattttgaaaaggaaggtctaacggatttacatgcggactatatttttatggctcaggttctactccatattcatgatgttgaattcgttttatcaaggctatttgatgttctaaatgaaggaggacatttactaatcgtagattttaataaaaatgaaaaagtagtttcagatatagttcataacggatttaatcaagaagagctgactgacattatgactaaaataggatatagagatattcagtccaaaactttttttaatggaagtaaaatattcatgggacaagatgcatctatgtttattcttgattctcaaaaataaaacttttaggcagaaatcagctctccttaccggaaacatgctttgtgtcttctcatgcatcgcagagggattggatcaaaagccgcttgactctgcaaagacgattaccattactatgcgatatttaaaaaatggcgaagaatcagttgtttttagttgtttttcctcattaggtttgcagaccgatttcgccttgtgtcatatgacattatggcactggtagatttgacatcaagagccgtaggatacgactactacttgtaaaggatgtgggctctttgatgacaagaaccgtcgtcagctttattcaaaatggctatttcctactgcttactttcgctaccggattgttttacttttgcttttatctggtcgctcttacattaggtttgagtctttcgtttaccgtcgcgggcgttcctctgattactcgcattttgcgaactacatacgccttcctgcaatttgaacgcatacagaccaagatctatacggatattaccacggagctttacgttaaaccaataaacactgatgcctctatctggcttcaagcaaggaaggagttgctaaatcggcgcaactggattgctatcggctggctgatgctgaagcttccggtggggattttaagcctcagtagtgcagccttgctttatataactccactcgtgatgattgcgaccccgctcctctttccgttatttaattattattttatgggtttacttgtagatactgtgataaaatccatactggtttcgaccttaggagtcgtattcactatggtgagctataggcttgcgaacagcttgacgcgtatgctaggcggctacacccgtcttatgatcaagagtgtgaaccgttaaaccggaatgtcccggtctggatttaaaagtattgttggatgatgttctgctctataatagttacgtaatgtcatactgatagttcttaggggttgatggttttgttcgatatggtaaagcagtggttctggtacgactggttcatgcttatgatccgcctgatttgcagtacttctctcctgctcactatcatagagcggcaagctcattttacgctgccgctttgggttcttgtgttttggcagcttattgctttttccgttccctggctgtgcttgcagctcaattatagatactacctgcttaccgagattgtgatcccgggcgggctgtgcttgtatttagcttcgttttttccggaagcctacctcacattcctgttgtatccatttttaattgccgctaacagcaaacaaagaacatatctttggtcaggtcctttatcggtattgctcctacccactataattaagctgcttgtagagcagactgatttttgggttatgaccattcaattcgggacggcttatgcattcggattttccttccatttattgatggtcaatcatcgtcaaagcgaaattatacgcgagcaaaatgcggtgctggagcagtacttgtcccaaatcgagcgcatcacgctggccgaagaacggaatcggctctccaaagagcttcatgatactgttggtcatgcctacacttccctcattatgggattggaaaccttgcgccctgagctagagacggatacaggaacgaaacggctcgattctctattgaacctggcccgggagaatatggacgaagtgagaggctatgtacatcaaatcgaatcgccgcatgaagaactcccactgcttcagtctttgcggaagctggcagaggagtttcaggagcatgctaaggtgtcggttcgtttccaggccttcggagaggaataccctgtaacgaagcaagcaaagatagcgctgtatcgctgcttgcaagaatcattgacgaatgccgtgcgtcatggacactcgacggagattacggttttggtgcaatttgagcctcagcagacgaggctcgaaattaaggataacggccgcgggatggaacatggacgggatggtttcggcttgaacgccatgaaagagcgagtaatgaatttgcaaggtcatgttggcgtctatacccaaccgggcgaaggcaccctcgttacctgcaccctgccacgacaaacggagcttaaggatgaagtcatccgtctgttggtcgtcgatgaccagccttttatccgtgaaagtctgcggactcttctggaggagcagcaagatttgcaagtcgtaggggtagcagaagatggcgagcaagccatcgaactgtgcaggcaggttcagcctcagctggtgctcatggatttggacatgccgaacctggacggaatctccgcatcccgtaccataaaacaaacgtggccccacatccgcatcttgattctcaccacgttcgaagatactggacaggctctggaagcgctgcaaagcggagccgacggatacttattgaagtcgatgaagccagtagagctcgccgaaacaatacgcacggtctatcgcggaggcacgctgatcgatcaggagatgtcgcacaaattgtttgcacagctggaagccgccaagagcggggaagatccgtcgacaacccaagtggccgcgacctatgacttaactccacgggagcttgaaattttacagttcgtgtcgaaaggactgcgatataaaaccattgcctccaaattgtatttatctgatggtacagttagaaactatgcgtcatcggtctatctgaagctgggggttcgcaaccgggaggaagcggtgcaaaaagcccgggaggcagggcttctggaataaaccttacggctcgatgcggatttccgttggatatggagaaaactaaaaataagcggcagcatcagcagccgcttgtttcttattatacaagaaaacccccagtttgatcgggggttcaggaaaccttatataaagtatcattatcttactttttccggttaaccttttgatttagtgactgattggcaacgtatagtaattaaatgcttgatctaataaggcactggcttcttgacgcttcaaaagctgtttggagcggaaatctatggagccgtctgaattgatcttggtatccgggtccatgataccttgggaaacaagagctgtgactgctttaactgcccaagcatccgtttcgccactcaatttaaccttagttccaggctcaacctgtttcaggttctggatcattaccgccgccatttgtctagtgataggagaattaggctgataattacgtagtccggccatcatctgcttcttattcggttcaatcatgaagggttgtttataccacccgtgggcgcgcagcagcacttctgagaattctccctgagtcatcgttcctttcggatcgaagagattggctgactttccgctcatgacgttcaaagcattaagattgttaatatatggattatatttactatccgcaggcacatcagaaaatggtgaatcaatgtttattttttgcgcataagcaacgaggtctgggagctgcatgtaatacaaatatgcaatatggcctgcttcatttttattaaacgtcaatttattacctgattcatcttcaaataataaagaatggatcatttttagtgtatgtttccctgatgttcctgtctccattattaatttcccgtccgaatacgaaaccttcgtccttaaggcagcgatacgcgtgttttggtataatcccacgtagtcttgggcctgctgctcacttattgccgcgtaggttgactttgaaacttctgattttctcggataataatgattcataaattcctcatacacgtcaagactcatcatggagtcgttattgtaggacatatacatcgctgtattcttctcaggcagaataacaatcaaggaagaatgccctgtaacatttcctccttttagaatcacatgctgattattcatcttctctttgaagtagccttcgaatccaattgttgtaaccgggaactccttgtcagggaataattggtacgtatgcatttgctctatgctctttggactcaccacttctttacctttgtacttgcctttgttcaggtgcatcatgaggtacttcgccatgtcatctgctgttgaaaccataccgccttcaggtttttccgttggtttaaacccgtccaagggtatcagttcacctgttggtccatagtgagcagccattctgcttaacaattggggggtaaaccgcacattcgtcgaagtcatgcctaacggtttgaaaatattcttttccatatatcgggaatatgacatgcccgttacgtttgctactgcatatccggctagcatgaaaccaaaattgtcataagtgtacgcttctcctggaggcctgacaacagttggcatatttgatgcaatgtacttcttcattggaaaatatttgtccgcgtattctggatgcatttccatgagaatatctggttcatcaaatccacttgaatatgtaagtagatcaaacatcgtcagtttttttcctgttttattcggaacctttattcctcctaaatactcttggatatcgtgttttagatccattttccccttatccaccaactgcatagctgccaatgcagtgaatgactttgtaactgagccgatttggaaaacggtatttttatcaacaggaattcttttttccctgtcggcataaccgtaacctttgcttagcatcactttcccacccgtgacgaccacaaaattagaaccaactgtattaaacttcttcatcttgtccgcaaaaacaccatctgcaaaagcttctagttccttggcatttcgcggcccctccaagctagcctttacagatgcaactggtgcgttaacgggtgcggcaactgacgcgccgttgggtgccatacaggcggtagttatcgtagcagataacagtagaaccgcgagattggtatgaatcatttttttcatgaatgatttctccttgaaatgtatttttgcctcatagcgtccggcaaaaccaagtatggcaaaggacttgtcataccaacaagttacatttcgtcaccgacccataccagtcacttcaaagtgtgtcatatgacaattaggcactaggtgcctagtgttcaatggtaatatcgtttttgggtgtgtccatttgattgtttacaatgaatgttggaccccttcacttcagtttcttctttaccgtctctccttcaatcaacacaggttgataataggtgtggttgcgtagatctttcttcccttgcagtttcttgataacccaatcggcggcatcacgtcccatttgttcctgtgggtgtgttaatgtcgttagtttgatgtttgcattcttggaaatataggaattatcttgaccaataatggatatgtcttcaggaacagatataccaagttgtctgcatacatgtacaacttctaatcctacctcgtcgttatagcagacaattgcggataacccgtccctttgttcggttaggaatttttttaagttggtggacaggtcctgcttcgtctctgtataaaatgagagcacttgctctgggtaaaaccgtaatttggcttctcccagcgccttgatatagcccttcattcgatgctttccttgtaaatcgtccattttggcaatgataccaatgtgtgtgtgtccgttagcaatcaattcttttgttgccagatagctggattgtacgtcatcgagacaaaagaagggaacttccaactcttcataataagcattaatcatgataaacggaacatcctgctccttgaacgtcagatagtaggagatattaggattatatagattgctcttcgtaggctcaatgatcaagccatccacaccaaaggacaacatcatctccaaggctttcttttcctgtgcgacatcattatttgtactagctaatagcaatgaataattatcttcattcaatctggcttcaatcccgcgaataatagaagggaagatgtaatcggaaatgtaggttgtgatgactccgatggttttattactggaattcccgccgttttttgatcgaaattggttgctgacataagtgcccgatcctttttcacttcttaaaaaaccctcgttggatagttctaaaattgccttacgtaccgtctggcggctaactttatacatatcctgcaaagccgattccgttggaatttgttctcctacgctgtatgctcctgatagaatgttgctctttatatcctcaaggatgacctgatactttggtttcactttattccttctttcctggttgtcctaatactaatttacctacccataatatttgtatgtacatatcttagcataattatgagcttattataatcgatagcctaacatgtataaatactaaaggccaagcctaataaacctaaaagacgaaaaaagattgagtcagatttcatcttgctcaacctacatttcatgcgtttatctggtcgattggcttctatgcactggcactaattccgtcaacacttctgccaagaataaaaagataaattaaagttaattcataattctaaggtcaagcgagcttccataggcatgttataccgtgttcgaaagtttttgtttgccactagcggagctattacggtaattatgtgcttgtcacaatcggcggtaaatcgcgctacgattcaccagttcgtaccacccatcgcatcgcataaattcaaacagtgaccttttgggatcttccttctcgtgtttttcgttccgcgtacaacagatcttctattcaatcccatcagtcttatcgtatttcgtatcttctcatcatactacttactgctcatttgcaatgggtttatagtttgcatacatgccctaaaggggaaaaaagagagatactcggtccatgagaatatttgtaggtataactatgtattcacgttgacaaatgtacgaacaaaaaatatactaaggttgtaaattaaagaaagcgccttctttcaattattgcgattataacagttgttcagagagaggagtaacgtgagcatggatcaagacattaaacaagcgattactaagggagaaacctcacttggtatcgaatttggatccacacgtatcaaggcagtgctgattgatcatcattttgaaaccatcgcatctggaagctatgagtgggaaaatctcttggtggacggttattggacgtacaacttagagagtattattacgggtctgcaagaggcttatagtgaaatgaagcaagaggttgaacgaaaatatgggattacccttcgtaccgttggttctataggattctctgcaatgatgcacggctatatggcttttgacagcaagggcgagttgcttgttccgttccggacttggcggaatgcgacaaccagtgccgcagcaaaagttttaactgataaattccaattcaacatccctgagcgatggagtattgctcacctgtatcaagctatattgaacgaagagcaacatgtccctcagattgattttatgacaacgttagctggatatattcactggctgctgactggcaataaggctattggcgtcggggatgcttcgggcatattcccaattgatgagactacacatgattataacgaatcgatggttaagcagttcgatgaactcattgcagccaaaggttacgattggaagctagaaggaattctccctaaagtttatatttcaggcgagcaggcaggtgtactaaccgccgtgggagctaaaatcttagataaatccgaagatttacaaccaggtattccgctttgtcctccagaaggtgatgcgggaacagggatggtcgctacgaatagtgtgagaaaacggacgggcaacgtctctgtgggaacctcggtttttgccatgcttgtattagagaaggacctttcagcggtatatccggaaattgatctggtgactacaccgaatggtaatccggtcggaatggttcatgccaacaactgttcaagtgatctcaatgcttggctgggattgttccgtgaattctatgaggccatggggcaaaaggcggatccgaatcaattgttcagtgtgctgctgaacaaggctttggaagcagatccagatggcggcggtttactcagctatggctatttgtcaggggagaatatcaccggaatagagaaaggccggccattgtttgtccgttctcctgaaagccgtttcaatttggccaatttcatgcggactcatcttttcactgcgtttgctgctttgaaaatcggaatggatattttgacaaagaaagaaaatgtagcaattgacagcattctggctcatggtggtttatttaaaacccctatcgtcggacaaaaaattgttgcggctgccatgaatgtcccggtatcagtgatgtcaacagccggagaaggcggggcgtgggggattgctattctggcttcttacatgatgaacaaggatcaacaagaaagtctggaagacttcctcgaccaaaaagtatttagagatgctgaggggcaagaaatttctcccgacagttccgacgttaagggatttgaaacattcatggaacgctacacacaaggcctggcgattgaacaggctgctgtagataatctagtggaaaactggaggaattgacgtgttagagcaactgaaagaagaagtatatcaagccaatctggatttgcctaaacatggactcgtgaaatacacctggggtaacgtaagcgctgttgatcgtgagagccgcttattcgttatcaaacctagtggtgttagctatgacacgatgaaacctagcgatatggtggttgttgattttgatggtaatgttgttgaaggagagatgagaccttcatcagatacaccgactcacgccgtactttataagcattatgcagagatcggcggtattgtacacacgcattcgacttgggcgaccatttgggctcaagccggcctggatgtacctgtaatggggactactcatgcagacaccttctatggttcagttccttgtgctcgtttcttgacacaagaggagattgatcgtggctacgaagcagaaacaggccgtgtcattatcgaaacttttgagcagcgtgggctggatattttagcagtgccaggtgtcctgcttaagggtcatgctcccttcacttggggaaaagatgcgaaatcggcagtcatgaatagcgtcgtgttggaagaagtttcgaaaatgaatttattcgcacgagaattgaatcattttgctgaagaattgccgcaacgcattctagataaacactatttacgcaaacatgggaaagacgcgtactacgggcaaaagtaatataaattaaaaaattaagaaaagaggatgaatgatgtcaacagtaggtacaaaacagttctggtttgtcgtaggttcacaacatctgtatggagaagaagcattagcagaagttaaagcacacgcacaagaaatgaccgatgccttaaataagagtggcgttctgccttatccgcttgtattgcaggatctggcggttagtgcagacaaaatcaccaatcttatgaaagaagtcaactatcgtgacgaggttgctggtatcatcacttggatgcataccttctcacctgcaaaaatgtggattcgtggtactaaattgctgcaaaagccgctacttcatttggctacacagtataatgaaagcattccttgggctacgattgatatggacttcatgaacctcaatcaggcagctcatggtgaccgtgaatatggatttatcaatgctcgcctgaagaaacagaataaagtggtcgtaggttactgggaacgcgcagaagtgcaaaagcaaatcgcagagtggatggatgtagcggttgcttataacgaaagcttcaatatcaaagttgcccgctttggcgacaatatgcgtaacgttggcgttacggaaggcgataaggtcgaagctcaaattcaatttggatggaccgttgactacttcggaattggcgaccttgttcagtacgtcaatgctgtgaaagaagaagagattgatgctttgtttgcggaatactccgaactctatgaatttgattatggtacttatagcaaggaagcttgggaagccagtgtaagagtgcaagcaagctatgaaattgcccttaaacggttcctggatcatggcggctatactgccttcactacgaacttcgaagacctctatggtatgaaacagcttcctggtcttgccgttcaacgtttgatggcacaaggatacggcttcgccggtgaaggagattggaagactgcagcgctcgatcgtctgcttaaagtaatgagccataaccaatccactggctttatggaagactacacctatgaattagcggctggtcaggaatcgatccttcaatcccatatgcttgaagttgacccaacgttggcaagcaacaaacctaaaatcatcgtttcaccgttaggtatcggcgatcgtgaagatccagcccgtctggtgtttgacggcaaggcaggagacggtgtggttgtttccatggctgactttggcacgcattataaactgctgatcaatgaggttactgcatttgaaccgacagttcctgctccaaatcttccagtggcccgtgtactgtggaatgtgaagccaaacttccaagatggggttaaagcatggattgagaacggcggtggtcaccataccgtggtttccttgaatctaaccacagaccaaattgttacttatgcaaaactggttaacctggactacgtaattattaagtaactagaagatagtcatctataaaagcattgggtcagtcctcaggacccagtgctttttattggttttctaagaatgtatagatatggtaaggttcctaagctatctggcattataacgggataattggtttctccttaaggtaatcatttaattcataaggatgtgatactatggcgaatgtaccagctgcgaaaacgaaactggttatcgttgaaggcatacctggctctggcaaatccacattatctagacacatacatgacatgttaaacacacatcaaatagaatcggaactatttttagaagggaacttacgacatcccgctgattatgaatcggttgcatgtatgccgaacgaagaacttgatcggctccgatctatctattctgaggtgtttcattacattgatccgtttgtatctgtgaatggcaacgactctttaatcgcatatgcacttgcgcagcaatcagctccaaatggaatcccttctagtttgtatgaggaaatccggcgttatgaaatttacgatggagtacccgtagaaaagcactgcgagttgatgattcaacgttggaagtcttttgttaaagatcagcgagaaaaagaaaagttgataatactcgaatgctgttttttacagaacccagggtgtgcattacttgcccgacataacgctggagaagatcgttttattcagcatgtattacagattgcggagcaaattcaggagttaaatccaattttgttctatttgaagcaaccgaatgtacatgagacgattgagcgagttaaaacaatgagatctcaagaatggttagatttcgcgatttggtaccatacggagcaagattatggaaataacaaggggctttacggatatgagggatatattcagttccttgaacatcgacgagagctagaattacaaattattgagcaactcccttttcaatcgtttattatggataactccgattatgattgggggaatcaacaacagaccgtttcgaatatcataatgaagtatttataagggcctatcccggaaagacatattttaccgagttattcatatacatggactgttgattcaatcattggaaatttgttactctacatcatttgcttctaagcgcttttttggtgtctgttattactgctagtaagtgaagcccaaaaaatacagcgtgttgagatccattcttattatttctgcaaagaaaattctcactttttagcagaaatgatttataattatcagataatagacaatataatttttaaaagattatattttagttataatagagacagaaaagatatgttcctgagtggagccttgcttcttgtatcacctaagcaggagggcctgctcttttttgcaaatataagagataaggaaggtttttatgaatagcattcagaaaaatacagacgttatcttaattggtgccggagtcatgagcgcgactctgggatcattgctgaaagagttagcaccagaatgggaaatcaaagtgtttgagaaactcgcaaacgcgggagaagaaagctctaacgaatggaataatgcaggtacaggccatgctgcactgtgcgaactgaactatacatccgagaaggctgacggatctatagatattcgtaaagctgtagacattaatgagcagtttcagctttcaagacagttttggtcttttcttgtaaacagcaatttgattcgtaatccacaggactttatcaaaccaatacctcatatgagcttggtaacaggagagaaaaatgtatcttttttgaaaaaaaggtttaaagcgctttcaaccatttctctgtttcaaggcatggaattttccgacgcccctgaaaagctgaaggaatggattccgctgattatggaaggccgtacaatgaatgaacccatcgcggcaaccaaaatcgactctggaacagatgtcaactttggtgctttaacacgcatgttgtttgagcatttaaaaagtaaaaacgtcgagatcaattacaaacatagtgtaaaggatattaaacgtgcgagcgacggctcgtggaaagtcaaagtccataacctggacaacggtaaaatcgaataccataatgccaaatttgtctttatcggtggtgggggcggaagtctacctttgctacaaagaaccggtattcctgagtccaaatatatcgggggattcccggtaagtggactatttatggtatgtaacaatcctaaggttgtcgcccagcatcatgcaaaagtatatggtaaagctaaggttggtgctcctcccatgtctgttccgcatctggatacaagatatatcggtaaccaaaaagcactgctatttggaccgtttgccggcttctcaccgaagttcttgaaaacgggctcaaatttggatttgatcggttctgtaaaacctaataatctcattacgatgttggccgcaggcgcaaaagagatggcattgaccaaatatctgatccagcaagtgatgttatcgaatgaaaagcgtctggaagaattacgcgagtttattccgaacgccaaaatcgaggactgggggatcgtggtagcaggccaacgtgtgcaggtgatcaaagatacggagggcggaaaaggaacacttcaatttggtacggaagtggttagtgccgctgatggttcggtagctgcactgctcggcgcttctccgggtgcttctactgctgttcacgttatgctggaagtattggaaaaatgcttcccacaacatatggaagagtgggaaccaaaaatcaaagagatgattccttcttatggggtgtcactagcggaaaacccagagctttaccaagaaatttacaattccacaacggaggtgctgggtctgggcgaaaaagaaccgcttcatcgttaatttttgcatggcggtcatttagtttactattttttgaagtgagttcacttatcaataatagaagaattaaaattatattcaaaaactcttgcaagaaacttaatcgaaaaagcagaagaccgtgaaatttaacggtcttctgctttttttaagattttaattctttgaatggggagctagggtattagatcatttacactttttttaaaattaacttatgaacaataaaatcacctttaggattttcaagagagattccgcaattatataactctgatccactataagtagcatttgtaataacttcgagatagttggcttcttggtctaaataaggaattcgaacaagtaatgataaatcaaatacttgataggtgttccgaaatacataaataatggcattacttttttcttcatcgacaaacatccaactacaaatatttgattcattaggagaactcaatcgatagaattccccttcaaaaacaagctttctttctcttttgtaagtcgatatatgattcgctaccttcttcttctcttcttcagacatggagatgacatccatttcatagcccatattggttgaagaagccaaagctgctcttgtctcaaattcagttatgcgaccagtttgatgatttggaacatcggaaacatgaccagttattgaagagattggaaacatgtaagaagctccatattggatttgttgtctgtccagagcatcggtattatcactgatccatgtttgaggaaaatagaacaacataccaggatctaatctacctccaccgctagaacaattttcaaagagtacttctggatggcttaaagtgagtgtgctaataatatgataaaagcccagcatatatctatgagaaaattcttgtgagttgttttctgtttcagtcggggagaaaggatcagtcatatgtcgattcatatcccacttgatatagttcactccgaaatttgcaattgcatctgacaatgtcttgataacgaagttttgaacttctttattggttaagtctaagaagtattgacttctgcccaaaatgggttcatagcttttactcttcattacccattcgggatgttgtttgattaggtttgtatcgggtgatatcatctcgggttcaaaccaaatcccaaaaccaatgtctttctctttagcataatctaccaaagatttaattccattggggaattttttttcgtcaaccttccaatctcctaaagaagttttactactattgcgtttaccaaaccagccatcatccaacaccactgtttcaaaacccaaaagactagcagaatcaatcaatttttttagcaaagcttcagaaacatcgaaataagtcatttcccagctgttgattacgatgggtctctttctttttttccatgatggattaatcaagtgattattgaaaaaagtatggaatgcttgagaattactattgaacccttgattgctgtatactagcagagcttgtggactctgaatggtctcccctgattttaaagtccatgagaagccctcttcatttaacccaatttgcattcttaagttattatattgatcacgttccaaaatctcttcgtgattgccactgtaaagtaaggtcattgcatggacttctccttgaaactctgtggcctcttttgataaagcgatgaagggaggatattgaggcccacttgcacctctagcactaccaattttaaataatccatgtttaatatcatttctatttatttggaactctttttgatgagtgccataaaatgaggtgcatacttgattctcgtaacgtatatcaagagaagcacttagaagtttttcaacttttattgtactagagctttcgttaattactttagtagaacgtacgataatcggtgaatcctcaaaaatcgtataaaacaaatctagagcaatatttgcgactttatcgtacaaatggacaattaaggtctgacaaaaagcttcattgcttcttgcagagggcagatcttgaagcgttaacgcttgatcaagaatttggtagccaacatagacaaatcttgtaattccttgtccatcttcatttcgaatctttatggaagaatttctaaaatcaccttgatgaggtaaagaaacctcttgaggtaaaaattcaagagatagttcaggtatattaatatctggagttgcagcaaatgttctcttttttaattttggtcgattgctaaaattgtaactagtaatcttttgtccccaataccgatgtagcaaataggtatcttctacaatttccataatataactgacataattatttgtgagatgaaatacttttttctcttcaacaaaatgaattaaaggattcattgatcatttatgctcctttctatactgggaaggtgatatcccaagttcttttctaaaaaatttagaaaatgataatgcatcagaaaaaccaactgagctagcaataaggttaataggatcgtcgctttcagcaagtagttcttttgctttgtttatttttaaattagaaagatattttttgggggggattcccacctcatttttaaacataagagacaaataatttggatgaatgccaacagaataggcaatatcggaaatttggatgtcatcgtgataatgaagatccatataacgcatcgcttgaaaagaaatggaggtactgctattcacagttgtttgaaccgggcattcattcaataaatttcctgcgatatcatacataatgccgttaattttaaaaaaagaggctaaatcatttttattcagttcgataatatcttcgattctactttcataaaaggaagcatcttggcaattcattacaaatttttcttcatcagactgaagtaatgtttgaacaaagtttccagattgaatgcccataaaaccaatccaagaatatttccacggcttatttgggtcagcggtataagtagaaacaacattcgctggtacaataaaaagttgattttcatggacttcaatcttttgatcttcaatttccagtagtcccttgccctcctttacaaaatggataaagtgatagtctcgtcgtttcgggccataactgtaacccggttcacaatattcaatgccgctgttataaagaataaagtctgaaatacttttttttgtaaaatcagtgaatctatccgtatattctcttaagttattattcatgcccttattatacataggaacgcttcaaagaaaatgtcgatattagaaagttccatatttctcttaaatatttctatattataaatgtaggttgaaatgataatatctcattaacaaaggtaatgaaagcgcattaatgaaaatttgaagaggaggactatttcaagttggaaaatcggcataagaattatttccatattgagccggataaaggattacttaatgatccaaacggtttgattcagtttaaaggaaaatattatttttttcatcaatggaatcgttttgatacgagccatgattacaaagaatggggattgtttttatctaaggatttagttcattggacaaatattcgatcagcgattttacctgatagatatgatgataaagatggtgtttactcaggaagcgcgattgagaacgatgggaaaatgtatctcttctatacagggaatactaaactaaatggagttagaaaaagttatcaaaaaattgctgtatctaacgatggacgaacattcatcaaacaggaaagcgtcattgaaacccctaaaggtttttctgaacaccatcgcgatcctaaagtttggagaaaagataataaatggtggatgattgtcggagctcaaacaaaagaaaatgtgggagcaatcacgctgtttcaatcagatgatttattaacatgggaatatcaaggtattttttacacggatactatattggatcagatgtgtgaatgcccggactactttaccttaaccgatggaatcgaaatactaatggtttgtccacaaaagcggacttctgacagacaaagtgatcggccaatttcaagctatgctggatatttagcaggaaaaatggattataaaacaaataaatttaatcagtctactgagataaaaatgatggatgaaggatttgatttttatgcgccgcaatcttttttagatgataaaggtcgaagaattatcgttggctggatgtctagaatggacgagaatcaagaaagaaattgtcctacagtgaaagatggctaccttcattgtttatccatgccgagagaactgaagtggatcgataatcacctttatcaagtccccttgaaagaatacgagaatttgaggaagagagagcaagaacacaaaaatgaatacggcattatttctaacaatagtaaagcctttgaactcattattgattttgatgaagctataaaagatttttcagtgtctttgaattccaacacaaatccaattatatatcgttgtggaaaacttgagattggacgaattaattgggttactaagaaattggaaacaaaaattcttcaagtaaaggacctaacgaagttgcacattttttgtgacagctctactttagaaattttcattaatgatggacagtatgttttttcaatgagatatttttgcgatgagcagaatcgtaatattgaatataagagtttgaatgagaaaggtatgattaatttttactcttatgaggaggaaaacgaatgagtaacaaagaaatcgctgataaaattttagaattagtcggtggaaatgaaaatattcaatcagtgacacattgtgcaactagactccgaattattattaacgataaagataaaattgatatgaaaggagtagaggcaattgataaagtcaaaggtagcttttttaattccgggcaatatcaagttattttagggactggattggttaacaaagtttacgatgaatttgctccaatgcttaatggctcgggtaagaaggcaactgaggcttcaaatgagtctcaaaaggttactttccaaaaagcgattcgagtttttggggatgtatttgttccaattattccagtattagttgcgacggggttattcatgggattacgaggtttattcactcaagaagcgttattgggacttgttggcctgactcctaatgatattccacaacagcttttaatgtttactcaaattttgactgatactgcctttgcattcttaccagcgctagtagcctggtctacatttagaatttttggtggaacacctattctaggaattgttctaggattgatgcttgttagtccagtacttcctaacgcttatgaggttggtcaacaagcagcagagccacttacgttttttggatttattaaagttgtcggttatcaaggttctgttcttcctgcgttcgtagcaggtattctaggttcaaaaattgaaatcttcttgagaaagaaaattccagattctttagacttaattcttactccctttttaactttattatcaggattaattttagcgctatttattgttggaccaatcttccatgaagtagaaatcggtgttttatatgcagttgagttcctattgaatctaccattggggattggcggcttaatttatggaagtttcggacagttattaggtatcttcggtgttcaccatatcctgaactttcttgaaatcagcatgttaggaaaagatggctggaactatctaaatcctattgggacttgcgggaatattgctcaggcaggagcagttttagctgttgcaattaaagcagtttcgccaaaaatgaagcaaattgcttttccttctgctctttccgcagcattgggaattaccgagccagctgtttttggagttactttacgcttagtaaaaccttttgtgatgtctatgattggtggtggagttggtggttttctagcctctattttccatttacgtgcaacaggtatggcattaacaggaattccggggacactactttatcttaatgagcaattaccgttatatatcttggtgaatgtagtatcattcgcagtatcattcgggttgacttggacatttggttataagaaagatcaaggattatagtcaaaaagataaataatatactaactaaaattagacatagactcttagcaatgagagtccatgtctttttgtatctttagttgcagagtttttatttagctgtcattctgttagacaagagaaggtgcccctatctatttatattacatttgtgcggttggacggattacgatttcgttcacatcaatatcggccggttgttcaattgcgaatccaattgcacgggctaccgcgtcaggtgtcatggctagtttatcccggatggcagcgagttgatctcttaatgctggattggtcataccctccgtgaaattcgtctgcacaataccaggcgaaatgatggtcacgcgcagcttgtcgccagcctcctggcgcaatccttctgagatcgcgcgcacggcgaacttcgtaccggagtagaccgactggttcggcacagtcttatgtcctgctacagaagcgatgttcacgaaatgtccagaaccctgcttgcgaaagataggcaacgctgcggctataccgtacaaaacgcctttaatgttgacatcaatcatgtcctcccagtcctcgacacacagatcttcgagaggggaaatgggcataacgccagcgttgctgacgagaacatccagcttcccataccgttcgcaagccaaattaacgagattgcacagatcctcgcgccgtctcacgtcagtgcgtgcataaacagcttcgccacctctattggaaatgcgtgtcgccagcgcttcaaggcgctccgctccgcgtgctccaagcacgacttttgctccacgctcggcaagtaacagtgctgttgcttctccaattccgctgcttgcacctgtaatcacgacgactttgttctctattcttccttccaaatgcatagcccaatccttcttcctttgatctatttgccttaggccctctgttggccttgcaagtaaattttaagtagaattcgattgagacaggtagaccgatcaagtccaattcttgcctaatcctattcggcgcgcatataattagcacatcaatattagcgttcaacggaaaggaaggtgaagcatgaatgatttcgtctcctcccccctctgatatttctacgaatctacaagaactgattcatctaattcatcaacatgcgtcttcggatggtacgtttgtctcgtctgtgccaggactttatttcagacgtgcaagccatgtgtccgagctgaatcatacggtccatatgccctccctgtacgtggttgcacaaggctcaaagacagcaatgctggctggagaaaactatgtgtacgatccaacaacctacatggccacatcagttcaacttcccgtaattggtaaaataactcaagcctcgtcggagcttccttatctaagtcttcaattatccattagcccagacgtcattctggacattatcaagaagagtcctcctcaaggtaccgtaaagactggacgcggcatactagtgagccaatttgaccctctgctgcttgatgcgctgcttcggcttgtcagactttcggatacgcctgcggatattcagtttcttgcgccgcttatcacgcacgagatcctttatcgtgtattacaaggtgagcagggggctttaatcaggcaatttgccgtagttggtagctatgcacatagcatctcccaagcgatccatctgataacccgcgattactctaagcctcttgtgattgaagaattggcgaaggaagtaaacatgagcccttcttccttacacaagcattttaaaaaggtaacggctataagtcctctgcagtatcagaaggccattcgattgcagactgcacgccgcttgttgctctcggagggagtggaagccgccaatgcaggctttcgcgttggctatgagagcccttcgcagttcagccgggaatatggacgcatgtttgggcgtccaccgatgagtgatgttaaacatttgcgcaattcccttagtgtctcagttgattgagagattcttcgggtgatctgtcgaggaggcccaaagcaagttgtctttggtctggtcaaggaggatatatcacaccaacggaagctcgtcaagccgttcgtaaatcaacaatcctttctctttcgccacccttaccatttcatcggcaccctgagagggttctccaacccgaagcacggcgttacagtaatcaagcaggcgaatggaagacgggtgaaagattttgttaaaggtctcatctcccagagcagtggaaccggctgtcgtgataaggggcaaagcataccactctcccagcaccggcatgtgaccagcctcgtaaacttgaagagcaatttcattcatgtagttgacgttcttctcgattaatacatgatcatcattcgttccagatcgataagggcctgcgataaggatatgaagtggtttcgatttcactttcaagaggccctggatctgagcgtattgaagcagcattatcgtcttggcgtcacgaatctcgccgctttcgaccatgtctagcgcttgagcaaacggaagttctatcacttcaatgttttcctgttcctcctcaaggccaccaccgccacccgttgtcatatcttcactatactcggctatatagaagtgcaggatttcggtaacggagcccggtgacatataggcctcgccaactttctgcacccggtcgatacggtatcccgtctcctcctccgtctcccgaagaataccttcttccggtgtttctttatcgagtaatcctgcacaggtttcgataagcattccagtttcattaccgttccgataagtaggcattcggaactgtctggtcagtacaacagtttgtttgtgctgattatagagcaggatcgttacgccgttgccacgatcgtacacttcacgggattgtgtctcccattgtccattatttttttcaaactcgaatgtgaccttatttaagatgtaccagttatccgatagaagctcctcttttacaatccgtactcttgggtgatactgttgtgccttcatctcatttcctccctagaaagattccgttctctttagtcatttcgagagttccgttctgctgcaaaagccgattgatgtggtctcgaaacttgtcaatagccgctccgacaagtcgctctcttgcgttcatcggagtcgaaattatatattcgatcaggggttccgcttcgtcgaccaacagacagtcctcgtatcgaagcaaccgaagatcggaaaagcaagaagacagcaagtcccctccgttatccaggtggaaccgtttaatagcatgatccaacacatgaagctcaggatcgaacgaaaccgccaagtgttcgacctcttgtaagtgttgagtgctcattgtagaggtgcatactatacctccttgctttaagatacggtgcatctcgcggattgctctagggatgtccggcacgtggtacagcatgttgttagcgataaccatatcgaattgctcttcatggaaggggatctgttgcgcgtcaacagataaaaacttaaactgcgaattgttgcttcccaagcggcaacgtacttcttccaccatcccgcttgacatatcggtaagcgtgatacgccagctgcttggaattcgttcggcgtttcttatccaaaaggttccgtcgccgcagcccaactcgagaatatgggctcccggttgcacctccagttgttcaaagatccaacggtgccagccttggggattcgtactgtacttgtcgtaaagatgtatccgcgtttgcaggcggttcgccgtccgatattgctccccccaattttgctcactctgcacggtttggataacatccgccaaatggttccaatcggagccataggccgacatttccatagcatctcgtattgcatgcactacgtgctccgtatgggcaattttcttttgtaaaacatcgagttgtgcttgcaacgaatgtctgatctctccgttggatggcgattctgcatctaaaatgtccattattttttgaagcgataaccctagatacttcaacatctgaattcgctgtaatctttccatatctttcatgttgtacagtcttatggatccagtgtggtgacctcctggactcagaagtccaatttgatcgtaatatcgcaatgtcctgaccgttatccctgtacgtttggcaagctgtcctgtcgtcagacagttctctttggccattcattgctcacatccaattgattgctctagcatgtcgttctcagtcagtatagcaaatgacgtaacgtcaccttcaagaaaaatttatgcaataagaaataagagaaaaccgccctagcaaaaggtgacttggtagttagtcacgaatatcatgtaataaaaattcatcagctcttcatggaggatactatgaaatctttcatttacatggtgagacatggcgaatcaccgaagacggaaggaaatgaaagaacaagaggtttgactgataaaggcaagtcagatgcttttcaaataacagaatggaattcaatgatcaggaattagttgaggtaaaaagattgtggaacatgccgtaatagtttgtgaggaaaaggtataaggactattctccaaaaagagactacccttaaaaaaggatgatctctcttcaaagcttttcctttatagctattgcggtgaaccgttaagcaaatcctcggctatttttaccaggtcttctttgctcagcgggctgtcctggttatcagatatgttgtagtgtaaacgccttttttcatcgagccatcccagtcgatttttccctacctccaagggcgtgcttgtttcgcttgccctgatgtaataggccttggttcctttgatcatcagttcctcagccgaatcctgttcattttgcatcacggtcgtctttgtgacttcgggagcgtacttggtgacggtgatgtttacatagtcatttcctcttgcataccgggcaaaggtgaagtctgacttgccccagctcagcttttgaataaacagattttcacctttcggtgcggccttggcctgttgcatcagtttatccgttaaagcccgatattcctctttgttcatcatcccaggatatgcagcgactggatagacgtatccgaaatcaaatcggtagccattcggcagatgagtaggattgtggaatagtggggcttctgtacgcttgatttcatcctgcagactgctgaagctagaaagttcagtcggtttgtatgcaaacaggacaggattagacgaatttcttggatttatagaatcgtccttaacgtaataggcggcatactctccaggctgtagacggtctctcaccttttcgttccactgtgtgtaggtggttgtatacgtttgggaagcgtccgtttcggcaggtgttttggcggtatttaatacgacatcgcctttgccgttacgtaattccagatattgcgaagcggcgtacccagtcacagaggcgcccaatacaaaaagtaagatcataataggagcggtgatgcgcggttgaagacgcatttttacgatgagtccctttttgggtttcgccttttggtagacctgttccatcactttgtcagagacgtcaaaggcttgtatttttaaaacgttctctggctccgtcaacatgtccatatttttaaagcctttgtctttcaggtcggtgtatttcagaccttgttcctgagttctgtcttgtaattcacgcattttgggtcctcctttatgggctccatcatttttttgagctttgtttttgttctgccgtattttttcttgatagcttcctcgcttttgttcataatttccccgatttctccaaacgatttttcttcaaaaatgcgtagcaccagcaggtttcgttcttctgcattcagttggcccaatgcccgacttagcggttcactgaaaagctgacgttccataacctgcgcggcgctgtctgaagtcatgttagttgaggtaaacaaattaattctaaatttgcgctgcagattcttccggcgaatcaggttcaggcagtgatgataagccattttatacaaccaggaagaaaaccccatagtcggcttgtacatattaattttctcaaaagctttgaccaaaatatcctgcacggcttcttctgcttcatgctcacttcctaacagccgccagcaatacacaaaaatctgacgctgatgctccttcacaatgtaggcgtaatcctggatctcgccagcttggacccgtttaattctatattcgatttcctcattcaaagatttaggcaccccctctgattaaaaagaaaactatatctgtataacaaatgaagatgaaccaaagggacatcttttctaaaattttttaagtattaaatcaaccctctaagagaatacgataaagcagaacaattatcaccaacgttgttgatttcatagagcttggatttttattgtggaaataaatagaataataaatatacctatccaaaaatttaaaaatagattgtaaagaaaaaaggggatgggaaatgaagttttatgataataggggagtccagatggtagttgcacttttatatcctgttataacatttgttatattaagtaatggtcatatgataggttcatggactgttccggccattattgcaattttgttttgtctgttatggaaaaatactttttatgtaatcatctctaatgtcttggtgcggaatatatccgtacctatgtggtggctgctagttgaacgtgtgaaaacaaaccagggcgctgaaattttcatttcgtcattaccattcattatattgttataacgtattgactcttaggcggacgctcttgccgccttagaaccagtagcatgagccaatttccctgcttgcctctcttgctcaccgaatcggaagccagcctccttgctacagatacccaggctggttcaaacaagcctttagagtttcaaccggctcatgaaaaaaagggtgttttgggattactccagaaacacccttgctatcaattcgtttaagtatacattttattcaagcaatgtatcagaaaattggttttcatttgttaccgtcaaggtaaaactgccctgcgtcggtatgatcttgtcggagatcaggtaacccgtatccgcataggaggacttggttgttcattgtgcacttacgacacaccgttaattgttttggccgtaatgatctacatccggtagctcatcgagcgtgatcacgtttggatggttaaacactttgttcaaatgctcccggctattgtttacgccatcggtcaggaactctcccgtccaggtagtgaaccagctccagttcgttccgtcactggagagtaaatccggatccgggatcgcgccgttctcggttaatgcgaccagcttctggttgttcacaagcgagacgagtgcgtcatacttgtcagtgaccggactatagtcgcccgcagacggataatgatccgtactcacgatgtctacaacatcgtgtcccggataccactccggtgcgctagagttccagacccaaatcaaattgttcagaccatgcacgctcgttaagcggtcgtacaccaggtggtaaagtttctttgacggctccggaccttttgcgccccaccagaaccatcctccttcagcttcatgcaacggccggaagagcacggggattttcgcatcttttagcttttgaagctgtgccgcaatggcatcgatatcccgcaaaataagtttataatcctcggattccgggtggttcaacgcgtaatcaacgtcgaaagtggtggaatccccgaagaatcccttgtaccactctttaccaggttggtcaattaaacccttcggcgcgttccaatgccatacaacggtgacaataccgccttggctgtgccaatcgatcgcattctcgatctcagaggaggaagcgccgtgctcgacgcgagacggtgaataatccatcaggtcgaatccgacaatggctggctttttaccaatcgcgtcctgcatccagctaatgttagaactgttctgctgaccggatagtacactcttgccgtattgatcgaccagatagctcatcaacgatttggcttcaggcgaggcgttgggattaacgagtgtcttcctaacataatgctccttagtgaccgtcgatttttgaaactcggccacccccccgttcagaacgcctgattctgcttcatacacagcttcagacacggtaaccggttcttcggatgcatgggcaaaagacaaaggatacagtaaaattgcaacccctgcggtacatagaagtgctggccatcttttaaacataaatcctcccaaaataactaaaaatttattcctttaattttgttttgctaaaacctgtttttattatgtaatctagattagtttgcaaaacactatcatttcattggcattctaacatttaccaaatttattgtcaacaaatgtcgaatcctagataaagctaacagagaaggaaaaactcacagttaaggcaaaagcagagcgaaagaaaataaaatctacgtgatggagaaatttttgattatcgcgtgtttgttgctgaaggattccaagtagttcatgaagacaataaacgaattctgaattttcatattaaaaacaaagaacgtggcttggcattggccagtcccattctcggttcagggctccaaatttctgaagcactatcgcttgattttcctgatattgattggtttaaggaaaaagtagatgttacgaggtaataaaacgaaatttcaattgttctatttagacattacatttttaataactttagacgtcgcaatagtaagtaatctctgaaacgattcaggagtgctttttcaaaataacttatggattaggtgaagcggaaggaatgagagatagaataaaattaagttattgataaggtgaagatgacgatatggttttatccaagagagcatgcgattttcttgcaaattcaaaatggaaagataaattaaacgatcaagagataaactcggcaatccctcccgtatagctaacgaaaaccatcggctatgctgggcgggattgcctcatcctctttagtgcagcgtatcttctacttattccctttacgtacctttaacagcttaccctttacggttgtattcttcataatctcaagcaccagtggacctttaccattcagaatctcaacatctgtcgcataatccagaatcgtaataatcccgatatcatctgcggtgaccccgtcaagcttagcgatggttcccacgaagtcgacagctctaagttttttcttcttaccgccgttaaaattcagcttcataatctgttggtttagttgctcgcgcttatcttttttgagtgcggtttttacatgcagtttctgctcaaaatcttctctacggaggtcaacagcctcttctgagggagcctttacctgcggaatcgcgaacccaatatatgcttcaatatcagctaatcttcggccatccttaggagtgatgagggaaatggctttacccgttttgccagcacgtcccgtacgtcctgtgcggtgaacatagctttccttctcaaggggaatatcgtagttaatgacatgggtgatattcgtgatatcaattcctctggcggcaacatctgtcgcgatcaagtaacggaattgaccccttctaaatgcattcattacctcaaatcgctcgtcttgctccatgccaccatgaatgcgatcacatggatattcaagatcagccaatgctctgaataatgtatctacattctcctgcgtacgacagaaaataatgcagctgtcaggattctcaacaatcagcagatcttgcagtagtgccagcttgtctgactccttcacctgaataagagagtgatcaattgtagcggtcgttataccggttgcttttatttcaatttcaacaggatcgttcatatacttgtgtgacagtctggctacatcctcaggaaaagtagcggagaataacatggtaacccggtcactaggcagggcctgaatgatcgactgaacttgctcgataaagcccatattcagcatctcgtcagcttcatcaatcacgaggtaggccattcgatctaacgatagcgtgcctcgttcaatatggtccagtacacgtcctggcgtacctacagccatatgtgttctttgttttaactcggccttttggatatgaaaaggatgttttccataaaggggcgtcgcttttatccgcttaaagcgtccaatattcgtgatgtcctcggtgacctgtaatgcaagttcacgggttggcgtcaggattaaagcttggggcttattctcattccaatctactagctcacaaagtggaataccatatgctgctgttttgccgctaccagtttgcgatttggcgacaaggtccttcttctcaagcgcaacaggaatgacttccgtctgaatctctgttggcgtctcatagcccaagctattcagcgctcttacaatttcttcacttaatgcgtaatctgtaaaatgcttctgactcattttcaacctcttctgcgctgtatttgaataccattacatatataatgtcatcgtgtatcgaacttatactcatatagtatactctatatccaggttcactctaatacatatcagcggtttacaatttcatacagaattaatcttttcgtcttgctgttttccagtaaggcaactatactttttctgggacgaaaaaacacagtctggttggtagtccagacgcatgaatgactctcagattccaagagtaccatgtcagtaaccttcccccctcgggatgtccatcgtttcgatttaaaatgagggggattaaaatgaagcttacagtttatcatgatggacagtattgggttggagtcgtggaagagcaggaccaagggaaattgaaggcagctaggcacatctttggtacagagcctaaggacgaggaaattctccattttatccgtgaggaaatgtgggaacttgttggtcggctctcacaagaggtggctataaagtggtctgaaacgaagaaggtcaatccgaagcggctagcaagacaggcagcgtatgaattaaggcagaagggggtctcttccaacgcacaagaggccttaaagttagagtatgagaagcgcaagttggagaaacatgcttactctaaacagcaaagggaatccatgaaggcacggataagggaattaaaggagaaaaaagcgaaagaaaaacatcgcgggcattaataaaacttccatccttatccgcaattgttacgcatgttttataccagcatatgtgaaaacatgtgttacgcacaaagggcacccgattgggtgccctttaaactatcgtatagtgattcccattcgtaaaaattgaattcaatccgaattacttaagcagtgtaagtgtcacctctatcgtgttatcaataaatgatcgttctggctagattttaaccgaaacgatgtgttaaaggagcaccagggtgttcagccaccccgcaatgatgtaaagtttttcggataaaatctttacttttacatgtagcggacaataacctttcattcttataattggaaatgtaagcgatttatttagagataggaatattaaaaactatacgtatgaggaggagattgtatgtcgaaatttaaagtgggcaagttggtaagcagcttggcgttggcgggtgtgttgttatcatcagttctgataaacccggctagtgccagtatggcgaacggtggcaaattcctcgggaatatcattgctggaagtgtccctgcaagtttcggaacgtactggaaccaggtgacgccagagaattcgaccaaatgggggtcggttgaaggcagccgtaacaacatgaactggtcgcaggcggataccgcctacaattatgcccgtaacaatggcttcccgttcaagttccatacattggtatggggtgctcaggagccaggttggattagcggactgtcggctgctgatcagaaggcggaagtaacccagtggattaaagcagcaggtcaacgctatccgaatgcggagtttatagatgtggtgaatgagcccctgcatcagaagccatccttccgcaatgccataggcggtgacggatcgaccggatgggattgggtcatatggtcgttccaacaggcaagacaagcttttccaaatgccaagctgatgattaatgaatatggaattatcaacgatccctcgttaaccgaccaatatgtcaatattattaatcagctcaagagcagaggcctgattgacggaattggtattcaatgccaccagtttagcatggacactgtttcagttaacacgatgaacactgtactgaacaagctggcggcaacaggattgccaatctatgtgtcggaactggatataactggagacgacaacacccagcttgccagatacaaggagaaatttccggtattatggaagcattctgcggtgaagggagttacgctctgggggtatatccagggacaaacttggaagccgaacacacatctgctgaattctaacggcacggaacgtcccgcgctccaatggctgagacaatatgtgcagagttaaactataagtggcacttaaaacccaacagatgcgaacttttgccaaatgtctgggctgggtagatgtttatttgacgaagtcttggctgaaatgttatacgcccaaggcttctttttatttagcttaaacctaaagtatcaaaacctaatccaactcaattaggcttacatacccaattcataactttaacccacttgaaataaaaccgtctggacggtatagtaaagaggggtgatcaatatgaatacaactaaaaaagcattaaaaagagaattaattcttaaagcggcctcgatgattgtgcacgaagaaggagtagagaaattaacgttagaagcggtggctaagaaagcgggaataagtaagggaggattgctttaccattttccgaataaagatgaattgattttgggaatggttgaacaactatcgaccagctttgtctccgaatttaatgagagagcagaaaacgatatgcattccaaaggaagatggactcgcgcgtatatgaatacatcattttctggcgatcggaatgcaagtgacctgtataccgctctctcagcagcacagtttacgaaccctcacatgctaaaattacttcaggacgagtatgagaatatccaaaataaaattgaaaacgacgaattggaccccgttcgttccacgatagtccgattagctatagacggtttgtggtttgctgaaatgtttgggcttgctcctcccaatgaagaaatgaggcaaaaaatgatgggagaattgaaaacatatataaaggagaatgaataatggcttatcttttcttggcaatctctattgttggtgaacttgttggaacttcaatgcttaaagcttcagaaggtttcaccagactgtatccgactttattcacaattgtggcgttcgtgatctctttcttctttatctccttatcccttaagacgctccccttaaatatgacttatgctatctggtcaggtgtaggaactgttgctacaacgcttatttcagtattgatttggaaagaaaaaatcaatacaggaagtatcgcaggtattgctttaattgttattggcgtggtggtactgaacctatttggtgcaggacatggtgaggcaaaaggaacaacagaagcaacgagttcaatcgttcaaaaatgagatgaaatagtatagacactggagatttactaccactatcgatcactgccagtttgtgtgaaaggaccctgctgcatcacttcgttcataagtatgggcaccaaaataatccctttgtgcttgcaaaaggttagcattcgaaatgcctgtccggtaactatcataataagtaagtgaagcacttaaacatggaaacgaagtgccagaattaataccctcacagacaacttttcgcaatcctttttgatactctttaaccttttcagcaaaatacggggcgattaatagattggccaaattcggctgttcttgatatgtttcgcttattacgtttaagaattcagcacgaatgatgcaaccaccacggaaaataagggctatatcctttaaaggtaaattccatccgtaaagttcagaagtcattttatattgtataaatccttgcgcgtaggcacaaatcttacccatataaaaagcttgtctaatgtactcaatccacacatctttatctaaacttcgctgatcaatccctggtcctgttagaatattttctgcataaactcgttcttcttttaaagaggagatgtaacgggcaaacaatgactctgtaataatggataatgggatcccattgtcaattgcttgaatgcttgtccatttacctgtgcccttttgccctgttttatcaagaatcacatcgattaatggtaagcctgttacatcatcctttttccgtaaaatctctgctgtgatttggattaaataacttttcagttccccttgattccatatttcaaagatatcagcaatttcattcacagataaacgtaacctttttcttaaaaatgtataggtttctgcgattaactgcatatctgcatactcgattccgttatgtaccatttttacaaagtgaccggacccttttggacccatataaacacagcaagggtctccgtccacttgggctgctatttttgttagaataggagctgctttttcatatacgtttttatctccaccaggcatgattgaaggtccatttaaagccccgacttcgccgccggagataccgattcctaaataaccgattccttttgacttcaattcatcatatctatgttccgtatctttgtaatgggagttaccaccgtccataatcacatcgcctgcttcaagaaagggtactaatgtacctattaccgaatcgaccggtttgcccgctgttaccataaggaagattttccttggagtttttaaggagtaaacaaaatcttgaatttcgtagtagggatggatggagtgaccttcactttttttaacaagatcatccgttaaatccctcgtataattatagacagcgacttgctcacccttaccagccatgtttaaagcgatattacggcccattacccctaaaccaatgacaccaattgtgttcgacattttttctgctccttttatttgaaatgaataggccgtagatcctcacttataggcttagaagattctaagaaaaataagtgggggatctaccgcccgggaatcatggtttatacgaataaacttagtactaaaataaatcctaatccagctacagaaatgatggtctcaagcaacgtccatgttgcaaatgtttctttcatgcttaaaccaaaatattctttaaacatccagaaaccggcatcgttaacatgtgaggctattaaactaccggctcctgttgcaagcacaactaaagcaagattaacgtcggattgtcctaacatcggaataactaaaccagcggttgttaaagctgcaacagttgcagaacctaaggaaattcgtaatattgcagcgataatccaggcaagtaagatgggtgataatgtagttccattgaataattcagccacatagtcacctacgccgccattaatcagtacttgtttgaaggcgccgccacccccaatgattaagagcatcatcccaatatgagtaatagcggttgtacaagatgccattacatttttgattggaatttttcgtgctattcccatggtgtagacagctaccagtaaggaaattaacatggaagttgatgcatcaccaataaaacggatcgctgctagtaaactgctatcttcaaatcccattgttttttgaagcaaagtaataaccgtagcaatagacattaaaataacaggaagcattgcagtaaatacactgataccaaatcccggagtttcctcggatttaaatactttttgttcacctaaagaggcaatattaccggttttcgtaaatgatgcaggtacgagttttttggcaagcttagtaaatacaggtccagctaaaataacggttggaatggcaataatgaaaccgtaaagtaaaacctcaccaaggttcgcgccatattcaccagcaataactgttggccctggatgtggaggtaagaaaccatgtgttacggataaagctgcaaccatcggaattccgagatataaaatagaaacctttaattcttttgaaatggcaaatatgattggaattaacaatactaatcctacttcaaaaaataacgccacaccgataatgaatgaagcagctacgactgcccattggatatttttttcaccaaatttgtctacgagggtcatggcaattcgttgagcaccaccagaatcagcgatcaacttacctaacatcgctccaagtccaaagattaacgctaagtgaccaagagttccgcctaatccggcttcgatggttttgacaatttcctctaatggcattccaagtgctaaagcgacgccgaacgatacaatgattaatgaaataaaggtattcaatttgaagcccattattaaaactaataatgctaaaattccaatcgctacgataactaatggcattgtaattaccccctgctttttatctttttagtgtttaattaagcttctttgataattggaaatccgtgtataatcatcttctaatactctagataggttaatgaaaatcggcagtaatttcctatattccttggtcgcttcttcttttggtgtatgtttgttggtactgccaatcatttcagaaacgacttcaaaggactggatttgtccggtggcatacaagcctaaaatacaagctcctagacaagaactttcgtagctttctggaacgacgacttcagatgagaatatgtcagacatcatttgccgccaaacatctgatcttgcgaagcctccagtagcttgaattctggtcacaggaccgtccatacattcggttaatgctaaaaatacggtgtacaaattgtaaatgactccttctagggctgcgcgaatcatatgttctttcttatgtgacatcgttaaaccgaagaatgagccacgtacgtctgggttccataatggcgcacgttcaccagccaggtatggatggaataacaatccgtcagatcctggtcttacacgttcagcaatcttggttagtacatcatatggatcaattcctagtcttttcgctgtttctacttctgatgaggcaagttcgtcacggatccagcgaaggaccatcccgccattgttcaccggccccccaataacccagtgcttttctgttaaggcataacagaatattcttcccttttcgtctgtttgaggcttgtctataatggttcgaatagctccgcttgtcccgattgtaacggcaacttcaccttttcgtatcgcatttacacctagattagaaaggactccatcgctagctccaatgacaaacgatgtttgtggatcgatccccatcttttttgctaaatctgaatcacagttggtaaatatcctggttgttggcacgagctcagataattgagaaggggttataccagcaatttttaatgcttcttcatcccaatctaatttttctagattcatcatgcccatggcagaagctagggaataatccactacatattgatcaaagaactttttgaaaatatattctttaattccgatatactttttaaccttgacagcggtttcaggaaggtcattcacaatccaggctattttcgttaagggtgacatggggtgaataggtgttcctgttcgtttatagacttcatggccattcagctcatcttttattttatgtgcccatgcttcacttcgattatctgcccaagtgatacaagacgtcagtgggcggtcattttcatccatcgcaatgacactatgcatggcactgctaaatgaaacaaacgatagctttttttgtgagtgatgtttcatgatattcgaagtggcttgcaggacagcctgaaaaatctcttctgggttttgttcagctgtcgctatatccggtgtataaagcgggtatccaatattctcttgttggatgacttcgcctttttcgctaaatagaacggctttcgtacttgtggttccgatatctatacccaacatatagttagtcattttgttgcacgactcctttagatagcatttgttgtgacatccataggtcttctactttaccttgaacatcatcaaagttttcatgtaaagacttgatcatgaggtctctatcttttactttgattgcttcaatataaagttcgtgattgtttataatccgtgtaaaatcttcatacttttcagtgaaacgcatacgcatcgacaaaagaatgagactttccataacaggctttaaattattccagatcatcagaatatgtgaatgattgacagcacgaataatcgtttcatggaacaagacatcttgatatgaaaactcatcagcatcactatatttgacggcgactttcatcatttcgagtattttactaagttccttcgccaaatcattagtgtccatctttacaagacgttcaaatacgaaggattctatgagcagacggacatcataaatttcttctatttctttttctgataggccaataacaacggctcccattctttctaatcgaatgatattttcggatgccagtatttttaacgcttcacgaatgggtgagcgacttacagtgaaatcagcagctagtttattttcagataatatggtaccgctttcaattccgccagaaataatgcgcattctaagctcggatgttacgcgatcaccagctgaggcttttaaaagccatttggagggatataggaattctgattcgaccatcatttcaccttcttaattaatcaagtatacttgtatacaggtattataatctgaaattttaaatttgcaagcgtattcattgaatttgttttgtgacactccgacacatagaatgaaattttcatatcaagacatagatcctgttcggattttttgttcaaatgcacaatcaatttcgtctgttcttcaatatttttaacgtgcggcaatcgatataatgaaagcgtaatcaaaaattgcccggggggttagacagatggaaggattgacgatcagttggataggagctctggcagggctggctattgcaattattctgatattaagaaagctgaatccggtttatgctttatttttgggagctattgtaggcgctttattgggcggagccaatttggaacagacgatcagcgtgttaataagcggtacgcaaagtgtgatggggacggtcattcgtgtgcttgccgcaggtgtattggcaggtgtaatgatggaatccggggcagcggagacgattgcgcaggctattgtaaagaagttcggcggcagtaaagcgatactcgcactagccttggcgacgatgattattacggcggtaggtgtatttattcccgttgccgtgttgattgtggcacctattgcattgtcggtcggtaacaaaatggggatttccaagctggcgctcctgttggctttatctggaggcggaaaagcggggaacatcatctctcccaatcctaatacgattgcagcggcgcgcggatttaatctggatttaagccacgtgatgttggcgggtgtggttcctgcgatatgcggtttaatcatgactgttttggtggcatctatgttgaaaaccaaaggtgtgaaggtgtccgaccaggatatcatggatagtgatgtcgatacatcgaaatacccggcgttgggacgggcgattgtagccccgctggtagctgttattttgctgatgattaacccgattggttccatctctggtattgaagcactttcgaatttcaaggtggatgcgatgtacattttgccgatcgctgggattgtgggtatgctggccatgggacaagggcgcaatatcctgaagtattcggcctccggtctgaataaaatgacggcgaccgtgctgattttgatcggtgcaggcgggattgcgggtctgatctctgcctccaacttgtctgctcaggtggttggcctgattgaagcttcgggagtttccggtacatttttggcaccgcttgcaggtattctgatggcagctgctacggcgtccacctcgactggagttattttggcgacaggctcgtttggggaagccattctgaacatgggaacagccccactcgctgcagctgtgatggtgcatacaggagctacagtcattgattccttgccgcagggcaactattttcacgtcacggcagacagcatgaaaatgagcattaaacaacggatgggattgattccttacgaagctattgtgggtggaacgatggcaattgtagcgacaattatgtatggatttttactttaatattcacgatggggtgagaagatgagagagaaaacatttgtgctggcaccagattcttttaaagaaagcatgacggctaaagaagtgtgtatcgcgatggagaaaggactgcgcaaggtctatccggcggcgaattatgtccacgtaccgatggcggacggcggtgaaggaacggtgcagtcactggtggatgcgacaggcgggcagattcgttatatcgaggtgacaggaccgcttggagaacctgtaactgctgcatacggcttgctgggagacggcaccacggcggcaatcgagatggcatctgctagtggaatccatctggtcaacaaggataacaaaaacccgctaaagacaacaacctacggcacaggggagttaatccgtgaatgtctgaaccagggaattcgaaaaattatcatcggcattggtggaagcgcgacgaatgatggcggtacaggaatggcggaagcgctgggcgccagatttctggatgcaacaagcaatactcttccgcgcggcggcggtagtctgggcgagctggccagtgttgatatttcatcactggatgaccgcttgcagcaggtacaattgattgtagcctgtgatgtgacaaatccgctgtgcggagagcatggggcatctcaagtattcgggccacaaaaaggggcaaccccggagatggtgcagcaattggatgccaatcttgcccattacgccggtgtggtgaagcagcagctgggcaaggatgtgcgcgatcttccaggcgcaggcgcagcaggtggattgggtgcgggcttattaattttcactcaggcagcgctgcaaaaaggcattgaaattgtgattgaatacaccggtttaaaacaaaagctcgccactgccgatatcgttttaacgggagaaggcggtattgattttcagaccaaattcggtaaaactccttatggagtagctcaggcggcaaaacagtctggtaaaaaggtcattgcggtcgcaggttatattggggaagggatcgacacgttgtacaaggaagggatcgatgcggtgtttggcatcgtgccgggagcctcggagctcggtaagctgctggccgaagggccgcaaaacgtagagcgtacgtgcgagaatatcgcaagagtacttcagttcagcgagaaatgaacagatggagaagtgggttataaacataaaacggcatcacacaaatacgatataatacgagcgctcgcctgtaatcccgaacttagccaaagctggattgactgaggaatttgggagtgacggcgagcggaaatatgatattactggcgcatggtctggcgtgaaacagcagttcattgatacagtgccaataagccatgcgtaagctcaaagagctgaaggaggttccggggatctttaccggttaaggtatggatgcgcttcaggcggtattgcagcgtatttcggtgaatatttaattcatctgcggtaaaggagacactgccgttatggttaataaagcttcgcagggtatccagcaaatccacagtatcttccaacttgctaaccagatagatcgtgttcgtcaggttcgtttgactcaatttgaccagaaactcgacttccgcaaaagaaattttttgcacaggcgggcgcaaagccagtaaaacattcatagctgacttggcttgcatataaacatccgcaatgttgtgctcctgtctgctgaccgtaatcagcacatcgggatggctacgcacaagtggctctagcagtttgtctgtcggctcctgattttgtatcagaatgagatagcagtcttcctccagacgaaaggacggatgctgcatgaatatattggacaactcggctaaatgagctggatcagcaggcagatactttacatatacagccgaagtttttagaagcaaatcaatgtgatattgagctgcttctttttttattttttgtgtgtaggctccctgatgatttaacaacatttccagcacagattttttgcgattggcttcatgggccagatgctccaatgagatccgctgttcaatcaggagagacaccgtagttttaacaatattgcaaaaaggacgcacttcatcgggattgcctgaaatacctatgacaccaactaactcatgatgaatgacaatcggttcattggttccctttttctcatagtggccgtcctgccacacttcaaccattttcccagtttcgagcgcctgaacagctccttggtgaatggttccgattcgttcactctcgccgctgccaatgatgatgcctcgttcattcataatattgatattgtatggaatatccttcatcattttgtctacgatgtcttgggcttgtttttcggagagctgaaacaaaatccggattcctcctttatctatagtaatatagcgtattttaatgtaccaccttaatgaaagggttttcaattcattgtgcatctgaacaatatgataaggcggattaccgaacatgtcagtcaattttatcatagatgtgaaattgcagcgtattatgataatccattagacgatattatatatttttgtattcagtgtaatctaaggaagggtatagttgtacgcaaaaaaacagggctcataggagcacctgctttttgtgtctatcctttttattgccagccacgctgtctaatgacgaacctcgcggaagctataggtaatgtcgtgcagttctttctttaaacggccgtctttagacgctggtgcatatccaagcacctggtagtaattcctttcggtctcaataatcgctacatgggtaacatatttgtccacatctttcttgcctttaatcacgaactcaagggcaggatatccataaatggttgtgttagagacaggtcctacactggacaggttccactctttggttaagttattttcagctttcttaccatactgttggagagttatattgcccaattgcttttttgagtgggatagtaccacaacggatttttggatgtacggattgaatattgcaatctctgcctttccttcacggtccgggtctgttgaccagtccagcggggccgtgatttgaaatcgtccatctttacttacatagctttgctctttcttgctcaccagaacttcaggaggtacgtaactgtctgcaagtataaaaatagcatttacaaacgaggctcccaagatcaccattgcggtaaaaaatataaagagcgaacgtttcattgtctttttgctaatcggctctaaatcccgtacctttacaacatatgtacctgcagctaaatctccaattcgttgtcttgatgcagttactaacacactgataccagcaggtatcccacccattagcaacggattggtgtcgattagcctgagcagcgtacgaatgagtgatttaagaaaaccaggaggctttccttccccgttaaccacctgaatacgaaaaacgaacttacccagcgtatagcctgtgtaaccttccaaaagcaaataatagctgaagaaagcaataagcagaatacaacgggttgcaatcgctaaaggcaaaaaccatctgtccgttatttgaatgacagaaataaaaaaacaaatatacccgattacaaaaaatatgcaatcaaaaactgttgctccccaccgtctaaacagagtagaattcccgtatgtttttgataacgccgccatcctatttggatctaccccataattttgaccatgccgaatgtacgtctgtcttgaagtttcctgcggaatgtgtgatatgtgctgttcgtccaaaaaatacacctcttcttaataattaaaaacacactccttatattaacggtcattttataatccatgtttaggaaaacattctataaacaaagaaattattataaatatcccttcctctcatttactctataattggaagaagaaagtaacgataagcgaatattgaactcaggaggcatgggtatgcaagaagaactggcaaaagcgaataaggcagcaagaggtgagaatgtgaaaggtgagtttccggttataacgactgaacgtctcatattacgaaaaatggtagcgacggacagcaaggacatgttggaatacttttcagatgagcaggttatgaagttttatggactgagcccgtttgagtctgaacaggatgcgttgaatgagattagttggtatgatcagatttttgagacagatcagggaatccgctgggctattcaaacaaatgaaggtaaaatcatcggttcttgcggatttcataactgggatcaacgtcatcaccgggcagaaatgggctatgaattgtccagagcctattggggccaagggctaatgtcggaggtacttgcagctgtaatcgactatgggtttaataccctctcattgaaccgcattcaggcgttagtagagccggagaatgcacaatccttgcgtttgcttgaaaaagcaggctttcggcaagaagggctcctctcccaatatgaatttacgttagggaaatatgatgatctttacatgtgcgcattggtcaaatcagtgtatatcaatcgttctcagaaatgatagatgtaggtgaatcaagcaggggagcatggataggaagaaggttgatcattgtacaacatgatcgaccttcagcggcatacccatttcatattgctcaatggggtctttcaagagacctattttttggataaagccttcaagagagtcattgtcagacagacagatgttcaccttctcaatcttttggatctctgctgctctatgaaggagggcgcatcctaatccttggttgcgatgcttaggatcgacccaaagaaagttgattttacccttagcactcatgctcaccatgccgaggcacgtttgatttacttcgtagatgccgagaaaagcttcctgtgtactggtggcgtaataaggtgtgtcactttgccaatggatgtggcagtcgataagggtctttcgaaaagctgcgatgtcatcaaatgtaacttccttaaaaatatacgaagatgagagggcagcgggtggcgcggagggcagagtgccgttgtagtatttcagcgtatagcgtggctgatagccttgcttttcatataatttgacggcccgatgattatccttgatgacttcgagccatagctgctggcaacccgcggagatggctgtttgtttatgtaattccagcaacttgttgctaatcccctgaccgcggtaagccggagcgatgcatagcgtgccgcaacgcatggtcttgtacccgtcgaactgccggacaccgccgagaattaagccgatcggttgatcctcatccatggcaaggaaagagtgattccgtgtattaccctctggacccaaaaaacgtgctgcgaaatcgtcctgatccgtggtcaggcgaatggaataatccgagaacccaagcgaaaatgcttggaaaatgtgttccatgctgacgtcgttgcatctcatataggtgatcatcgttattccccctagaaattcatgctatatttggattatagggaattaagggagctccatcaatctcccgctggaaataaaaaaaccccttaaaaaaggggattggtgctgtgtgttatagggttgcaattcgtatcgctaagatcaggattggtagagaggtcacgatagtgattgagcttatattcaataattttttgagtttccatcagtctggaaatttcttgttgaatcttctgattatgtttttcaagtaaggagtatctgtcaggaagggtaatgttaccttgctccgaaagttctcgataatgcttcatttcctctatagtcattccagtggcttttaatcgggttaaaaagataatccccagaatctgatctctactgtagaacctgtggccgttagcctttcgttccgcataaggcagcaagccaattcgctcataatagcgtatggtatcttctgttaaacctgttagttctgcggcttggctaatagaggttatcgtctccggaatttcttgcaaagtattcagctccttagtagcagttaccaaggtacttctccgttggcgtcgaaaaatcctcctgtcggccctccatcatttaaagtggctaaacgaacaacgacagcagcggcttgctgtaccgaacccgttcctgtaaagccatttaagtcggtggcggtaaaaccagggtcagccgaattgattttgagaggtgagtctttgaattctttggcaagggtgacggtgaacatattaaccgctgctttgctgctattgtaagcaagcaaattaaaatgggcatgcttatgctcaggatcgctattaaaggttaaagaaccaaggccactcgacaagttaacgattctaccgcatggggattcttgcaataaaggtagcatggcttgcgtcacggcgaccaaaccgaagaagtttgtttcatacgtttctcttaaatcgtccaaagagaactgacttggaggagtggctcctccccgagatacgccggcattgttgatgagtacatcaagggaaccgaattcttgtttgatctgttggactgcggaatcaatcgtactttgattcgtcacgtctaacaaaatcaatcgggcttctactccctcattagccaacttagccaccgcttcccggccactctgctcattccgtgagccaatcaggattgtaagacccataccccccaattgtctggctgtttcatacccgatgcctttgttggcccctgtaataagagctgttttcccaatagtcatgagcgattcctcttttcattattcttgaatttggcggccaccatgctttaaatgtactacttggagtatacttaaagtcaacacaaaaccagcaaaaatatagctcgaaatgccctggacattctttattttggaagatgggagaatggaatgaataaaaggcaaatggaaattttacgcctgttgttaactgaaccggaccggttgtggttagcgcaggatctggcggatctgaccgactgctctgaaaagacgatccgcaacgatctgaaagtaattgaagattatatcgtcaagcattctgatgccaatctggtgagaaggccgggacgcggcatttatctggagatgggtgaagcggatcagaatgaattgttccatcgactgtatgcggacgagagtacagcccaacatgagtcggatgaggaaagggtgctgcatgtcgcctatcggctcttgatgaatgccaagcctgtgaccatccaggatctagcttcacagtattatgtaaacaagacggtgattcgtagagatatggagaagatcgatggctggctgcacagctttgatctggccttgattaccaagcagcgcgttggattgaccattcaaggctctgagaaaaataagcgcatcgctttggcgcggatgaaccagctgattgacagtcctgagttaacaggacagatgatgcgcaaacagtttgaatcgcacgagattacaaccataaatcatgaattaaaagcatttcaaaaacgctatgagctcagctttactgacgaagctttcgaagctctaatgctgcatatcctcttaatggtcaaacgaaccaagatgggacaacccatttcgctctccaagcaggacattgcctttttgcaggagagacgcgaatttacatgggctacgtcttttttgcagcagttgcaaaagttgtttgctgtgcctttttccaaggaagagacggcgtatttaactctgcacctgcttagtgggaagttccgttaccagcaggagggaagaacaggaaaacaaggtgagctggcagatagccacccgcttttgcctgagttgattgagcagttagttcggcggatgtccgagctgaatatgattgccttttctaaagacaagatgttactgaaagggttgaatgtccatttatatacgaccctgaaccgtcttcaatatggattgaccgtgtccaatcctatgctggccgagatcaagaagatgtacccctacatgttcgaccgagttattattacactggaagaggtgggacaatggacccggctatccttccccgaggaggaagcggcgtatttaacgctgcattttcaggcttctgtggagcgattgcaccagaaagagagtcatccccagagagccatcatcgtgtgtcacatgggcatcggtatgtcccaactgctacgcaccaaggtggaacgtaaatttccggctgtacatgtggagacaaccctttccaaagcagaagtccaggactatctggcagcccaggaggtggatctcgtcattaccactgtagatctcccagagatgaacattccgcacattctcgtctctcccttgctggatgccaaggacgaacgtcgactggagcaagtgatccgacgactggatgagccggaacatagggcagcagaagaatcggtattttttaaatatacaacaccttttttggtctttccccagcaggaagtacagcatccggaacaattgatctccaagctggcgcaaatactggaggacaaaggatatgtggagcccggttatgtggacagcgtactggcgcgagaaaaaatgtcggccacgacgattgggggaggcatagccatcccgcatggcggttctgagtggataaggcagtcctccattgtaatcgctaccttgaagcaaccgcttacctggggaaccgagaaagtagagcttgtgttcttgcttgcggtcaaacaggatgggcgggaagagatgcgccagttatttaaggaattgtccctgatcagtgagcagcctgctttggttcatgccttatctaaggagaccgatgcgatgagattattagggagaatgaagggataaactaaaatcaaaagctgtgctctggaacaggacttatagataggtcctgttttttgttggtataattccgtttttccgaaagttccggtaaaaagttcgtccgataacagcaagataggcgtttatactatcaatgtaagcggaaacaacagagagaaggggaatgactatgaagatattggcgattacctcatgtcctaacggaattgcacatacgtatatggcagctgagaatctgcaaaaggcagcagcaaagctgggcgtcgagatgaaggtcgagacacaaggctccattggagtcgaaaatcaactgaccgagcaggagatccgtgaggcagatggcattattattgcagcggataaaacggtggttaaagaccgcttcgtcggtaagaaactgctggtcgttggcgtacaggatggcattcgccgtccagaagaattgatccagcgggtgatgaagggtaatgtacctgtgtaccaagcagagtcacgttctgccgaaggtagctcacaggagaacaaaccgaaacaaaatcccatctaccgccacttgatgaacggtgtatcctatatggtacccttcatcgtcattgggggattgctcattgccattgcgttgacgattggcggtgagaagacaccaggcggtctggttataccggacggttcattctggaagacggttcaggatatcggttcggcttcgtttacctttatgataccgatcctcgccggatttatcgcgatgagtattgcagatagaccggggcttgcaccgggtatgattggcggattcattgctgcgaacggcagcttttatggaagtgaggcgggggctggatttatcggcggcattatcgccggtttcctggccggttatgttgcacttgggattcgaaaaatcaaggttggccgagcattacagccgatcatgcctataattattatccctgtattggcatcgttaattgttggattaatctttgtctttgtaatcggtgctccagtcgcacaattgtttgaagctttaacaggttggcttgcaggtatgcaaggtacaagctcaattctactggcattgattctaggtgcgatgatctcctttgatatgggcggccctgtgaacaaagttgctttcttattcggttcggccatgatcggcgaagggaattatgaaattatggggccaatcgccgttgcgatttgtattccgccgattgggatggggcttgcagcgatgatcaacaaacgtaaatttgcacctgcggaacgcgaggctgggaaggcaacattcacaatggggttgttcggtattaccgaaggtgcaattccattcgcggcgcaagatccactacgtgttattcctagtatcatggtaggatccatggtcggttcagtcattgcgatgttggggaatgtaggtgacaaggtagctcacggtggaccgattgtagctgtacttggtgcagtggaccatgtgcttatgttcttcatcgccgttattgtcggcgtagccgtatcggttgtcctggtgagcttgctgaaaaaagatattgcagcaactgtaactccagatgctgctggggaagctggacaatctgcgattactacaacggccgctatggagtcatctgcttcaacaactgttacaaataatgggccagccgtttctccacaagccattcacattgagaaactgacggatattgtaacgatggatctgattaatttggatctggaaggaacgacacgagatgctgtggttgatgaaatgatcggagtacttgagagaactggagccgtaagctctgccagtgatttcaaacaggcgatattagccagagaggaagaaggctccacaggcattggaatgaatattgccattcctcatggcaaatcggaagctgtcctgaagccaagcgtggtcttcggcatcaagcagggtggtgttgactggaatagtgcagacggaagtgaagcaaaactgatcttcatgattgccgtaccgcgcaacagcaaggaaaatgcgcatctgaaagtattgcaaatgttatcgcgtaagctgatggacgatcatttcagagaagcgctcctggcggttaaaacgaaggaagaagcatatcaattgctggatcaggtgcattaattcaatgcgataagaacttgaattaaagaagagaggctcccgaagtttcagccgggagcctctctttcctaaagcatgtattcttacgaggattgtgccatgcgtactagcatatgggcaagcgcatgctgctgctctttgtcccccgctttccacagctcctggaggagcttctcctcgctgtttcgaggttcttctttggctgccagatatccagctatcttctcagctgcttttgcgatcaattcttcattcagaccaatattttgagccatttcaatcttgtcgctcaaataacttttgaatgagtcaaagttgttcagaatgtcatcctttttgctgtcgtctatccgatttaatacgtcatctaccttgttcaaggccacttcgccttccttattcacaacatgattgtgctctgccatttctaatgcctcctcaagattgtttttaagggataaggacttttccgatatagtgtacttaccccgactaactaaagtgaaaacgtgagaagcaagcagagtatcgtggagtgatgaaggaaaacagagtagagagattccaagaaaaatacagttgatcctacataaagtcaaaaaaataacgaattacgtggaaaaagacgggcgaggtgtaggtcaagctatccacccggcttaagtagctttttttcaaagcatcgaacttatcatcatcgccgattaataaatcccgctttagcacggaaaccgttaagctgccgaagaaaccgctcaagctgatcagcatgccgaaaataattccaaatttcaggtcaaacggcgtcaggtagggatagatgagataggaggccgctatagttacgggaaaagcgaatgcaaagccttcccaagttatattgggattggatgtcgggacgattttccgttttccgaaatagagtgatgctagatagtgtacgacatcattgagctgcgtcagtaccactagaaaaagtacaagtttcgctccgtattgcggcgtagcaaactgaaaataggccagatgactcaacccgaaaaccatcagcatgagtccccattgggtcgagctgacactgcgcaaaaaaccaaccgttcctttgttgatcaatcgcggaagcggtagcagcaagaatacatagatagggataaagacaataaacattccgtaccaccctatataaatccaataaaattgtacgggaatcgccaagtacgcccatagaaacaatctgcgatcagcttttctggatctaatcatggaaaagtattcttttagcgcaaaaaaggtgagtgccatcaaggaaagcagtgaaacgatcggattgaaaagagttgccaagcaaaagataaagaacataccccaccatgtcttgatgcgaagcccaatagctgcatagtctttgtctggctgtgttttgactactactatgtaaatcagatggatgaccaataaggctgtaaaaataaggattaacgttaatagcgaactatccattaccactcaccaacttatcgcgaaatagggttccattagggttcctatgttattatgaaggaataattcaaacttgataaggggaaatttcgtaaatggtagcagatcaatccgtctttatcttgcttacgaatacgggaacgtttcttacgagagtcattaaaagctatacgagagcgccatacaatcacgcctccatttccttcaaccgggaactttcggagttatacagcttcgggagaaagaccccgaataaccctctggatggtggtttcgtgaaagaggatattaagacaggtacatacagcagatttccgaatacgacatgcgttatctacgagcttcaagtaaccgaccgtgaagtcgaaaaaatgaagcgagttttacatgtatttatccgaagtcgtcaaaaatatatgtataacttactgggtttgattggtattgcactcaaagaaccagtcgagttcagcaattcttatttttgttcgcaattcgtcgcggaaattttacagcgatccggcataaaaatatggaacaaactgcccgctcttgttacgccagatgattttcgtcaaagtgatcgattccatttgatctacgaggggaaattgagcgagtatgatcctcaagcttgaggaccagcaccgcatcacttaaacgtcttccggcacaattacctcgatatgacgcggtaaaataccaagctcgataggcaaagacggcccttcctcaccatctacattcgtactgaccggttctgcggagctgacacttacatgctttgcggtaaagtaaacgatatcactatgatccttcaggttgcctaaaaataaggatatgctggccgtcacggtgttcaatatattgaggtttttgaaaataaagcagtgaagtagaccatcgtcaacagctgcatcgggagccagtttctcgaatccgccaactgaattggttaacgtagccaaaaagagtggagatttcccttcccaggtcttgtcatcatagcggacgataagtgagtgggcaggatggctgataagctctttcatgccttctttgaagtaggcaaacgtgccaaacatggatttatcgtctgatgatacagctgatagcgattcagcaagcgaacctgtggcaaccacattggcaaacattcggccgtttaagaggcccgtatctacgtttttcacgcgggtagaagtcagtgtacggatcgccagctcaggacttagcggaatttgtaaggcacgggcaaaatcattgactgtcccaagggggatgacacccagtcgtggacgatggtcttgatcaatgaagccgttgatggtttcgtgaagtgtgccatccccaccgatggaaacgactaggtcacaagcttcctcacacgcattaacgcaaaaacgggtggcgtccagttcctttgccgtctctttaaccgtaacaacgtatccttgatcacgtagaatttcttctacgcttctgacatgttggagggattcctctttgccagaagagggatttacaatgatcatagctttcttcatatacaggttcctttctctggggaaattttgggttaccaactcttacccgaaaagcagacctttagactctagattagacatgtgttatatttttagttactatataaaagtaaataaaatctgaatggaggatttcatatgaaaatcgcattaacaggagcaacggggcaactgggttccatcgtggtagatacgttgcttacatttgtctccgcaaacgatcttattgttagcgtaagaaatccagaaaaagcagagaacttaaggtctcgtggcgtcgacgttcgtcatggcgactttgataaaccggagacgctggatcaggcgtttgctggagtagaccggttgctgattatatccgcagacggggataatgatactagaatccgtcagcataaagcggctgttgatgctgctgtacgtgctggagtaggcttcatcgcctatactagcgctgccaatgccgctgacagcactctattccttgcacccgtacatcgcatcacggaggagttcattcgtgagtcaggcattccttactccttcctgcgtaataattggtatctggaaaatgaggcaggcacgatccaatccgtactcgcgggggctccttggctaacctcggcagggtccggtaaagtaggttgggctacccgcgcagattatgcgcaagcagctgcaaccgttttgtctggcgaagggcatgagaatacaatatacgagctctccggtaagccgattacccaagaagagtttgcagcgatactggctgaggttctgggcaaagacgttcctgtacagcaggtggatgatgctacgtatgccgaggttatgctcggtgcgggagtcccggaaggtgcaatccctattgtggtcggtattcaacaagcgattcgtgaaggagccctggatgtcgtaagcaacgatttcgagaagctgttgaaacgcccccttacgccgcttagccaaggaatgagtgaactgatcaagcaaacccaagcataataaacgtgccatagagtacaatttcaacatatgatactgcttatgtctaaaacggatgctacctagagaggtcagcatccgttttagttacattcataagtggaaccgcgactgattatccaatatacttgtagggaactccaaggtaggcttggaatagaaataaaaatgaatggagtacataataccatgtctaatttaccaaattgtcctgaatgtaattcagagtacacttatgaggatcgcagtcttttcatttgcccggaatgcgctcatgagtggtctaccgagtcagaagcaagcagtgaagacgtaaaggtcgtcaaagatgcgaatggtaacatcctgcaggatggtgactctgtaacggtcattaaagaccttaaagtgaagggaagctcatccgtcttgaaaatcgggaccaaagtaaaaaacatccgtctggtggatggcgatcatgatattgactgcaaaattgatggttttggagcaatgaagctaaaatcggagtttgtaaaaaagaattaaaatgtaagaaaggagaagccggggcttctcctttcttatgtttataatggtgctaaccatacggttcctgttcccctgtacacatttaccagcccttcgccggaagcagccgagcccattttggttttcccggatttttcgacggtgaactgtaaggtattggaccacatgagggcgaagttaccatccaccttcagcacatcattttgcaattctataacgaccgcttcttcggaagggatcggcgcttgaagtgccagcactccttttccgcgggcgcttaaattaaataacccttctccgcccagtgcagcagaggaaagattactacgtgcaacgacggatatgtctagcgtcgtgtcacaagccaaaaacaagccgtcttcgatggcaatatcatcattgtccacatcaataagccaaatatattggtaggtaggctccagcatgatggtacccgtgcctttatagtgtggtttaatggcacctgtcccggttacagcaccggacaccaagtttcgcattaagcctccaacgccttttacaccggtagtcatttccatgctacccatagtatattgcatggctcccgccttcatcataatctcgctattgttgatttcgatcatgagttgtttgcggcgcatattacttttgctcatatagtaattgtttttcgcagcctccaccgaggtagaactcaaatctgttatgtattccagtaccgtaaatccgcctaattggtctgtgatggcaacattgctgttatcctttaaattgttaatgacaaaagccataaatgtatgtgcctccttgttgtattcatgttgtgggatgggaatcttctttattccatacaatattcgacaaagagacttcttttcctgcggcgaatctagacacttcccttggctggttttcagactcagaaaaagagagcttgaaaaagatgcaaaaaaggttcaatataaagatatcggtttttaaaatgattggcttcgaaagcagccgtatgagaatagggcatgaaaatagggggtagaacaagtggagatagggataagcacgtttgtagaaacaacgccggatccccaaacgggtgaggtcatcagtcatgcacaacgaatacgtgaagttgtcgaggagattgtgcttgcagatcaggtagggctggatgtgtacggcgtgggggagcatcatcgtaaagattatgcggcatctgctccggccgttatcctcgctgctgctgctgcgcagacccaacgaattcggctaaccagtgcagttacggtgctttcatcggatgatcctgtacgtgtgtttcaggattttgctacactggacggcatttcgaatggacgagctgagattatggcaggccggggttcttttatcgaatcgttcccgttatttgggtatgatttggataactacgatgaattatttgatgaaaagctggagctgttattgaaaatacgggaatccgagaaagttacctggaaaggcggacatcggccggcaatcaacaatttgggcgtgtatccgcgtccagttcaaaatccgttgcccgtatggattgggagtgggggtaatcaggaatctgtggttcgtgcaggcttgctcggcttgccgttggttctggcgattattgggggtagtcctgttcagtttgccccgttggtggaactgtataaaaaagccgctaggcatgccggtcatgatgactcgctgcttccagttgcatcacactcacatggttttatcgcagagacgactgagctggcagcggataagttcttcccttccacccagcagagcatgaatgtgcttgggcgtgaacggggttggggtccttacactcgctccagcttcgatgccgcacgcagctttgaaggagcgttgtatgtaggagattccgacacggttgccaagaaaatcatccatctgcgtaaacaggtaggcattacacgttttctgctccacgtacccgtcgggacgatgccgcatgatgatgtcatgagagctattgagctattgggaacagaggtagcaccacgggtgcgtgaagagatatccaagtgggaatccgagagtaaataaacggaattacttcatagataaaagagaaaggagcagaccatgggagtgaggtcgctccttttaataaaaaatatgactgctttagatctcatgcaatgttgcgaattaggaattctacatcaattctttctcagtcttgtaggtactgcaacacggttggatgacagaggttttccctgtttcaattttttagccgttctaggtattcttacgactaaggatcctcctgtgctttgtttggaaggcaaggctatgcggatattcccggattgaggtgcgctttggctagcgctgctaaccaggttgatggtgtaacttgcgtagattggactgacaggaatccgccgcatacctaaattcctacaggtcgtacatcctacgttccaacaccaatggaaggcctggctagggagctgggtaaaataagaacctgaccatgtgcgtccaaagctactttcggcatagtaatagaacgtattgcctccggcatatccactccaaacttctcttgtctgcccaggatctacacgataccagccaatcttggcatagttgataggactacagttgaagttcggataagcgtaagcaatatagatagccgcattagtactgttgcgaaaattgaaacccattgtcgtcacttctttcctcatatattaatcctacagaatattctatgagagttttgaaagaagggaacggacaggagtctcttaatcactaaaattaaaccatttgctgatgtctattttgtgatgttcattcatagattgccattcattcgtatctggttgatagatataatctttttgccaggtcatgatgttttccacgattgcccgtatggaagaggcgatataggagacttcctgattcgtcatcatgggatggagcgacagacgcacccagcccggttttcgagataagtctcccgcatggatcaggtctgtcatgtgtttagatgtttgtgggtcgatgcccagcaaataatgtccgtaggggcctgcacaagagcaaccgcccctgacttgaatgccaaaccgatcattcaatagttttacaatcaggttatagtgaatatggccgacaacgaaagaaacgattcccattcgttcttggctgcttcctcctaagatgtgtagccctggtatggtactcaagctctttagtaataatgatgtcagttcctttttgcgctccaacagacgcttctgtcccatctgttcttttagccgaatgcagagcgcggttcgaacggcctgtagaaaggcaggcgtccctccatcctcacgggcttcagcattatctttatactcgtatccaccccaaggattggtccagttaactgtgcctcctccgggctgatctggagcacaatggaggaacagcctcgaatccataattaaaacgccgcttgtaccgggacccccaagaaatttgtggggtgaaaatacaatcccgtccagtttctcaaggggatctgtgcggtgcatgttgatctcggtataaggtgcgcttgccgaaaaatcaacgaaacaaacgccgccatgttcgtgcattttgcgggctagctggtaaatcggtacttcgaaccctgtaacattggagcaagcggtaaaggcgccgattttgatagggcgatgccggaattgaagcagcagtcgttcgagatgagttagatcgaccattccgccgggacctggaggaagacacacaacgtcgccaatggtttctgcccaggaaatatgattggaatgatgctccatgtgtgtaacgaaaataacggggcgttctttttcggcgatggggtagagaggctttagtttttcatgtattttcaatcctaacagtcgctgaagcttattcactgcacctgtcataccggacccggcgaacaggatgatatcatgttcattggcatgaacgtggcttttaatgatttgtttcgcttcttcataggcttgggtcatcagagttcctgtcaaattagactccgtatgcgtgttcgccacgaaagggcctaattcatttgctattttcgactcgatgggtccatacagacggccgctggctgcccaatccgcataaatcagctttttttgcccgtatggagattcaaaggtctggtgatatccgattgtactttcacgatacctttggaaataagcctcgttagaaggctgatacctacaattactgcttccaattcgagccatgagcatacggcgcctcccaagtcgttctgtcttcttagggtacgtaggtaggcccgaatgggttaaaaaaaataggcgagtgtcatcatttagtcacaataaaagcctcatccaaaagcgggataaggcagtaggtctatcttatataaacaactgcatatcggattcgagcgcatcttttagatacgttttggcctcgataatttccagttcaggtataaattcttccggtttaaaacccataatatcgaccgatagcttacaggcataaaattttacatttttcttccgcgctcctttcaagaaatgaatgagcttcggggcttcgttatcttcgatcatttccgtcagcatcagcttgccaaggccactaaaattcattttggacaatggcagttcctcgggtccttttggagtcatccagcccatgattttttcataaatcgtcttgtcttcaaacgtcatcttgtcagggtcacgaaccagaaatagtccccagaacgcaaaaaacatcgtcacgtccacatccagctcccgagctgtatttgccagaatcagtccagccattgccttatcataatcgccgctgaacataagcagattcatccttttatccataattcccgcctccattaccaacagatatattcagtatggatttgggaatgagaagtatgcccagttcacatattaatcacaattacaggacatgtgtcggattcaagagcactattcaatatatgttattattattatctacggaaattacatagcaccattgttttatggaatattagtaggataaatgtgaaaggaacggggtttgaaatttatgaaaagggatggatcatcctaacggggtgaaaacgttggtggtattcccttccgagtctacaggttggccgctcgacctgtcttcaactggagaatcggaagcctttgacgagtttggggaattgaaagcaggctataggcttcaagcgagcgtttacgactttgatcatgatggaactaacgagttagtcattgcagcgggtgacttagctacgaatgctgagatatgggttttttcatttacaaatgtagaaaacattaaaaagatagatccttttcatcaggagttagccgtaacagggcaatcctatattactttgaatggacatgaattagatgtgccttatggctctcaaggtttatttgagacgtataagtatgtagataaagaatttcttacttctgtcaagtagcccgccgttaccaatgtcatatctacaaaccgctcccatctgtataatctcaagggaattcaagacttaagcctgagattgggaggatcatgagaaagtgagtatagacaacaaatataaagcacttgaactggaaaagccgggcatctacgagctggagggactggaagtcggggttacctccaattgcaacttcaagtgtgattactgctgtgcgtatcagcggaacgacgggcaatgcatcagcagcaaagaagtcattgatattattgatgacattccaacgttaaaacgtgtgcgactgtccgggggagaagtgaccttgaaatatgaggattgtctggacatcgtggctcactgttcaagcaagggcatcgctacccagctcaacaccaatgccagcttgctcagccctgaacgaattgagaaactgcgtgatgcaggactttccaatattcatatctccttcaacttcacggatgccgataagtatgcagcttattatcatgtacatcctcgcatgtatgagaagattgtacagaatattcggttatgtaccgaagccaagctagaaacggtgctggagacgttgctgtttgcagagacgcagaacaacatgccagccattagtgaaaaggtatatgaactcggtgtgcgcatccatgaaatccaaaacagtatcgtgatggatcatacgaactggaacgctatttctaccaaggaagcgctcgttcgttccgttcatgacctgattgcacataaaaaggacgatactgtgctgtatttcacctgtatggaccgttttgcagaagcactgggcttcaaggaacagccgggtgtttatttttccaactgcgttgatggtaaaaaacagctccatcttcacgggaacggggacatcctgatctgtgagctatgccaccctgtggtcatcggcaatatttataatgaaacttccctaaaggatatttataaaaataaaccgaagcagcttgaggagtttctcgataaactgccttgtcctgcatatgatgcgctttttcctgtaggaagcaagtagacatgatttaagattgtgaggctatgagcatctaccatccaaataggttggatggtagatgtccttcatgtaactccatgaatcctttattatttcaggattttgcaaaatcctcatttgttttaatgaaagggtttacatgttaaaatataaaaatatgatcctcttatgaaagaaggagtagatatgaaatatagaaatgtaggcaacagtggtcttaaaattagtgaaatcggtctagggagctggttgacgtacggtacagccgccgagcaggaagcagctcatacctgtattgccaaagcctttgaactcgggattaatttctttgataccgcgaacgcgtataaccggggagaaggcgagaaggctatgggagctgccttgaagccttatcgaagagagagctatgtgttatctaccaaggtgtacttccctatggactccggtcccaatgacaggggactgtcacgcaagcacattatggagcaatgtgaagcgagtctgaagcgtcttggtacggattatatcgacatgtacttctgtcatcgttatgattcggatactcctttggaagagacgctgcgagcgctcgatgaccttcaggctcaggggaagattctgtacgctgctgtcagtgaatggagtgctgcccagctcacggatgcccatgggattggaaaaaggcttaatttgcggccactgattgccaatcagccaatctataatatgttcgaacgttatatcgaacatgaggtacttcctgtatccgggcagataggtatcggccaaatcgtattttcgcctctggctcaagggattctcacgggtaaatacaagccgggacagcctttaccgacgggtagccgcggggctgatgcctctgtcaataatgtcatcagcagttacatgaacgataccgttctaaactgtgtccaagagctagaaaagttggcgaagggcttgggtgtcaccctgtcacagctcgcgcttgcctggattctgagagaaccgggtatcagcgctgcactcattggggctactaaaccggcacaaatcgaagaaaatgtgaaagcagtcgaagtgacgctacaaccggagacatgcgtggaaattgagcgaattctgaagcaagcagagggttttgaacctttgcgttaagcatttttaacttgcttcaagcatggcataaatacctgaacccacactaaatacgatcccgttcactaaaacaaggatttgcttcttactgagatccagcggatcaaaaaagatgggcaacagccattttaggctgatgacagcccataaaccctccagtaatcctagcatcaacaccttttgtccccagtgaaacttcatttgcggtgttagcggaccttcaagaaacaggtcacctgaagtatggaggttccaagaaacgataactacgaatataacaagagttaatagggtcgacataatataggtgatatcttttttagcctctttcgtaagtctcggcgattttttaaactcaggcaagccaatcaggaaaaagacgattcctacgataatagccacgcctacagaggaaccaagtatgatattggctaagatgccgatgccattgatgattaataataaaataagctctccccctttggggttacgatgatagttattttattgtacacataggaacgaaaatgctcaaatatttggaaaatccccagcgctttcgcctggggctttttttgctttttaccaattacaatgctgatttaatgacctttttataatacaggatggatagtatcccaaaaatggaatataaggcggtgtacagcaccataacgatgatcataggcatccaaatttcagttccaaacaagaaccagccggattggacggcgaaatagctatgtgaaaggccaatcactaatgggatgccgaagttaaagagttgttttattttaatgcctctaagcaggtcactttgagtgaaccctaactttcttaacacggtgtaattggctttttcgtcttcgctctcatccatttgcttaaaataaaggatacagcctgatgtaatgagaaaggtgagtcctaaaaatccaactacaaacatgatcactcccatgttccgcttctgattgctgctcatttcaaggcgtgatgtttgttgatcattaaaatccgcagctgcaaagagacgattcgcttcttcaatctgttctgcatttatcatatcaattccaatatataaggatgatttcttttgaatctcaggatttatatctttctttaaccgctcaaatatggtttcgtctacaatggcagtgggtagtcccccggctgtaaaatagtagggaatcacatactccttttttagacccaaatattgttgatgtatgacttctttttttcccttcaaatccaatggaccaaagtttttcaaggacataaatttctgtaacaaatcattatagcccattaaaattgcttgacctggagatacatccgtaccctccacagattgatcgcttatgacaggcaacgtcatggaattcgcaccgatatttaacccttccagaggagtctccatgatttgcgctgtgtccacactgacttgaataacttcaattttcttctcacgatactttatgtcatgctcctgaagtaacgttttgaatttctcagcatccggttcactcgtcattgcaaaatgggaaggtacattgtcctcagctgattgatccgcagaataataggcgatatagcttaaggaaagtaaaccgatggcaagtgccgatactgttgtaataatggtcaacaacaaagcattggatttcatgcggaacataatggatgagagagatagcacctcattaatgttcaaatagccgcctttactttttctgatgatattggaaataaagcggatagatcctttataaaaaagtagtgttccgatgatgacagtgcccaaaataaacaccatagccataaacaactcgttcatggatgtaaagtctccgccaaataatttggaggaaacatagtaacctaaagcgatgagagagatgccaatgatcccgatgatcatctcatagatcgttattttcttgattttcccttcggtggttgagttcactctgaacaaagacaaaatactttgtctcttgataaaggaataattcatgagcatgatcaacaggtagatgatacaaaaaacgatgagtgtttgaatcagtgcttggttagagaaatatagagtggcaatggcttcgacgcctgtcgttttaaataagatcatgatcactaatttggaaaaggaaaatccaactccgattccaataaacagggaactgaagtatagaattaagttttcagcactcaggatgcggaaaattttgtttttggtcattccgatcaattgaaatagaccaatttctttgctgcgtctttttataaagatattattagcatataaaaggaagatgcagacaatggcgaccagtaaaacggaagctgcccttatggaagctgcccctttaacagaacccttcacttcgtccatggaaggatcgtattgtaatgtgacgaaagcgaaatagagcgcaacactaaaaatgagagcaaaaacatacaggtaataattctttagattttttttcaaattctttagaatgagcagattaatgttcatattgggccccgcctaagaccccttgggttttcatgatatcctggaagaagctttgtctttcctgctcgcctttatgaagctgcgtatacatctgcccatccttaataaaaatgacccgactgcaatggctggctgcgacaggatcatgcgtgaccataataatggtcgccttgcgtttttggttcaactggcccagcttatttaataaatcggaggccgacttggaatccagcgcacccgtaggttcatcggcaaaaataatactgggctcatgaataaatgctctggccgcagatgttcgctgcttctgtccacccgagatttcattggggtatttgtccttgagctcataaattcccagttctgtagctacttcctgaaatttttggttggcttcttttttaggcgttttggtgatggataagggtaagagaatgttctccttcacggttagcgtatccagcagattatactcttggaaaataaagcctaaatgctttttgcgaaattcagccagttgcttttctttcattttcgtcatttcgatatcattgattttaatggaaccttggctcactttatcaatagaggaaagaacattcaacagtgtggttttacctgagccggaggctcccataatactgacaaattccccttcttctataagaatatctattcccttcaaaacctcctgcatatttaacttattaccgtagcttttatgaattttatgggcttctaaaatattcacttcgatgcactccttattgttcttgtagccttattataaaaatagagccgatgtttttcctttgattgggcgaacaatacataaaagcatgtgacatctctgtcacatgctcaccatgctcacgaaatcatttcgtttgggaaaaattaaagtgaaggttgtacccacgttcggtttggagtgcacatctatatgtatgagcaaggactgggctgcctttttcgttaaatataaccccatgcccgttgaagtatgatcagaatgttgggttgtggaggtaaaacctttctcgaaaatacggggtatatccttcggatcaataccgcgcccaaagtcttggatctcaagctgtattcgatccctctgttcatagctgtgaatgataatatcactggcatcgctatatttgatggcattagttaagagctgtctgatgataaaggccagccatttggcatcactcagcacttccatgtgctccaattggatgtcaaaaccgatccctttttggatgcaccatgactgtaatgctttgatttcattaaaaaccagagattttaaattcacttgctcgacatacagatcattttctataaaggatatgcgtttgtgatggagctgctgatccagcagtaagtggattcgtagccattcataggttaactgagcttttaggggcttatcgtccaaccgctcaatcatcaaatgcatggtggtcaaaggcgtttttacctcatgaatccaggataatagttcatctttttcatgttcaagtgtcaattgattttgcgagatgatctgttgtaaccgttcggtctggtcagtgattttttgttcaatgatttgctcaaacggactctccggttcgcctatacccgttagttcaagagggcttctccattcttctagtgttgtatagaatttggtttccttgggatagcgaatgattaaaaaaaccaagaaaatcatcatggataagaagatgatataaaggatgggcattaacggaattgctgcatccacataagcaatgaacaggatcagaaattgctggcatacaaacagtagaatccagctccgcctctctataagatattttttaatcataggaaggtgcctcttctgtagccatgtagccttgtccgactttcgtttcaatgaaacggcccaaatccagctcgtctaattttttacgcaggcggttcaagttgacggtcagggtattgtcgctgacaaaacgttcatcatcccagaggcttttaattaattcctctcgtgcgacaattttatttttttgttcgattagcagcttcaaaataaaaatctcgttcttggttaattcgatggagccagcctcattggctactacatttttttcataatcgaccgtcgctccacaccatgttttcagggagacgggttctgtattgtaattatatacgcggcggagtgtcgcctgtaattttgcaatgagtacatcaaaatgaaacggtttttggataaaatcatccgctccaagctgcatcgacatcaccatatccgtaggatgatcccgtgacgataagaaaaggatggggacgttagagtgggatcgaatcattcggcaccaatgaaacccatcaaatttcggcaattgaatatctatcacgaccagatcaggctttatcgttgtgaattcctgaatgactttattaaagtcctggatgccatacacatcatagttccattgagttaaccgatccttcatttcatggaacaaagtttcatcatcttcaattagtaagattttgaacaacgatttcaccactttatactttttttggtttttgggaaattcgattccagtcgcttattggattttgcaaactcctcttttataaagagtatagcaaaaattgtgtatgtgctacatggtggactcaacttgatattgcgataatctactgttaatagttgaggtttatagtgggtttatattgactatctcatataatttaaaggatggatgcaatgatgggaattcacacgtattttcggtcgctaaatgagctggaaagaatcatccgttgtccagggaagtttaaatttgaggaacacagcgtatcggctcattcctggaaagtggtgcaatatgccaaaacgctggctgatattgaagaaagaaatggtgtcagtattgactggaaaaagctatacgagattacgagcagtcacgattacggggagatttttattggagacatcaaaacgccagttaagcattcctctaaggaactacggctattaatccagcaggtcgaagaaggtatggttgagtattttattgaagagaatattcccgaggattttaaagccatttttcgcaaacagctaagggagggtaaagatgattctgtagaaggtttaatccttgaagttgcggacaaaatggatcaggtgtacgaagcatttgctgagcttcagcggggaaatactgaaaaagaatttatagtcatgtaccgtaatgcacttgtgaaaatcaagaatattcaattacactgcgttaattattttttggaaaatatcctgcccgatatggttaaggaagaaacgccctcatccattgatatcaaaaagattacggaagaagcctttgctttgtaaatgaattcccctaccgtccagaagctactgaagcgcttctgtccatacataataattccccttgcaaaaccagacaacgcttgacttcaagttaactttaagtagtaacatacggaatgtgacgtagtgattaggaaatgcgatgactattctgacaattgaggagtgatacaaatgaaaaagaaacaactgggtaacagtgatcttcaagtatctgcactgggtctgggctgcatgggtatgtccgaatattacggtgagttgaacgatcaggagtcgatcaaaacgcttcatcgtgcgctggagctagggataaacttctgggatactgccgatgtctacggtgtggggaaaaatgaaaaactgattagccaagttttgcggaaccaccgtgacgaagtagtgttagctactaaattttctattatgcgtggggaagatggcgcatttatgggggtaagcggccgtcccgaatatgtaaaagaggcatgcgaccgcagtctgcaaagactaggagtagatgtgattgatttgtactaccagcaccgtgtcgatccgaatgtacctatcgaggaaacggtgggtgcgatgagtgacctggttcaggcgggaaaagtccgctatttggggctgtccgaagcttctcctgggctcattcgacgcgctcacaaggtacatgcgattacagccctgcaaacggaatactccttatggagccgggaagcagaagatgaagttataccgacgtgtaaggaactgggcatcgaatttgtggcctacagtccacttggacgcggctttttgagcgggcaaattcagaagtttgatgattttgcagaagatgatttccgtcgctctgtgccacgttttcaacctgagaatttccagaaaaatctggatctcgtgcagcatgttaaggaccttgctgcccaaaaaggggtcaaaccttctcaactggcgttagcatggctgcttgcgcaagagggaattgtaccgattccaggaaccaagcaggttacgtatttagaggaaaatgcaggagccgtcgatgtggttttatccgcacaggaaatggaagctattaacgcaatcatccccaaaggaatggcagcaggccttcgctatcctgcagagcggatgccgaattggcaagctgaataatgaagataatgagataaacccaaaagccttctttcacgcggatcggcgtgaaagaaggctttgcgggtttcatacggccaaagttatctttttacaaaacgggagcttgcaatgcagtattgatattttgcagatccatcgaaagctgctcttttacgttccaagggtgataccagccgcgttcaatcatgtatgtggaaatttgttcatgcgtatcaatagcttcatccagttgctttgtaagaattgccttaatttctggagttcccgcttctgttacggccatagcgtaatttctcacaccgcttttggccgcgttcagaaaatcggctgcaatgacttggtccgttaaggtatgcagtccggtcaaatgctccaacagtgtattcatggcttaacctcctgtgaaatggcttgatctaagagggtgccgagttcttgtatttggcgggttgataagtcaacatcctgctgtaatatagctttgagagtcggatcagagattaatgcttgcattgttttggacttggtaagacatactgccttgaacgctgacagttcatggacttcaagggtttcatgcaggccatacaccatatgacgtttgcctccattcaaaatatatagttaaggtttaagtaccactttgatgcaattgtcttgtctggtatcgaaaatttcatatccacgtttggcgtcgcttaacggaatgacgtgtgtaacaacgtctcctgggtccacctttcccgtatcaatcagctcatacatatatggcatatagtgaataacgggagcctgtcccgtacgtaaattaacatttcgctgaaaaatgtctcccaaaggaaaaccgttatatcgtccgccgtataccccggtaacttgaatggtcccgcctttgcggacagcttgtgtggctatgaccaaccctcctaaagctccaccgtgaagtttgagaccagaagccaaggattccagcggagacattttaccgctcatgccggagcaatcaataactacgtccgcgcctcctttggtcatctccttcaggtagttgccaacgttttcttgcgattccacattaacgatctccacgtgattggtgcgcttcgcgtgttgcagacgataatccagatagtctgccgcaatgactcgttttgcccctttgaaccaggcgaacttttgcgctaacaaacctaccggcccacagccaataacaatgacagtatccccgtccgttacccctgcattatcgacgctccagaacgcagtggtcatggcatcagagatcaagcagagcttctcgtcagaatgttcacaactctccggaattttgaagtgagtgaagttggcaaaaggcacacgtaaatattcagcttgtccacccggatatccaccggttgttcctgaatagccgaaaaagccgcccatttctccatgctcattagaatgatcacattggctttccaattggtttttacaataaaagcattcaccgcacgctatgttgaacggaatgatcacgcggtctccctttttcaagttggttacgccgctgccgacttcttctacaacccccatcggctcatgcccaattacataatcctcttgtagattcggaatcattccatgaatgagatgcagatctgaaccacaaatagcggttgttgtcagtctgataatcgcatcatcggctttttgaatactcggatccggaacatctttaaccacaacgtttttgataccttggtaggtcactgctttcatgcctggtttcctcccatatgttcgtccggcgtgcgatcaaacatacccttgcgggtggtatcgtctgggaacagtttcattttactgatgtccaccgtcttgttggctgatagttgatccaattgatactgcttttgcagatcatagggatgaaaccatttttttcgtaccataagatcagtgatttcctgatgaaacgcgatgccttgatgcaattgattgcgcaacagagttctagcatctggagagacggtttccgtcaaggctatggctgtatttcgaaccccttccttgacgcgaatcagaaagtccatcgcaaatgtcatgtctgccatttccggcatatttaatgagttttttggatccacataatccattcttgcggactgggtctgatttaatgtcacatcattcacctcaatttaatattggtgtgggacggaattctggaacaggtgcctgaaacggtgctttaacatacaatgcttgcaaatcggcaatagcttgtatagattgctgaacatctttttccattaaatcctttagctcttgatcgaataccaagccctgcattaatttggacttagctaagcataacgttttaaaattaagcgcttcgtggatctctagagactcgtgcgccgctaatgcagactgttggcttatcataggatcacctttcttttatgattctcaaaggtatgttgtccagcgtaactatgtttattcagagctatgaaaaggttgggttaccgaacgagggggactcttttggaagaacagcgagcgattccagtaaggcctgtgctcttgagtctccttaagcatacaaaggttggtgctatttcccttcaaccttgccaagcgattttttggccggaccttcaatgacttcgccttgatatgaaaagcgtgagccatgacaagggcaatcccatgttctttccgcttcattccactcgacttcgcaacccatatgggtgcatgttgtgtccactaggtgtaatgctccttgtgggtctcggtatgcgcccgctcttttgccgttcacccgaatgaccgccccttcgtcgtgctgcagttcttcggcttttttgtagttgatccccaatttcccagcaatcaaatgtttagccacattcgcattttgagtcacaaatgttttaatgtcagggtccatatgaaatcttgaaggggagaaaagatcctgatacgggctttcctctctggtaatcagattcgtatttaataaagccgccgctacacttgtggtcatcccccattttctataccccgtagcaacgaggatgttagaagtgttagatagttcctgcccaatataagggagtttgtctagcgtatacaagtcttgggccgaccagcgataaacgatctcctttaatccaaatgtttgctctgcaaacttttgtaaagcttcatagtactggaaagtacagattccttgtcccgttttgtggccttccccaccgacgataaccatcggttctccgtttattagtacagagcgaagcgaacgtttgggggtttccgcacttaggtacataccacccggataggttttgtccgtcttgaccgctagtacataagaccgctcggcatgcaatcgcgcaaaataaagactgtttggatcattgaacggaaaatgcgaggaggatacgacatagttgcaggtgattttgtgcccgtcgcttgtattaataatggagggggttcccttatccacacctacaacggtggtctgctcataaatcttcccgccttgccggatgatttgattggctagataccttaagaaaggaatcggattaaactgagcttggttttccatcataatagctgctttagttgaaaagggcagaggcgtttgttcgacataacttcccgggatgccaagttccttgtaagctttatattcgtcgttgattttttccacatgcgtatccgcacatgtataaacgtaggcatcttcttctgtaaattgacaatcgatatgatactcttctaccgtttgtctgataaattgaagagcatcacggttggcttcgtaatagagccgggttttttccttgccaaaatgtgaaagaaactcgctgtagatcaaatcatgttgtgcggtaattttggcggtcgtatgccccgttgttccatgaagtatccgccctgcgtcgacgactgcgacgtttagtccttttttagaaagtaaataagcagtggtaataccagtaatccccgcacctacaatggcaacatccacctgaatatcttcactaagcttgggaaagttggggatgtcagttgaagctaaccaatatgattcgggaaattgcggaaatgtggtacgagattcgccttgtgtcatttttacaaatacccctttgattacaatttatgtatattgttatcattgtgggcttttatattcactaaacgactctctttagtatttttttgatacggagggagtgatggaaaagaaacaaaaccgtccttaacgcggatcggcgcgaaaggcggctttgtaggtttacatatacagctaaggacgtggcttaaaaatgccgaaaggacgcccgacgggcaggaatgtacggccaaaatgagcattcagaacggcagctcctgtaccatacagtgagagcagaccaatgcccatttcagcataagcggcgatggtatggaacacctctggggcaacgccaaatgcatcgaagctaagaccgaggaacagaaaatcaatcaacacaaaaataaagaatagaaccttatgcgtctccatcgctccaatggtcatgaaaagcgtaaagatgagatagcccgcaaaggcaaagccgagctgtttgccatctacagcagatgccagctctgagccgaatacgcccattttaatcatccagctactggctacggccaaccagaagaaggcgtaagcaccaaatgccgtcatgccgaaggtgttgttatgttttgcatcctgaatggaggcaaatagctgtgcaaaagcaccgagaaatatagcccaagggatgatgaagcttaagccttcggtgaggccaagcttttgggatgaagccacaagcgttacaatagccaagccaaacaggccgatcgcactcggatcggccgttatgatttttacgttagaatgagattcattttgcataaaaaaatagaagcctccaataatgttcaagtacgcgtcaatctgccgatgccagaatcacactgacatattgtaacggaaaccgacgtactcgcatagtaggtaagttataaaatttctaccgatctgtcttgtgatggggcaaggattattaaatggtgttaccgcaggatttgtgataatatttacacctatatagaatgaggaagtgacatagtgattaatataacaattccaactccggatatcacgattaccaaacaggttaaccctgagcttagccatatttacggatttaccgactttcacctgatccctagagataaggctggtatctttatgttctacaacacacaggaggaattgctgtttgttggtaaagcaagaaagctgagacaaagaatcaaaaaacattttgaagataccgtatcgccgatcaaggacaagcggaacgaagtagcgattattgaggtttgtattgtggaagatgcagtagagcgagaaatttatgaaacctacatcatcaattcacaaaaggctaaatataacgtcgaaaaagtattttttaagtaatggagtaacttccatatgaaaaaagagcaataagtcgcagtgactgtactgtccttattgcttttttgtatttctgcatttttgatccttccagagaggggccgtggtatgaataaaacagatcgtatgctagcgatcttgctagagttgcagcgtaaggatattgtacgagccgaggatttggcagccatattcgaaacgagtgtgaggaccatctatcgggatgttcaggctctaagtgaatcgggcgtaccgattgtaggagcaccgggcattggatattccttgatggaggggtacttcctgccccccttgagctttaccgcagaagaggctgtggcgttgctaatcggaacggattttgtcgaacaaaaatttgatacagactacggtatcaaggcgcaagcttcccgcagaaagattgaagccattttaccggagagcgttcgcagggaagtctcccgggtgcgtacgaccatcagactgctcgcagtggatgaaggagcaaaccatagagagaaaacctatctggaaacgctgcgtctcgctgtattggaaaaacggaaagtacagtttggctactccaaaagaatgccagaggctgacgggaatcgtcaaagtgtgcgtgtggtcgctccttatggtcttgtcctgctccgtggttcttgggtgttaattgggcaatgtgaattgaggcagcagcttcgccatttccgtctgtcacgtatggacgagcttatcgtgctggaggacgggtttcagttgcctgttgattttcatttgcaggattacaagcaaaccgatgaccgtcatgtaactgttcgcatactagcacgttcggatatcgcagataaggtgaaggaagcgaacaacttttatatggaggccatagaggagcgtgcagatggactgcatatactcttccgcgtcagacagccggaggaattactgcaatgggtacttggatggggcgcggatatggttgtgctggagcctgagtcgctccgggagcggatacgtacagaagtggaaaaaatgttaaaatgctactgacataatgctgtcagtagcatttttgtatagtaaagctactttgatagagaggggcaattattaatatatgaatacaactgaaacattacagcgtttcgaagaaacggcacaacactatcttcttgaattggacggctttagcttggagcaactgcagtacacacctcaggagggtcaatggtcgcttggacaaatgtatctccatttggtgaactctgcactgtatatgcatcttaagaacattgatctttgtctacagcctaatggggagacaggggttaaaacggaggcgggtacggccgtttttaatctaggaggatttccgcccatacgtatccaagttccaccatctccgcagtatactcccccacaaccgacgagcaaagaagaaattgtggagggtttaaatgctgtgatccgtaaaatgagagagattgagccgatcgttgggaaatcaacagggctttctaccgtctctcatcccagattcggcgcgttgaatgctggagagtggttttcgctcatcgagatgcattatcgtcatcatcttttgcagaaggagcgcttgaagcacgcaatagccgattaatcgtctcccggcgtagcccgataaactggccgatttcctcctgcgtcagcacgtccgttaacgtggcgggtgcgatgtaggagtggaaccagcgttgaagcttccgaagcttctcggcaggtgacacctcggtgagctggtcaattcgttgctgcatcatgcgcaatttgtcctgtagctgcaaagcgatctcccgacattgagctgggtcttgctccagctttagataccattctttttgcgacaaaaccccaatttcagaggttaccaacgccaccgctgtaccataataaggattggggctgatcagggagtggtgcgggatgatttcatcgggcacaatcacattaactaaaatttgcgagccgtcttcatggactcggacaatttttaacaagccgctctttaggtgatataaagggccggattctccttgtcgaaataaggtctcgcctttgtgtaatatcatgaacgtaaacagcctccattccatgtattccagcttttagataaacccgccattgacgcggatcgtctgcccggtaacccactgtgatttggcactgactaggaactcaatcacatcagcgatatcttccggttcgccgagccgacccatagcattcatttttttcatgccttcgatttgctgctcggtttttcctgcttggaaaagctcggtgttcacaggaccgggagccacggcgttgatcgtaatttgcttgcttccgaactccttggctagctgacgtgtaaattgctccactgcgcccttggtacctgcgtatacgctatatgccgggaacatttgtccgatcacggatgtggacaggttcacgattcttccgtagttctccatatatttcatggcttgctgacaggcaaagaaagtgccctttacattcagtgcgaattgtttgtcaaaatcagcttcggttacctcagccagaggttgggtgatcatcagcccagcgttgttaaccagaatatccactttaccgaattcagcaatcgtatttgtaaataatgcttcaatatcactcattttgcccagatcagcgtgaagtgctatggctttgccgcctttttggataatgccctccacgacttcttgggctttatccggactgctggcataattgatgattacattagcgcctagatcagccagttgctcggcaatggcacgtccaatccctctggaggacccggtgataattgctgtttttccgtccaaatgctccatatgtgttcagccctgctttccatatctattttaagtgattcctttttctaaaagcgtccacacatccgaaaactcctgattaatcacagggctcttccattcgtaagcatgagcggggtgatgaaaacgggctgtggcatagaaaagggtacgcgccagttgggctggctgatctgatatgatgtccccgcgtgcaatgatatcagcgagatgatccacaatgtgggcgatatgctggtcgattaaatcagcggcttgctcggtgaccctcgtatacatctcgaacatttcctcgtcgtcgcgggcataatactgtttgagttcaaccaaggtctgtatatatcgttttaagtgtggcgttcccagtatagatgaattctgacagacctccgttaacgggccaataatcttttcgttcagccatttctcggtcacgccttcaagaagctcggccttacttttaaagtgtcggtaaatggtgccatgacttactcccaatactttggcaacatcggttacggaggttttggctacaccaaaacgcctaagtgtgtcttcagtagcaatgagaatctgttccttggttagcacatctgaggatttttccatagggacacggtcaagtgccgtgtgagtcacctccttgaagtcaggataacacaaagagtatcaaatgacaaatattcatttttgtcatttgatactctttttttaagaatccaaagaaatgaacagaaaaactacaatagcgattcgatgacaggatcaatggcgcagggctccgttgttacttcaaaccttccttttatctggccatcgcgatcgaccaagaatttagaaaaattccacttgataccgtcgccagcgtatatttctggatacttatcccgcaggaaatcctccatccattgaccgtctttggtttgggtatcgaagccttgaaacggtgcctgttgggtcagatattgaaataaaggatgaggagatgagcctcttacatccgtcttctcaaagagcgggaaggttactccatggttaatttgacagaatccctgaacctccgaattgctacctggctctttttcattgaattggttacaaggaaacgcgaggatttcaaagccttgctccctccgtctatcgtagagcctctgcagatccgcgaattgactggagaagctacacttgctggctgtgtttacaatgaggagaacctttcctctgtagtctgagaattcaatcgttttcccgttaattgaggttgcttgaaaatcataaatagacatgttaacgttcctcctcacgttattatttaatacatcatatatccagaatcattattggtctaatatattattaggatcaactttataggtatttacaataacttcgtcatgcagaacacattgtccatctctctcttgaaatcaaagaagactcgccttaaagaaagtaggagatttgcctctttcatagcaaactgtggcattcgccgttaccaagatagaatatagatgcatattcatgtaatgtgtgcaaaaacccaacagaatcgagggatattcgtgcccattggaaagatgattcaatacaaggaaatgcaacaacatcccattttacgttctcacttgcccgaaacccgctggatcagtaatgcaaggactttacggatgctggatacctatcgcacagtctttatcaagcctaattatgggagtggaggaactggcatcatacgtgcgaaaaagctggggaggaagtatgaggttcgttgtggctccagtcgcagagtcgttagatcccacgccgtaagaagagcagttagaacctatcggagacctcatcgtcgttatttggtacagcaaggacttaagttagccaagtacaaaggttccatttttgatgccagagtgtatatgcagaaaccggaatcggaatgggtcatttcaggaataaccggtcgtgtcgctgcacctcgaaaagtcgttaccaattatcggaagggaggacatgcggcgccgttgtccaaagtgcttttaagggtctttaaaaatgacagaataaaaatgaaagagattctggaccagatcatcgagctttctagaatcattgccgacacgatagataaaaatcatccggttcgcgagttgggcatcgatcttgctattgaaaagagcggtcaaatctggattatcgaggccaatccgcatcccggacatatgttgttcaggcagctccccaatcacaagatgattcgcaacattttgagaaacaaacgtcgtattcatcactaggataaagtttttgaaatcattcattgataagaaaaggaggagaacgcccaagcaaagatgcgggagcgttctccgttttttttgttaaatgactgacggatttaagacgaagcttttatgttaaaatatgtccgccatccacatgaaggacggttccggtcacaaactgattttgaatcaaataaagtacacctcgtgcaacatcctccgcaagtccaactcgcttcacaggaagcttatgcgcgaccgtatcatagaattgattacgcgtattttcaggcattttgctgcgggaaggtgtatcaataatgccgggtgagacgacattcacgcggatgggagcaagctctaacgccaaggtttgaccaagattcgaaaccgctgcattcacagcgccgagcgcagaggagccaatcattggcttgtatgccaccactcctgaaaataaagtaatggaacccttggttgagagttgggaagccccgtatttagctgcataatattggccccaaaatttgttttcgaatagcttgcgggcttgatccgtctccaactgaaggaatgacccgctttagggaagtagtgatatttaattcatatagtttcctaaagggaactattgtgataccgtcgggtttaacagatgatttttggaggagttcccatgcacgcccaagaacctattgaattgaccaaaggaataccaggcaagccgtgtcctattgcccaaacacttgatttgatcggaacgaaatggacttttctaatcatccgtgatctgcttatcgaaggaacactgagattcagccaacttcagaaatccatgaaggggattagtcccaaaacgctttccctacgcctgaaggaacttgaagataacggcctgttagaaagaaaggtatatgccgaggttccaccgcgagttgaatattcgttaacggaaaaagggaagcgactggaaagtgtttttattgagctgaagagatttggcttagatttagaagcagatcattgagggatatgactacaacattccgaggtatcgttgagctgaacgatgcctatttcttatatatataaagggaagcgcttactataaagttcacagaaagttcacttatgtggaggtttcgactatttatataattaccaaggtacacagaagggatgatagaattgccaacaacgaagaaagaagatttttattttggtttaatgatgtgcttggggatggtcgtattcatgacattttataatctatatacaaatgacttgattggcataatatctctaaaagtaatgtttcttcaatttattttatgttttatcattgctttcgtattggaattatttattgtcggtccactagcaaagaagatagccttctcattaccatacgacaaatctaaaaaggtatttgtgattctgtccctttcatgctgtatggtcattggaatggttctttgtatgtcactttatggattggggacagcttacttttttaatggtctttcgggagattcattatttaaaaattacttatctttagtttttaagaattttatttttgctttccctctgcagctcttaattgtagggccgcttgttcggtatttatttgctaaattcgtgaaaggtacacgaattgcggtatctttaagctaaaacgtaatcaacgacggtatacgatagctcacaagccgccttctgtctgagaaggcggcttgtttttacccagaagtcccagtacctttacagtgtttgtccgctatccaccgtaataatctggcctgtcatggcttcctgttccaaagcagagcagatcatgctggcaatatcctccggcgtagaaatgcgctgtaggagcaaatgaggaaacagttgcttcatttgttcttccctgcctgcccaccatcttgtcgccacggctcccggcacgatgcaattgacgcgaatatccggtgccagtgctcgtgctaaagatttggtcagcccgtggacggccgctttggataccgcatagggaagagaggaacctagccctgtttgccctgctatacttcccagattgacgatagccccttgtttactacgcttcataaaaggagctacggctctggcacagtaaaacatgccttttacatttacatcaaatagatcatcccatacctcttccgtggctgactccagatcatccataggaatgtgatgtgtaatgctagcgttattcacaagtatatcaatcgtaccgaattgctggacaatctgatcaaccatagttcgaacttcctgatctcgggaaacatctgcctgtaatgcgatagcacgtccgcccttttcaaggatcatacgtaccgtttcctcagcatcgtttttagagcgggaatagtttacgactaccgtagcttttcgatctgccaaggccatacatgcggctctcccaattcctgtacctccacctgtaaccagtgctactttttgatgtaaatccatatatattcgctccttctccaaccagttcattttgcgtctgaaaataatatgatctgatatgtatcattgtagaggatgtattgtgttctgtataattgaattaactgaatttatgattcaataaaattgaattaattgggcatataggagactgagaatggacattaaaacgctcaaaacatttcaaatgattgtgaattacgggagttttatgcgtgcagcggaagagttgaattatgcacaatctaccgtgacgatgcaaatacagaagctggagtccgatatgggaattcaactgatcgaacggggcaagaaaataaagttaactgaagcgggcaggatgttttacgagcaaagtctacatattgtaaaggatatggagcaattgcaggaaaatatggacaatctgcaaagaggaaccacaggcgacattcgtataggagtgaccgaaccgactgccagttatcgactaccagaaattttaaaacgcttcttaacccattatccgaatattcgggtttctgttgagtttgggaatacccctaccttaagcgagcgtattctcaagggagatattgacttagcgctgtgttccacaccggatgtgggcacagagctatattttgaacctttatttaaggagaattttgtagttttgatgcctgaaaatcacccgcttgcggaaaaagaaaacattgggccagaggatttacaggggcatcggttgcttattacatcggccacctgtccatatcgtcgcaaacttgaaatggtcatgaaggaatatggaataaccacgctagacacgatggaaattggcagcatgacggctctgaaattttatgtggaaagcgatttgggtattgcccttgtgccacagattctggtcagtcctatcccggcaggagtagcggtgagggaattaagcggcagcctgatcgatatgaccttcggccttctttgcaaagcaacagactatccgctaaggctggcaagctcaaggctatattctgtgttgaaggaggagcttggggaatggtcctcggtgcattgagctagagtagcgagtatgcagggaattgtgttttctgtcaccttatgatgtaaatgtagtacggtataaaaccgactgcaatcggcagtcggttcggtttgtttactttttcttaatcggaatccaaacttcacttcggtagtcttcagcatgtgaatctcccatagtatacacttccagtttccgggccgcctgaatgctcataattactggcagggaaccattcctgaaaaattctttgccataccttttggatcgagtgaggcatagggccgatggatgtaaacactgcccaggttgaagccggaatggttctggattccagcccattcgcggtcgctacgtcttcgctgccttctgcggcgattaagtaactaaacgtctcctccccatgtttcatgtccaagcatataccgagtatatcgtcgcctgtccccaaggcatgaattcgatccgatgtaccatccgcattcagttcgttccagaattttgggatttctcgaagattatcgccgttcttagtagtgacttgaatggacttgccaatgaccgtaaaggccgttttctctacaattttgtaatccatttcctgatctcccttcaacgatagatggaaggtgatgcgtggaaaggctttcaggttcaccccagggcttctggcctcagtgggagaaataccgtgtaccttacggaacgctttagaaaaagattcgggggaatcatatccgtatttgaacgctacatccagcaccttggcgggagaaagactcaattcctgagcagccaaggtcaatcgacgtttgcgtacatattctgctaccgtgacgccggttagcatatgaaacatacgctgaaaatggaaaggagacgaataggctgcccttgcaatttcatcgatatcgagtggctgctgcattctctcttccatcagatcgagtgcgttcttgatccgaagcaaccattccaaccgtatcaccttccttagttgtaatcatatcattaggagtatctgtaatcctgtctttgcgtgctcttgttgaacaggttctgtcgcatagtttaatgtggcttgtacttggtttcaagacataatttcacgctaaaattttggagaaacaatgtgcctgcccccttgtgttcataattaaaatttgggacaatgaaagaggcgcttaaatagcgcagatagcttaaacatgctatgatgcaatgatggttgagacgaatggtgcgtgcttagttttatatagaggaagacgaatttgaatgttttgaaaagaggatcgaacatgaaaaaagaatccatttatggattaacgctagatcaattgacagcatggctcatcgagcatggacataagaaatcccgggcattgcaggtatggaacgcattgtaccggaagcgggttactgattttgcagcgatggcagaggttcatgaggattgtactcgcctgttggcagagcacttttccattgaaacacttgaagaacacgtgaagcaacagtcagcagacgggacggtcaagttcttgttccggcttcaggatggtaatttgattgagacggtattgatgaggcataagtttggcttatccgtatgtgtgactacgcaggtaggatgtaacattgggtgcagcttctgtgcgagcggattgttgaagaagagccgtgatctgtccagcggtgaaattgtagagcaaattatgaaggtccagctgtatctggatcaggaacgtccgggcgaccaagtcagtcatgttgttgtgatgggaattggcgaaccgtttgataacttcgtgaacctgtccgatttcattcgggtcattaaggatcacaaagggctggcgattgggccgcggcatattaccgtttccacaagtggacttgctgataaaatcattgaatttgcagattccgacctgcatgtcaatctggcgatctccctccacgctccgaataatgagattcgtactcgcattatgaagatcaaccgtgcgattccgattgagaaactcatgcaggcgattgattattatttggacaaaacaaatcgtcggattacgctggagtacatcctgctgaaggatgttaatgacggtaaggagcatgcgctcgaactggctgagctggtgggccatcgtcgtaatctggccaatgtaaacctgattccgtacaatccggtggatgagcatagccaataccagcggagtgagtcggagtcgattacgggcttctatgatgtgctgaaaaaacaaggcattagctgtagtgttcggctggagcatggagtcgatattgacgcagcctgcggacagctacgcagcaagcaaatccgtaaggatgccaagggtagccgcaatgcggagcgcgaagccattagttaaatacacaagcgtactctctaacaggagtacgcttttttatatcacgagtcgtagggcgaaacgttgccctaaaatgtgaaaatagtcacgtaatagttgctgcttttacgttatagtgagtggttagtggaggggttatatggctaacgtaatttcgaatgtggcgctcgttccgggcatctatgtgatgaaaatagagggaaagtttaaagggaacatggggcagttttacatgctgcgcagcgggacaggttatccactgctgcccagacccatcagcatttatgatatcggggaagagagtatttcctttttgtaccgggttgttggagaggggacaaatttgttttcccaattacagcctggtcaggagattcagttagaaggacctttcggaaacggttttccgcaggtagagggtagtttggctttaatcggcggtggcatgggtacagctccgttgctgttggctgcaaagtactacccgcatgcgcatgtttacctggggtttgcacagcaagccttcggggttgaagcgttcgaagctgtggcggcatctgtacaggtcaaggtagggggaagcatcgtcgaacaggtcgatccgacgctttatgcaaatatgttctcctgcgggccaactccgatgttgcaagcactcgccatgaaaacggtggatacgtcgtcccgtttatatatttcaactgaaagacacatggcctgtggtattggcgcatgtttgggctgtacgatgcgtacccgtggaggcaatcggagggtatgtaaagaagggcctgtattcccggtggaggaggtggagttcgatgatctccatggcgtgtaatattgcgggtgtaccgttcaagaacccaatcatcatggcttccggtacgtttggattcggacgtgagtatgcggaattttattctcctgaattattgggcggtatcgtcggcaagggactaaccctgcatccgaaggctggtaatacgggatcacgaatacatgagacagcatccggcatgctcaatagtgtagggctggagaatccgggggttgccgcctttttgaaggatgaactggatgacatgactcactggaacacggctattattgccaacgtaggcggctccaatctggaggaatatgttcaggccgtagcgatgattacggaaaacgcgcaaaaacgacgcacgatgaatcgaagaggcgtcgatatgctggaattgaacatttcgtgtcccaatgtgaagcagggtggaatgcaatttggtatccagacggaggtagcgcgggaggttgtgcgtcaggtgcgcaatgtgactgcgcttccattggtcgtcaagctgtctccaaacgcagagaacatcacgcagatggcggttatgtgcgaggaagaaggcgcagacggagtttcgctgatcaatacattttctgcaatgaaaatagatatacgccggcgtcgcagtgtcttcgccaacacgtatgctggtctttccggcccggcaattaagccaattgccttgcgcatggttcaccaggtggcacaggcggtgtcgattccggtgatcgggatgggcgggattagctcggtagaggatattattgaattcaccatggcaggggccgctgccattcaggtgggaacgtacaactttgtccatttacatgcaggggctgaactggtacatggacttgaacaatggatgcagcgggaaaaggtgcagtcattggatgagatacggggaattttgtgaatttgaaaccttttagcatacactaattcatatagaaccggcttgtctttaaaagacaagtcggttttatttattttactgaaatagccaagcttcaactagtggttaatatcgcacttgttcaagatgaacgaaatttttgattttccagccgatgaatggcttgcgaaataagaaggaaattgtcaaacggtgtcgaataacaagggattatagggaaagagataggctctttttcctaatggagagcttgacaaagaagctgggtgatgggattgcggttaataggtaagtcgaagccgagacgacaattcaaggtttcgctacaattcatgattattattttggttgttttagctattattatttccttaattatatccttgcttctcattcgtaatttcgtaattaaccaacattttgataatacgaaggaaaaactttcgggtattgccaaggtggtcgctagtgacaacgatgttattcgtaatgttgagcagggagtccctgtgaagcagatccaagactactcgcttggagtcatgcacaacgttaatgtggattttgtagtcattctgaaccacgatttaattcggctatctcatccgaatgcaacgatggttggcaaaccgttctctgatttgaatgatgccagaagagcgttatccggtcagggacatttttctgagaatataggtattttgggcaaaggttaccgatattttacgccgatatttaatcaacaacatgaggtcattggcattgtatgtgtagggctgaccatgaggaccctaaatcatgatttgatgcaggcgcagtataccatttttggggggctgatgctgggactctttagtggagttttgggcgcgatcattctggctcagaaaatcaaaacgattttatttgggcttgagccgcaagagatagcaacacgattgcgcgaaaaagaaattattgaaaatgaggtcgctgaaggaattatagccatttcggcggacaagaaaattatgctcatgaacaaagaagctcaggccaagtaccaactggcgaaccaagagatgaaagccccgattggcgagcagctagataccaacttttataacgtactcttcaagagagtgtttgatgataagaagaagatcaaggatcgctcattttatgtgaatggtatagaagtcattgcgacagtaacccctatatatattgaaaatgagttttttggggcggttgcaacgttacgcgaccaatccgagatgattcatcttagcaaccagttaagtggtacaaaatattatattaactcccttcgtggacagactcatgaatttatgaacaaaatgcacgtaatatccgggctaattgaaatgaggaaatatgcggaggtcagtcaatatattcagcaactaaatcaccgatatcaagatgaggtaggctttctgactgagagaattaaagttccggcattagcaggttttattatgggtaaaatcaacgaagcacgcgaacagaacatttcggttcttcttgcagaaagctcgaatgtctctaatgtagagatgcaggatatcgttcatgatgtcatacacatcctgggtaatttttttgacaacgccatagattctatcttacaaaaaaaagaacccggcaaaattgagctgaaattgaactatgagtgtgagggaaatgtattcattttgaaagtgaaagataatgggttggggattgattttgagatgcaaaaaagaatattcgagcatggcttttcaaccaaaggagaagacagaggctacggcttgaatctggttaaaaccatggtggaaaatcatcaaggaatcattgagcttgatagccaaccgggtctgggaacaagtatatatgtagagttgccctgtacattggaggtgacaaatgaatgaaagttctaattgttgaggatgatccgatggttgctgagctcaatcaacagtttatcgagcgcatggacaatttggacgttgtatgtaaggcagataccgtcaaaaaagcacaggactgtcttcaaaaatggaaaccggatctggtattactggacgtttatttacctggaaaaagcggattaactttattatcacatatgcaggagcatcaatatcatgcttcggttattttaattacggctgcaaaagatattcagacggtgaaggaagctgttttttatggtgttgcagactatttaattaaaccctttacattcgaacgctttagactggctgttgagaaaatccagcgcctagccacggtgatggaggaagggaacggaattaatcaagctgtcattgaccattattttaataaagaagagcatgcgggtgtggaaaagaaaaaaactgttgaacatccatcgcataatctaccgaaaaacctgtctaaaaatttgtccaaactgaccatgaccacgatactgaagagtattcaagagctggacggaccattctcggttgaaacgttagctagagaagtggacttgtcccgtattacggtaaaaaaatatattcagttcctggtggacgatggcttcctggttgaatcgatagaataccacaaggttggcaggccgctaatgctctatcagttgaatcctgatataaaagaaccgccatttccattgtaatctggaaatagcggttctttttttgttcacaagagtaccgagcttcctaattatttcatagagagaacaggaagtgggactaggttatctgaagaatgagttgtaacgatatcatggaagttgtcgtagctagtttcaatcatgttggataacgccgtaacggtattcgagccagcatgaggcgttaccaaaactcttggatacagctccacaagcttctggatcgttgggtccgggagcatttgccatggttcaaatgctttaaagaataattcatcttctttagggaagacatccgtagcgaagccttccagatggttactgagcaaagcgtctaaaatggcttggttatcttgtaattctccacgtgatgtattgataagaatagatccctttttcatttttgctaaaaagctggcgttaatcattttgtcgttctgtcccggcagataaggaacatgaacactaacgacatcacactctgccagtaattcatccaaggttgtgaatggaatgacttccttggccgcgtccgattggtacacatcatagccgataacagaagcacctaatcctttaaataatttggcttctgtcagaccgatgcggccgaccccaataatcccaactttacaattgtgaatctctttgctgaatgtatgctcgtccacaatgaaatttttgaacgagcttttggtagtcatataagcggtgtgtcggaacagcatcattgctaaggttaaggagagctcggcgatggcattcggagagtaagatggcacgcgtgccaccttcattccgaattcgctgcaggcatccaaatcaatgtggttgattccgactgttctggtaaaaacatatcgaatgccgtattcattgaattttgtgatattttcccgattggcagcacagtttcctcttagcaaaacggcatcgtgatgctgtgccaattctgcattgctggtggttaacaactcttctaccagcgttagttggaagttatatttattgagatcctggaaatagggtttctcataagaacggacaccatagcaaatgatttttaacatgttgttttccccctgatttagaaaattccaattttatcaatgacattgagcgtaacgatccacactggaatcatgacgacagaagtaatagttgagagaagcgatgcattggaggtcaatatggcttccttatcaaaactgatggcataggctgcggctacggtagctgtaggagttgccatcatgatgacaatagtagctaaagcgactgaatcgactgacagaatatgagatacagtcaacaaagccagcaagacgatgttaacaataggcacaagccaaaccttaactatgctgtaataccaagaggtcttatcagtagctgccgacttgaagctgatctcccctaatgtcgagccaatcgataaccaggctaacggagaagctagtccagcaaggtaggtcatgggcttgaacagccagacagcggtttgatcaattctcagaaaggcgaactgctgaatggccccatcctctgtagctacactcatctgtggcaaataaccttgaaacaaccaaacaaacaagcctagaaacgtggcgataacgattggattcaaaaacatggttttgagatttttaagctccattttcaagccgctcattttgatatagccataggagtataagaaaatgcggtaccctatgttaaaaatggaactgtacatcactccggtaggaccgtaaatggctccgacaattggaattccgaagaaagtcgtagaaccgaagatggttaacacccgtaaaacatcctgtttatccttgttgtagctcagaaagaacggtttagaaataaagatgagaataatataaattagaactccccatattaaaacattcattccttgttttaacattgtaggattaatgtcctgcatgaaagaattaaaggctagtgctggtagagccacggttagaacaaccttggataacaactttcctactgctgcgttaaaaatccccttcttccggcaaaagaaaccaagaaggataataaaaacggtggaagcgatagaactgacaattttgttatctgttaaggtcgctgtaatcatttctagtaaagacatagataaaaccctctcttgtaccttttttcacataaatgacgatgcagaatgtgacgatgcaattccctgatcttttggccaaagtgttggtttgcacttttatagtaaaatgactttgtgaaaaaaagaacaatatctaattaatttaacttatgaaactaatttaaaaaatttatacgttacatcagatggcaaatgaaacgaaaggggaagtcttcacggaatgattatttcttggctttgtgagtgctcatcaacattcgtgctataatataaatcattaaaacccacttgattagtgggtttagtagaaaagacgagcaggaggggccgcatgaatccgatacaacatatactggacgaatttcagctgatcgtgctggacggcgcaatggcgaccgagctggagcgtcatggacatgatctgaacgatagcttatggtcagctaaaatcctccatgaacacccggagtcgatcaagcgcgtacatagagattattttgaggctggtgcggactgtgcaattactgcgagctatcaggccaccgttgagggctatgttaaacgaggcctaagcgaaaatgaggcgctggagctgattcaatcatcggtacggattgctgtgcaggcacgcgatgagttttgggctgacgtgatggctactgcaagtcagcgacatcgtcccaagccgctagtcgcggcctctgtaggcccttacggggcgtttttggcagatggatcagagtatcgcggcgattacaagctgagcgaggaacagctagtagagttccacaggccgcgtatgaaagctctgattgaggcgggtgcagatattttagcttgtgaaacaataccctgtctggttgaagccaaggccatcgcccgattgctgaaggaattccctggcacgtatgcctggatcagctttagcgcaaaggatgggcagcatatcagcaatggtgagtctgccgctgcatgtgctgagtggctgaatgggcgtgagcaagtggctgctgtgggaatcaattgcactttgccgaaattcgttccatcgcttattcacgaaatacgcagccgcacggataagcctgtggtggtatatcccaatctgggggaggaatatgacccggtcaccaagacatggcacggcagcacatgtacagagacattcggacaaagtgcccgccaatggtatgaagcgggagctcgtcttattggcggttgttgccggactcagccgcaggatattgaggaaatagcatcatggtcgagagatgaataaacggagataaacgatggtccgaaaaaaacaagcaggctgaaccaagttgtgctccagtaatggaggggcttggttcagcctgctttgtttactgccttcgccgatccggtcagctttctgccaaacgttccagcagcgcgtctccattgcggctcacccgaatatgggcaaaatgtgcgttctgttctacagtacgtccggttccctcaggaatgaaataattctcaataccgtacagaatacgggaaccataccattgtccatttagaatgacttcatggctggcaagtttttcaccatcttgatataggcgatccgcgacgtatactccttggctatctggtgtgagaacgactttgaccttgcctcggctccattcctcctcctgaagagggggcttggaaggcggggtagatatgtcgtaattcagtgccacataatcgccttgcagcagggagcgcgggtctacaggagctagtttgagcttaatggaagcccctgtggcgagcagggtttcacttctcgccgtctgatagccgatgatccccagctgtagcacgatgacaatggcaatgagtaacgggcttaagcgcataaagctaaagctgcggtggtcagcatcgaatgctgctttgccgctatgggccattcgccgatccgcccaccaggtaattccgagcgcaatgatccccagtagcgccagcgtaaaagatttatacagtagcgtccacaataaatcatagtatttgaagccgataaaaataaaccagaagacaacgctcgtgatggcctccgatttttgtttcagacgggcaaaggcaaagaccatcccggtaacgataacaaaataaaaaatgttaatgaacatataagagtgtggaacgacatcctcgaaaaacgtcgcccaaaacaggaacagcaagctgaaaaataatgagctattccgtagatgttcttttaactccgtcttggatataaagtaacttaccccatataacacggcattgacgatgaaaagagagaagatgatgaacttataggtccagttccaaccatcccactcctgatactgctgaaataaaatggtcgccagattcaggtttacaaaggtgtaggcaaaaaacaactgccttttccccttggagcgaaaccatccagcgatggaaacgatcagaaataataccgaaagcagcgactgatctgaccatagaatggccgccaagcctgtaatatagctgatggtcagcagtgtataacgtattaccgaatccagcttggattccggtatgacaatcatcgaaatcataagcagcaacgacacaaccaacagtacgtattcggtgtggtttacattcgtgctaatcataatcaatccgatgagagatatactaccgatcagcactccaaccactttgatcacacgggatacggttttactgatccattcactgccacgttcctcgggaacggtcgcctcggtctttgatgtactagtgtccgttgtccctgcttccggcagtgttttccccaaacgattcaaatagcggaaaaaccacacgttacccgtcagcagcaacgccacaaaaatcaaaccaaaaacaaaaaacagagatgaggagtacgcctcggccagctctataaatttaaagacagcaaatgccgaaagtgccaatgcattcaaggtcagtagcgttttattcagccgcaccttgataaatatataaaatcctaaagcaatcacagcaatatgcggtacattcatgatcaggccatactcatcaaatgcaaaagaactggtcatcgctaacatggctatatggaaaaccgtaaagctcatatattgtagtggagcagaatgtatacgatggaggaacgtcaataaaaatagcagcagattgactattgcgaacattccggcaatggataacgattccagctcgctataaggcacactttgcatcgtagggtaaaaataaagccacaaaccaagatgaattagtacataagacagcatataaaaaggattgtagcgagtaatccagctaagcagtagagacggcaccgaccaaatgaaaaacaatccgtagctgtccgcatgggaattgtaaatttgaccgagcaatgccacggaaacgccaaaggctatacagccagccaccaaaaacatattagacagaaaagcttgttgaccgggaacagcacgtatccgtgcaaatacaaaagacaagccatagaacagaacaataagcgcagcagcaagtacaatcttgaatgtccgatccagtccgccccaattggaggcgaaaaaataaataattgcggccagtatcagtgagatgcccagcagatagcccgtacgtatcgcattgaatcgcagcatggatttcacgtacctttcctgttggtttgatgcctattatagcgttgaaagggctcagaaccaagtgggaattaggatcaggtcataaaaagagagacaccgtatacggcggctctctttaacgttactggattccgactaagcgttgacggtacgaatctcttgccgggactgatgtcggaagcgatactcacgcggtggaatccctgctgttttcttaaatgctttggaaaaggtggacatatcggtatagccgatggactgggctatgatcgacaaattgtaagtcgtctgctccagtaatcttttggcttcgttaatcttgaggttttgcaaatacttggcgggagagatgaggaaggtggaatggaatttacgtgaaaaatgcgcacgatccacacctacatgctcggcaatttgttcaatcgtaacacggtcacaataatgcatttcaatgtagtctttcccctgctggagccaataatcagagcatacaaagttgcgcagcacgtcagatgtgttgcgggataactcctcgaagatctggtgcagtgtaatcaagcgggccagatcgctgccctgtctgctgttgtcgtgtacgatggaaaacaggttggagataagtctgaggatttcctcgctcgttgcgttagccatcaatggcgtagagggattaattccgatccgctccagcaatgcgagggacttgggtccctcaaaggcaatccataccttttgcaacgggtgctcctgatcggtgtaatattcatgggcaagatgcggaaaaaaacagaataaatcagacttttggacgcggtacttttgttgcttataaataaacttagcctgaccttcaagtacaaaaatcaaataaaaataaggaacagccttgggaccgacatggtagcttgttttcgaaatatccatacctagtctgacaggccaaacggcactggatttttccaattcggtggctgtgaaataatggtcttccacgatgtcgaagtgatcttcattttttgctcttttcataacttgtcacctctcctttggtggagataagggaattttgattttattgtatataaaggaaaacataattacaagttaattcattggaattaagggttatataattgaaactaggtatgccaaaggctccatggccggtttgagacgatccatggagccttttaagttctgtattatgagataaagattagattagcctatatttatacgttcaggattccttcttttggagtaacgttgaaggctttggccagatcggctaattcctgatctgtaatccgttgctgaatatcatggtgagcaatgagcatataaatttgcgccgctttttcaatcgtttcaatcaggccaaatgcttcatcaatggagctgcccgttccgaaaatgccatgatgaggccataatacagcgcgatgatccttcattttttttgccgtttcgcggccgatttcgctggaacccggtaccatccaagggattacaccgataccgtctggaaagacgacaatacattcggtacacatttcccacagcgttttggtgaattggttttcgtccagactatgaatgaaggtcatggcaataacatgggtggcatgattatgaatcacaacacgatggttaggatcgaccttcaagcgctcaatgtggctcataaaatgggaaggcaactcactggtaggcactgcgccatgtttgaggccccataagacttccaactgctcgccatcctgggagacacgaagaactcctaagttagcttctggatctgcaattacgtttttaaaatatttccctgatccggtgacgataaaatatttaccagctagttcattcactgggaaagcaggtttaatcgtccgaatgacctgatgaatatctatatattttgcaacctcagcttcatccagaatatagcttacattacctccattgcgttcatcccagccgaatttccacatgttttgtgtaatttccgccatctcgcgaacaaatgggatatccagtcccgattttcgttctttttgattctccagtacagtagtcatggataatctctcccttttggatgatatgaatataagcattatcagtacagtagttaacgtttcagcagtacctgttgttcataattcttaacttcggccagccattcctcacgaacaggaacgccgttttgagcgcaatagtaatcccatacggcaccaaacggatacgatttaaactcttcgaccagagcaagacgagtggtaaagtcccgttcctcttccgcctgctttaatgcttgaattggttcaagcatagcgcgaagcagcgctttgatcgtgttgcgtgttccgatgacccatgctgctacatgattgatacttccatcaaagaaatcaagaccgatatgggttcgggaaagcaatttaccgcgaaccagctcacgggcaatgtctagcaattcgtcgtccatcgtcacgacatgatcactgtcccagcgaaccggtctgctgacatggagcaataattgatcggtgaacatcagcacagaggacagtttgttcgaaatgacttcggttggatggaagtgaccagcgtcgagacagatagatttaccgcgtgtcagggcgtaacccatatagaattcatgggagcccacgacatagctttccgagccaatgccaaacagcttgctttcaaccgcatcgatgttgtattcttcactgattttctcgctgaaaatttcgtccaaagcatcacgcagacgttctcttggagccaaccgatcaaccggagtatctttatagccatccggcatccagtggtttgtgacacagggctgaccgagttcttttccaaaatgctctgcaatcctgcgtgattttttgcagtgtgtgatccagaaatcacggatttccgaatccttatggctcagtgtgaagccgtcttccgctttgggatgggagaacaaagttggattaaaatcaagcccaagcccttgctgcttagcccagtctacccagttctgaaaatggcgtggctccagttgatccagatccacttgttcagtggtgtccgcatagattgcgtgcaaattgaccttgtgtttacccggaatgagtgatagagctttttctaaatcctgacgcaactcatgcggcgtgcctgctctgcccgggtagctgcccgttacggcaatccccccgctaagctgtttgtctttgaacagaaatccctgaacatcatctccctgccagcagtgcagtgatattttgatttgtgaaagcttccgtaaaatgtcgtcaacttgaataccgtggcgggcatacagctttttcgcttcgttataactggcttcaatagcttcgttcatggctttactcctttattgagatatgtgaatagaggatgttgcttgtatcttaaggtgctcccagcgacccaaaagatcttgcacgtcttccaccgattgtggctcatagagccgagtcggaaaggagcgggcgatggttcggccagcagctttgagatcctcaagaacaccagagctaattaattgcacgacaatattgccgatggccgtagattcggaaggacctgcctgaacctcaattcccaagagatcggcggttagctgacatagtaattcgttgttagcgcctccgccaacaatgtgcaatctggtaatcgtttcgtctgttaaacattgcagttcgtgtaaggcatcgcggtagcttaaggccagactgtcaaaaatacagcgggcgagtaaacccggcgtcctggggatgggctggcctgtttcttcacagaatcgctggatttcaacggtcatactatccgggtttaaaaaggatgactggttacagaggacgagactgacaaacggtgcctctgctgaagccagttcggccaattcggcaaagctatgtgcggaatcgccctctctcctaacctcctgaatcatccataatcccataatatttttcagaaaacggtacgtaccgtaagcgccccactcattcgtgtagttcgcctgcatggctgccttggtattcaaggcttcggatcgttccattcccagtagtgaccacgttccgctgctaatataagcccaaggttcttcccgctgtgacggtacacctgcaacagccgatgcagtatcgtgagtaggcgcaagaatgatctgacagtccggaagatcgtatttttgaacaagctccggcaaaagagaacccagaacccgtccaggctcggcaagctctgaaaactgattgcgttgcaggtggagcagggagagcaggtcttcatcaaactctcgggtgttcacgttgagaagctgcatcgtggacgcattcgtcatttcattgatcatgatgcctgtcaggcgatagtacagataatcggggaccatcaatattttatccgcctgggcaagctgttcccgatcatggacgaacagttgatacagggtattaaagtttaattcctgaatgcctgttttctcatacacagcctctcgactgatgtgctggtgcagcctgttgggtgcatggagggtacgtgcatcccggtaagcgtatacctcatgaatgcggttacctttctgatcaagcagcacgtaatctacagcccatgtatcaatgccgagcgtacaggaatgaatccctttttgtttagctttttgcaagccctgaataatctcattcaatagttcgtcgatattccagtaatcgtgtccgtttttttcggtaaaggagttgttgaaacggtgaagctcttgcaagtgtagctggtcaccttgcagagttgcacttacgagccttccgcttgaagctccaatatcaacagcaagataattattcatacccaaatctccttgcatggataaaatacgggcagcctgaaaatctgccttttgttttcttaactaactccatactacttccgtttttctttgtagtcaacggaaacggaagtgaaatttgtggttttatttttgtttttttaaaattataattaaaattaagtgttgttttgtatgtatttttgtttttttatctgttttctacaatcaggataatgcaaagtcctcacaatatatataccttgaacaaagttcgatttgattttacgatattccaattgtggaaggttctccaaatgccgctgtctgtatgaaaaatagtcttgaaaccgcccgccagagggtgtagtatacaagatatcaatttcatatgactcgtataatattggggatatggcccaaaagtttctaccggatgaccactgtaatcgtccgactatgagtgatagcgcatcggctttggatgaatgcgggcatttatttgtgcgccaatccgtcagggatgacaaccccaaggacaggcttcacttgagaaacaactcaagggagcctgtccttttttggttttggcaggttttatactattttaaagtacagaaggagcgatactcgcataatgaaagctttggaggaacgtattcgtcaagaaggacaaattttatctgacaccgtattaaaggtagattcatttttgaatcatcaggtagatacagcattagcattggagattggtaaggagtttgcacgccttttcggcagtgctccgatcaccaaggtgcttacaattgaagctagtggtattcaatttgctatggctactgctattgccttgggggtcccgttcatttatgcgaagaaaaagaaggcaatcacgctgaatgagcaggtatacttcgcagaggttcattcgttcactcggcaggaaacctatcaggtgagcatttcccaaaaatatctcgatgctagcgaccatgtgctgatcgtggatgattttctggctactggcgcagccttggttggacttacggatattgtgaaggaagcaggagcggagctggccggggttggctgtgtaattgagaagagcttccaggaaggccgtggactgttggagcaaagaggcattgctgtgcgctctcttgcgcgtatcgcttccatggcaccaggcgaggttcattttatagaggaagctggagcggtgattcctcccgttaaggagaatgtgggatgctaagtaaacaaaagttattcgcgctgggcttccagcatgtcatggcgatgtacgctggagcaattgctgtacctctaattgtaggaggagcattgcacctgacaccagcccagatggcttatttggtggctgccgatctgttcacttgcgggattgctacgttattacagattatggggacacgctttttcggtagtagactgcctgtcattttaggctgtacatttacggcagtagggcccattatcgcgattgcttcgacctcaaatttagcgacagcgtacggtgctattattttgtccggtatattcgtggtgttagcagcacctttgtatggcaagctgctacgctttttcccgacggtcgttacgggttcggtcgttacgattatcggtctatctcttattccggtggcgatgaacaatgtagcagggggccagggcagcgcggattttggacagccacgtaatttgctgttggcgttagttacactactggttatcctgcttgtgaatcggttggcaaaaggctttttgcgctcgatttccgtgcttattggtctgttcgcgggtacggtggttgcttatggaatgggaatggtgcattttgctcccgtggcggaagcctcatgggtgagtgtcgcgcagccgttttattttggtaagccagagtttagcatgatggcagtatgtacgatgattatcgtcaatattgtcagtatggttgagtctacaggcgtttatctggcagtaggcaaagcgattgatcagaaggtggaacagaagcagatcgtcaatggtctgcgttccgaaggactcgcgattatgcttgggggtatttttaatgcgtttccttatacagctttttcgcaaaatgttggtctgatctcactcacacgcgtcaaatcgcggaacgttatttttgctgcgggcggtatcatggttgttctcggtttgctgcctaagttggctgccttaacgacagtgattcctaacgctgtgctaggcggggcgatgatcgtcatgtttggctcggttgctgcatcaggcatgtctattttgtcagaagtggatctgcggaaggaaagcaatctgctgatcgcagcatgcagtattgccgtgggcctaggctctgccgttctgccacaaatgttcgaccagctgccgagctttgccaaaatgctgttgcaaaatggtatcgtttcgggctcgattacagcgattgtcttgaacattgttttgacgagaaaacaaggggaatcggtcaaaagcgtgacggtttcggaggttccacagaaggtttgatgattaggaataaataaagatagccggagagaggacgtatgcctcttttccggctttctggcatggagttatccagatagtagatacccttgccgtctggggacatatagatgaagctgcgggatgaaatgggtagctctaatttggtgtgttttccagtttatacgctagaagaatttgctagagtggtaggaaggggcatggtataatctaaattatggattttgaatagtggtggatgttttcggaccacggtgcagcttcccgaaagggggtgaagccgatggtcaaccttgtgtcgtgctacgatgtgttgcgttggatggttacgttactaagcctggtgtttagtattcgtaaactttatcgctggctgcgtcggaaatttcggaacaagcgaaaacccaccgcgtaattaggttggcccctaacggtgggtttcgtttgcattaaccattagttatgcagcgcgccgtgggtgatccacagcctttcaagtcctaagagtctttgccgttggcgcggcgaaggctctttttagtatacggacacggtggtttactctatacctaattttaacacttcaattgcgtgcacgcaattgaaggttatgtcttgtttctaccttatcgttcaaatttgaattattgtgcagcatttattgacaagcttgtgacaacaaaataagataatcctaaatcgtaatgaaaagaaataatagaagaaaacaggtgtgagccggacgactctatgtacggggttttgttgagaccatgtggatagttgttgagcgtgctcacttaaaagggaagttcggttgattccgacacgggcccgccactgtatacaggcatcagcaggatactgctggagctttcagaacagccactggaactgtgaagaaccgggaaggcctgaaagatacgcttggagtcaggagacctgcctgttttgacatcactgtcagacccacgggatgctggggaggtggttaggcgtgctgcatacggaatgtctgaaaccgatctgatcccttctatgtttttggagttggtttcgaggtgtgttttgacattttataatgaaagcatttctgactgctggtcaagtggtccggaatgcttttttcgcgttttgcgttaggtttatatgattttacaagatagagggggattcatcgaatgattagcaatcgtagcaggcgctcatggttgatatgtacaggggtgatgctgctgctggcagttatggctctttcgggatgtactagcaataagacgtcgagtagctccggcaaagatgagaacgcgtcagcacaacaaacagcgacaggtaaaaagctggtaatggcgtatacatggaaaccgtcaggtgttgacccgcacggagataatagctgggatgtgatgcgatccggtgcaggtgagacactggtacgtttgaatgaaaagctggagcctgtggcttggctggcaaaggagtggaagcaggatagtcctacagtttggacgttcagcttgcaggataaagtcacttttcataatggaaagagtatggatgcagcaagtgtaaaagcatctttgctacgctctatcgagaaaagccatctggcgaaggatttactgaatgtgaagtccattgatgtaagcggcccgctggccttaaagatcacgacaaaccagccgaatgcggcgctggtgtccaatctagctgatccatcgacgactgtactggatgtggcatcgatgaaagatgagcagagttacccagcgatgacaggcgcctttaaaatcaaagcgttcagcaaggaccaatccttggtcgtagagcgttatgacggatactggggcgagaaggcccgattggctgaggcgacaatgaagttcattacggacgggaattcgcgcctgatggcgctgcaatccggcgaggtggatgtagcgacggatattccggttgataacgcagaggtactgaaaaagaacgacaggctacaagttctgtcggctccctccttgcgcacccatatgatcgtgtacaatatggaatcgccagtattcaaggatgcggcgaaccgtaaggtggtggacagcctgattccacgcacatcgattgtgagcgccgtcatgaggggcttcggtacggaggcaagcagtccgttcccgagcattcttcccttcggtaaagttgagcgtaaagcgctggacggaacggtgaatcagctgttaacgaaggatggctggcagaaggatgcccaagggacatggactaagcaaggcaagccgttcgaggttacgctgctgacttttcctcagcgtccggagctctctgttatggctgaggtcatccaaagccaattgctaaaagagggaatccaggtcaagattcgcaaggtggaaaatatcgacgaggcgttgaccaaaaacgattgggattttgctatgtacagtatgcttactgctcatacaggagagccacaatattttatggacatgttttattcttcgcaaagcgaagccaatgtaagccgttatagttccaaaccgctggagagtattcttaacagcttgaagctggcgaaggatacagcgcagcgtaatgctgtgacactacaagcgctggatatcatcaatacggatttgccacagtcgttcattgtgcatcctgacaatgtgtttggtgtgaaaaaaggggtggagggttttacaccccatccgatcgagtattactacattacagcgcaatccgatattgcggaataacgagcggcgtatcctatgattcgttttatactggaacgtgtggcgcagctgctcatcattgtattcgttgtatccacgctgacttttgtactgatgaggctggctcctggtgaccctgctaccattttgctcaccgcgcataatgtccctgcctctgaggaagcgttgacgacgctacggcaggaactgggcttaaacgaaccgtttcatattcaatatgtgaactggctgcgggatgtgttcacagggcattggggcacctcgtatgtatccaaggaatccgtgctagccgaactgtggaacagactgcctgctactgtggagctagctgctgcgggctttgccgtcatgacggtgcttacgctggggttgggactggctgcctcgctaaaaatcagtggtccactggatcgcctgggcaggctgtttgccctgctgggatcgtcgatcccctctttttggcttgggtttctgttgatctatctattctccgttcgcttgggctggctcccatccatgggaagggaggattggacacatttagtgctcccagcgctgactcttggtgcaggtttgggagctgtgcaagcccgtgtactgcgcgctcaaatgctggagctgggtgaccggaattttgtgaaagcagcgaaggcccgaggcttttcccgtatgcatatcctgttttttgagatatttaagcatgcggttctgcctataattacactgctaggtaccaatctatcatttatgctggcaggtaatgtcatcgtagagaccattttttcatggccggggttgggcaagtattttatagatgcaattacacagcgagattatccggtgattcaggggtatgttattttcgccgtatttttaattgtaggagttcagtgtttggtggatgtggtccagacggcgatagatctgaggctgcgtttgcgttaagggggaagctgaaaatgaaaaagatacggctttcctttcaagggagcttgctggcaggaggcgtactgtttggtctgatcgtgctgcttgggttattggctccatgggtcgctcctcatgatcctcttcaagtggatcttttgaaccgtttggcaccacccagtcggaaatatcctttcggtacggatcatctgggtcgggatgtgctgtcaaggctaatttacgggattcggatgagcgtgctaatcgcatgtgcaattactgtagctacgttgtgtttcagtctgcctatagggttgctcattggttatgtgcgtggacgtgtggatcagctgatcatgcggggaatcgacggtgtactggcttttcctgatattattttaacggtggcaattgtgggcattttgggcccaggttttgttaacatgacccttgcgattattgcggtacggtgggcgggttatgtccggtatatccgtagtctggttcaaaaagcctgtcaggaggactacgttcgatatgcccgtttatccggcaattcacacgtacgtatactgagccgttatgtattgccacaagcgttgccgcagttgttggtttatgcggtatgggatatcgggcgcgtggtgctgatgatcgctgggctgtcctttcttggactgggtgtacagccgcccaagccagagtggggcgtgatgctgcatgatgcaacctcatattttcaggtggttccgcatgtcatgattttcccgggcttggcgattatgctattcgtacttgcctgccagcttttgggcgaccgcttttcggaaaagggggcggccaaatagtggaggatcaaacagcccttgggtgcaaggatacgatagagcaagtggcagggcgaaaaccgttgttacacgtggaacatttggaaatctgccgcacaggcgtaggagcaagcggaagtgggagcaaaccactgctgcgtgatgtgagcttttccatatattcaggggagattgtggccctgaccggaccgagcggatgcggcaagagcctgaccgcacacgcaatcgcaggcatgctggagccaggtattaatgttacgcaagggcgtatctactataacggggaagacattctcccgttccaggaacggcgctggcaaaggctgcgccgagaagatattgccctgctcattcaacagtcgctgagcgggttgaacccgatccggactgtccgcgcccagctgatggacacgcttagactgcacgggcggcgtcggatgccgcatgaccaaatggagccggagcacgctgatgctgtcccatcccatactgcaccgcagcaagtccacccgctgggcgtgctgccatggatgtggcagatgctgagccgtgccacggagatagccagaggaggcgctactccagtgcgggaggcctatttgcgctctctgctccgcaaggttggatttgcaaatcctgagcatattttgtcgtcatatccttttgaactaagcgggggcatgtgtcaaagggtgctgctggctgcaatgttaagctccggtccgagcctctttattgccgacgagcctactacggcgttggatgttatcaaccgggacaaggtcttggcattgctgcaacagttgagagaagagtttgatctcaccatattgctgatttcacatgatcgccaggggatgagccgcatagcagatcgagtgttggagatgagcccggaaggaaggatgcaccagtgatgctggaattgaagaatgtgaccaaagcataccctgtccgtaaacggagaaaaggctggttcagcacgcaagatagcgaacaggctgtgaagaaggtgaatctggagctacgacagggggaatgtcttggactggttggagaaagtggaagtggcaaaagcacgctggcacaatgtattctagggctggagtcgttgacctcaggagagatttggctggatgaccagcccattcacaccggaaggatgaaggatatctacctgtacaagcgaatccagttggttgcacaggattcgtcttcctcgctccatcctcgcatgaccatacgagatattttagaggagccaatccacaattattttcccggacgaaaagctcaagcactggatatttgccagtctttactggaatctgtggggctggacacggaatgtctggaaaaatacccaacacaactaagtggcgggcaaaaacagcgggtatgtattgcccgagcgttggcggtggagcccgatattatcttgttcgatgaatcgatcgccaatctggatacgacaacgcagttttccgtgctgggtatgcttaagagaatgcagcaggagcgtgagttgtcctacttattcatcactcacgatctccaatctactcgtcagttttgtgaccgcgttgctgttatggttcagggggagatcgtggaaatatttaaggaatgggatgaagacttgttacagcatgagtacacgcgtgctctgtttcaaacgttggcgaattaagccataaatttaatattctacaaatttaaaataaataagaggatggcttgtcgaatgttgttgacaaaatagaacgtggtacctattctaaatatgattatgataatcattatcacatatatagaaaaggggaaatacattgatgtccgttcgacaccgcaagactgccacccttatgttggtagcgctcctcttattatccgttgttttgggctgcgcgaagcaggagaacgcacctgcatccacctctactgacggagctaccaatgaaaagtcgatcacgctatcgtggccgcgtgacattggtacgatgaatcctcacgtatacaatccttcccaactttttgcacaatccatggtctatgagccgttagtcagctacaagcaaggaggcaagctggagcctgctttggctgaatcctggactatttccaaggacggcaagatatatacgtttaagctgcgcaaaggtgtgaaattttcggatggaacgctatttaatgcagccattgtcaaaaagaactttgacgctattataaaaaatgagaagacgcacagctggcttggtatagtaggcgttctcgacaaaactgaagctgtagatgacagcaccttccgaatgacactcaaagaaccatactacccagtgcttcaggatttgtctgtcgttcgcccgttccgttttctgggtgaagcggggttcccggatgatggagatacgtccaaaggaatcaagaaacctgtaggtacaggaccttggatgctagatgaatacaagcaagatgaatatgcaacctttaagcgtaatccaaattattggggcactgcaccaaaggtggataaaattatggtaaaaatcattcccgatggcgaaacccgtgtaatggcctttgaaaaaggcgatctggatctgatttatggagagggtgtcattagtctggatgctttcaaacagcttcgcgacacgaatcagtatgttaccacgctgtccgagcctgtcggtacaagaagcctgttgctcaactcatccaatcccaagctggcagaccttcgggtacgtctggcactccagcatggctttaacaagcaggcaatggtggaaggtgtaacctcggggctggaggaaacagcggatacggttttatccaaaaactatccgtatacgaatgtaaacttacagcctgttggttatgatgtggaaaaatccaaatcgttgctggatgaggctggctggaagctgcccgcaggcggtacagtacgggaaaaagacggacaacagctagattttgagctgattttcgataaaaccgatccgatccaaaaggcgatggctgaaaccattcaggctgaatggggagaactgggtgtcaaagtgaacctgatcggactggagctgacggttcaaattaagcgccttagatccaaccagtttgatctgtacttctggtacaactatggtgcgccttatgatccgcattcctttattaatgttattgctaagaagagctttggaatttccgaggtgctgagcgcccttccgatgaagaaagacctggatcagcaagtacacgaagcgctctcatcgacagatgaaaccaagcgccaagagctgtatgcttcgattctgaagacgctccaggagcaatctgccattgtgcctatttcgtatattaagaaaacggcagtgtaccagaaaaagattacaaactttgtattcccggctaatcgggatgaaaatccgtttgagggaattgaaatcggaaagtagctgaagccgataggtaacggtagtttacaggataggaggacaactcatgatcagctatatcgggaagcgaatggtagcggtcattcctattgttctctttgccaccctcgttacctttgcactcattcatatttcaccagttgatccggccgaggcctatttgacggctgctcatatttaccctactccagagattctggagcagaaaagacatgagttcgggctggatcagcctttgctgacgcagtatatgcatacacttcaaagaatcagtcaattggactttggtacttcgtatctaaccaacaagccggtgtgggatgaggtcaaggttcggctccccgccacttttgaattggctgtgagcagtatgttgctatctattgtggtaagtattccgctgggcgtgctggcggcgatgcgtaaaaatggctggatcgacatgcttagtcgaggaatttcatattttggcgcgtctataccccagttctggctgggatatttgttaatcttctttttctctgtccgattggattggctccctgtagaggggcgaggaacgtggcagcatctggtgttgcccacgttaaccctgtcgctggttctgattgctttatatacgcgcctgctgcgttccagtgtgttggagcagcttcaggaaacgtatgtgcagtatgccagaactcgaggaattcgtgagcgggtgatcatgctcaagcatgtactgaaaattgccattgctccactgattacaagtatgggtatgaatctgggcaagcttctgaccggaacaattattgtggagcaggtgttttcatggcccgggtttggccgttattttgtggaagcgatttttaaccgggatattcccgtcatacaatgctatgtatttttggcggcatgcctgttcatcgtatgcaatttgctcgttgatctggtgcatttgtatatggacccccgaatttcatcgaagggacgagcagagcagtgatgataaggttgcgtacaatgttcaaaagtcaaaaggtaatcgtggtctgctctgtcgtactggctgctctttttatcattatggcgctagctccttggctggctccccatgatccggttaaagttaatttactgcacaagctggagggaccttcgaaagaatacttgctggggaccgatcatttgggtcggtgcaatttatcccggttgctgtatggagcgcggatttcccttggttttgcgacattaattttcctgtcctcgcttagcatcggcgttgtgattgggtcgcttgcaggttatgtgggtggctgggtcgatagtgtgttgatgcgattttgcgaaggtattatggcgtttccgaatttggtgcttgtgctgggcattgtcggtatttttgggccgggcctcatgcaggtgctgcttgctttaatgatggtgcagtgggtgtattatgccagaatgtgccgcaatatggtcgtcagtctgaaagaacggaattttatagctgccgcaaggattagcgggtcctcctcaggggccattatccgccggcatatcattccaaatgtattaaggccgattgtggtcattggtacgctggaaatgggctgggcgatcatggatatttctgcgttgtctttcctcggtttgggcatccaaccgccgactcccgaatggggagcgatgattcatgagggaacgggatacatccgcagtcacccggaattaatgatctatccgggggttatgattctggtggtggtaatggccttcaatatattgggggaggcgctgtccgaccgatacggaattgccaaacgtcagtaaaacaggagtgagttacaacgatggacgacagggcgaaggtgctggaggtcagcggcttacaggtgaagctcaaaaccgatgccggggcggtatctctgctgaagccaattcattttgagctgaaaaggggacaagttttgggtcttgtcggcgagagtggaagcggcaaaacggtgacttgtaaagcgttgctccaattgctggatcgccagacgatggacgtggaaggtagtgtccgtctgaacgggcgtgaactgaacggaatggcggccgaggaaatgcggcgtattcggggcaaggaaatcgcatttattatgcaaaatccgatgagcgcctttacgccagtgtatacgatcggagctcagtttatggaaacggtccgtacgcacaccggattaaccaaacgacaggcccgtgatcttgccataacggctctggaaaatatgaatttgcccgatccagctaagctgatgaagcgttattcgtttcagttgagcggcgggatgctgcaacgggtcatgattgccatttccatgtgcctgcggccagcagtggttattgcggatgaaccaacgacggcgcttgatgtggtcaatcagctacaggtgctaagagagctggatcgcttgcgtacggaatacaatacgtccattttgctgatctcgcatgatctgggcgtcatttcccaattggcggatgaagtggctgtcatgcagcagggtcgtattgttgagcaggctgaggtccatcagttgttcgatcacccgcaagatgaatataccaaaatgctgctacaagtcagacccaagttgtccattcggggcatgaatcaggaaggtggttagtcgcctgttcgacagttacactttcaaaaggggagcgaatgcgtatgctacaagtgaagaaagtaactcatagctatggaaggcgcaaatggctgggccgttctgaactacgcccccctgtgttggctaacgtttcacttactatagagagtgggttttgcctaggcttacttggaaccagtggagccggtaaaagcacgctgggcaaggtaattctggggctggagaagccgcaggagggtcaggtgctgttccagggacaggacatttataatgcgagccctcaagtccgcaggggaatgcgacgggatatgcaggtcgtatttcaggactgctactctgctgtaaacccccgattgaccgccgggcagattattggggagccattggacaattacgaacggttatcggtgcaggaacaaaaaagaacggtcgaaagcctactggaacgggtcggcctcaagccggaggatcggattaaatatccgcatcagttcagtggcggacaattacagcggatcaatattgcacgggcgattgcgctcaaaccaaagctgatcgtgctggatgagtccgtcagcagcctcgatatggttcaccagatgcacattttatccctgctgggagaactgaaatcttcgtttggattgtcatatctgttcatcacgcatgatattcgggcagcttatgctgtctgcgatggcattgctgtgatggagcaggggagactgatcgagcgctgtgatgagaaggatcagatttttgaatctgctcatccggctgtacgacggttgatctcgtccattttgccggaacatccagcagagcgttttccgcttcatggatgacattggacccgcaggggtcctttttttgtgcaacatatagctaaataatcaatatgaaatttacttgttgtattatttgaataacccgttataatataaaatcatagtaaattacttggatattaaaaaggggatgtcataatatgaagaaatctgctttggtagcagcgattggcctatctcttgtgttattaacgggtgccttaagtggatgttcctcgaaggaggcggcatcgggggataaggtcatctatgtcggcacacaaaatgactacccaccgtttgcttttacgaatgataaaaacgagctgactggatacgatgtggaagtagtcaaggagatcgacaagaagctggacggctataagattgaatttgtgccttcgggctgggatgcgatattccttgcactagattcaaataaagttcagatgatcgccgatgaagttgccaaaaatcccgaacgtgagaagaagtatttattctcggatgagtcctatttctcggctcagtcggttattattgtgaaaaagggtagaacggatattcattccctcaaggatttggaaggcaagaaggtagcagcctcggtaggcgactcctacacacagttgctggaacagtataatgcggagaacggaaataaaattattttgaaatacaatgatacaggtacttcgtccgataaccttcaagacgtgcaaaatggccgagtggacgcttatgtgaatgatccggttatggcggcggcaacaatcaagaaggaaggcttgcaggtggaagctgtgggtgagccggtgcaaagcgataacatcaacctggtgttcaaaaaggataagcagggcgaagagctgaaagctaaaatcgatccgattattaaagagctgaaagcggacggaacactgaaaaaattgtctgaacagtggacaggtggagaatttattcctcagtaataacaatgtaaagggtaaagtggggttcctatggaaaagctgtttgatcttgattatatgctgaaaagccttccccagatcgtcgagtatcttcccgtgaccttatggattgcgtttgtgtccatgctgctgggtgggatcatcgggttagctacggccttaatccggatatacaaggtgcctgtcttggcgccattgtctacgttgtatgtctcgtacattcggggaacaccgctcattgtgcagctgtttctcgtatattacggaatacccaagtttctgtattatttccagagcgaatatggattcttacagcaattcaatgtctatgtcatcccgcccgagctgtttgcgttgctctcattttcattgaacctcgggggatatttgtcggagacgttccgggcggcgattcattcagtcgaccggggacaatttgaggctgctaattccatcggtatgagccaaacacaaattatgctcaaaattgtattgccgcaggcgttgacggtcgctttgcccaatttgggaaacacgctgatcagtacggtgaaggatacgtcttttatttttatgatcggtgtcgtcgatatgatgggacaggctaaaattatgggcgcgcgagcgttggctttttttgaggtatatgttgcggtgtctctgatttactggttggtgtgcattattattgagcgcgggcttgtcgtgctggagaagcgtattcgaatttacgaaagaagtgagtaagggtatgattcaacttcatcaaattcataagcattttggacagcatcacgtgttgaagggcatagacctgacggtaggcaagggagaagtcgtagtgatcctgggtccaagcggatcggggaagtccacgctgctgcgcagcattaattttttggaacagccgaccagtggtgttatagaaattgacggtgtaaaggtcgatgccgccaaggcgggaaaaaaggacattctcggactacggatggcaacggcaatggtatttcagcaatatcagttgtttaaaaatttgaatgcactccacaatgtgatgattggtctgaccagtgtgaaaaagctggatcgtaagcaggcgagggagatcagtgaaggcattctggaaaaggtcgggttaaaggatcgtatgacctattatcctgcccagctttcgggtggacagcagcagcgagttgcgattgcccgtgctttagcactaaatccacaggtgttgttgttcgatgaaccgacatcctcacttgatcctgaattggtggatgaagtgctgtccgtgattcaaaaggtggcgagtgaaggcaatacgatgattattgtcacacatgagcttggttttgcgagagatgtagcggatcgggttgtactaatggagcatggcgtgatcgtggagcaggggcccgtggagcagtttttcaccaatccgaaggaagaacggacacggcagtttctgggcaaagcgttggtacagagagcgccgcaggagcagcctgtatccccataagaagtacgtggatgggttataggtatgtgcagcgctgtagagtattgcacctatagtaaaaagcacgttagacaagtcgcaggaggaaggaaagcccgcgcttgtttgtcgtgctttttttggcccctcatatcaccaattcttttccattacaaagtagcttatcacacttattcatgataaattctaagaacaatacagtgaagatgtaatcgggaaggaacattggcatatgaaaaaggttttgttcattaataccggagggaccatttcttcctcctatcaggaaaacggcctgacaccgacccaatcggctgaaaatattttggcggaaattccggagctgaaggagatttgcgagattgatgcccataatctgatgagcattgatagcacaaatacacaacctgaggattgggcttctatcgcccggatggtacatcgttcgctcgatcaatacgacggtattgtcattgcacacggcacggatacgatggcttatacagcttcagccttgagcttcatgttgggaactgtagacaaacccgtcgtcgtgacaggttcgcaggtttctattttggcggagcacagtgattccaaaaaaaatgtaatcgactcattcctgaccgcatgtggcgaggtggccggggtttttgtcgtgtttaatggcaaaattatcaacggtagccgtagctcgaagatcagaacacgcagctataacgcctttgagagtattaactatccgtacattggcctcgtggagaacggtaaggtggtctatacggagggcgtatttgcaaatcgcggcaccgttcgtcacctatacaacgacgggtatgcttcggaggtatttctgctcaggctgattccgggtacgaatccggcgattttcgatgccattcagggcttgggctataaaggtatcgtcattgagggctttggtatgggaggagtcccttttaaagaaagaagcttgatcagcaaaatcgaggaactgatgaaggacggtatgagtattgtcgtgactactcaatgtccttatgagggcggggatttgacgatttacgaagtggggcaaaaggtactggagaagggcgttattccggggtatgacatgacaacggaagcgctggtgacgaaaatgatgtgggcattggggcagacgaccgacccggccggggtagccaagattatggcaacgaactacgcggacgaagtttctttgcctgtggatacagcttccttataggaagctgacttccgtagataagaacaggcataagaaaaaatacggggttaacgttgggcttgccccagtctgcttttaatctcaacagccactttcagcgcttgtacagccgattccagtggaatcaggctttccgaatgtccgccaaagcattcaagtgcatgatcccaacttttttcatatggattggcagattcgaggttgattttttgctgtcctgatgcggtatactcatataatgcggtaggtataagatcgttttcgtcgctttcatgaaataccagcttggccttttcaaaataagcctcttaagccactgtgaagggatagcttcccggcatgtgggatgaggctagtccaagatccccccacagaggaggcgtttctcttttcaaagataaggagatgagcctcccgtatttctgttggcggtatgcctcatacagataggtataggcgggatcaaacttaatgaactggttgaccagaatctttttgccatattgcttctcagcttgttgcataagaagagcgtcttcgagatcaaagcaaaccggtgtttcacaaaatacatgcttaccgtgcttcagcgcatccacggcatatgacctatgcagctgggagggcaggcatagatcgacgatatccacgtctgggtccagcagaatatcctctatattttgtgtgacttctacgtttagctcctctttcagcttttgcagcttggtttcgttccttccaaataccatgattctgtttaccttgggatggttgtttaacagtgaggcatgatacgcgccgaatcccgtccccaatattccaatattcatcatccattacacccctttacttctatgatacacacctattactgccaacagggtgtcaagggagaatgaaggccaaggaattggcgttggcactggaaacctctgtacgctccatttacagggatatcgacctcctggctgaagccggcgttccgattgttaccgcatccggcccgaagggcggaatttatttaatggaggattatacggcgaacctgaaacagttgaatggcggggatgtcattcagttgtatttaacagggatgggcatttatacaggcgggcccacagaaattggtttgaagttaaaaaatgctctactcaaactggaacagacgataccagacccgtatcagtccgatattaagaaagccaaagcgcggttttattttgatgatacgccgtggtggacggaacgtatagccattccttgtcttgaggccgtgagagctgcagtgtgggggtcccataaaataaccattcaatatgagaaagctgacggaatctgttcttcccgtcatgtgcatccctatggacttgtggtgaaaaaaggagattggtatctcattgccttctgtgaagttgggcaggagattcggacctttaaatgtgagcgaatcaaggaggttcagccgtctgcggaagtctttgaggttccggtagatttttcgctggaacatcattggatgaggcaagaaaccgcgtttaagcagctttgtatagagaaagaatactatcccgttctgatccgaacgaataagaagcaagcgggaattatagcgaaaagaatggacatcatccagtctgtacaggaaggcagtcattgtactctaacggtcaacatgtatagctatgaagcggcctgtcgcgatgctatggattggatcggtagggttgaagttgtggagcctgtaccactccgacagtttgtgaaggaagaaattaaccgactccagaggctatatggataaatcataaaaaaacacctgcctagggcagatgcttttgcttgttaagtccaggcccagagaaatccgtcacgatcccaggcgattctgccaccatgaagcttgcggaatgcttttttgatttctttttccagagatacatgaccatgctcgcttataaacacatactgctctccatactcagagcgtacatatgcaattgcatcttcttgtttcagggtgcccacttcacggatctgcgcgaccatccattgtgcaatttcttgttctgttgtaggggtgttgtccatttgtcgtatcctttcctgcgtaccgattgggtgtagctgttcggctcacctccccgtagtatacggcaattcggagaattattgaattttttgatataaatttacttgagcggttggctaagtgggctttcttttgtataattaagggaatattcacgggaattttctttttttgtattgtaatcatgcaagtaatccctgggggtgcctgatttgaaggaaacaaccacaattcgcgcagagctggagcagtacatcagacgagaaggaattacgattagtaagtttggggagaacacaggtattaatgcaggaacgatcagtgccattattaacggtaatcgtccgattgcgatgctgctgttggatcggattggtgcaggcatggggcttgaagaagggagcctctatgagttatacattgatgaatttatacggaatacggcaccgaattggcgacgggttcgtccctttttgcatcgctgtgcagagctgaacaaactggattgtattaagcaagtcgtggagtttatgatggactatctcatatacgccccagctttgtttgagacagcagaagaattattcagtgaaggtaagttcgaggctgcggcaattatttataaaaatgtttcggaaagtgagaagtaccaacattcagagcgtctggcgctctgccaataccgtttatttacgattgccgttggcgatgaccaagacgaaaatttatgggcagccacacactttgaaagctttgtggagcgattgggtgaagcagatcaactggatgccttaagagacctggctaatgcctatgcttccttgcgacgttgggataaagtagaatggtttgctgaaaaaatggctcaaaaagccaaggtacaatacgaacaaaaatacgggaataccagaagatcagagcgtggcaaggaacctaagggtcctttgtttatgtatattgtatactcttacgtgttgcgtgccggggtgtgggatgagcgcggggattatcagaaggcgctggagtatgtatcgctatactctgatttgagctgggtgcaagaggatacggaagaagctcggcgtttgaaggccctttgtagcaactgggctgaggccaacgggtatttgtatcagttgatgtcaggcagcctggatgtgattccacaatatgtggattatttgaaaaaaaacgaaggcgaaattctggtggggttgcataaaattatggtagcggccaaccgttatgattttaatgtagatcatgtactgttgcactttgaaaaacaaattgaggcatttgcagatcagcatgtcaaggtaggcacctatacggagcaaatgtcagcagatctttatgcacgatttttggcagagatggcttgttatgatctcaacaaacaccgttataccaaaggcatgaaattcttgcttgagagtctttcttattccgtcatgctgaatggtaatcctgtcacaatcaaatgtgtaggactatttgaaaagtatcggcatactgccacttctgaggacaaagaggaatataaaaacttacttggagaggtagagtacatccatgataaaaaagatcgttttttctctgctcgcatttaatgtttttgtcctattgaatttttcacccgttcccccccctatggaagatcctagcgacgtccacagtcatgggttggggggatgggctttttcatcccttgaaccatccgcttagaggatctagaaagcggcattcaaaaaggtattctcttatgaagaagaggataccttttttgatgtggaagtgcatttgaaggagcacttttgccgtcaagagtggggagctggaagttgagcaggaggaaaccagacatgacgcagatccacccagccctgactgttaaaagatacgccacgcacagaagggagataggccgtctgaacgggcttttcatataaaatatgcagctggtgctcatccatgagccgagtttcgatatgttcgaattgctgcgccctaacagtatgatcggcctcccgtacaatttcacgcagcagtctttcgatatccacacggctatgaggctccacatgcccagatacattgagatacaagtcaaacaggcgtaattgctcatcacggtcacgaaagagagaaaagatgattaagtctgactccatacggatagatgagcttttgaattcgttcatagatgcggccacgatgttacaggtatacccacaggattcgagctgagccgcaacccggtctgcgtctgctttatactcgggaatggtagcaatttgcagcgccgccagtggttcataagaatcgttagatgaatccactgctggaggaagggagcgatgatccagacatgctacaatgcgggcacgtatttctggattgcgtagcggtccatccttgtgtgtattacatgtgataaatttgcgtaccgaagccgccgagtgaatctggctccatgcggtatccgtatctcccgccgataggggattatggataatgtgaaaagaagaagcggtgtcttccgtatccgacgattctagcttagtcgcccatgggagttggacaatttccactcggtccagatgagcccggccttgaaaataaggtgcgaaagcctccagtgtacacaggctttcgttcatttctgtgactttgaatgcccctgtaccgacagggcggatgccaaaggcggcttcacccacctgattaagctcacgcggcacaatcgcagcccggctggtacacaggaaggatagaaacagctcgttcggctcctttagtacgaagcgtactatcgttggacttagcgcctggacgtgctgaatttgccggacgataaaatggtaaagtctccttcccggcgcccgactcagtcgctcaaaggtatagacgacgtcttcagcggtcagtatttttccgttatgaaacaacacttctttacgcaggaaaaaggtccactgtgtacgagtagtatccacctcccaagcgtgcgccaatcccggcaaaatctcgccgctttcgttcgcccggcgggccagaccatcaaagacgtggctggatacgaaggactcggcgagccagttcaagtacaacgggtccagcgtatagagctgctggcgaataggcagacgcagcgtgtcgatctgctgctgatcactgcgcacctctgcgtgatgcccaaaataattcagcaaccagccttgcaaatgctcctgcatggtggaggagcgtgaatggactcgaatttcatccagcgcgcgtttgatatcatggcggtctatggcttgcatcatggattgcacggcaatgtcttccggttgaatgaggaagcgcagactggagcgacgacctctgcctcggcggggagtccattgtatccagtcatgctgctccattttctgaatgatcatcaaggcgttgcggtgagtacagtcaaaaatagccgcaagctcatccagcgtcgtctctagggtatggttatcgtccttgttgtcagctgcgtgggagtgaagccgtaaaaattgggcatggagtttcattcaaggttgctccgtttcctctatatttgattaaaagcgtagtcacttttataaaataggaaattttgtttgaattaatttctctttatcttcttattttatcatctacaataagggttataaagcatatttgtggaggtatttaccatgcatgacaagatgaatggaacgtctttgccgaaaacgtcgtttctgtccgcctttgctggcgcaattgtgttggcgctggttcatcaatatctgttttacggacatgggctgggtgtgtctatgccaatttttgttattggtttttacgcctatatgtatgcctttaaccgagatcgtttccagtccagatcatggatagggcgtttgctgtttgtgatcattttcatgctggcattgacatacgcgctgttcaataatccggtcctatacgtgttaaatgcgctggcgatacctgctctgattagcgtacatatggtgctgctgttcggggagaaaaggcatggctggtcagaacccggtattatcggtcaggcgataagccattggttttatcaaaactttcgtcatatcgtgaccccctttcggatggtcaagacagtagcccttcgaaatgtaaaggatgagcgtaagcgtgtattgggaaaagtgctgatcggtttacttattgccttgccgctactgttcattattatatctttgctggcttcggcggatgggatgttcgaaaagttgttagctggagtacccgaatggatcggaacgctgtcctttgggaatggcatgctgcggctgatctggacctgctttttcaccttctgtttcttctgttatttgtggggatttgtacagcctgctccgcgtaatacgcagagagagacccaatcatggcacgggttaaatgagcgcacgaatggccaaaccaccgagcatgatggtcactcttcagtgatgattgaccgaccaacggtgccttaccacgagccggtcgcgattaaatttgaccctgtcattaccgctacggtgctgattgtcatgaatctggtgtatgttgtgttcgtcgtgttgcagtttggatatttgtttggtgcatgggaaggtgctctgcccgaaggaacctcgtatgccgaatatgcgagaagaggattcggggagctggttatggtaacaggtatcaactttgtgctgatgatcagtgtattgaagtggactgaatttggctcaggtatagtgcaaaaaatgaacagtggcctgctgtacatactcgtgggttgttcgggtgtgatgctgtattcgggatatacccggctggttatgtacgaagaagcatacggctatacgtacacccgctatttggtacacgcgtttatgatttttctgggcttgctactgcttattgcagcaatgcgcattcatttccgtcaactgccgttggcgaaatattatattgtactcgctctggtcgcctatgtcgtcgtgaactatgtgggcattgatatacggattgctgaaaataatctcgaacggtatcgcacgacatcggtgatagataaggaatatttgagtgagctatcggcagacgcgattccgctgctgattgactttagtcgtaaggaacatggatcactagatgagtttttacaagcccgtttgacgagcatgacgagagaagaatcggcttggcctgaattcaattgggcaaagtatcgagcgcaacgggaattgcacgactatattttggaatgagaggtgtttgggaatgatcggaacagaaacggtacagggtatggtactggagctacaggatgaaatgtcacagtatcagcatcagtttggtgtaagacggaacgattttctcgtggaggctatgtcttacggaatgagtgaggaggaagctcggtcttatgctatccagagtatcggtccggtcgttcccgtcgcctatatgcctacgttggctcctggtaaaatccgaccactcagtccaatgctggcagcgcggtaccgatatgcgggggattggaaggatatcgacgagcatctgctcctacctgatgaagtcctgcggatcgcaggtacagagcagttccgcagctggatcagcgatatgcggaattactgggtggaatcggctccataccgattcggggatgatcgtctttcgctgctatcggttgcgagcgaggaagagggtcacttttccatgctcgtctggaaggagcccggtgaagagccagaagtatggacgtatgcttcgcagcatgaataccgattcagtcatttactccattggttcaagtggctgaacgggcggagtgaagaatgagaggtacagatgatgaaaaagaatcgtaattgggtcgtgctatttatcggcatcgctctgatgatgggggcagcagactatttaacacaagctaagcctacgactactcctgagcttatcgttccaaccgtaatcagtgaagaaagccttcagttatgagaatgaagttaattttttgtagtattacgttgttaaagtaagccggaaatcaccctaatagttgagagggaattgaggccaacatcaatgaatgtggagccattcagatgttcaagcgactccgtcgtttcctctacaacttatattcagggggaatttcaatggctagaagtgcaagtacttacgcatctgtaattgacggttttaaggtagaaacgaacaaaaagtattcgccagtaggtggaacgaagtgtaatatttttgcacaagatgtgatgtctgcgatgtcggcttccctgccaagtggcttagccaatcaaatggctgatgctttactgggtaacaatgcgccgggatggtacactgtaacctttcaggatgctcaaaaaagagcaaatctcgggtatcctaccatcggaatcaaaaaagcagatgggcatggtcatgtggtcgttgtcagaccgaagggttcatcgatcacgattttgaaggaggtacaggttgcacaggcggggaccaaaaattacaacagtaataccattaattattcgtgggtagcagcagatctgcctggagtgaaattctacacacacgactaattgtatacaagatattggaaatctaatgaccccggaagcagatccactcgatctgcctccggggtcgtcttttttattttgaaacggaatgtttagatacaataaacgctttgcctggcttgataaaagcaacagcatagccattggagaaggaggaggattctgccctgtactcaagtttagtcagcagttgcccctgacgattgatgtaaccgaatttgccgtctgagacggatgattgtgtttgtttaccgactaaagctaagccttctttgaacggagaagtaacatcatatttttgttgatatttaatgaccagcgttccgtttttatcaataaatccaacctcattttttgcatttttcacactcgccaagccttcactaaaatcctgtgcatccgtaaatttaaagggaattgcgacttttccctgtttattgatgaatccccattttcccttagtattttgcacaggggccaatccttccgagaagtctccaccggattgatattgaggaggaataacttctttccctgctgtattgatatatccgtatagcccttggctattctgaacaatagccaagccatccgagaaaccacgactgtatttatatttataaggaattgctagttgaccagaggcattcacaaaaccgatcttgccagtgttgggggcgtaggcaagagccagaccgtccgtaaatatatattctgaatccccattttctttaaaatgagaaatgatttttcccgttcgatctataattgcattttctttggtgtctgctatggtaaccttggcttttccttcggaaaagaaattggcttcggtatattggcaagggatgaccagtgtccctttggtggtaatgtatccatagagattggtttttgtatttttgactacggctcgctgctcatgaaaatcaccaatgggtttaagctcggcgggaagtgagaaagctttctctcctttggtattgtaatacacgaggtttccagcagatgtttcagcagccaataagccatcatgaaaagcaccatcgctcagcgggcgagcaacgttgtaatccagagcagttttagaaacttcaatggttgttgtgccggatgcggcccagcctgttccaataacagagaggctagtaaccagaatcaatgcagctaatcctaacttttttaacatgcataagctcctttgtgagttgattttttaacttcgggcttcgaaaaatcttaccttcatacgtaaggtattccataatatagacgataaaaatgtaggaatgtttcttgatattctaaatttttctaattttcatctcaataaccagaaagggagcaagctaatcgcttgctccctctacacctaaacctgccctatatctttcgtatgcttaacagagagttgccgttacgcataaactcatacggaaccttggcctctgtcacccgtaagccttctgcctccagctcaagaatcaaacgatctagcagatctccataacagctccaaacataattatcttttgcacgttctagcgtttccattgcatgctcaatatccaataggcctttgcgtttcagatcatcaatcttgtgatcgtaggcgatatcacttgcggtgatgtccagcgaggctttggtgcccagagcggtgaaggaacatgctcccgcaggacagtccaaaatctttttgcctacaagttcagaaatttgcaaattgaacatttggacgtactcctcaaacgtgcggccgatgaacacgacccggtctaactcttgcttggttttactttgactcttctcatctctactcatctcttctcacctcagctattctttggctacggaggagcaatcaagtttactccgtaagctcatgttaacagtttacagaatcgaataacatatcatttggcagaacctcttattgtgaaaatcgattctattgagagattaaagataagagatcacgttcattttcaagaaaaaaagtgaagaaacagtgtcattttaaaaaaagtctatacatatatattaaatgtatagacaaatcaaaaaactggatttataattacgctgtaaacgttttctagtagttaacatccaatcagaccttgaagggaaggaacaatcatgaagaaaattttgctggcgtgcagctcaggtatgtctacaagtttgctggttactaagatgcaggattatgctaagtccatcggagacgaggctgaaatttgggcagtaggtcaagatcaggcggcagaagacatggctaaggctgacgcagtattgattggcccgcaaatgagttttcttaaaggacagctggaaaaggaagcagcccaatatggtattcatgtagaagtgattgacatgatggcctacgggatggttgacggtaagaaagcctatgagcaagcagtgaagctggtggaacgcaaaaatggataaagtcaatatagccgaactgacggaagagcaaattagtttccaacttattcttcatagtggaagcgctcgcagtaaagtgattcaggcgctgaccgaataccgaaatgagaatgtagagggtgcggatgaactgctcaaacaagccaagcaggatttacgtgctgcgcatgatatccattttcaaatggttaagaaggaagcgggaggtacccaaactcctttctcgctccttctaatgcatgccgaggatcatctgatgtccacggttaccatgaaggatctggttctagaattgctggagctgttcaaatccagaaatttataacggaacatgtaagtttgtgaaatttgggacatgaaaagcttgcaaccctattgatgcaagtcacttcgcggggaggaataggctttgtttgagaaattaagccggatactgatacctattgccggtaaactgaacaacaaccgctatcttactgtactgcgtgatgcatttatgttgtcatttccattaacagtttttggctctatcattgtcgttattatcaatctgccgtttctaaaagattggatgggcgacggtaattatgcgacttttaacagtctgctgaacattgcgccgagtgccaccctgaacatcatgaccttattcgtggttgtcgggatcggctattatttatcccgaagttataaggtcgagcccatattcggtggcatgatcgcgttggtcagcttcttgatgctcaccccgtttgtgctgacacaagaaagcggtgccacgattgctggtgtcattccgttggatcggattggggccaaaggcatgttccttggcatgatcgttgcttttatagctgctgaaatttaccgaagagtgacacagcggaacattgttatcaaaatgccttcaggcgttccgccagccgttgccaaatcgtttgccgctttgcttccggcgtgtatcacattgggcatatttttgatcattaatgttgtagttacactgactcttcataataacctgcatgatctgatttatcatgctgtacaggcacctctggtgcacttgggcagtggtattatacctacattaattgctattttctttgttcagcttttatggttctttgggcttcatggtcagattattatcaactcagtcatggaaccgatctggaatacgctggcacttgaaaactacgaagcgtactccaaaggagcggaactgccgcatattatcaccaagcagtttgtggatatttataccgtaggtatcggtggtacaggtatgacactggccgtagtactcacgattctgatcttcctgaagagtaagcaattgaagcaggtcagtaagctggcccttggaccgggtctgtttaatgtcaacgagcccgtcatattcggtttgccggttgtgatgaatccgcttatttttgtcccatgggtcattgctccaatgatcgttacgctgattacttacttcgccatgtctactgggattgtaccgccgccaaacggaatacaggttccttggacgatgccgttgttctttagtggaatgatggctacgggatctctgatgggaggcgtactgcagttgtttaatatggctgtcgtctttgtcatctggttcccgttcctaaaaattattgatcggatgaacgttcgtaaagagcaggaagaggagcttaaccaaacagccattgcaggtaaggatcaaactgttggaatgtaatgtgaataagctgctagattagcaacttattcatgcaaaagagagaggagtagagctgtgaatcataccgaaatgaaagatatagagcagcaaaccattcaataccgttttccatccgacttctggtggggctcatcggcctcggctacccagacagaaggaaccgtggagggagacggcaaaggaccgaacatttgggattattggtttgagcaggagccgaaccgtttttatgacggcgttggacctggcgaaacgtcccgtttctatacccgttataaagaagatattgcactcatgaaagagcttggtcacaactccttccggttctctatttcctggtcgcgtctgtttccggcagggagaggtaaattgaaccagcaggcagttcaattctataatgccgtaattgaagagttgcatcaggcgggtattgagccgtttgtgaacttgtaccattttgatttgccgatggctttacaggaaaaaggaggctgggtgaaccgggagacggtcgaagcttacgtggattacgctaacacttgctttgagctattcggggatcgtgtagccaaatggtttacgcataacgagccgattgtcccggtggaaggcggctatctgtacgatttccactatccgaatgaagtggatttcggtaaagccgtacaggtgggatatcataccttgttatcgagcgcgagtgtcattaaggcttacagagaaggcggttataagggcaaaatcggaattattttgaacctgacgccgacttatccgcgtagtcagcatccggcagacgtgcaggctgctgaaatatgcgatgcgttctttaaccgttcctttttagacccatctgtgacgggagaattcaatcctttgctcgtggagctgttacgccaagagggatatgtaccaagcatggaagacggagatcgggagattatacgccagggcactgtggacctactgggtattaactattatcagccccgcagagtcaaggctcgtgaaagtctgccgaacccggatgctccttttgtgccggaacgtttcttcgattattacgtcatgcctggccgcaagatgaatgagatgcggggctgggagatttatgagaaaggcatttacgacattctgaccaatgtcagagaaaattatggaaacattgaatgcttcatttcagaaaacggaatgggcgttcaaggtgaagaaaagttcagagatgaacagggcatgatccgcgatgactatcgcattgattttatccgtgagcatctcaagtgggttcaacgggccatttcagagggctccaatgtgaagggctatcacttatggacgtttatggacaactggtcctggacgaatgcttataaaaatcgctatggttttgtgtctgtcgatcttcagaacggtggcaagagatccgttaaacagagtgggcactggttcaaacaggtgatcgagaataacggattctaaggtggtcctctggaccgcctttttttcttcatcatcatcaaagaactgtgctgtacgccgctggtgagaaagtataatgttcggtatacttacttataccgtgataccttaacgtcccgcctgcagaaccaaaaggaccagcgctaccgatgttttggtaaaatgctgacataaaacaaattttagtacaggtggtagaccaatgaacaaatacgaacggattgcacaagaggtcaagaagcgtattatagacaagacctatagcagtgatgatccgattcccgatgaaatttcactggccagtgagttccgggtaagtcggatgacgattaagagggcattggataccttggtgtcggaagggctgttgaatcgtaaaagaggacacggaacctttatcgtcaaatcgatctacaatggcccggttaatgtcgttgtgaatgaaatgctggggctgacaaacgtgctgcgcgggaaagaaatcaaaagtaaaatcatagcctttgacgttcaatttccatctgaagaggtagcggcgcatctatttattgatgccaattctcctgtgtatcgtgtagtccgtctgcgtattgtagagggcgagccgtatgtgatagagcgcacatacatgcctacgaagctgatcagcggtattaccgagcaggtgttgcacggctcagtgtacaaacatattaaggaggagctgggccttaatattgtcagttcacatcgtaccatccgcgcgtccaagtcgaccgagctagattgggagtatttggattgtggtgcggatgatccggttttagaaattgagcaggtaggttatctggatacgggtataccgtttgaatactcattctcacggcatcggtatgataaatttgtgtttaccacagtaaatcgggtacgttgagcgaatgagtacgaaacaggtggtaaagcaaacatggcagaagaagcctatctaatatgggattctcctgccatgttcttttttaatgaagcaagttaattgccaagcaatcttacttcatgcaccgtaggggtataccagttgtttggattattaaataacaccgcatttacaagattgattcgtacgtaacgggcctgaaaactaactttgtcactggtaaaaccatacgtggtattacctgtgcggtcaatcgtggagtagttaactccatccgtgctgtattcaattttatatttgtaatacgcttcagatcctttgtacataaaccatgaaatatccacttcgctgatggtcttggtactgcccaaatcgacctgccaccaagcgggccaggatgcggaagtagctttccacgaggtttgggcgttgccatcgttcgccagtgaagctggagaactggatgcggctgagctcgcagtcgccgttttgccctgtgcgtgattcacaagggacggtaggattactgtgcctgtcgcagcatccagatcccagctactgtaccagttcagggttgctgttttattggagtcattcagagttagtggcaaccagatgaatttgtggtcgctcagattgagcggattccagcggtcgcccatatagatgtagctggttcctgcgctacccgtaatcgtggcgatggaatggatttgcgagccgtaagctgccgggtcaccgaagggcgacagagcagaccagcttccagtcatggaactggcggttgcgtaagcgccctgattcggataccagccggaagcctgcgaggtgaacaggtagtaggtattgttctttttcacaacagcaggagcttcgcgatagccattttcaaaaatccagccaacgaacgactgcacgcctgtataatcgactgtcagcttgaagatggccatcgtatcgttggcgccgccatttttacgggaagctgtaataaggtaaccgctaccgtcagtatccgtgaacaccgtcatatcccgagactcgtaattcagcgggcggaagctgccttggtaggcaaaatttccgtcgggtgtatcgctggtagcgacggctacacgaccgagtgagtagtccgtgccattttcatagtgcgcccatagtacatattttccggtggttttgttgtagatgactttgggacgctcgattttgctcgaattcagctcaggggcggaatctttggtgagaatactgctgcggaaggaccaatttttcaaatcggttgaggtatatacgttcactttttcaaatttccagttttcggcgtgctcgccgtaccaataataagtagaacctacttttagaatattaccgctgttcgcctgaatcgggttacctgcggtgtctttccaatccattccgttcgtaatggctgtgcttgctgttgcgctcagggatagttcagcattggcgacgtccaaaccattcagcgcttggttcacctcggtcccgtaggttgcttgcgtaacgcctgttgtatgggcatgtgctgtatcgggttgaagacccgcactggccactgcgaataggatacaaatccatgcggctaaccatttgctgctgttgatccacttcacgatatcatctgcctcctttaacacggataggatgggtcggaatggcttgtccggcacctcatcttcgattttatcctaattggaagcgtttacaagtggaataaattgaagtccttagcatggggaaagctcgtcagttatgtgggaagtgtttattaattgtgcgttttgtcattgacacgttcacattatttcaaatttaaagtgactggaatcacataaacggttactttatgtgggtatactgggttttaaattgaggattaacaaatgggacatatgttgaaataccctttgttatcttattttggagagaagagggatacaaagatgctaagtgagcaaaccattgcaacgatcaaatcgactgtacctgttttggaggtacacggaactacaatcaccaagcgtttttaccagatgatgtttgaggcccatcccgagcttctcaatatattcaatcacgcaaatcagaagcaaggacgtcaacagggagcgctggccaatgctgtatatgcggctgcacagcacattgaccgcctggaggaaattattccggtggtacgccagattgcacataagcatcgcagtttgggaattaagcccgagcattatcctatcgtcggaaaatatctgctcgctgcgatcaaggacgtactgggagatgctgctacagacgagatcattgccgcatgggccgaagcctacggtgtgatcgctaacgtatttatagacatggaagctgaaatgtacaaggaggctggacagcagcagggaggctggtcagactttaagagctttgttgtgcagaaaaaggttaaggaaagcgaccaaattacgtccttttatttggtgccgcaggatgggcaggtgttgcctgacttcgagcctggacaatatatcagcttaaagatggaaattccgggcgaacacaatacccacattcgtcaatacagtctttcggatgcaccgggccaatctcactaccggatatctgtaaagcgtgaggatgctgtagagtcccgcccggcaggtaaagtatccgtgtatctgcatgagcaggtgcaagagggcgatgtgcttcaagtatctgcaccggcgggtgattttacgctggatcggacagatcgcagacctgtcgtgctgatcagcggtggggtcgggctaaccccgatggttagtatgctggcttctttggtgaaatctgctccgcatcggcctatcacttttgtccacgcagcagtcaatggggataaccatgctttgcgtaatgaggtagaaaagctggtcgccacacatgcacaggctgcagttcgctggtgttacagcagaccaacggagcaggatcggctggcacaggcttttcacaaggaaggccgtttggatctggcctggttacaatccgtgataccggatcggaacgcccaatattatttttgcggccctgagggattcatgcaatcggtatacggcctgttgaaggagtggaatatccctacttcggatatccactatgaattctttggtcctgccagcgcatgggaagcagaagcacaatgacacaatgaaacatcaaaaaagacgaaggatatttatccttcgtcttttttgcgatgattataatcgaaaatcctgctcattgggtactacttttcaaagtgcgctcctgttttcataacaagggagtacgcaaaaattccatacctcgcggcatatatgggcgtaaggcctccggaatacggatcgaaccgtcctcttgctggtgatgctccagcaacggaatcagaatccggggtgaagcgaccgctgtgttgttgagcgtgtaacaatatttcagcttgccgtccgcattgcggtaccggatgttggaacggcgtgcctggaaatcaagcagctgggacgacgaatgtgtctcgccgtaagcttggcggctgggcatccatgtctcgatgtccacctgcttgtaggttttttgcgccatgtcgcctgtacagacagccatcttgcgataaggcagctccagctgttgaagcaaatcttccgcattgcgcgtaatttcttgaaacatctgctccgaagcgtccaggctggcttcgcagatgacgacctgctcaaccttggcaaactggtgcacacgatacagtccgtgcacatctcttccggctgagccgacttcattgcggaagcatacggacacggcagccagccgaatcgggtcggtaacatccacgatctcaccgctgtaatacgagactagcggcacttccgaagtgcctacaagccactgatcctctcctgtgatgcggtacgtctgatccagtccgagcgggaagaaaccagtgctgcgcatcgcctctgcacgtaccatcagtggaacgtccagtaactggaaaccacgtgcagtcagcagatccaccgcaagctgctgcacagcccgatgcactgcaacccctgctcccgtcagatagtagttacgggtaccggctgttttgacaccccgagggacgtcgattagcttatgaagctcaccgagcgccatatgatcctttggttcaaatccgaagtttggaactggcccgacccgctccagttctacattatcgtcatccgatcttccccgtggcgtatctggcgatacgatattaggcatcagaagcaaaagctgttgaaactgttcctctacttcctgttgcggggcttccagaagatctagccgttcgttaatttctttgacctgccgctttgccccttctgcctgttcactcttgccggcatggattagcgcgccaatatcctgactacactgattacgcttctgtcgaagctgttcgacttcctgaagtagctgttttctctgatcatccagggtcaacagctccacgaccgatacctgtattcctttgccgtctgctgctgtctgaacttgctcttgatgctctctgatccatttgatatccaacatgacaccgcactccttttcggataaaaatacaaaaagcgccctcatccacatgggacgaggagcgctttgatctcgcggtgccacccaaattgaccggacagcatgacagatgtcatgactctccaatccactttgctccgctgtaacgggcgggtccggtttacttaggtacatatcgccatatcctacgctaacgtatggtccttggcgtaaacgcctccgagttggatgctcttcacaggcataatatcgtttgcttttttgttagtatacggattttcggcaggttaatcaagctacaacaactttttaagctgcgatatacggacttgtgacacgccaagccattgtgcatattcgccctgcttggcatggggatgctcatgcagaagttcccttaggtgttggattaatttttgtgatgattggtttactctctttcctttgtgcacaggtttcttagccattggagcaggagtgcggcttacggctatattttcttttaactcttgtatacaggtcttacataaaagtgaatccctaaaataggtcagatcttcatcagcattacataggttacaagcgaccccgatatactttcgcatactcaaaaaaaccgtttcgatatccatataaaattctataggatcgccaacatctatccccatagacatccgcatttctttaggaataacgattcgtcctaacgaatctaaagagcgagtcatacctgtattcttcataagatgtcctccttcttcacctgacttggcaaagctcatttctccagtggggtacttgcttgattaaacacttgttgtatgagctggcttatgcgagcttctgagatacccaacatgctagcatattgctgttgtgtagcatgtggatggttttcatacagatctaaaagaagttgggccatgatctctttgggttgaaagatttgttcacgcatagatacgatcttgagcatatagttgcaatttttacatatcagaaagcctttcaatttacttaatttttcggtagagaggcaaaaatgacaagactgaccgtagtgtctttgtagtaatagcgtacccgtcttttcatctgcaaaaaattcaatagaatgaccgtgaaaaataccgcatgtatacaggatttccttgggaatgaccaagcgccctgtagggtctaagttttttgtcatttttacatgaggcattgccaaaagacctcctattaccaagataaaaagcaataaaatagaagtatttattgttattccaaaaggtggtattatcaggatagtcaaaacttttattatattataagtttccaaaatatattttttgaaaaaatgtgtatcatattaaagttcacgctgaaagggtggtttatttatggaaatcacacctaagattagagcagaattagaaggatacctaaaacaagcaggcttgagcatgaccgagtttggacacattgctggcatgaatccgggtacggtgagcggtattataacaggtaatcgtaccatttcggtgcaccaattggatcgcattacgttaggaatgaatttaccaacagaccatttctatgaaagatatattgaagaaagtgtgatagatgcaccgctgaactggaaaagaattagcccgttcttgtaccgctgtgtgcagtttcagcgtgtagactgtttgcaaaaagtagtaagtgtactgctggataatctgggctatattccttatctctttgcattagcagaggattgttatgaacaagattatcgggaagcagcggcttacttatacgagaacatctccgagggcgaaaaacagcagcattcggaacgacttgcactctgccattatcgcttgttcactattgcgataggaaaagaccagaatctcaatttcgacgcagcggccaaatttgaatcattcgtccatcgtttggatgaagtggaccaactggatgggctgaaagatttggcgaatgtgtacagagcattgagccagtgggacaaggtatataagtatgcaaagcagatgggacagctaggtggaatatactatgagatggttcataactctgagcgcaaggaaaaagaaccacaaaagaagctaagcaggccgctgtttgtatacatagcttacgccgaattgatgtgtgctaatgcctgtgatgcgaagggagatcatgagcaggcattagtacaccttcaaggctatgctgatctaagctgggtcaaggagagtgacccggacacgctccattggttgggtttatttcagcattgggcaaaaattaatacgtacgtgaacaagctgatgtcgggagatgtgagtgtcctgcccaattatgtagaatatatggcaggcgaaaaatatattttcaacgaactcttaaacgtcattgaagcagccaatcgttatcatattgatgtggatcatatccttcagcgctttgaacctcaaattacggcgtatcaggagccgtcccctgctgacattaggcaacaatatttgccacagcagtatgcacggttttggtacaagatggctaaatacagcctaaataaaggaagatattcatatggcttcaaatgtttaatagacgctttagaaaaagctggtacaattaatcacgtactacttattgccaattgtgcaggtttatttgactgcttcagggcatatgccgctcctgaaatattggctcagtatcattctacctaccaggaggtgtggaaagaaaatgatcaaaaagatggctttgctcttggcagcagctagctttgtactggtactggtactaccagttcaggctaaagatccgacccttggcacattcaaaccgcaggaacacattggttcagcttgatccgagcactaattcattactattgaccagcctagacgctggtctttttttgttatattatgctgactttttgattgctaaaatagcgatccatatttccacatttcaacctaaaatgagattcattaggagggaatgcgctatgaatccagatgaaacgttaaatcaacagttggaagatgctaggcaacgattgcatgagctttatggactatatggtttcggacatgcccgtgtgctggagcagtctatgtttttggatgaactgattaatcagtacaaccgtatgtttcagacca

SEQ ID NO: 54 - DNA, 31887 bp, Unknown
  Kingdom: Bacteria, Phylum: Firmicutes, Class: Bacilli, Order: Bacillales, Family: Paenibacillaceae, Genus: Paenibacillus
aaaatgaacataaaaaagctatcgagactttctcgacagcctgaggagccgaaaggctcctttttcttttccgctgctgcgattgttataaaaacagatcaagcgggtaataacaaatcgtggtagacaaacaaacttaattttaatttgtttcgaggataaccggaaaggagatctgaacattaatgagtaaaattgcatttttattagctgaccaatttgaagattctgaaatgaaggtaccttatgatgaattgaaaaaggctggacatgaggcagatattgttgggctgaagcaaggtgagaaagtgagcggcaagcaaggtgaagcaagctacactattgaaaaagccattgcagatgtgaaatcaagtgactatgatgcagttgttattcctggcggatcctccccggaaaatctgcgattggatgcacatgttctgaaatttgtgactgaaattaacgaggccaaaaaaacgattggcgctatctgtcacgggccacaaattttggcgagtgccaatttgttacaaggccggacgattactgcttatcctccgttgaaagatgacttaattaatgcgggtgctcattttgaggatcgagaggcggttgtggacggtaactttattacgtctcggacccctaaggatgagcctgcctttgtgcgtgagttattaaaagcgttgtaatttgaacgtgaatatttccttagatcaatgccagtacaattcccaaacgaggaggatttgatatggcaaaacagattcaggcttattttcgcacagaagatgaagctgagggtgccagagcctcgcttcaagcttatagaactgaacatttggaagtaggtgccttggatgatgcgctcggtcgggagacgagagttttaattccgctggtcccctataacaatacaggttctgtgagtacaggaggctctgcaggtgcggcaatccctgcggcgggtgcttatggcgagaatattctaccagatgcgaaggatgaccagattaactctggctcagcccaaagggatctgaatgaagatcggggtggaacaacgaatcatgacggaggattgctccgtgcgacagatgtgtatattaacggtaatcaagatgaattacggtatgtattatcagcaaaggtgaatgatgacgattatgatgaggtcatttataagctacgttccaatcggggatatgtatcgcagttggattaaagctaaagagcgcaacacaagagattgtcgatacttgagaaattcagctacaaaagagtgactgtaatacaattgtaatattcgaaacatcattccttaatattcgttgtttataataacagcatgacccccttttgatatatctttttgaacctgcggaccgtttccgcaggttttttctttttataagccttatttgtccgattatagggagaatgtcttgactttgtcgaagcggttcattaaaatcataaaataatgaaaaatgatttgatgacgggaccaagtactccgaacccacaagcgcagagaggaatttccaggctgtaaaaattcccttgatgagcggatgaatgacctccccgagaacaggcggcgaacaattgaggaaaccctactgaaagtacattgcaactgtgccgacagtggatggtcctgcataatagccgtactgcgcgttacgggcgttatacgtatgagcggagtcagtttaatgctgacgggcaatgagtgattcttatgctggttgtctgggtaaactccggaatgtgggtggtaccacgggtgatttgtaaacgacaatccctcgtccctgttaatgttaacaggacgagggattttttgttttatttgaaagtggagcaataaaaaagtgcacaatacgaaatacaacgatggggggatacgttaatggcctttcaaaaaccgacgggaacacaggatttgctgccgggcagtgtagaaaaatggcaagttgtcgaggaaaaagcccgtgagattagccgccgctttaattaccgagagattcgtacgcccatgttcgaacaaacgaatttgttcgttcgaggtgtgggtgaaacgacggatgtggtggaaaaagaaatgtatacttttgaggataaagggaagcgcagcatgactttgcgtccagaaggaacagcaggggttgtccgctcctatgtggagaacaaactatacggggagccggatgtaactaagctgtattatatcggcccgatgttccggtatgagcgtccacaggctgggcgtcagcgccagtttcaccaatttggaattgaagcatttggtgcggtcgatccggcgttggatgcagaagttattgctttcgggtatcaattctgccgtgaactgggcttgaaaggagtacaggtggagattaactccgtcggtaatgcagccagccgggcagcttatcgtcagcatctggtagacttcttgatgccaattaaggatacgttgaccaaggagagccaagcacgcattgagcgcaatccgctgcgagtgctagatagcaaagatgatcaggacaaatttggcggagcaccttcgattttggatagtttggatgaggaatcccgcacgcattttgagaaagtgaagcaaaatttggatgccatgggcgtggaatatacagttaacccgcgtttggtacgggggctggattattatacgttgacagcgttcgaattcaaagccgaaggaattggtgccatagacacgatcggtggaggcggccgctacaacggattggttggagatctgggcggaccggatcagccgggcattggttttggcattggactggagcgaattcagctgatcttggagcatcaaggtgtcaaactgaacgaagccaagccgttagatatctatatggtagcgttgggagaagcagcagaaacggaagtaaccaaacaactattcaagttgcgtcaagccggattttccgcagaacgagattatctggggcgtaaaatgaaggcgcagatgaaatcagccgatcgctttaaagcaaggtatactgcgattctgggtgaggatgagctggttcagggtgaaattgcactaaaaaacatggaaaccggcgagcaacgtaccgttaagctggatcagctggtggaagaattaggataaacaaaataatgtaacatcagtcaggggaagtttccctctggctgtcatatagcattaactactaaacataaacaggagtgtgtattatgaaaaggagtcatcaatgcggcgcattgactcatgcgcatatcggagaaacagttacattgaacggttgggtacaaactcgtcgtgatttggggggcgtactttttatagaccttcgtgaccgtagcggaattgtacaaatcgtgtttaatccggcatattccggtgacgcactgcaaattgcggatcgtgtccgtagtgaatacgtgcttgaggttaccggtacgattgttaagcgtgatgcagaaacgattaacccgaacctgcctacaggtgaaattgaggtacgcgtcactgaaatcgaagtattgaatgcgtctaaaacacctccgttcttcattgaaaatggtgtagaagtggacgagtctctgcgtttaaaataccgttatttggacctgcgtcgtccggaaatgtaccagaccttgaaactgcgctccaaagcagcaaaaatattccgtgacttcctggacggagaagagttcgtcgaggtggaaacaccaattttgacgaaaagctccccagagggcgcacgtgactatctggtgcctagccgggtgcatgaaggcgaattttttgccttgccgcaatcgccacaactgtacaagcaattgctgatggtgggtggcctggagcgctactaccaaattgcacgttgtttccgtgatgaagacttgcgtgctgaccgccagcctgaatttacgcaggtcgatattgagacctcctttatgcaacaggatgacttgctgcctatgatggagcgtcttatggtgaaattgttcaaagaaaccgttggggtagaactggaaacaccgttccaacggattacacatgcagaggcaatggacaagtatggttctgacaagcctgacctgcgttttggtcttgagctgataaatgttaatgatatcgtggcaaccagtggtgtgaaagtatttgcttccgtaattgaaaagggtggcgaagttaaagtccttaatgccaaaggatgtggcacgtggagccgtaaggacattgatgacctgggtccttttgcagcgcgttatggagctaaaggcttggcttggattcaagtgaaggaaggcgaattcaagggacctatcgttaaattcttcacaccggaagaaatcgaagccttgaaggagcgcacaggagccgaagaaggcgatctgttgctgttctctgcggataataaaaaagtagttgctgatgtattaggcgcgcttcgtctgaaaattggccgtcatttggggctcatcgacgataacaaattcaaatttgcctgggtcgtagacttcccgcttctgggctatgacgaagaacaaaaacgttatgtagcggagcaccatccgttcactcgtccgaaggaagaagacctggccctcttggacacagatccaggtcaagttcgtgctcaggcctatgatatcgtgctgaacggctacgaagtgggtggtggctcgatgcggattttcaaacgtgaagttcaggaaaaaatgttcaaagcgctcaatctgccgcctgaagaagtgaaggataaattcggttacctgctggatgcatttgaatatggtacgcctccacatggtggtattgcctttggttttgaccgccttgtgatgttgcttgcaggtcgtacaaacctgcgtgaaactattgcattcccgaaaacagccagcgcgacagacctgcttatggatgcaccagccgaagtggatcaagctcaattggatcagcttcatattcgtcttgctccgaagcctgttgcgcctaaagcttaagacgaacatttggcttagcaagtgccatccattggcatgagatagcttatagaatgccatgaacccgttaccctcatatggataatgggttcgtggtttgtatgctggagttcaggcatagagtttaaatcagtgagggaggatataccatattgttgcatcaattttcacgaacggaactggccattggaactgaaggtctagaggttatgaaaaatagcacggtggccgtgctgggtattggcggtgtcggttcgattgcagtggaagcactggcgcgcacgggtgtgggacgcatcattttgattgataaagatgttgtagatatcaccaatattaatcgccagattcatgcgttgacaacgacggtaggtcaaaaaaaggctgatctgatggtagagcgtgtgaagctgattaatcctgaatgtgaagcgattgcactgaacatgttttatacagaagaaacatatgaggagctgttcaagtacgacttggattatgtgctggatgcttcggatacgattatatacaaaattcatttgattaaggaatgcctgaaacgggggattccgatgatctccagtatgggcgctgcgaataaaatggacccgagtcgttttcaagtagcggatatttcccagacgagaatggacccgattgcccgtgtcatccgcaccaagttgcgcaaggaaggtattaccaaaggcgtcaaagttgtattctccgatgaggaaccgatgaagccacgcgaagaaattacaaaaaaaattgtacctgcaaacgcacctgaaattcggaaggcgaagcagccgcctgcaagcaatgcatttgtacctccggtagcaggactgatcatggttagtgtagccgtgaaggatttgttagaacacgctggtgtgtaagttgcaaaaatagcatggcagtgcattcgtagatttacagcagtatgtattcactttaagacctgtagttctgtgcatcacatcctttgtgtgtcacagttgctacagctcttttttgttttgaaaaagcgcagcttactgcaaacagattgaacaacttgctggagggttttggtatgaaggatggactatggtccagaagtctcggtttcaagcccgagcatcattggaaaaaggaattagccgctggggccatttcttatttttccgttgtatacattgttatggttaatgcaactattttggcagatgctgggattcccctccaaggggcaatgctcgggacgctgctgacatcgatgatcggctgcctgcttatggcttttggtgggaaatctccaatggtcgttgtacctgggatgggaattaatgcttttttcacatatacgctcgtacattctatgaagctgagctggcaggaagcgctgatggtggttgccgtcacagggattttattcgccattgtggcttttacatcattgtacaagctgattagccaagcgattccccataatttgcagcacggaattacggtgggcattgggttgtttttaacctttatcggattgcaaaaaagcggcatcgtgattgctcatcagacgacttttgtggctattggccattttaatgatcccaaggtcattacggcttgtgtaacgttgctgctcgctattgtattgtttgtgcgtaacgttcagggaggtttactaattagcattttggcgggaactggccttgcttatatactaggagctgtagagcctacaagcacggtacgaacctctgaaacggtgcgacagtatgggcaattgtttggagagctttccttttcaggcattgtctcggtagctttctggattgctgtctttttgctcctactcattgtgctattcgagaatattggtatgattactgcacaaaccaacatgattggaagaccggatttatttaaaaacagcttgcgtgtgttggctgtaaccaatatctttgccggtattttgggtagcagtccggcggtagccgctgcggaatcgacggctggcattgcagcagggggacgctcgggaatgacaccgctggtaactgctattttattcggagcgacgtttttctttattcctctgttggcttatattcctgacagtgccattgcgcccgtgttgatcatcattggggggctaatggtgcaaaatgtgcgagagatggatttcagtgattttactgaagcgtttcctgcatttctgatcatggtgatgatgccctttacttacagtattgtagacgggatggcctttggttttattgcataccccgtagccaagctggcagcaggacggggcaaggaagtgcctgttgcattatatatcatttctgtactgtttgtggctaactttgtgcttcattctctggtgtagtaaactcgaagatagattgtactgttcatacccgcgcagagcgcgggtgttgttgtttgaacaagaatggtcagacaggaagcgaggttgatggcatatggaaaaagaacatcatacacaccaagatgagcaggaggaccagatgaaggaaaaaccgggtaaaagaccggataaggctggcatggggcggtttatcaaattgattgcgagtgcgcatccgcccaaggcaattctgatcatcgccctgattctgacgctgattcagaccattgctggtttaatcgtacccatgatgaccaaagggttgattgatggcttgaccttttcttcactaaaccgtatggtcattgttggtctgcttggcgcttttgtgcttcaagcggtggcttcggcggtttctatctatatgttgaactatgccgggcataagattgtggctaatttgcgcaaacgtttatggcataaaatcttatctctacctatcccttactttgatcggaatcggtcaggagatacgatgagtcgcgtcaccaatgacacaagcctgattatgaacttaattacggagtatctagtcaatctgatttctaatgtgatcgcaattattggtggtattgcattgttattttatctagattgggtgatgacgctcattattatggccattgttccgctaacagccctgattttatttccggtaggcagaaaaatgtaccgcatctccaaaaaacagcaggatgagatggcagatctgacctcagtgttgagtcaggttatcggcgaaatcagactggtgaaggcctacggaaccgaaagcagagaggctcaggccggtgaggatcgtatttaccggatgttccgcttcggtttgcaagagtcacgtatcctggcccttgtaggtcccatttctaccttcttgctgactgcagtgctggtcattatattgggtgttggtggtgttcgtgtcgcatcgggtgtgctgaccgctggggatttggtggcttttattttgctgctgtttcaggtgatcacaccgatggcacaattcacgaccctgtattcacgtctgcaaaaggtggttggggctactgaacggattcagacgattttagatcatgaagaggaaccgctcgagttaaagcaggaagcggcaaaagagagcagagatattatacttcgtgatgttgccttttcttataccgaaggtgaagaggtccttcataatgcgaacttggtcattccggctaaccggacgacagcattcgtgggaccgagtggaagtgggaagtccaccttgttttcattgttggaacgcttttatgtgccagatacaggtgaaattcgttatggagacgaaccgatatcgtcatatacactttcctcctggcgctccaaaattggttatgtatcgcaggaaagctcaatgatgaccggaacggtcagagataacattacatatggcttggggcgcgaagctgacttggaagaagtgagacgagcagccacgatggcgtatgcggatacatttattatggatctacctcaaggctacaatactgaggtgggagaacggggaatgaagctgtccggagggcagcgtcaacggatcgctattgcgcgtgcgcttcttcgtagccctgacattctcatgctggatgaggctacatctagtttggacagctcatctgagcatgaggtacagaaggccctagcgaacttgatggaaggacgcacgacaattgtcattgctcatcgtttgtctacagtggttcactccgatcagattatcgtgttggacaagggcaaggtgaccggtgcaggaactcatactgagttattagagtcccatcaggtgtaccgtgagctggctcaaaagcagtttgtggagatgggggagaggagtatggagtattagaggccgctccactggtgccgcaaagcttcatacttttgtgaaagagtaggggaataggcgtactaggaaataaggttggatttttatggttaaatgtgttacgcttactttcctttttttgtgtcggagcaagtgaatgcgatgcagaaatcgagacttgatattcttaggaggtaactgaaatggagaatgagtttcaaagtgcctatcaagaagaacagcataggctgtcgcttgctatggaggaaattgatcggagattggaacggcttcgcaatacgccggtgtacaccgggcatgattttacggagcaagtgctagaatcggcacgggaggaaaaacgtcaggctttggccaaaagctcgcaggagccttattttggtcgtatggattttgacgaacgtggcagagggcagcggaagccactttatatcggtaaaattggggtggagcgtgaagaaacgtcagcgtatccgctggtgattgattggcgtgcaccgattgccagcttgttttattcatttacaggtggtgaagaaactgcgtcctatgaggctcccgaaggaactattgagggcttggtctatctgaagcgtaacgttgtcattcggaaaagaattctggaacgggtagcggatacatacaaccgtgaaagtgacgaacctgccgtttccgatgagtttctcgtttatcgtttgggagagaacaaggacaaccgtttacgggatattgtatctaccattcaggcggagcaggatcagatcatccgcgcggctaaaaatacagccctcgttattcagggggtagcgggtagtggcaaaacgaccgtagcgctgcatcggctcgcatttttgctgtatcaatacaaggatcaagtgtcggcggacaaaatggtaattttcgcaccaaaccatatgttccttgactatatttcagatgtacttccagagctgggggtcgggaatattcagcaaagtacatttgcagactgggcgctggatttgttgggtttggatttacctttggctgatcctgccgaaacattatcttattggtttgagagtagcagtctgagaaaggaatccatggatgaggcgccgggaagattcaagggttcggttcattttatggagttgcttcaagcttttgttgaacgactggagcccatttccgtgccagagggagatttttcaccatgggatggagcggtgctgccacaagctgagattttgaattggttcaatgaggaatataagccttatccgctcgcgaagcggaaggagcgtgtgctggcaagagtgcaccgctggattgaaatggagctgaaaaagtcgccttcggcggcagcgctcaaggaacgcaagaaaaaggcaggggcacgtgaaaaggcatatgctaaaaaatggccacaatatgacgcactgacgctctacaagcagctttttcaggcagctaaagggttacccgcagatacggctgcggagatgaaggcttctctgccgcctgctatttttaaggccacacagtcggatttgcgaaaacagattatccgtgaagaagatctgactgcgttagtgtatcttcacgtgctgattcatgaggtagaatcatcccaacgttttgaccatgtggtcattgatgaagcacaggatttttcaccttttcatatcgcattgctggatttgttcgtgaaagggcattcctttacgatattgggcgatttatcgcagggcattcatgaataccgtggtgtacatgcgtgggaggaaatgagttctctttttgcgccggaacatacagggtattttgcacttacgcggagctacagatcaaccttggaaataatagaatttgcaaatacgattttggagcagggagttcgcggcggtattacagcagttcccgtatttcgtagtggtgatccagtgcgcaccgtgtcttacgactcatccgtgcgtgagcagagtttgctcaccgctctaaaagagctgtcctccaaggagtatcgtactgtttctgtgctgactcgtaccttaaaagaggctgtggaactgcataaggttttcacaagcgcggggttggatgtgaatttgattgacggtggtaaaaaacaatatgaaggcggtttgtcggtactgcctgtgtatctatctaaaggtctggagttcgatgcagttattgtggcggatgccgaccatgagcattatggagaacgggcatgggatgccaagctgctgtatgtaggatgtacccgtgcgctgcatgagctgtggctattgcatgatggctcacttcctagttacgtacaggcacagacggagtaagcagaaaaagcgttgtaaagcatcgcctgagttgttgtatttctttttgtttgctgtttatcttagtgatggaaattatgaagttatgccagtcgaagaacagccacgaaattcatctttcgtctaaggctgttctttcttttttgtgggcgactgacttgtagatctacagccgtgccgtgaccatgctatcagcaacttgttaacggatatggtagaataagaggcggtttataccgcatcaggattatagatgacttgaattttcatgatttcaaccgtatgagcgaacataatatagtatgttttcaaagaaaaagagaaagtgttcgttcataaaccataaggaagtgaatgaaatggacttattttcatattcccaagagtcaacgccaagcaatcggttgcttgcggatcgcttgcgtccgacttcgctggatgaatatattggacaggagcatgttgtgggtcctggtaagctgttgcgaagagctatagaggcagatcaggtttcttctattttgttgtacggaccaccggggtgcggcaaaacaacactggcacatatcatctcgcaacacacgcaaggcgattttgtacgtctgaatgctgtagaagcatctgtgaaagatgtaagagaagtcattgaccgggcacagacgaataaatcgatgtatggcaaaaaaaccattttgtttctcgacgaggtacatcgttttaacagttcacgtcaggatgcactgctgcctgcggtggaaaagggcacgatcgtgtttattggcgccaccactgaaaatccctttcactatgtcaacggcgctttaatgagccgttctacgttgttccagcttgaagcgctaacgcaggagcattcgctggctgctatgcgccgtgccttgagcgatgcggacaaagggctcggctacatgcagcttcaggtagatgaagctgcactggctcacatcgcgtccatggcgaacggtgatatccgccgcgctttgaacgcgctggaactggcggcgctcacgacgcctccgctggcagacggcacgattcacgtgacactggaagtcgcagaggaatccatccgtcgcccgattgtcaaagcagatgaatccacgcagtatgacgtgctgtcggcctttcacaaaagcattcgcggctccagcgacgccgcgctgttctggttcctgtacgccgtagaaaagctcggcatggacccgatgacctttatccgccgcctcatcgcggcgagcagtgaggacattggcctggcgaacccgcaggcaatggtgcaagcggtgagtgcgcttgaagcctatcgcaataacggctggcccgaggccaaactgaacattgcacaggccattttgtttgctgtggaaagccccaaatcgaatgccgtatatacggcaatttcacgggccatgtcggctatggacgatatcaaatcggccgaggtgccactccatttgcgtgacgcacactacaaaggctcggaaaagctcggtcatgttggctatcaatatccacataattatccgaatcattatgtgaagcagcaatatttgcccgattcgatagcagaccaaaccttctatcaggctactgagcaggggaatgagtctaaaatcaggcaaaaccagcgctggcgggattcacagtcttaatatatgtgcgacttcatatacagagtgtgtacgaaatcgtcacgttacaccatgatcgtgcaaaagcgaagaaggggataagaagatgaaagacgtgctattcgttgccgcgggcggagcgcttggaacctctacccgttatggcctgcaatcgctgttgcctgcggcgggtgcggattttccacttggtgtgctgctaatcaattggatcggctgcctgtttcttggttggttctttacggtaaccttgcgatcgtggcggatcaagccgcgattgcgacttgccatcggaacaggctttacagggggctttaccaccttttccacttttgcagtagatgctgtacgcctcacggttcatgatcgtatgctgacggcagtgttgtacctgctgcttagtgtaggcggagggctgtttttgacatggacaggtatccgcctaggtacaaaaatgacgcaggctgctgctcccaaggaggaacgcttatgatctggtgggcggcggcaggcgggattatgggtacactggcgagatacgggcttggcatgtgggctggaaaaaggttcggtaccgtattcccgtgggggacgtggatcattaacgtcagcggttcattgctgctaggctggctctatggtcagtttacgcaaaaccatttgtctcctgcactttggatgctgctaggaacaggtttttgtggcggatacaccaccttttccacattcggctatgaatctcttcaactgatggagcgtaaagagtaccgacgcatggctatgtatgtactgtcctccgtcgtggtaggagttgtagctgcggctatcggatacagagtaagttaaactctatacattttcgaaataacacgtaaaaatgcaataaaaagcttccaatctcgactcaaggcattctcagccgtgatacggttttggaagcttagtgctgtacctatacagctaatttttatctcgttctttatacaattcaggtaaaagggattcaagttcaggtcttggttcaggatcagacaacttcatttcctccagcgtttggacggcaatccgtagcacagtataatccctataccaacggttgtctgaaggaacgacataccaaggagcttgtttggttgcacttagctctaatacatcctcataatactgggtatattgcttccaaaattttcgttcctgcaaatcacttggatcaagcttccagtttttgtgaggcttttcaattcgatcgatcagcttttctaactgaaattgctttgaaatatgtaaaaagattttaaccacctttacaccattatccagcaacaactgttcaaaatgtttgatatgcttaatattccgtttggcctgcttatcggatatctgtccgtgaacacgtgtaatcagcacatcctcataataagaacggttaaatgctgcaatatacccacgtcctggggtaacgctatgagcacgccacaagaaatcatgacttaattcctcagccgtaggtgatttaaagctgtggacagtcacccccgcagggttaaggttggaaaatacctgtttgatgacgccatctttgccgctgcaatccataccctgaaatacaaacaaaacggattgttttttctctgtaaataatttgctctgtaattccatgaagcgttccttcaattgatctgtttcctgtcggatttcttctttatttttgatattcttcgtatccttggggtcccattctttcaaagaaacttttttacccggtgtcaacattcctaatgaatcagacataaaggcacgctccttttcaattgaagtatgatcttgtctacatcatatacccaaatgaggatgttatcaaaagttacttatgtacggtctttattagcgatttttctactggtgacgcctctggtcacgaaattttcttcaggttcaataattaaaaagtcaagttttaagtctttaggcataggcaataaggttaatctttcttataacaattaggaattaagatggttctccataaatttgaagagtgttattatgtcatgacgaactctcaacagaggtataatatgacaactattaaagtaacacctgagcaacttatggctatctccaagcaatttgaacttgcacagcaaaaagtggcccgaatgaattacaatttaatgcaacaaatttcatctatggaacgattctgggatggggtgaccaaagagcagttctattatagattccaaacatctcagaagaatatgaatgactttgttacactaacagattctattgcaaaagaactgcgtcatcatgcggacaaattcagattagctgatttgctagaagcaggtaatattgatgcaagctgcttaccacctccacctaattcatgtgctatccctgctccagatactagaaatgctttagaaaaatcggcagatagtttggtagagcttggtgaggattttatggctgctgcggaggacaggtacgaaaaacgctatgactcggtaggtggatttttagactattggacgtttggaattccgaaaggtttgtatcaaggatatgcagagcgtgcatccaagcagtttgattcagggaatgatttttttaacttctggacttttggtgtacatggaacaatcagagaagcaatgtttcctacaaatgcatggtcaaaggaacattgggctaacatgatcggtacagcgggaatatttgggggagtcagttcagtaattaaacctaagattggattgggctcgtcaataaaatatgaggtgagatctggggctactattgaagttgaaggagcttcaaatcgattatctgatacgatgttaggtaagaatgatgctgatccatttagggatatatatggtcccggacgactttctcatccagaagagtggaatactattattaagaatacgcaaggagccggagtcgaagttaggattctagatagagacattatggcgtatgcacccaaaggatcaggaaagcctgggcaattgaatatatatgaggatgcttcaattagtgcactgcggcatgagtaccaacattttcttgatgataaagctaaaggatttcctagtttggatgtaacatatgaattcaaaaataggattatcatggaacttagagcctatatggtggagataaaagaagcagagaggattggaaataaggcacttgcagaacacctttggaacaattacagggatgaacggcagtatctcttagagaattatgggccagttaaactagattgatgggagataataaaatgaagctacttactttatcaaaagaaatacgagagggaaaaataggtgacgatcaattggtggaatgtttggatatccagcataatcaggtacagttgaatgcaatgagtcagatcgctaaaaagaaactatgcaatgagaaaataatcgaaaaattgaaacatattagccagttcagagaccctaaggtaaataagctttttggtattgatacgcttggacactatagtattgctgtgcttcgagtattgaacacttctgaatctataaaacagtacgagctgttaatgtctgaactcgacgattttgataaaggaatagttgaaagaattacagagggaataagttaatatttatgctagaagtccatttaaagagcagatcatgaactcttttcaatccattaactaaaaacatctttcattaaaaaagtcgccctcccaaatctggagagacgacttttttaattccctactatatcaatgaaaaatggtcattcatttaaactgtttcaggctgaagtttttcaaccttatcaatggttcctccacccagacagcgttccccatcataaaatacaacagcttgtccaggcgtaatggccttttgatgtacatcaaatatgacatgcacggttccatcggcaagccattgtaaagttacttgctgatcaggttggcgataacggaacttggctgtgcaacggaattcgccggacggacgagtatctgcgccttcaatccagttcacatctgttgcaatcaggctggtagaatacaggctgtggtgacgatcaccttgtaccacatatagaatattcttctccagatccttatccgctacaaaccacggttcacctgaacctgagccgccaatgcccaagccttgtcgttgacccagtgtatagtacatcagaccatcgtggcgtcctttgacttcaccagtagcgatatccaccatgtctccaccttttgcaggcagatatccactcagaaactccttgaaattacgctcgccgataaagcatacgcctgtgctgtctttcttcttggccgtatacagtcccgcagcttccgcaattttacgtacttctggttttggcagatgaccgatgggaaacatcgctcgggataactgtgtttggcttaatgcatttaggaaataagtctgatccttgttgctatccacacctcgcaacaaagtaaagtggccgtcttcttccacaacccgtgcataatgtccagtagcaacataatctgctcccaaatccagcgctttatttagaaactcgccgaacttaatttcacggttacacatgacatccgggttgggtgtgcgtccagctttatattcatcaagaaaataggagaatactttatcgaagtattctttctcaaaattgacggtatagtaaggaatgtcgatctgttcacagacgcggcgcacatcctccgcatcctcctcagccgtacaacggccaaattcatccgtgtcatcccagtttttcatgaagatgccgattacgtcatagccctgctccttcagcagcagcgcggtaacggatgagtcgacgccaccggacatcccgacgacgacacgggtttcatgattggctttagccatggtcatcacccaattctttcaatattgttgtagaacccacctattgtaacataaacgataataagatacgatgtttggacgatccaacgacacggcgaacgatggaagaaagctatataaaatgggctaaagctgttccaaatcgcccgaaagcaactttttttaagattgttaccgtaatgtttccctttacctgccctaatatgttaacataagctgagggttaggatcggaatagagaggtttacaacaccagttattccgcgtgtttaacggaattgttactataagtgaggtggcacaattgaaaatatcaacgaagggccgttacggcctgaccattatgatggaacttgcagccaggtttggcgaaggtccaacttctttgaaaagtattgccgaaaaaaatcagctgtcagagcattatctggaacagctcatcgcgcctttgcgtaatgcaggtttggtaaaaagtatccgtggtgcttacggcggttatattttggcgaatgaaccggcaggagtaacagcgggagacatcattcgtgtactggaaggtccgatttctccggtcgatttcacggaagaagacgatcctgcaaaacgtcagctgtggctgcgaattcgtgacagcatcgctgaagtgttggattcaactacacttaaggacttgatcacataccaagaacatgatgaattggacaattacatgttctatatttagccaagagatagttatatagccaaattgccttatgtggcaagggttttcgaggttatggattcgagcgagttacccgcaaattacccgcacttctaattgttgattgcccattcaaaatcatcagcaatcttgatttggcggttttttgtgacgtggagatagatcagttcggtaactttagaattgctcttgtgtccgattcgtgcctgaatctctggtagtccaactcgcggattagaagcgagtaacgatacatgggtatggcgcaaactgtgtggagtaagatttgttggcaactcggctttcgcaagaaccttcttcatatagtcgcccacccctgtaacttgaactggatatccgggataagtgggacaccagaaaacaaaattgtccttcgggttaaactttttggcagaaaggcgctcatccttttgccactctagcaataatccgaaagccttggctacggtatctccaaagcttacgatacgttcactttgttcattctttggagggataaaggaatacttaagaacacttgtaccgtatatctgtttgtttacatcaatcgttctgttctccatgtcaatatcttcccattgaagtcccgcggcttcgctgatccgtaagcctgtgtaagctagtacaatgaagaaagcccacatattggttgttgacatgaaccttgctaattgtagaaattttttcagttcgtccttctcaagaaatttggggaggacttgttttttttctccgattttacgcgctgtttttttctccttcggtataaccgcatcagcagtcggatcgaactcgatcaagcctttccgtttagcgtgttcaaacatgaggctagccgctgtgtgtatagtggtaatagtgctgcggctcttgccgtcctcttttagcttataaaggaaatcctgatattgactcacgctcacatctacgattgaaaatccaccaaattgttttaaaagaacccttagtccatactcacgattcttgatcgtgttgccagctggttctcgctccatgatgtatgctttaagccatgtctgactccaagtccttactgttaggtcgtctgtgtatttcaacttcttctgtatctttttcgcctcgatcaagattccaaaatcaactgcctcttgaattgtgtcaaacctaggcgactccatttctttgctgcttttcttttcctccccttcaatgaatttggtagtggggatgtaatagcgataagaatacttgccatcacgttcccttacatttgtcggtaactttcgcttcggggaacttcctttctttttcacaattatgactcctttctttttgaagttacagaacgtatgttccgtttttgggtatatttaaacagccttgcagctggaaagcacaaagttatatatgaaaattatgaagttgtttcgggatgccgcaatgcagtagataagattcgtgcgtttctccggctctggtttgtcggaatatgtcagtagttttatagcaaaaaagttggcttgccgttcgtatttcccgactgcaaaaaaggtgtgctcatctagccagaattggcttaaacctgagtgtagacggtcatgtccaagctcatgagcacatactacacgctgccattcatcagacagaccgtgagtccctttatcgaaaaaatccacatggcggattaatatgttaagccctttggcaatgacaaaagggtcatttgtcttgagtttacgaactagtttgtgaataatatcttcccaaatgtctacctattcttgatcgcccttgagttctgtatttttctttctaccttgagatttcttgttgctctctttgctttcccaaagaaggccggatagcatatccatcacccgttgacgtttttcaccttcaataggaaccccgtcgaacaaaatgggttggttttcttcgatcatgcgttttatatccgctatatctttagtggaccaatcaggaacgttgtgtgtaggctcgccttcaaaacctgaccgtccaagcagatagtccagagagaccccgaatatatctgcgatttgaagcgcaatttcggtaccgagccttttcttttcacgttccatctcatataagtatgttggggttatatttaacatttcagccaatttagggccactaatgcctttactctttcgtatttctctaatacggtttgacatgttcacgcctctttccgctatttgctctaatgttatcagctattagcttaaagttcaacaagcaaatagctctaaaaaggagtaaatgaaagaaaaatatagctaaatgctcaaatattctacaatatgcagctattagctcgattttggcggttgtttaaatatagctattagcttaatattgtcacaggaggtgatactggtgaatttttctaacacaataaccaagattttgaatcagcgagggttatcaccgtcagacttatctaggatgactggatactctcctcagtatgtgattgacattctaaaaggtaatcgccgttggaacgaaaccacccttagtaaagcttgcgaggcattagagttagaaatcagattggtttctataaaaaaaattagcagaaaggatgtgtaggagttggagaaaacgtcgatggcagcctttgataaaactatcctaagaccaacgttggatgttattgatgctgcaaattacttgaatgtcagcaaatacactgtgatcaatcgtatcaaacaaggccagttaaaagcctataaacaagggcgggtatggaaaattaaaagagaatggcttcttgaatatgaaaatgatctactcaaacaaattgcataatcgaaaggagaatcagattgcaaattgacgtcactaaaatcaaggtcagtgatcgtatccgcaaagattttggtggaattgaagaactggcccgagatatagaacaaaatggactcattaaccctattgtagtaacaccagattatcagcttattgccggagagcggcgtttgagagcgcatcagttccttggacgctcagaagtgacagtaagaattatggaaatcaaagactttgaacatcagcttcagcttgagatttctgaaaatgaacatcgtaaagagttcactttttctgaacgagtagaatgggcgcggcgacttgaagaggccgaacgtttgaaagccaaagagcgcatggctggaggtacggaaaattttcctgaccaacctaccgggcaagtacgagacattgtagcggatcaagcagggttcggctctggcagacagtacgataaggcgaagttcatcgctgaaaatgccacaccggagattatccagcagcttgatgaaggattgattagcactcataaagcgttcgtggagacaaaaacccgattggaggccgctgtccgtgaagccgaagagagagcggagcaagcagaacttgacaagcttgagctgcaaagacagtacaaggatgccattcctgcggatcaacttgaggatgccgtgtctgccgcagtagagcggcatgaggaagaaaccaccgtgttcatccgacagaaggaaaaagaagctgaagcacaactcaagcagcgtgacgaatactggaaaggcaagcttaaagaagatttggaggctgagcgccttaaaatagaacagttgcgaggtggctatcaaagagctaaggaagaacttgagactatcaagctccagcaaccagacgacttcgacgaacagcaggcagcagctcagatgaagaaacttcgttttgaggctgatagcaatacgattcaagtcagcatccatgtaaagcagtttctacaaaaggtcggaattacttcattcatgctgggtgcaataggtagtgctagtagctctgaaaagaagcggttgtccgaaagcttggacatgctggaagcctttgttgaacagattcgaccagccgtgaacggcaggaaggcggtagagaaatgacattaattaatcctaatcagcagcctgattttttgtctgttgtcgaaaagcagatgcagcttacggaggctcaaggcatggcaattcgtggccttgtggacggtatcaagcaaatgcatttggatgttactgaaaaagtggaagaagttcagatgatggttcaagaggttcgggatagcgtgacgcttacagatgctgaatgctatcagttacaggatgcagtaagaatcaggtccaacgcactcacgaaagaccgttacaaggaaacagacggcaagtttaatgaaacggttgggaaataccgtcggatgatctggagcaagctgaaaatcatgttcagtgtggcgaagtacagtcacatccggcgtatagattatgccgatgcgatttattttgttcaagatttccgacctgaagattacatctaaggaggctttggttatgactctttcagagttggctcgaatatggtttggtaatccattgcagcatgccattatcgtccgtaatatccgcagaaaaaaggtattatgagcaattcattaaaaataatctattcggttcctgttgtaaatgacgaaggtgataagttttttatagctaaagaagcggagtcccttatatttgcagtattgaaagttcatcggttcttaaattgccagcattcagttgatttagaactgctagagttaaccgagcaagacaagaaaaaactcgctctacaaaaggaaaaagaacttactgagcaaaaacttcaaggcatttataaaactcaatatgccattacggatagtctatggcctaatcatgtgtgcatccagaaaatgaaacctttgaatgaacaagaaagacgtttgaaagctaaaatatccgaacttgaagcggagatatggagctgagagagttggacgagcataaacaatctagggtgcttagagcacaattacgtgagttatatgaggacagcattgacgctgtcaaattcggattaccgactgatgacattcatgctcaaatagatttgcttactgctgaattaagtgaacttgaggaatttaaaaatgaagaatatgaagggctagaggctcctaaggaatcaggatacaagatatccggtaaaggaataggttgctgcaatcattgtggtaaagagatattcgaaggtcagaaacaccccgttccaaatgaagaaggacttttctgtaattactattgccgtaagttataccgcaaaagaaaagacagagaagccctgacaaacaatcgtgctaccaacacgatctaattaaatacaactagcggaattatatcatatcttcaatttattgcaaatgtccatagaaaggaatggctgcattgtctctacaaaaacaatatacgctcggagagctttatagtcttgcggatcaatgcagccatgattaccctgctaccctggctcgcaagattgaattgttgacagaagtccaggttatcttagggcgtaaggctgctgaggccgtaagagaatataagcgcatctacgctgagagaaagcgtgtttatgcagaagcgtatattgcggcagagaatcttagggagcagcgagcagagttggcggtaatcaaacttcgcaaccaagaagcagatgcagaagctgataaggtccgctggagtaatgctgtggaaagtaatgaccaggttataaactctttaaaatacagcctaaaggttctgctagcggagtttggaaacaacgccagcgcaaacaggtaggtttatgattcaaaagctgagaagaggttgaaacatggcagaaataaaatggatcaagctcagtactggcatgtttgacgacgaaaaaattaaaatcatcgaagatatgcccgaagctgacacgatcattgttatatggctcaaattaatgactatgacaggccgatcaaatatgggcggttatattatgctgacagaatccattccttacacagaggatatgttgatttcagtgattaagaggccgttacctgtcataaaaatggctctatctatttttgagagatttggaatgttggaaatatctgaacaaggagctttcttccttccgaattgggaaaagcaccagaatacagaatctcttcaaaaggtgcgagagtacgagcgaaaacgaaaagctgaacaaagggctaaacgaaaacagttacagcttgctgaacctagtcccggaaatgtcccggacagtcccggtgatgtcacgcccctagaagtaagaagtaagactaaagaaaaagaaagtagttgttgtttaacgcccgagactgaaatcaaattcgaagatgaggggataccgttcacccgacaggatgctgttcctgtcactcctgaaacagatgccgactctggacaggatgaaatatcatcttctgatatcgactatcacaatgccgttgccgacaagtacctacagcgcagggggaagggattatacattacagcagctgacgaaacgagcattgatgaattgctagccgctggtgtaccgcttcaaaccgctttggacggaattgatcagtcctttgacaaatttaaacctaagcataagcgcgatgggatacggagtttgagttactgtgcgactattattttctccttacacgccttacgagaagatattggtaagggggagaggaccgaaagtgctttgccttgtaagcctgagtcacaaatagatgtgccaccaagcgaatacaccgagtcggacattcaaagcatgcttgcaaaactaagggctaaacagggaggttgatgccacatggagagcttcggcaaagaactaaaggcattaatacccgctggttttgctaaaaggcaggctgcggtgctggaacgcctagcgaaccatcctgaggttcagcgattaaaaagtgaatttcctgaccgaaccgaggatctgaccgaaccaaaacgatatagagatctgtcacagcatatatcctattgcgataaatgcagcgagtgtccaggtttgcttgcttgccagaacgaacagaagggccatacaagtgttgcagaacctagcccgaccaaaggtgatgaactggtcttccgacttcaaaaatgcccattgctggtcactcacgaaagagagcaaggaataggtgagaggatcaggagccattacatcccggctcacatcctgaatgccaccttcgaagacattgaacctgacccgcagcggatatctgcaattgcagcggcaataagcttctgtgatgaatttgttcccggagaaacgacaacaggactatacttttacggtcaaatgggtgtaggcaaaagcaggatcgttggagccattgcccaagagttggctaagcgtgacgtaagcgtactgatggtctatgttcctgattttctactggagatcaaggatgcgattggatcaaagacagagagcgttgaaagcaagcttgatgctttgaggacagttcctgtgttgatattggacgatattggagcagagtcattaacgacttggacaagggatgaagttttaggacctatacttcagcgacgtatggaacgcctaacgacgatctacacatctaatttaacaatgagtgagttgaaacagcacttggcgaatgtgaaagatagcaagccgagcgaacagaaacagaatgacaaaaaagcggcccggataattgagcgaatagaaccatttgtaaaaatactgccagtaggcggacggaatagacgtagggggtaaacatatgtgcagaacatgtgggggcaataaggtggcgtatcagtttctcggctccatgatggcattggggccatgtccagaatgcaacccaaatgctaagaaggaagcggtaaaagaggaggtcagagcttatgaatatagtagtggacagcgctctattagctgaggcattggaagatgccagtaaggcgatttcaacaaaagtaataatcccaatattgagttgctttttgatcgaagcaacggaggacagggtaaccgttactggtaccgatgaccgagcaactatccaatcatttgtcgaggaaaacatagacatcaaagagactggttccgcggcgctgcccaaagttctattggatattctccagaagatcaatgggaaaatagaactgcaagttaaaaatggggatcaagtcaccataaagtcacggaataaggagattgagattactggaatgcctccagaagaatatcctgctcctccagagataaatgaaaatgagtttgttgagattaagggaaaagacttaaaaaatctgatcaaaaagacagttttcgcggctgatatagacggaaaatcattgcctatcattacaggggtaaacgttatccttcagaccgggaaaattcaaatggtggcaacgaaccgacaccgactggcccatgccgaaagagaatttgatataggaaatatcggcacggctgttattgaagctagaggaataattgaattacagaagatcgttaatgacaacgatgaagtagaattcggtttttccaagtcttctggcggagatgtgatatatgcgttcgcacgaacagaaaggtttatattttattctcgtgtcctagaaggtatttatcctgatacaactcatgctatggctattaaatcagttaccgaaataactgttaaccgaaaagaactgatcgaatcattggagcttattttcactctggcgaaagaggaaaaaaataacgctgtcacattctctgtttcagaaaaagaaattaacattcgaggtaaggggaaggaaacgggcaaggcaacagaaagcataacaccaatcagtttcaacggagaaaatttcaacctgacgttgaatgcaaaatatgtgctggatgcattgaaggtcttagaaaacgatgtaattacactcgggtacactggttctttaaagcctctcactcttcggagtgacgagtccagtttctacattgttcttccttatagggtggctggataagatgagtaaatataatgccaaaaaggtcattgtcacggaggacggaacgttatttgaggaatggattgtaaaaaggtatgaactagatgtgataggtactctctttgatagcaaagcagagggagagtattgccaagaactccttcgtcagcgcaagtatggagaaatcaaagacttcaagtgccaccctgtatttatactacaggagaaaccaaaagtgacctacattgctgattttctggtcactaatctggacgatactcagcgagtaatagatatcaagggtgtggagacatcgacattccgtgtcaaattgaaattattccaagcaaaatatccgactttacctatagatatactcactaaaaaacgaggagaatttattccgatcaagcagttcaagaaagaaaaagcggatcggaaacgagctatcaataaacttttaaaacaagcagaaggagagagggaaaatgtcaggactagccggaatgcaagtaaaattcaccgtattaaaaaatgaggatatcaataaataccttgatgaacgtgagaaaagtgatctatctcgtattttgtggaaggttcaggagctgcggcttctggatggaaagcctccacttaatacgtatctggtagttaacacagacgaaccatatgccactgatattgttcgtatcatgcaaaccaataaccattggggtccggtgagtgatcctaatcaggcagagatggagtattacggtggtacgcttactctaccgagaacggaggaggaaattaaatgaagcgctctcaaaatgaaattaaacgtccggaagtaacacagcggatcatagaattgctggacaagcaaaatgagaaaggtcttaagaaatacggaacaactatagaccaggtatccgatcagtcatatgactggaagttgatggcgatggaggagatggttgaccttattcagtatcagcaaaaggaaatcatgcgactcgaaaggcttcttaatccgatctaagcgggaaacaaaaaggagcatagaggttatttatcctcttgctccgtccttaactctattaattggtttgcatccgttaaaccgaaagcatctgctatcttctctaagtggtcacgatttatagaacgcctcatattattgcatatttcacttatagcagcagtacggagattcgttttctctgctaaatatttttgagtccaaccacgttcatcaagtaaatcttggacttttatatatatcgtggacatcaataccgcacctccagtcaaaccgatattatcataaagttgtgaattacgcaatttcgtattcttttattgacattacgaaattgcgtaattataatcaagatatgaaataatgaagaagcgaaataacgtaatgataattgtatctgcaaagatgcaaccttggagggggcaggtggttggggtgaacaagaacatattgaagtggctggataaaaacattgaagggtatgaaatccatgattcagagggggataaaaaggtcattttcataccggtacgatattgggttcaagcgatgaaatacttcaaaaaatatgacgttcgttgggagtaccgagcaaactatacatgggttgcaattttcataaccgcctaatgattcgggatagttacccgatgaaatacattccgcttcggcggtgtatagcgataagttgtatataaaaaaagtggaggaactatccaatgagaaaaacatacaagcaatgggtattctggcaagatgggttttgggaattcgagtggagtttcatcctactcacaatttggataaaagaattaaaaactcgtctgagcgagtataaacaggtcattaagctcagagcgttcaccgggataatccggtgaggttggcacaagccaagtgatcagttaaggaaacttttcctacgctgaatgattcgtttacgcaacactgtacccaaaagagcaacattgtactggaaccaaaaacgtaatggaggcatggtgtatgacagaacaagaaatggatgagttcactacagcattggtagaacgttacgtggatatacaaaagtttgcttcgtgtaacaatgaattattaaacatatggaatgaggctattgataccttaccacctgagataaaacataattttgaagaaaaatataatcgccttgcaagggagagtagttcgtgaaaaagctcgacttgaacaagcttgatgaagaacctattgaagtacagcaggccgtggccttctacgcatcacatacaataaatgaagtgcgcataacaacgaaagaaaggtatgaatattattccattttagaggaagctggcttgcttgaacccctaaaatccgtagtggagccgtagcggtttaggctcaaaatataagcatgagcacaggaaatacgaatcaatctgttggaaaggtggcgagagggaatgtctcatcaaacgttctggaagcctgagaaaaaagtcaaagaaaagaaaacgtatagcagccttggacaacggaaaaaggataaaaaacctgttcctgaatggaagaaagatattctctctcatcaccagtcaagacctaacaccaaggagcgcagtgaatttccaaaggatgtaattgcggaactgatagctgattcaaacggaatctgtgaatgttgcaaagcggccgaagccacgactactcatcacgtttatccgcgcgggagaaaaggacgaggagtaaagacaaacggcctgcggctctgctggccttgccatgatcgaatacaaataaatgaagaactccttcaattttggatatcggcattccgtgataaatacggcgattacttttggttcgatgaacaggattgggaagagcataaccgtaaactggcggcgcggcaacgtgtggaattcgagaaaaaagaacgcttggagagcataaagccagtcgttgaactgattacttcagcggcaggccgaactttgaaggctaaggaagtacgtttgctggaagctatggatgataaagaaatgcttgtttttacaaatatgatatctgatgccttgaacaattttagtaagccagctccatcttatggttacggagaacgttttgaggattaaatatatagcccctagggcagagaggacataacaatggaaaaagcaattttaacccaagcgcaggcggaggcaattgattcaattcaagctgcatatcattggacggcagagtcattcatccgcaaccatgcagcagatccgcaccaatgggtagagccttgtgatgtgctcaacggagttcctttggataccattatccgtgcgctttatatcggttatgaagtcgaactgacgatagaggaaaagctgttagaaatgtatagagaagggttaccatgtccaacgacgcctactgaagattcggcttttcgcgaaggtatgaaaaaggcatgtgaaatagctggaattaaggtcaaatggtccagaaattaggcccaggggataagaaggagggaacagccctccataagggggagagacacatatgcgtaaattaagacaagatgaacgagtttcaggaatgtatagagactatctttctggcatgagtttatctgaggtagccgctaagtacagaataacgaggcaatcggtgtacaaatgtttttcgagacgatcgttgaaactcagaaaaagacctcaatctaaaaattatgttgaattcaacggcagtagatatacaaaaggtacattgggctattggagaaaaacagtaggtgatagaagccttttgcatagagatgtatgggtctatcacaaaggtgaaataccagatggttgggatatacaccacattgatgaagacaaggacaataacgacatatccaattttgaatgtctgcctaaagcagagcatacaagacaatattcacctggtcataatcagtat

SEQ ID NO: 55 - DNA, 1380 bp, Unknown
  Kingdom: Bacteria, Phylum: Firmicutes, Class: Bacilli, Order: Bacillales, Family: Paenibacillaceae, Genus: Paenibacillus
cacctggtcataatcagtatacgccaaaggagttgaggaaacgtgcgaacgcttgatctgttcgcggggatagggggaattactcttgcggccgaatgggcaggaatgactccagcagcgttttgcgaaattgaaccattccctcaaaaagttttaaagaaacattggcctgacgtgcctatttttgaagatgtcagaacactaacaaaagaaaaattgatagagaagggagtgatgtccgatgacgatccagccagaacaattgaccttatttccgctggatatccttgaccatgccaacccttttccaatgccgggaaacgaagaggcgaggaagatgaccgtcacctctggccggaagttgctagattactatcggaaatccggccccgttggttccttggtgaaaatgttgctgggcacatcacattgggactcgacgttgtgctttctgacctggaagggctcggctacaccgcacaagcgtttgttattccgtctgcagccgtcggtgccccgcatcgcagagacagagtcttcattgtggcccacgccgactgcatcggatgtgtggaaagggcatctaaaaagcactcaacagaagtcggggagcagtcacagtttggatttgccttctgcaataaaaatgtggcctactccagcagcccaggacagcaagaacgccacgctaccgtcatcacagatagagcgggatacagttccgggggcgctaatgagggaaggtcacacaggacagctcaatccggactgggtagaatgcttgatgggctttcccgaaaactggacgaacatagatggcccgcagcattagggcaggaacaatacgattgggagccaccacgggtagcaactggtattaaaaatcgcgttggtcggctaaaagccttgggcaatgcagttaatccgcgtcaggtttacccggtgttggcagccataaaagcaataaacgacagtctataagggggagagacacaatgcatcccctataccaaaggagagatatacagatggcaactggacaagtaaaccctgatctatacgaacttttgagagagcgtgaaactggactgtatacgcaaaacttcgaaaagaacgaaacagtatttgcatatgtccatttagactacagtgacgttgcggattttgttgagttggtcggatacgattttttatgtgaaggcggatacgacgccaagatttgcactacttccgtttgtattgaaatcaacgatgttatagaacgttttgggcatgatctgtccgactacaaaaattgctttgatgaagacctgtggaaggatcacgagaaaaaaattgcaattatggaggcataacagcctcttaccctatacccctata

SEQ ID NO: 56 - DNA, 625 bp, Unknown
  Kingdom: Bacteria, Phylum: Firmicutes, Class: Bacilli, Order: Bacillales, Family: Paenibacillaceae, Genus: Paenibacillus
catctatatatcctcccttagtgggtgtaggtcctacaccctgtattggtttaagttacaaaaggctcaatagcgagcgctataaagactaagattgttactacgataagtccccattgccaccaactaaaaggattaaattcattcaaatttatcgtcctccctgtataggtttaatcctgactggataatgtcatataagcagcctctgccctctctcgggggctgtagcagctccgggttatcgtgtatgttgcctattaccgtaatctctgccgattcgctgaacagataatctccgtcctttccgtccaagtcctcaagcagatacgatccgtcaatgtactttacaatccccgtccgtgtgccatgcagcgggaacagcatctctttctttttggatatatcatcctcataaatttcctgaccatctggaaactctgctgtacttttcgagtcctttaatcccgtgtactcacctactgattcgggatgcacttcatcagcgctaaaattgtccccgattcgttttacgatccaagctttatccccatcaaatacaggcacaccataaatccattcgccgtaattgatctttttaccacggaatttaatatctctcatg

SEQ ID NO: 57 - DNA, 32706 bp, Unknown
  Kingdom: Bacteria, Phylum: Firmicutes, Class: Bacilli, Order: Bacillales, Family: Paenibacillaceae, Genus: Paenibacillus
aacaaatggggtgcagttcagttgctcccatggctgcttttttgggctttattaacgcttggaactgctgcgaacaggacgcttgccatggctgcgagtatgacagcaaggttctccaggatcctttatactcaccggaaatacgtgatgaggcacaggtacaatgtgcgtctgatttacaatttcaatcggatgaaccacaggcacgacttgtgggaaaaattgatgatttacaaattggatcggtgggcacacgatcgggtcgtaagggcaatgactcataatgtgcaactcctttcggtgaattagtacagcatattaagaaggcaggtgctgtgcttggatgtttaccccctaatacaaatatcccttataaaataggcttccgttcaacaatgaccgaacgatcaagcagttcacccaacaaacggcacagtttgtgaagacctgttttaagtgcttccttgtccgcatacgaaaaagaaatacggatatgattactgttcataccacctgcatagcatactgccccaggtaaaaaggaaacgccttctcggtcagccagccgctccaattctggaatatcaacattaggaggaagcttaatccacacatttaagccgccttcgggagcataccagctgacctctggcggagcatagcgctggagcgtgtgcaatgcgactgtcaaccgatcccgcatttgttcccgcaaccaaacaaggtgctgatcaagtcggttcttgataaagggcagtagcgctttttgcgttaatagagggctccccaaatccgtagtagacttggcagccaccaaacgatccattacactgcccgtggccgctacacaagctatacggcagccgggagcaacggttttgctaaagcttttgatatatatcacatgtccggactgatcatgcgccttgatagagagtggcggctttgttttataataaaggtcggaaaatggatcatcttcaacaatgagacaatgataactttgagctagatccagtaattgtgtgcgtctggccatcgttaaagttactccggtaggattatgaaaagtgggtatcgtgtagatcagttttgggggatgagtgtcgcaaagacgtgtgaggatatcgatccgcatgccctgctcatccatcggaatcataattactttggcaccacgactggtaaacacatcaatggccccggtatatgtaggagcctccatgtagacaacatctccagaaccaacaaaagtacgtgccaccaagtcaatcccctgttgggcaccactggttacgagtagctgttctgccactgtgcatatactgcgttcgttcaagtgatctacaaacacttccctcagcgctaaatcaccttcaaaagtcccatatgctgccattgcatcgggatttccagaggatagacgttgagtatcagcaatgatttcgcgtgtaggaagaagctccggttgaattgctgctatatgaaaagaatagggaacctgtctgctatggttaaagtttctccatagctgtgcgcgcggcaaataatcgatcagcgacatttgccatgacaaatcctgcgctccctcaccttgaacagctaccgaaggctccgctacatagcaaccttttccctgtgtacaggttaccaaattaatagactccagctcagcatacgccttgcttacagttacgggacttaccgcaagtaggctggacagatgacggacagacggaagctttgtgccctgaggcagcaatccagactggatgcgatctgctaatgttttggcaatctgtaaatataatttgacactgctattgcggctgagatcaatatgcatcggaactgtccccccaaaaaatcaactgttacatttagacgtttactgttatacttcattatcgatataatacaacaaatttcatagtacagtatagaacacaggagatgattggattggaacacaaattttcgggtatggctcgtactcagggctcgtccatggtaagggacattttaaagctgacacagggaacagatgtgttatctctggcaggcggccttcctgccgatgcctttttccccatcgaagctgttgctaaagcctatgagcgggtatttcgcctcggcggtactaccgctcttcaatacggcctaaccgagggctacattcctctacgggaacgtcttgcagcaatcatgtcatcccaaggcatctccgtcaacagagataatatcattatgacgacgggttcacagcagaccattgatctggtttcgcgtgtgttgctcgatccgcaggatactgtattggtggagtcccctacttatttggcagctcttcaggtatttaattcctatggtgccaacattgtaagtgtagatacagactctaacggtatgcaattagaagatcttgaagccaagatcaaaaaacatcagcctaaattcgtgtatgtcatccccaccttctccaacccggcaggaagtgtttggagtatggaacgcagaacaggcgttgttgaactatgccgtaaatacggcactttgatttttgaagatgatccttacggacgtcttaaatttgacgaaaaccttaactttccatcccttttctcaattgatcaacagttaggtggagacagtcatgtaatgtacacttctacattctctaaaactgtcgctccaggtgttcgctctggatggttggtagccgatcaagctatcgtcgttaaagtcgcgaatgccaaacaatctgccgatctgcactccagcagtattgatcaacgtgctttgaatgagttattggacttttttgacttggacggacatattcgtaccgtgtccgctgagtaccattctcgtatgctacgtctcacgtcgctaatgaaagaacgccaatgggaaggaattacctggaatgatgcacttggcggtatgtttatgtgggttaccctacctgagggcttccgttctgaccggttgctgcaactcgcaattcaggaaggagtcgcatttgtgcctggacaagtcttctatgctgacctgagcggcagcaaccatatgcgaatcaacttcacgcataccgatccttccctgcttccaaaagcagttgaccgattggatcgagcactgaagatgtacacagaggaaagtgtggtaaaaagcgtacgctgatggagttggcagaacacgtcgtgaggcccgcttcacgttgtttttacgattgctgttatccctgattcgtttggattttgaatagtggtggaatctgggacaaaagccgcacgcctcgcttctacagattcaaatgcgttgctacgcttactacgtgcctcttcctcgcacgtttttacggtagagggagtaaaaattaaaatgaaagcctccagtaattatgcttgggggcttcattctaaaaatgcactatttctgcgcaaatacggtatgttaaaaagggtgtgtcatgattcccacaggaatatgacacaccctttttaattcaataaatacatttggattaaaggctttcatgcaaacaggtcatttacaaaagttaaattcatacattttaaggtgttgcagtggggaaagttttccgtaagccgggttctgtgctattcgtggtacagacgggaactaccctcccactacaagcgacaatcatctatctaggccgaacattgctatccagctccagcgaccaacctagacacgcctcgggctaaggctgcttcgcgaagaagctgtgtcccattaggtcttgctccagatggggtttaccaggaacgaagtcaccagcgttcctcggggtctcttacacctcggttccatccttgcctgtgccgcaagcggccatcggcggtccatttctgtggcactatccttcaactcgcgctgactggacgttatccagcatcctgccctatggagcccggactttcctctcgcggcttacgccgccagcgattgtctgtcaaactttccgaacaacattacatagtatacagggaacgcgcgcacgttacaaccctgaaaatattgtaaaaagtagaaagcacctttattttctcatagacgttgaggttttacaaaaattgaaaaggttcggtttccacctgagatacatgtacttccgttgagtatcgaccttctgccaagcgtttacgcatccactctgcagttttaggcttcataatcttttcagcgttatgtcctgggtcaataatagcaatccccgccataagggcatcctgagccgtgtgatagtcaatatcccccgtgactaatacatcagcccccttaaaaagcgacttgttcacataacggctgccagagcccccaagcacggctgcctttttgatcgtacgatctaagtcgcccaccacacgtacatgctcgacgttgaaaccgtttttcacaacatcgacaaactcacgtaacgtgcaggcttccttaagcttgccgacccgccccaaaccaaagctacggccttgcaaatccatatggtacaggtcataagccacctcttcataaggatgagccttcagcatcgcttgaacaactttattacgtataccctgcggtacaatggtctcaatacgaacctcttcactacgttccattttacccggctcacccaaaaacggctgtgtgccttcacccggcacaaaagttccgtagccatcaatgttaaagctgcaatggctgtagttgccaatatgtccagctccagctcccagtacggcatccagtacccgttgatgatgtgttttgggtacgaaaacgacaagcttgaacaattgctcggtgtgaacatcctccagcgtaccttcactttgaatacccagtgcttccgccatccagtcattcatgccgttctcagccgtatccagattcgtatgactgatgtagacagcaatatcattcttgatcagcttttcatacaatctgcccgcaggctgatccgtgttcaaagctttaagtgggcggaatataatcgcatgatgcgcaataatgaggtctgcttttatgcggattgcctcttcgacaacctcatcattaacatccagggctactaatatgcttttgatttccttttgcagactacccagctgaagcccgattctatcgtctggaactgccaagtattttggagccagctgctccatatagctaattactgtctgtcctttggcaaacatgcaagtacctcctctagctgttcaatttgcttgcgcaattgttcccgcttatgctgtgcggattcctgatctgaccgtgccacttgtgccagcacatcctgaagcttgcgaatctccaatttccatttataaaaaaagatttcattcggtgctttaaccaatagcggcccgagttgcattaacaaatcctgtgtcagtaccagcgaactatcgggaagtttccatggttgatacagctcatcctgtttcagtgggcttaccgaatcaggtactgccgtcagaatctcatatatttttccatcttcttccataatatgttcacttgttagtacccattgatgttcaatgagccatcggcgtaaaatatcctcgcctacgttaggctgtagaacaagttgttttattgaaacaagcttgtctttcccttgctctagaatggaagcgatcaaggcaccacccatgccggctattgtaataacatcaacctcattggccttaattacagccaagccatctccctttctaaccgcaatgcgatcagtaagacctgcttcggccacttgcttttgagccgcacgcaacggcccatcgttgacttcacccgccacggcttgcggtactctgccaccacgcactgcagccacagggagcagtccatgatccgagccaatatccgcaagtctgctcccggcaggaatttgttccataatatattgtaatcgttgagaaattttcatgtcgtcacccacgtaatccatttttttcgagtccaaaataaaatccctacaacaaatgccaacttcagtatgctgtaaaacaccacatcacccgctgcttgatggcgcaggataatcatgtctgcttcagccatgaatgctagtgtcatgcctatagcgaaataaaccaaagcgagacgcggaaagcggcgatgtacccaccagcttaaccagatcaacaatactgcgtgcaaaatccaaaatgcctcaagcatcattaaagttgctgtaggccagtagcggcctataaggaccgcgtacactaaaagcagcccagcaagaccacagtaatgaagtaagttgatccgcaaagttaatcccacaagacaccatactacaccgcataggcctacgagaaaaagaaaccaaaccttagcttcaccttgatggagctgaatgatccacacacccgaacccagcataatcgcactgcctaaagtgctcaacatcgcactcatactcttttcggaagaccgccaaaatgcggccactccatagcaaatcgtagtaactgcacttgccgagaatatttgcattgccaacggaaaagcggtaaaataaaaaccgatcaaacaaatgcaggaaataatgacaaaaccaagaagccaggcgatcccatgcccgtgtctaagatatgtaagcagcccggtgttgttacggttctggctctgcgacggatcttcgtcctcccgatacaggttagacaaaaaatcgcaatattgctcagggagcagccgacttcgccgccaatgctcaatttcatgtaacagtattgcccgttttttctcctggtccaagcttcttcccctccaccaaggctgccatgagataaaaaaagaccccctgcgcgcttcaagccgcagaaggtccgcaatgttacgcttctattcgaggaaatccttcagtcgcttactgcggcttggatggcgcaacttacgcagcgctttggcctcaatctgacgaatacgttcacgtgtaacaccgaacactttacccacttcttcaagagttctggttcttccgtcgtccaaaccaaagcggagacgcaaaacattctcttcccgttcggtcaacgtatccagtacatcctcaagctgttccttcagaagttcataggcagccgcatctgcaggcgccaatgcttcctgatcctcaatgaaatcccccagatgtgagtcatcctcttcaccaattggtgtttccaatgaaaccggttcttgggcaattttcataatctcccgtactttttccacgctcagctccatctcggcagccacttcttccggcgtaggttcgcgccccagctcttgcaacagttgacgcgatacgcgaatcagcttgttgatcgtttccaccatatgcactggaatacggatcgttctcgcctgatcggctattgcgcgcgtaatggcctgacgaatccaccaggttgcatacgtactgaatttaaagcctttttcgtaatcaaatttttctactgccttaatcaaacccatattaccttcctgaatcagatccaggaaaagcattccgcgaccaacataacgtttggcaatacttacaaccagacgcaagttcgcttcggccaaccgacgcttagcttcttcatcgccgttattgatccgtttggcaagctccacctcatcatcagcagaaagcaacggtacacgaccgatttccttcaagtacatccggaccgggtcattaattttaataccgggaggcaggctcagatcgtcatcgaaattaaaatcatccccatcattgttttccgggtcgtcattttgacgcaatctggtaacttcttcgtcgttgtcattcacaacctcaatccccaagtcacccagctgctcataaaactcatccatttgctcggggtcctgatcaaacggcgacagtttttccatgatatctttgtagttcagagaggaactttttttacccaactcaatcagttgatctttaacctgatccagtgttagttccgtctccagttcagtatgctgatcattcgccatctttcgactccctcctccctagaaacatccgacctctgtgtgttcattgtctctctagggctataatctcacttgcaatttgtgctgcgcgcaaaaagtcacctaagcgctcagcggctctcatttcttcccttttcaaatccagttgctcctgcaatggaaattttcgcacttgatgaatataatcatccaaaatgtgcggtgcccatacgcctggagcatccatcatcatgatcgaacttacgttcttctccagtcggtcgtcttgcaaagatgaaataaaacggcttgtatccggtaacttcccttgcgcgtaataggcatatagataagcagcaattgctgcatgatcctcaatattaaaggcgtcgcccagatgcttttctacatactctgcagcttctaaatcctgcatcatccagtgaagcagcctgcgttcagccacatggtaagctggcaacagattaggtgtggagacctgcccttttttatgcctaccattattccacccattttcgttattatccccaaagttctgttttttttgcagggattgacggagtaaattgcattcttgcttcaaggtttcaaaatccaccttgacttcggatgatacttcgcgcagatacacttcccgctcggtcggggatgacagaggtgcaatgacatttaatgcttcgcgggaatacgcgattcttccttcttcctcttgcagtatatggttttttttcagatatataagcttaaatttcaccgttgaaacagcactttcgataatttggcgctggaatcgttcgccgccgtattgccggataaaatcatccgggtccataccgtcactgaccagcgctactttcacgtgaagccccgcattttccaacagcggaaaatttttaagcgcagcagcttgtcctgcccggtcaccatcataacaaataataacctcgtcgcacagtccttttaacatcgtggcatggtgctccgttagagcagtgcccatagcggccaccccattttgtacgccagcttcccacgccgagataacatcaccatagccttcaaaaagaacactttggcgtagcttgcgaattgaggttttagcatgatggagattgtacagcgttcggctcttgttgaatagcttggtctccggtgaattcaaatacttcggctgtccctcaccaagtatacggcctgcaaaggcaataacttttccgttgcgattccaaatgggaaacatgatacgatctctgaatcgatccacatatccatcaccctcatgccggggagaaataagccctcccttttccatctccacgggatcaaaagaacgcttctccagaaactgaacgatcgtatcccatcggttgggtgcatagccaatttgaaattgatcaatgatcttgtcactgaatccccgtgagcgcaagtattccatggctggtttgccgtgttccgtatttttaagcaaaaaatggtacatcttagaagttaactcatacgcttgcaacagcctgtccaactcaggatgctgatgcgatgaatcacgtccctgccattcgccgagcgggatatgactttcttctgccattgtcctgacagcttcgggaaaggatagtccttcgatttccatcataaatttgatggcattgcctcccgcgccgcagccgtagcagtaaaaaatctgacgatccggtgtcacggtgaatgaaggggttttttcggaatgaaaaggacagaggcctttcatatatttcccctgcttggtcaaatgcacgtacttgcttaccgtatctacaatatcatgatgttgtaaaaccgactcaatgatatcgtccggtatgttgccttgtccggcactcatattaaccaccttcatctctttagcacgtaaatataattcgataccgttactcattctcctgcaagcgaagtaaaagttttgtcagtttatgttgaaaaacttcacgatcctctaatgtaaacggtttaggaccttttccataacgtccttttttccgttctttggcagaagtatgacgtcggtcaagcatgaaatctatcgaatcgtttcgatacatagctccgcgaaaagacatcacttcacaaccttttgccaaggcaagtgcagcaagaccataatcattggtggttacaatatctccgcggcggatatgattggcaatatagagatcggcactttggtcgcttcggtctactttaacgacgcttacgcctttgctgccctgaatgagatgatcatatgaagataccataataacctcaatatgaaaacgggaagctatctccgcaatttcacttttaacaggacaagcgtccccgtcaacaacgatccgcacatccagtaaagttccggttccctccatgagcatcccccatctccatccgcattcgagtaaaatacggaacggctgcaagattactcttacaccgttccgtatatttatacccattttttcaagttgttcatactaccacaactgacgtttaaactacaagcttggaaaaatcggcaaaacgcttcagttctgagtcaatagcagccagcaatgccaaacgattattacgaacagcatcatcctcagccataaccataacggaatcaaagaatgccgtcaccgcaggggtaatagatgaagcaagcgctaacgctcgtgtcgcatcaccttcctgtaaagctacgctataagattcataagcgctagaccatgcttcgtaaagcgttttttcgccttgctccgtaaactcactcgtattaactaacttatgcactgctttagcagccagattgcctatacgattaaaggattcaactgttgctttgaatacctcacctgtttgtacagcagtcattaatgcagttccgcggttaacaacggaagcaacatcgtcatatccagctgcaagcacagcatccacaacgtcatagcgaagtgtctcagacaatagtttcttcacccgtaatccgaaaaactcatgtaattctttacgtatttcatctgcggaacgtttcatatttccaaggttgctgtgcacatcgagcgcgatattgaacacatcagataacgtagccgaaagcttacgatccaacaagatctgcacaatacctgctgcctgacgacgaagcgcgtaagggtcctgtgaacctgttggaataataccgatggagaagcatcctgtaatggtatctatcttgtctgcgatacttacaatcgctccagcattcgttgaaggaaccgtttctcctgcataacgcggttggtaatgctcaaacaccgctctcgccacttcttccttctctccagccttacgagcataatcctcacccatcacaccttgcagttcagggaactcatataccatttgtgttaccaggtcaaatttacaaatatccgctgctcgactaaccgattcctgtgtatctgaggaaacgtgaagtttctctgccagagcatcagcaatacggcgaattcggcgcactttgtctccaaccgttcccagctcttcgtggaaaacgatactttccagtttggagagtgcatctttaatttccagcttctgatcctcttcataaaagaatttggcatcagacagccgcgcacgcaatactttttcattccctttagcaatgacttccagcgattgacttcctccgttacgtaccgtaacaaagtatggcagtagctctcctgtgcgatccagcactgggaaatagcgttgatgttcacgcatggaagtaatgagtacatccttcggaatgttcaggaacgcaggatcaaaacctccgaacagtactgttggggtttccaccaaatacagcacttcttccagcagatcatccttgaccgcaatcgtccaatctttttcggcagccagcgcttcaatttgctttacaataagcgtttgacgttcctcaatgtccacaatgacatgctgcttgcgaagtacttcaacatagtcggccggacttgctacaacggcatcctgtcccaggaaacgatgccctcttgtcacatttcctgactgcacgccagcaatctccaaattaacaatatcgttaccaaataaggcaatcaaccagcggatcggacgaacaaatttaaagtcataacttgcccagcgcatgaatttagggaatgtcatggcatgtaaaatgtgcaataaaccttcggacagtacatctgctgttggtacacctatgctgctcttagtggcgtaaatatattccacgcctccaagctccttgaatgtgaactgttcaggatcaacaccttggctgcgagcaaagcctagtgcagccttgctccagttaccagcttcgtcgagtgcgattttgcgggaaggacctttaacttcttcgttaatatcttcttgcttctccgctacttccttgacaagtaccgccaaacggcgaggtgtagcataagcctctacagcaccataagcaatacgcgagctgtcaagccacgccgtcatacgctgcttcaactgctgaatcgcattcgggataaaacgtgcagggacttcttccaacccgatctcaaacaataaatccttagacatttgccgcacctcctttcttcaacagcgggaagcccagcttctcgcgctcctccagataggtcgcagccacctgacgcgccaaattacgtactcgtataataaacccagtccgttccgtcacgctgatcgctccgcgagcgtccagcaagttgaacgcatgagaacatttcagcacataatcataggctggaaatacaagatgctgcgccatcgctttatttgcctcttcttcgtacatattaaaaagagtaaagagcattttgacgtcagatacttcgaacgtatacttggaatgctcaaattcaggctggtggaaaacatcaccgtacgtgattccattgacccactccaaatcgaacacattctccttgtcctggatgtaggaagcaagacgttccataccatacgtgatttctacggcaaccggactggcatcaataccgcccacttgctggaaataggtgaattgggtaatttccataccgtccagccatacttcccaacctaagccccacgctcccaacgtcggtgcttcccagttatcttcaacgaaacgaatatcatgctccagagggttaatgcccaaacggctcaaactctccaaatacaattcctgaatgttatccggtgaaggcttcaaaactacttggaactgatgatgctgatacaggcgattcgggttctcaccataacgtccgtctgacggacgacgagaaggctcaacataagctacattccacggctcaggtccgatcgaacgtaaatacgtcattgggttcatcgtgcctgcccctttttccgtgtcatacggctgtacaataatacagttgtgttctgcccaaaattgttgcagcgttaaaatcatctgctgaaaattcattggtacacgctccctttctacttccctcaaatgttggtgatttcttctcattaagctcgtatgtacagggctattttatcccaaaagccttgctagagacagcaaaaagcccccgcctctacgcctgtacagacgtagggacgagagctgactcccgcggttccaccctacttgattgcgatcctacatcaccaatagatcgcaatcctcttttccgtgtccattcagatgctcccgagtgccttgttcacgaagaattcccgctgggcttacaccgtccccaactcgctaattacagagaatacatcccgctactttctcgttcaatgcatctgctcccgaaggagatatatagtaggatattacacgttttcagcaatacagtcaagagaatagggcgtttcacatatcgtacttgtcgagctgatccaagaaattgcgggatttcagcttgacctccaactgcatatccatgaactgacgcatgacatgtttgatctccagcttagtggagtccttcacgtcaatgttgccgagccgattcaaatccattctggcgaacaagcgcagcaacttcaatgtacgtggagtcacgctcaatgcagctggatcaaaatgcttgtagctccgacacaaaactccgcctagcctcggactgacaaacatatcttcatcagcacattgttgaccacttgaaatacatgcatccagctgaggagcatatccggccgcctgcaatattttaaattcataaatactcatgacgatcagcggatctttgccactctccagcgcctccaaacatgcttttagctgcttaaaccagaacgcacctgtttcctcatcctgtaacacccgatcgagtaattcacaagcataagatgcgtaagcagccttagtaatatcctcgcgtaatgtatggtgggattggatgatttcaccggcattcaacgtgcctaagcctgtgtttcgaaaaaaaacgaattcaccgtacgtaaacggctgcgttaaagcagcgtgacggcttttggacttttttgcacctctgaccagcacgcctgctttgcctccgctttcggtgcaaagcgtaataattttgttcccctcaccgtaatccatgctgcggatgacgattccttccaccctgtaaagcatgcctcttcccccaaacattcgcgaagaagccagtggcttgtactattcacgggcttcttcatgctcgtccgactctccctcatccgtgtcttgctcccttgtcacggcgctctcccgatataacagatacgcaccgacatctccagtcatcgcaaaatacttccacgaaaaatctcgcaattgtattcatccttccttcggaaatgacgtttgcatctcaaaaataggatgatgcgaagagaggagaagtatgcgatgaaataaatggattgcgttaaaaaaggctgctgtatgtagattggaatgccgcttcgcaaatgatttgatcttacgatcgctgttacccccgaatttatttgaatgtaccaacatacaaagggttaaattcgggggtaaaggcgaacgctatcgcttctttagattcaaatccttcgctccgctacaacgtgcatacagataaccttttttaaaacgttcgttatttcatcactggaagaaaagggtaaaaaagagcaagagttaagcgccgcatatgcgcggcgctttgaatgaccagaagactgttacttatctcagtcatagagatcggacggcttttttatgatgcttacaacaactatacatatttatttaatatcaatttttttagcctcaataaacccttgaactaaagtaacgtagaatcgaattctgtttttaagcgtcgcgatggaagccaaggtcacgaaggacgcggtcctggttgcgccagtctttttttaccttaacccaaagttccaggaaaatcttggagcctagcaggttttggatatcctggcgggcctgtttgcccacctctttgagcatggctccctgtttgccgataatgatccccttttgggagtcacgctctacaaaaataacagccataatatgcactaccccattatcctgcactttcatgtcttcaatcataacggcaatagaatggggtacttcctcacgtgtcatatgcagaattttttcccgaaccagctctgcaataacaaactgttctggatgatcggtaatttgatcatccggataatattgcggcccttctggcaagtatttttgcacctgctccagcagggtgtttacattgttgcccattttggccgagatcggtacgatttctgcaaagtcgtacaacttgcgatactgctcaatcaggggcaacaacgcttccggctcaatgcgatcaattttattcagcaccaagataactggcgtttttacttgtttaagctgttccgcaataaaacggtcgccaccgcctagtccttcagcagcgtcaataagaaaaagtaccgcttctacttcacccaacgtattaaaagcagtctgattcatgtaatcgcctaattttgactggcgcttatgaataccgggtgtatccaaaaatacaatttgcgtgtcttccgtagtaaatacgccgtgaattttgttgcgtgtagtttgtggcttgtctgacataatggcgatcttctgcccaatgacgtggttcatcagtgttgattttccgacattgggtctgccaacaattgcgacaaagcctgatttaaagtgtttcttagccatttcatttcctccagcgcgattaagcacctattttattttggtttttccattaaaacagcgaactaattaacgtcaacataggcctataaaacacaaatataccaataattacagcaaaaaccgctgccaggagcacggctccggcggcggtgtctttagccgctttggccagcggatgaatatcaggtgagatgagatccaccgctgcttcaacagcggtgttgaacagttcggctacaatgactatagcgatagccacgcagacgaataaccagtcgagccgggagatgtgcagagttaagcctgctacaatgacaaggaacgccacggccacatgtatccgcatatttacttgcgtacgcagagcatacatcacgccttctgccgcatagcgaaaggtcattctccaaggctgacgtctcattaccttgtcaaccccgcttgagccagtatagcttcctgtttgcccatcatttcagcttcactcacatcatcctgatgatcatagcctaacagatgcagaaacccgtgaacaaacaaaaaaccgatttcacgctcaatggaatgtccgtattcttcgctctgagcttgcgctgtctgtacagagattataatatcccccagaacatctggtacatcattcaatgaattttcttcattcggttcgtaaataatttcaagctcttcatccagtgtctccttcatagcaaaagacaacacatcggtgggacgatcaattccccgatagtccctgttcaactcatgaatttgctcatcattaacgaaggtaagggcgacctcaccgtctgtgactccctccactctgcctgcctcctctaataaggtgttcagcagcgtaattaaagattcgttaattaccatatcgttttgttcattattccaagctaattgaaggcccatgccaaccgctccttttaattctagtgctctacccgtgcttcatgcacaagttatattaagcttttccgttttcagacttgggcctttcctctggatactcaatacgggaatggaaaatccccattactgtttccttgagggtttgagccacgatatcaagctcccgcatggtcagctcgcagtcgttaaattggtgatcatcaagacggctcttaataattttctcaatcatggattcaacctgttccaccgtcggcttccgtaaggaacgaactgctgcctccacactatcagcaattcccaccacagcagactctttagactgagccttcggtcccggataacggaaatcatcctccgtgaagtcaggctccaccccccgctcttcagcctcacgcaacgccttgtgataaaaatagtgtaagaatgtcgttccgtggtgctgctcggcaatatcgcgaattggcttgggtagcttgtaatccaattgcatttccacgccgtcacgagcatgggcgataatgatggatttgctaagcttgggctctattgaatcatgtggattttccaacccattttgattttcaatgaagtacgaaggcctcttggttttaccaatatcatgataatacgaaccaacccggcacaacaagccgtttgctcctatagcctccgctgcggcctctgacagattacccaccattacactatgatgatacgttccaggtgtttccgtaagcagcttacggagcaatggatggttgggattcgacagctcaacaagcttcagtgccgacaagataccaaaagtagactcaaaaaatggcattagcccaataacaagtattgctgttatcagaccgcctgcaaaagcaaaagctaccccatagagcgtcgtcgtttgagtccaatttccttggtcaatcagtgccaaagaaaaaacagacagggcaccgaacaggcataccataatcgcccctttgaacagtgttgaacgctggctggctcgatgggtagagaaaatcgctgccagacagaccacaatagcaaaaaacccaaaattaaagtcaaaaatttgtccctgacggacattcaaaataacacttgccaatatactgaatataacggcacatacgaaagccaacgacatatcaagcaacagcgttacgagcatagctccaagcgcgataggcgccagatagccgagataggaacgttcactgttctgcagtatggaaattaacatcattgctcccactgtaatcacaaagattaatactagcatgagcaactgcgcattattatacttgaagtttcgtgttcgtgattgaaattgacgaatatacataaacagacccaatgccagcatcatagacaacatcagcagcccaaattgtggccaataattgattttatccttgagcaattcattttcatcaagcagtgtatagatttcctgggtaataatctcacccttcttgacgagtacttcaccctgtttaatgtaaactgtcggtgtatcttcacgagcctgtaccttggcgtccttcgtagctgtatcatcataaaacttgttggcggtaatcacaagccttgcaagttcctgaacaacctcccgtgaagtacgcttagtaagcgagcttgtactaacccgctcagctactttcgctcgggctgtctgagcatccgtaatttgatcattcatcaaccctgtcacaatctcacgggcaacaggccgcatttcagcaatatcctcagatgtaaggcgcggaattttaatgaatgtctcctctggaattcgatacgtttgctctttcgttttttccagcacttcatccagcagcttatctgggtaggcatccgcattacggctgttattcacaaaattttgcacaaattcccgtgcacgttgcggaatctcatccttataaatcgaaatcttatctgctctggaaacctgatcatcctgattgagccgttcaattcgatccaaaataccagtaatcaggttatcgttgcgaacgggcacaatggtatacatgggctgcacacgttcagctgattcctcttgagccttcaaagtcgccttactgttaggaagctgcatcggggcgacaatttccttttcactcggttgatttacccgaatatcataacgctcgggaagcagcttggacgcaaagcctacataaaaaagaaccaccaaaaataaaaacagaagatagcgtgtcgccacgctatacttccatccattcattctatgctggaacgttttccctttagataattccttcgaggtcatctaaaacaatccctctccatcatctttttcaaggcagctacactgctcattttatactttttctgatcgtacacaccatacttgtacttgaatggctatccttgattctcggcaacacggtcataagcaacaatgattttttgaacgagggaatgacggacaacatcctcttctgcaaactggacaaagcctatttcctcaatcccttgtaaaatcgcattcgcttcaatcagaccggattttttgccacgaggcaaatcaatttgcgtgacatcgccggtaatgaccattttggagccgaagccaagtcgagtcaaaaacattttcatttgctcgggtgtggtgttttgcgcttcgtccaaaataataaatgaatcatccagcgtacgtccccgcatataagccaaaggagcaatttctattaacccgcgctccagtgcctttgcagtctgctctgggcccatcacgtcgtatagtgcatcatacaatggacgtaaatacggatcaaccttttcctgtaaatcccctggtaaaaaacctaaattttcacctgcttccaccgcaggacgagtcagtacaatgcgcttaactgaaccttccttcagagcagctacggccagcactacagccagataggttttaccagtacccgccgggccaattccaaatacaatatcgcgtttcttaatcgtggttacatagtgcttttgtccaatcgttttgacgcgaatcggtttaccccgaaacgtcgtcgtaatttcacccttgaacaaatcgagcagctgatcagcgcgcaaatctttggccaattcaatcgcataatggacatccctttcggtcagtatatacccattgcgaattaactggagtaatacatcgaacaattgttcgagcacttccacctcgtgtgcattaccaaaaacattaacttctgcctcacgagatgctatttttgctggaatagcggcttcgattaattttaaaaaggaatcctgcgggccaaataacgcctgtccttctcccgcattgttcaatgcaatttgtatgctgcgttgttgttctgccaaatagcctcattctccttggttatgaactaacggaagttcttccgcaatatcctgctccacttcaaaaagcactttcatataaactttaccattctctctcttctcatgcaaaattttttggctcattattttcgttcctttgccgtatttagctaaaatatcagctcgcgcgccttctattcctgacattttcgcttctgcttccgtaagcttctgctcttgtatctttgtctccctcacactttcggtcatccaacccattggaagtttgtaggaacgccaggttagcggatcatgttcaactgttgttttatgtgtagaataaggtattttcccatatccccacaattgtatcgcacggttgcctaacaccagatacaagcggtcgtgacttgtacctgtatacgtgctgctgcgttgcaccgtgggactgctaatttcgtattcatgccatacaagacccttaacctctcctttggctacgacctgctgctgattctcctcatctccaagcgttcccgagatgagaatggctccttttttgacacgcgtatttttatgcacgacaggacgaccctgctcggcaaaaatttcagtgactaccgcgtctgccttactgatgatatgacgtgggctgtagagcggcgcaggggtaggctgtgaagcttcaacaacctgaatcgtcaccaaagtaccctgtttttccacaccgatccaggatgcctctggaagcttctgcatgagcgcacgggaaagcttgtcttgactggaaagccgaaagctccattgaaacggatacagcccctcctgtcgggcggctttgagaacggattccgtcgagagcttatcattccccttcacttcaatgtcccagataagcgaagacatcagcaggagacctacccagaacaaagccaatccagccagaaaaaatttacgtttggcaagtcgtataacagtaaagggaagcccttgccgcttcagaacatgcattttacagcctgtccttctcaaaagcgggcgtaggaggaagacgtgcggcagcagaaggttcatttctgcatgtctagtactcatcggccgcacgttccaaacaggtatatgttgatcggtgagtaaattaatgaaatcttccacactttcgcccttgacagcaagggtaaccgtgccatgcagctttgctaaagcaggatgtttcacgagccttcctccgttccttccatttggatatccgttatatgtccctccacacttacctgctctggcagaatagacgtaatgactagatcatggccggacaccctcagcctgccttgcgcaagtgcaagtacgagctgatccggcgtgaaatccaccacgccccggtgattctccacataaagctggcggctgccgatgagggttaaccgcggcaagtcaaatagaatgtcctgcggaagctccagcgtctcgctggcccactttcgcagtttgcggctcatcctgctcatacggcgaaatctcctttcccgtcatcaaaacatctgttatccaatggctcatagttgttttgatgacagcacgctgctattttttcatcttctgttattgccattcggacccatagatgtttcatggcagctacgctgctggcttttcatcgtatattcttattatcagtgaacaccattacagcagcgccacagatatctgttctgtacattttatgatccagtccccgcatttatgaggctaaacttacaattcgtagctgctactatattgcagaggcaaaagatgggttctttcaaaattcacaaccaaaaaagccaacctcgttttcatatcgaaaacaaggttggcttttttgattttcattatatgacacggttatttctcggtatctcgattcaaaagagagttttttctagagtataagaagtaaacagccataccaatgacaagccaaatcataaagcgaataaatgtctgaccattcaaattaagaatgagcaccccacatgaaacgatagccagaattggaatatacggaactccaggacatcggaaggcccttggcaaatcaggttttgtttttctcataacgatgacggcgatcgaaatcagaataaatgctgacagggttccaatgttcaccaaactagctaactcatctagcgggatcagcccacccattaatgcagataaagtaccgaaaaacaacgtgttaatgtagggcgttttatatttggaatgaaccttggataatactttggggactaagccgtcacgtgacatagcaaacataatgcgagtttgaccatagagcataaccagcatgaccgttgtcattcctaagatagctcctatatctataatacctgcaacccagttctgacctgcaacctgcaataccaatgacacagggtgagagataccttcaaattgcataaacggtactataccagtcataatcgcgctaacaacggcatacaaaaatgtacaaacaacaagtgagaaaataatgcctcgcggtaaatcacgagcgggatttttggtttcttcagccgctgatgaaacagcatcaaaaccaataaaagcaaaaaacacaagagctgcggctccaaacaccccattgaacccaaacggtataaacggtgtccagttatctggcttcacatatttaaaagcaacgatgataaacaataaaataacaacaatttttacgattaccatgatgttgtttatccgttttgattcttttatcccaaaataaagcaagaacgtgatacccatcaaaattaaaaaagctgggagattaaaataagtcatttggtcttttaaagtcccaggtgcagcagtgaattcaagcggaatatgaaggccaattccattcaaaaatgatacaaagtaacccgaccaacctgcggaaacggcgctggctgccagcatgtattccaaaatcaaatcccatccaataataaaggccaatagttcccccatcgttgcatatgtaaaagtgtaaacagaaccggatactggaacagtagatgcaaactccgcataagccaatgctgcgaacaaacaggcgagtcccgcaatcacaaaagaaagaaccaagcctggaccagctgtaactgctcccgtacctgtcaacacaaaaatccccgttccaataatggctccaattccaagcatcgttaaatcaaacacacccagttcccttttgagtgctttttccccccgcgtagcagcaatcaactgatcaatgctcttctttctgaacaagctattccccatccattccatcctcctaaaaattaatttttcatttttataaccttgtttatcacctcaatttaaatcaaattttagctaaatatggagtaaatttcataagtatctatcattgaaaacattatatataaaaaagaaaaaatgaaaactgctttcggaaagcttcattcatattgttacatttgatcatttctcacgaatatattttcataaatgaggccctaaattagacaaaatgccaccattttagatgacagcaaatgttagaaacctagggcacacaagagattatcacattcgttgtcaggtaattagagcatttttcgttaattcactttttattctgagcatgcttatgtattcctaaagcatcacaaaaaaagatccgccacagccaaagccgtgacggatccactatcattttaacgtcttcctccacccatgtagcgcttagaacgcggaggacctaatatctctgcccaaatcacacctctgcgcagatcagccgtacccaccgcattacggtcttgcgaagctatctctggcgcatctgtaatttcacctgactccctcgcgttggatatacgatcgagacgggctaaaaccaatctacgttcttcttccatagcacggatccgatcctctagagtcgaaccgttatctaatgaatcccggttcatccgttcttccgtttccgaccgatcgcccacttcttctatacgacgagcttccataaccgcccgtcgttcattaggaaattgacgttgcaactcaccagcaacatcctgctggcgctgctcttgcccatgttccgttgtgaagggtctggatgacgtcgagagcccgcgagaaccctgatcccccccaaaggtaggcataccttttcgcggcggtgatttccgccctgtaccttggatgcttttccccaagaaggacaccaaagcaaagccaatcacgatcaggatatacaaatgttcaaagatccagctgataaagttcattactcaccacctagctgccgtcattcatcggctatgtcccgttattaatcccggttcttgttgtcattccccgagttctcattcggtttgcctaaggagctacgcatttgcgtatctgcctcaatatttttcaaattcatatagtccatgacgccaagcttcccgccacgcagcgcttcagccattgccagcggcacttcggactcggattccaccacgcgtgctctcatttctacaacacgtgccttcatttcctgctcctgcgctacagccatcgcacgccgctcttccgcttttgcctgcgcaatacgtttgtccgcttccgcctgctctgtttgtagaaaagcaccgatgtttttacctacatcaacgtccgcaatatcaatggacaagatttcaaatgctgtcccggcatccaaacctttggacaatacagttcttgaaattgaatctggattctccaatacgtccttatgcgagttactggaacctacggttgtaacaataccttcaccgacccgtgcaataatcgtttcttctccggcacccccaacaagtcgatcaatgttggcacgcaccgtaacacgagctttaacctttacttcgataccatccttggctaccgcagccacaataggtgtctcaataacacgcggattaacgctcatttggaccgcttgcagaacatcccgtcccgcaaggtcaatcgctgccgcacgttcaaactcaagcggaatgttagctcgctgcgcagcaatcaacgcattgatcactcggtctacattccctcctgcgagaaaatggctttccagctggttgatgttcaagcccagacccgccttggttgccttaatgagcggattgacaattcggcttggcgtgacgcgccgtaaccgcatagctaccagcgtaatgataccaatgcgcacacccgaagccaatgctgaaatccacagcatcaccgggaagaaactgaaaaatacgctcaatacaataatcactacaacggcaatcagcaaaacgctgacaatacctgattcgaacactcgcatcatcctccattaatctaattctttgttgtttacttgtttagacgctagtgtctgccttgaccacaatacgcccaccttctactttggatactataatcggcatatctgtagcaataaactcgccgttcgtcacaacatcgactcgctcatcagcgatcagcaccgttccggctggacgaagtggtgtcagactgacacccctttgacctaatagcatttcccggttcacaactgaagaaaaaccttgttcagctgttaaactttctttaagtataaaacggttccatatccctcggtccttgaatacaaccgcgatgatcgccaccacggcaaccgcagctgcaaaggcaatgcccaaagatataaacgcgtgctgcatgttgtatgctgcgcgaacaactccgacgacaaggctgactgaacccaaaatgcccaaaataccaaagcttgggatgaacatttcaaggataagcagagccagaccgataataaacaacaaccacgtctccgaacctgcaaaaccagcgatataattgccgaaaaaatacaacccaaacccgagtatgcccaaaattcccggtacaccaaaaccgggtacgagcagctcaataacgacacccgcgataccgataaataaaagcaacgtctgcacaattgggttggtcaatatctcggctgctttttcagcccatgtttgctccacatgaattacatcatccgtgctgtaacccatccactggataacttcttgttcggaagacgcgatgtgatccgcataacccaacttcagcgcttcctcactggttaaagaaatgatctgaccattttccttattaaagttcatctttggaatagatatggtcgttttagagtcaaccatacctctggcaatatccggattacgtcctccagcttctgcggcagatgccatgctactcttccaccaagctatcgtttttggatctgtgatagcctgccccctgccgtctactaacgctgctgctccgataatactccccggtttcataacaatcttgtttgcgctcaacgcaatatagctacccgctgaggccgcttcgccccttatataggctacggtcggaattggactgtctttaatcagtttgcccagcttctccgctgtatctacccgtccaccgggagtgttaatatccagtaaaatcagacctgctttgaaatctgctgcttctgcaaatccacgttccataaatttgcccagaccttgctcaatttcctgatcaactggtataacaaacactgctccacctttagtttgggccgccgctgattcggaatgaactaagggtaacagcaaaacggataccataatccacaacgttaaaaagatcaatttgcgactggagtggtgatgttctctatgcatttctctcccccctttcgatctttctatgttacagcataccaaactttgttagacaaactatacagttttcaggatttaatgtgaaattattgggtatattgctaatcctgacggctgtcagatactttacgcacccaatggacatcacgtttcacacaattaacgataacgcttacatataagaatctttcatcattacattctatggtaggcatcgcttatatagaaataacaccctctgtaaacagagggtgttgtgttttcctgtttgtcgcaggtttattgcagaaattgctgaaccgcttggttcacgagcttaccgtcagcgcggccttttaccttaggcatcaaggccgtcattactttccccatctcggctttcgaagaagcaccggtttcctggatggtctgctgtacaataactttaatttcttcctcagaaagttgttcgggaaggtactgagcgatgatctctatttctgctttagtgcttgtcgcaagttcatcacgaccggctttttcaaattcatggagggcatcttttcgctgtttgatctcacgactcagaatatcaagcacttcgttgtcgtccaaatcccgtttcaaatctatttcaagatttttaatcgtagaacgaaccattcgaatggtggagagtttgaacttgtccttactcttcattgcttgcttcatatcttcgttcaatcgttcgctcaaattcatgattgcttagatcctcctagaactttctcttacgagcagcctcggactttttcttgcgctttacgcttggcttttcataatgcttgcgtttcttcacctcagccaatacgccatccttagcaatggaacgtttaaagcgacgaagtgcagcatcaattgtctcgtttttgcgaactttagtttcagacaccagttttccctccctccgaccagaccgtccaagagcaataacacggttcatcaaattttattataggtgaaacggaaaccaggtgtcaacctataagaaaaaatgaatacataaagggccatttttctcctttcacttccgtatcactgaaaagacaagctctgtcattttttaagaatgtgagtccgaaatacctgtcaaggcacccaattttgcgccgcccagtaagtgataatgcagatgccccaccgcttgtccactatccgggccacagttgttaatcaaccgatagccagactcagcgattcctaactttttcgcaacctcaaccgcaacacgatgaatctccgcgataagaggaagatcctcctccgtcacagcattcatcgaaggaatatattttttgggaataatgagcacgtgtactggcgccgcaggctggatgtcatgaaatgcgagcacattgtcggtttccaacacctttttgctggggatggttccatccacaattttcaaaaacagatcgtccattcaaaaccctcctttggcagtgagccgatcataagtaaataggcaaaaaaaactgcccttgctctcggcattcaaagttatgtatttcccgcactgaatagaaacatatacagccatgtttggttatacttatgtttctatatgtatcataacggaaaaagggtcttaataccagtttcccttactaacttcctctataatagctttcacccctgcatcaatttgatccaactgcgagcgcgaaatacttatgcgcaaaaacttctcttgttccctatagcctgacaaataaaagcctttcccagctacaacctggatgttcctcgcggaaagacactgtaccaaacgttccaaattcaccgtccgaggcagtttaaactgcatataaactcctgaggttacagctgaagtctgaacgtatccgccctgattgtatcgttccacagccttgttaagagcacgaacgcgctccgaatacagtttacatatcgtgtgcttgtggcgttcatacattccatttttaatataaatatcaagcgccgcctgagacaaaatagatgtgtcgacatatcttttataggtattaaacgtcttcaatagggattctggcaataccgcaactcctaatcgtaagccggggaaaatgattttcgagaagcttttcaaataaataacatggttcgtctggtcgtatgcataaatgggatcaaaaagatgatcggtccccaaatctgccatatagtcatcttctacaatgtacacatcatatttggcggctaaggcagctatcgcttttcgctcctctgtgttgtaagagactcctaatggattatgatatcttgacatggtataaaaaaacttgatgctctcgttcttaaattggttctccaattcgtgaaaatccataccttccgctgtccggacgatggtactgacgggtatgttctcttcctccagaaaacgcaaatatatatcgtaacttggctgctcgaccaaaaccttttctttgccattgggaaacggcattttagcgagtatctccaatgcctgctgaacacccgaagtaacgataatccgatccatttttgcaaacacctgagtatcggctaaatgggaaaccaatgtatgacgcagtgtttccagtccttgcgaatcaccataggtgaacagatgatatttgtaggtgtcaatagcctgattcaaacaatgttggaaatccagataagggaatacattcaaatcgggggaggccgaagcaaaatcaacgaagtcttgcatatggctatggtgtaaatcgcccgaattttccactacatagtatccactttgcggtatggaatagatggcgtgtttcttttcaagttcagcatatgcccgcagaatagtgcttttgctgcacctgtataattcagaagcctcacggaccgacggcagcttgtaacctgatttatattgtccctcgcgaattttaagttctatttccaataaaattgaaacgtattttttcacaatatcctcccacctgctctttacatactcattacatgctcaattcattacatgcttattccgtcttatgtttctttacacgctagatgttaccatggtttatggataaacaggatacctcatttcattgaactgtactaatacagtttcaattatcggatcatattggggatggtttacgtaaaaaagaggctgtttcttcataatggaagaaacagccttgcatggtgatgatgtatggatgcgccttaaagtcacttgtactgtacaagaactgtaggcgggagagagcagagaattcactatatctggcgactaaggaatcaggattagtaataaggcagcaagctaatcgctgtcaacgctgcaagtggcagaatcaaacgattaaaacgacggcgtccgtatgggaacccatatgcataagcgggtactggatacgggtacgggtacggaaacggaggataagacgcatagccaccataagcacgggagccgcagccacaattgttaggtggatatgggagattaatattgactttctccatctcttctccacccataggaacggctaagtatatcttttcatcatccacatgctctacaatgccatcatacattgtcccgtccttcacccatacgcatacataacgatgcatatgcttttgacatagtgttttagcatccgtctgttccggtgctgtaactttttcggttgtcatgcttttttccatggttgtttcctcctaggctcttgcatgtataccgtatgttattcaaaaacgggctatttgctacatcaaattgggcgaattccggcttgcaaaaaaaagaagcaccccgggagctcttggcagagcccctctgaacggacgtatgacgggaagatttcttccgcagcatacgtccgccggggtgctgtatgattaacttgtcggcttggctgtattataacaatagtttgaaactgtatctgtgacctgtatcacattacttcaaaaagtttccataaccacacgtgagccgcctccagcctgctctgctggaagaacaactagcttgcgtggcagacgggcccgtagttcaggcacatgactaatcacaccaacagacaattgatcgtggtgcagcttttccagtgaagtgatcactgtgtcaagcagctcagggtctaacgttccaaagccttcatccagaaagaaaaattgcagagggtattggccccgcaattgaatttgagccgacagcgcaagcgcaagcgacaaggaggtcaggaacgtttcgccaccggacaaggtcgatactggacgtttgaccccaccgttggcatcgtcactaatgacaaaaccaccgctggaatctacctctagcgcgtaacgttgcttggtcagaaaacgcaggcggcgtgaagccgactggctaacctgcatgagctgctcctcggcaatatattcaacaaaggcattgccacgaaaaacagactggagcttggacattttttccgcttcgctacgcaaatgtatacgattggactccagcttcatccagcggacgtgtcgatgctgcaagtcctctaaatcacgctcagccttggcgcgattctgaagcgcctcttcgtcgcgtgtacggcaatcgcgcagctgcgcagaggtcgtttcccactgttcctttgttaccgttgctccattcagctgctcttcgacatgctttaagcgggaagacagctctttttctcgttctcgatgcaaactcacttcacgttcataacgtgcgacttcttccggtcccaagcaacattccataacctctgcttccgtagcaaaagaggaggcttccagacggctgccccaacgggactctgccatctgacgtctttcttctgccgagtcggaggcctgccgggcaatcagtgaagcatgaacggcttgctgcttgcgttcttccgcttcggtacggcggcgtgccgcggcttcggctccgtttttcagtcccaacagtcgcgaggtcgcttcttccaacaatgaagccgcttggccatctccaacccattttcggagctgtgctagcttttcacgaagcgaatcatctttgctttggagccctgtacgacgggcaataatgattttgtcctcctcgatgatactctgctgtatctgttgaacacgcgccgcctttccttcgaggaaggtcacactcgtctccagccgggaccgcagttcttccgcacgcccgtcgcgctcctgcatgacacggtaacgctccgcggcttcgctcggagcgacatccggcagctgcgccgcccattcggcgcgcagcccctcgctgcgcgtggtgcatgcctcgcgcttgctgcgtgcctgcgtcagcgctgcagctgctgcctcctgctcggcagcagcacggatgcgccgctgctgtccggcggcgtctgcctcgcgtagcgcctgtgcctcggcaggcagtgcatgcgcacgtgcggctagctctgccgcagcacgctccagcgc

SEQ ID NO: 58 - DNA, 73975 bp, Unknown
  Kingdom: Bacteria, Phylum: Firmicutes, Class: Bacilli, Order: Bacillales, Family: Paenibacillaceae, Genus: Paenibacillus
atactgattatgaccaggtgcatatttcattgccttgatatggtctagtaatatgggttgccatactcgcttattgctgtgtaccaacgcatgcatgtcatatgagagcagcacacaattgtctacctcgtatttgcctccctgtgagccgtaaacgatgcggtgcaagtgtaatcctggtcccggtctaccactcaacaggcagcaattatgagcgcctacggtggcatctcgttctgatacagcagcacgtactttctctttgctcatagattctggatcaacaggagcacgcttctttttaggatgctcccggcggttatggtgggccagaatactctggcgccactctggtataggtttcttgcgtttagcgagtgtcatagctacctcctaaaatggtccgtcaattggctcgggtaagggaccgccgtcgtcgtaaaatgggtctttatcgcggtcatatttgttcatgttcacgccgccttatttttatccagatactgagcaagcttggttacgtcagccgcccgtacttctgcaaatttggtaatttcataattcagaaaataattgatttctttgtagctggaccaccctgtagctttgtgctttgcatacaacattttggtttgtccttcacttgcaaatccaccagaatacccatgaccttgtgttggttgtacgttgttaggtgatgaaacagttgaatgactcgcgttttctccgtcatcatcttcacccgtattaagtgatagaaaggcactaaggctgtatctacgtgcataggttgtacaactgcctataccttgcggatcgttctttacaggcttcattacaatgggctgtgattcgatccattcccctgactcgtggagcaacattgtcgtcatgctgaatctctccccgtcaccacctgggaactgcataatggataaaccatgcttttgtaagatcggtcttacttcatctatgatgttgtccaagctggcatagttatttttgaaatgcggatttaggctatccttttgaatcttctcaatttccccgttgaatttgaccaatgccattgcgatatttttgattgattcgctcttattgcacatggctttctcctacttctaactcataggttacttttaccgggactacatggaagttttgcggatcatcgggaccatagcgacctaatatccatatattcagatcatcttcacgggaaaaatgtgccgccttcataaaatcctctgtaggttcagaataaatattgatgaagtgtccattcttatgttgtggtacataacgatatctagtaaccattgccaatcctccattccagtgatataatcacgttaataattttcttatgctatgaattgagctgccgttgcctcggcggctttttcctttttataggctatcgccatgttccgtaggtaaaccctcagcaacgtttttgtcagcgtcccgcgttgttttgcgatctttgcgagttctagaaacaccctgcgatccgtcatccttcttcacctccacaagtttgacatcacctccccaaccgtaatgctttaaaatatcgtctacactcccaaaactcatgctgtccgtttgccctcccgatcttctggatgaaacatcttgtccaattcaactgcgcgcttggcatatgcagccaaattcgcttcgtactcctctattgtttctattaattctggcttgtaattacgctctttcagccgtcgccgcaggctttcgatatcaaaatcgtattcagcaagattgcgaccgcattcagttaacacatggtattccgtcataacgtccacactgcttcttaatcctttagctggcatcgtcaaaacctccattccaacgtttcaccatcacaaacgtcttattgtcgattgcttctaacatgcatgacttgcagtgaggttgaccgtatacttcataatctggatcagccccacatccgcatttgcctacattaatagaaggttcagcgtctggacgtttaaacgggaacggggtaactacgcgattttctatctcctttggatgtttagccacttttcttctctccctccaggttcgtaactcgatgtccgtatttttggttaagcaatataattttgcgggtgaactctagtcgtgtacgttcactcagttctggtatgcttttatttaattcaccattggtagaatttactttcatgtagacgcctcctagatgtacaatggggtgtgttgtgaatatacaagtgtcatgtcatgctgtatgctctctgaacttattaaggaagtacatttgtcctctggttgtaactactgttgtcttggttgtccgtggctcttcatcgggcttattaattacgcctgtttttacttcaaataatcgaagatccatagaccgttgtgttggcatgttataatgctcgcccttcttgccaaggtatccattctcacgcaaccagctgtacaagcgacgttcaccagtatcaatgccattctgcttaagcatttttgcaaggttagcaactaagatgcagtctttagaagcttgtagtgagtttgcaaacaacactttaggttcatcagccacaaccttttcttcaagcactttgcgtgcatcctgttctttctttaaggcggtgataactccaataatgtaatctggatcttttaaggtctgttccatcgtttctggcgtaatgtacgcgccatgttttctaatggaaggaatgacttcgtgtgtgatccaacgtttgaattggcgcgcttctggtttgcggctgcctaggattagtgagtacagaccagattcattgatagtcaccatattcgggtttttgcttaaagtatccgttaaacggatagtttgtttttcgtcgtcgtctagtctagccactgcgtttccttggtttgttatttcaaggacatcacaaatatcttttgcaacaaaccatggttcgttgttgatgactactgttctgacttgaatctgtccatacataaatggtttaaggttgttcatttgtatctctccttaagctgatttttgcttttgcttcattttgtggcatttatcttcaaaaaaaaggtctgggaatattttttcagctggaatcttgaagtgtctttccatttttaccatcagtttagctgttgggtttcttaagccaagttccatcatgctcagatattgtctagagatatctaagttttttgccacatcttcttgggaaccttcggacttacgtagttcagcaagcaacgaccttttcatagtgaccattttgcaccgcctttcttatttcagccacgttttgtggcatttcatgtttataatataactcttcattttgtggttgtcaatatgtttttgcaacaaattgtggctttgttcttctaaaaaaactttattgcaacttttcgtggcattaattttatttgacacattatgtggagtaaaatacaggagggattcaataaatgaatataattaaaggagagataatcaaattgctgccggatcgccttattagcttgaggaaagagaaaaaattgactcaagagaaaatcgcggaaaaattgggcattacaagatccgcctattcacaatacgaactcggaactaggaaccctgatcacgaaacattaaataaaatggctgactttcataacgcctcaattgattacctaatgggcagaactgatattcgaacgcagatattaacagaaccttcaagagaactaattgattcacttgatttagctgatgaagacataattaagaaatttaattttcaagtagatggagtggaattaaaggaagacgaagttcacagatttattgcgtttgtcagggcagagagatctatgaagaacaaaaatcatgattctcagaacgatggagatgatctttaacacattctggtttaacattggccttcctaatgttgttaagtacaaactcaggattcaaaccaatttcctccaatatttcttttgtgatgttaaaaatgatccttttctccatgcgtatcagctcccgttgcataattgctatcagtatacttcattttaagggaacgcgtgttcttattcaagaataaaataacagtgaggcatgatcatggtatataagcctggtcgctgcctgctaactatacgtttaaaagagatacgtaagactcaacaatggttatgcgaacagatcggaatgagcaaatcacaaatatccgattacgcaacaaaccgaacaatgatgtcttacggaacagccatgaccattgccggggctattggctgccacatggaagatctttacgaacgcatagatagcagtagcagatgagtgacgcaagtcgctctgaccgggatgacagtacactcaatcacgtactgtgaagcgctaatattgtgcttcaggttaaacatatcatatattggtgaattctggcgagaaaaaacctattggaaatatcgggaaatacctttacaatatatcaagtgcttattaaaggaagtgaattgcttgatagtcatgtggatagtatggagtatattacttctatttgcattcgttctaattataggagggttagttggatacaaagagacaaaaaaagaaagattccctaattactttacaccaacttttctacttgttcttggtataggtctcataattctttgtttcaattatattccacacgactcggttagtttgacagatacttcaactaatacttcagaagaagatacagagattgataatgtgtattattcaaattgcaccgatgcaagagaggctggagttgcccctatttataaaggggagccaggatacagagttggattagatagggatagagatggaattgcatgcgagagataaaaggaaggtaaacaaaatatgaaattattaagtgtttttcagtggatctttagcataattggcagtcttgcctttataggaatccttttttggttaggttctgatgtaatgaaagccccaccaacaaaccttgttttgcttgctgatcatgcaaataaaacatatatatcgcctgaatgcttaaatgcaaaagttgattatacaacaagtgaatttgaagttgttactttagagaaagcatcaaaggaattgaattatgaatatgattcagtttgcacccatgatagtatatggccttctagaaattctgcttgggatttcataggtacaaagttaggttttttaaagccacttaactggaaatggaacgatgacggtagttggaaagaggaagtatttaaaagataaaaaaggggtaaaacaatgtttgaaaaaatgcctaattggctgcggtgggttctctttataccaattgttccagctgcagctgtagtatatatattttttgttaatatatcatttatacacttactaaacaggttagaaataccaatgttaacatatataattgagagaatattctataatttatttggtatatgcttttgcttaacagttagtattaatatgataccaaaaggaaaggtagtattatcttctgtatatcttggaataacacttctagctataggtatgtcaattgccttttctttacttataccaagtgaagaatatgcggtatggcaagttatttacgaaagtatattatctgtactagcagccttaatatcattaattatggctttatctgaaagaaaagtaactgttgagtcaattaatgaagataatgttcatcagtaattcaatcaccatgaataaaatctctgctaaccttaatgggtcggcagagctttgtttttttatacaccatatttaaatggaaattgaattgcaatgtataaacttcgtatgataccataagaatagaaaaagggaccgggtgcaaccgatccgctataagagcggtcggcttggtttgcgatcacgaaatagaccgataccttgtccagggcggtctatttccgtttatggaaagaaagtatcagaatcaccaatgttgcaaattgaatcatcaacatcagcgtgtctttaacttccatggcttcaccccctttacaggagattagccgaccgcccttgatagccgttatgtcgtacaatccagattataccacattagtcctctattaagagggctttttattttgcttcatacaccttacaattctagtaagacagttaggaggcacattatgagagtagcaatatacatccgggtaagtaccgacatgcaagtagaagatggcttctctattgaagggcagcgtacaaggctcacaagctatgcagcgtctcaagactgggaaattcacgacttttacatagatgaaggacagtcagctaaagaccttaagcggcccgaaatggaacgcatgcttgcagacatggtagaacataaatttgacgtggtactcgtttataagcttgaccgtctcacgcgctctgtaagcgatctgcacgaccttttgaagcgttttgataagcatagtgtaaagttcaaatcagcgacagaaatatttgatactacgactgctatgggccgtctctttatcacaatcgttgctgcgatggcagaatgggaacgtggcaccatctctgagcgagtgcggtttggtatagagcaaatgatattagaaggtaagcgtcctggcggtgtcctgccctatggatacacacaagatagtgaattaatagaagaagaagcagaaataatccgttatgcccgtaagttgtacatgagcggtcttggctaccagtcagttgcagtgagactcaatcgtgaaggtaagcttcgccgcggaaaactgtggaccgccgcaacagtaacttacaccttagaaaaccctttttatgctggtatcctacgcttgggttccaagcttcctggtggaaactacgttaaccacggacgcgatgacagagtaaaatgcctatatggtgatggtgatcatcccgttatctttacacgcctggaatacgaagaaacaaaagaatatatgaagcgtagaactagcggtggattcagccgtgtacagacctactggttttctggcgtgctgcgttgtggacgctgtggagcagctatgttcggcaggatgtcaaacaagcgaaaaagaaccgatggaagccttgtccgtacgccttattatatctgctctaacaaacacgccaataaaagctgtggcatgcctacatttagacagatacatgtagagcatctatttatggaatacattaagcaagtcaccacggatcaggaaaccgtaaaacaggttgcagctactatgcagaatgatgagattaaaatagtagatgaaattgctttggcaaagaaagagttaaaaaaaatagctgacagacgcgagaagtggcaatacatgttcgtcgaaggtcttataactaaagatcaaatccgtaaacgaatcactgaagaagatgcggccgaagaagaaatcaaaaaacatttggcagaaaataagaacatgatgtctgctgttcccaaatcagatgatttaaaagagctcgatcagttgtggcctgaaatgaatgatgaagaaaagaaagatatgatttttacattgtgttctaaaatagtgttgcatacagatgaaacgaatgttaaaggtgtaaagaacaaatttttcgatgcttatattggtgaggtactttataattaatttatagcgctcttttatgagcgcttattacatatgaataccacattgtattgtatagacttccatcatggccagtattcatcgcttgcagcatatccagcgcctcacttccccggacctcacccaccacaatgcgattgggccgcatacgcagggaggaacgaatcagatcacgaattgtgatttctccctttccctcggtgttcgcattccttgtttccatggaaaccagattagggaccgtcacaatttgtagctctgctgagtcttcaatggtaataatccgttcagacgacgggataaactgggataatgcattcagaaaagttgttttaccagaacccgttcccccgctgataaaaatgttgtacttgctacgtaccaagtccttgagcatagcagcggtttctgcatccagcgcacccattcgtatcaagtcatccatcgtcataggacgctcgggaaacttccgtattgtcatcgtcggacccttgagagcaactggaggcagcacaatatttacgcgtgacccatcctttaaccgggcatccacaatgggggaagcctcattcacaattcggttcaccccggctacaatcgtctggattaaatcctccagtcgctcgcgggactcaaattgatcgggtacctgcatcacctcaccagcccgctccacaaagatttcgcggtgactgttgatcataatttccgtaacggtcgggtcgtcaatcaatggctggagtacatctagcccacggaaagagttaaaaatcttgcggacaagtgcgtgcttctcacgggaagttaagcccgccagctctacatcgtgtaaaattcgattttcaatatgccgaaccagatcggtatcctttaccgaagacgttacgtcaagcccgtttcggatatctgctcgcaatgccttaaaccgttcctcattcatgttcatcagccccttttaagaccaaacggcgggcggatgtgttacattgtccacattcagcagctcgtggcacagatgacgaatttcccgctgataaatcggtgaactaagcagtagctcacggtgctgcatctgcttccatgaaggtatatagggtaacgctccgtttagctccatgaagtcacgaggtaacgagttgatcatagttcccatatagcggttcaccacaaagctggttttgcatatcatatcttcaagcccttcaggctgcgtggtttctaaaacatccagccataatccgcacttgtgcatgctcattaaatcgtctgccagcagccagatcagcttatgactagcttcaagcacagcttgagcgcggtcacctttttcagaatcgccatctacgatcactacatcatactgtccgctttcggcaaccgttcgaatcagttccttcgcttcatcacaagtcatgtccgtcagttccttacgattatagacaggctgaaaagtatccgcctgaatttcagggcggcgaacacaataggctgccacggataatggaatgctctcattcccctccgccttgagatcatagagcagcctggatagcccctctccttctgctccgctagcacttcctgaaccagtgaacaacgagcttgaatccaccgtctccagattcagatagaataccgaatatccctcattccccagctgtttggacatattgagtgcggccgttgtcttgcccagtccgccggaagctgctaccatgccgataatcagtccaccttcccggctgtttacacatttccgaccgttcgacttctgtctcgccgtttccaaaataaaaccgaccagctcaggtaagggctgatattttaataaaggctgtccatattcgctcacttgttctccctcatgcaataccaaacaaggaatatcagcagcttccctatctgtccatagattcaaaaaagccacttcaccaaccaccacgtccggtcttttcattccgctggtttccatcatgtattgatgaaatgcctccggttgcgaaaaagccgttattctcagccttctggcgtactcgcttccgtgaacataattcagcagcggctcaatataatcccggccttctacagccaataccactttcactggaatcataacgctcatccctttccctaacacaacaacgcaaaaaagcaccgttcatccatccgtaagtacatacggttggtgaacggtgcttccgtcacgtgcaatctatttactggtagaatagcatagcgcttatattagagcaagtattttttgtgcaagtatcttccaaaatcctcgtactaggagaaggcgggcagtctagccccgcctcctactatcttcatcttagtagaatttgtggtgacgacgatgacagtcatgatggcgacgtttccggcaatgacatttcttatcaaaatcttcatgtttccagtgatcacgtttaaatttaggtttaaacttaatgacagtcaccttaatgatcttcttaaagacacgtttttttggctttggaaaatgacaatcatgcttacgatgtttatacattcaaattcgcctccatttctttgagatagaatatactatggaagcagcgaaccatcggtaaccagcatatgactatttatgatttactgggctaattaatgatctacctccagcttaatatctggatcataatccgccacaattagaacatccatatgacgtgcttgacggagaatccttggcacaaccgcagacttaccccaacggctacttcgggaagactgccccacgatgagctgtgtacctgaatatccttccaccggagcaatcaaaatgtcggcaatttcgcgtcggctggaaacaagccgtatctcaaaggtcccccccagtcggtgggtcagcaactttagttgttccagacgagggttcagtctctcaggtatacgctcaccgacatgagcataagtcacaatccacacagccttcagacgaaaggcgatacgaaaaccacggcgaatcaacctttcagcatttttgcttagcgtcacgcctacgaagatcacttcctccctgcgccacggtccccgaagtgattcgtgtcgatcccaggattccagccgctcatctacgtcatctgccaattcccgcaaagcaagttcacgcagcgcaatcagattgcccagtttaaaaaagtggctaagtgcctgttccaccttcgcaggatcgtatattttgccctcacgcatgcgttgctgcaacgatttaggagccacatccacaagctgtacttcatcggccagacgcatcatatggtcgggaacagtctctctcactcgtataccagtaatctgttccaccgcatcattcaggctctccagatgctgtacattcattgtggatatcacagaaataccttgttccaaaatggtaagcacatcctcatagcgcttagatctcatacttccaggcacgttggtatgtgccagctcatcaataagcactacctcgggattacgccggagaatggcttcggtgtccatttcttccaaatgtgcaccatgacgctcgatggactgacggggaatcatttccagagagcctacttgggccaatgtttctgctcttccatgcgtttccagcagtccgataactacatcgatcccgctttccagcagatcattcccctctctcagcatcgtgtatgttttgccgacccccggagcagcgccaatgtataccttgagcttgccccgcaggattttggctgcctcagcctgtgcttcctcaacgctcaaacgatgatacggatcattatctccctcttcctgtctcattgttggcaagatccgctcaccctcctgctcggcccggtccgcaatcagcagcaaatccatatttttcattcgttttaaaatcccgttcaccagcgatcctttcatcagctcctgccacggagtctgccgagaatgccccataacaattcgggtaacattgtgcgtcaccgcataatgaatcagttgacgaggcaaccttctgcgggaaaaaagcgggatttcttcaaatgttgatccgatcttgtcagccaactgctcaatcgaacgcttgaaggctgctgattccttggacagcctgcgcttcgagctgacaaaggagaccactagcatatctccacccaaccgcttggcgacctgttctcccctacgtacataaatagacccattccaatgatattgaacaggtaccaaaatacgctctgccgctcctgacgccccgtgcaagcctaactcctcccggtgtcgttccagcgaatcattcacatcctctgctaccaatcgcagagcaagctcacgcaatttaccgagatttccccggtgaaacatctcaggattgggcgtatgcatgtagcctttcgccagccgttccaaaatcatctccggggtggcatcaatcagacgaatttcatccgccagctccagtgtatcaactggaaccgtatattccgcttcaaagcctgttagctgatatacccactccgtaattccttcgagttcataaacattaaccgtcgtaatgacgctaattccctgctccagcaaataccgaatatcctccagccgtgttggaaatggggcgtctttccggttatgatgtgccaaatgatccaccagtaccacctcgggatttcgtgccaccaaagcttccacattcagatccttttgctcctcaccatcttttatccaatgaatactaggcacgcgctccagcgtgccgatctgttccatggtcacaggccgctgcatggttgagaccgcacaaatcacaacatcaataccttcatgctgcaacgattgtccttcctgcagcatatgatacgtcttgcccgagccactgaccgcacccatgtaaattttgagtctgcctcgatgcagtttgttaatcgaatccagtatttcctctggtgatttacgtttgaagctctccactttcgttcctcctccagcgtaaccgctcattccgttcattcttatatggttgtaatgaatgtactcccgtgtcccaatcaattcaagataatcaatcaagcttgccccaaaaaagccgcacagggcagtataagcgcaaaaaaacgtgcattcaggtctcttatgcctgaatacacgctattttaggtaactcatatgggatcacttcctacaatcacttgctatcttcgccaacgatcccccgttgttgaaataacttttgccataccacaccgtgagacggagaaaagagaaaagccaaaagcagcaacacacccgatacacacagcatacatgctgcaatagaagcatccaatacacttgctgtgtaaaagcctacgaccgaactgatcgccccaaatccgacgctgtatacaatcatacgagacaacttctccgtcagcagataagcggtaagcggcggcacaacgagcatgccaaccaccagaattgcgcccacgctctcaaatgatgccaccgtcgttagcgagacaaggctcatcagcagataatgaaaaaaaacaactggaatgcctaatgaagctgccagggcggggtcgaaggaagtgattttaaattgcctgaaaaagcctcctatcgcgagcaaattgatcaaaaacatcgcgcccgtaatccacacagccctcggaccgacatcgaagccggcaatctcgaacgtattccatggcacataagcaatttccccatacaaaacgtgatccatatccagatgggcattggaagcaaacacactgatcagcaaaacaccgatagcaaacaatgtcgtaaacaccacgccaatggcagcatcactttgcagaccgctttgttggaatagctgaattaggtacaccgttagaagacccagcacagccgcaccaaacatcatccacaccgaatccctcgatccgctgatgagaaaggcaatgacaatccccggcaataccgcatgactgattgcatcaccgatcatagccatttttcgaagcacgagaaagcacccaacgatactacatccccctgccactaacattcccgtcaaaattacataaaatgaactcatagggcacgctcctcccttggctgtgttccgactgtctgctccagattttttctggcgttcaaccgaacgatagccttggagatcatcccgcgctgcggcgcaaaaatcaagctcattccaaacaccacagtcgcacacaacacacataacggtcctgtaggcagattttgccccagagagctaatgagtgtcccaccgaggcctgctatagcaccaaacaagcctgataggcataccatgacacccagcttctctgtccagtatcttgccgacacggccggggtaatcagcagggcagccatcataatgactcccacggcctgaatgccagcaaccaccgcaatgacaatcattagcatcaacaacttatccagcaaacctgccggataaccaagtccgcgggcaaagccgggatcaaagctgagcaacttaaattccttgaaaaataatatacatattccgatgagtactaccgaaattaccgccatcgtatagacatcagacaataccattgccgcagcttgaccaaatagaaatttatccaatccgctttggttgcccgcgccactatgctgaatttcggtcaacaacataatgccaaagccaaaaaataccgacagcaccgctgcaatcgcggaatcgcttttaattcgtgaataccgggttaacgcactgatggcaaaggtcgcaacaatccctgcaatggcggccccaatcataaatccaaacacggattttgtacctgtgatcataaaagccacacatacccccggcaaagccgcatgtgccaaagcatctcccatgagcgactgcttgcgcaaatacataaaactgccaatcactccgctgcttaaaccgagcaaaatacagcccagcaaaatccactgcatattcgggtcggtcaaaagcgttgccaagcttgtcatactgctcacctcactccgagtatcgtaccggaatccgggcttgttttgagtatactcagacgcccgccatacgtacgctgcagattttcctcggtaaaaatatctgtcgtctctccaaacgccataagatgcccgttcaacagcataacctgatcaaaataatccgtgactgtagataaatcatgatgaacgacaagtacggttttaccctgctgtttcagatcgttgagcagcgaaataatggctttttctgttgcagcgtccacaccgacaaacggttcatccataaaataaagctgagcatcctgcgcgagtgctctggctaaaaaaacacgttgttgctgaccgccagacaattgactaatctgcctgtctgcatatttgctcattccaaccttgtccaaactctccatcgcagcctgacgatctgctgcacccggacgcttaaaccagcccaatctgccataccgtcccatcataaccacatccaatgcgttcgtcggaaaatcccaatccaccgactcccgctgtggtacatagccaaccttgagcagctgttgcttatagggcttgccgtagaccagcacctcgcccctaagctttggaatcagtccaagcgctgccttgatcaacgtagatttcccagccccgttcgggccgataataccaatcagcttgccttccggcacctcaaaggaaacatcgaacaaaacgggctttttttgataagctaccgataaatcacgaacgacaagtggtgaatgccccatgtatctttgcctccttatttaagagctttaacaatcgtattaacgttatgcttgaccattccaatatatgtgccatcttctgtgccttcttcacccatggcatccgaatacagctcgccaccaaccataattgtatgaccttgctgagcggccccctgaataaccgcatctatggcctttctcggaacactagattctacgaatatagccttgattttatgttcgaccagataatctcgcagcttggtcacatcttgagaacccgcttctgattctgtgctcataccttgaagtcctctcacttgaatgtggtaggcatctccgaaatagccgaaagcatcatgtgccgtgacaagcacgcgctgggcttccggtatactggcaatctgctctctcgtgtaatcatccagctctcgcagctcagtaagataggcttctgcgttggccttatattcctccgcatgaacaacgtctagcgccgacaattcatctctgacggtttctaccgcagacatccaattctgtacgttaaaccagatatgcggatcatgctcagatcccatttccgggctacctgcacgcaactgatcctgtgcgatgtttttggacacgggtatgacgggtttttgcttgctgatcttctccagaatgtcctgcatttttccttccagatgcaacccgttataaaaaataacatcggcctgatccagcttgcgcatatctccctgagaagccttgtacaaatgcgggtcaacgcctgacttcataattcccgtgacctccacatgattaccgccgaccttgcggacaatgtcagagatcataccgatggtagccgtagcctttattttttgttctgtttctctcgcagttccctgctccttcttcttagcatcggtacatgcagtcgctagaaccagagctagagacaatactccaactgtcattacccatcgcggcaaagccttcttaaactgcttgttcatgttttaaaatcctcctttgaacttcgttttgggacaaactatttccttgattcaattattttttatcaatactatattttagagtatacactaaagtttttacctagggaaacatttttaaaaaatataattcttatgtatttcgttataccgttcgattttcgttctcccaatgtgtaatatatagaagatatccaatcgttaaaccaaagaatacatataaagaggtgcaggtcatggagccaacaggatacagcccttatcggaacaaacgtcggcaagttcggatacgaaaaatactgcttatttttatgctggtgtgctgtctgcttgccctaacttcctgtgctcgaggtgacatccatgtagatgttcatctcgatcaaagtgtagatctcgatgcaacgttcagtgtaaacaaccagacactgatgatgttggacaatcccgggctgctagatcgattagtcaagcgtattcaaagcaacaatgtagatgtacagccgctagctgaacagggaagaaagggatatcaaatcaaggggcattatcaaggagattggagcacaaacaaaaaaaatcccagtcagggattaaatctacctgagggattagaaataaagcgcgctgtgagccaacattttttcacaacgaatattgatcttaccatgaagctcgatctaccacggatgcttcctgaagaagctcaaggactgagtgataaatttgagcaaatgaatgtgtttgcgcgcaaattactggagcggcagctggatcttaacttcagcctatccttacccatccaacctgctaccaataatgcggaccgtgtgtcggaagacggaaaaacactgtattgggacattgctcctttggaatctaacgagctaaaattgtctgttaacgtacccaatgtacggcatatcgtgtatgtagctgttacgagcctgatactaatcgtgatcgctgtgatcttactaattcgtagacatcgctccaaaaaagaaacttaaaaaagcaactaaaaaaatcgttgtctgatttctggtggggggatctgacattgatcctcttcatccttgccaaaccaacgatatcggttacgcgccacccagttatagacagcgttgcgcacaaagcggggaaccaggatgaacacataggccagcgggtatggaaaacgaagacgtttggcaattcgcaaagccgcagtggaccttgtataatacgtaccgtcttcaatcagcacgaacgtatccagctgatctgtagatagtcctcctgcacgtaatagttcttgtcctgcctcggattgcagggaaccaaaatgaaatgttcccttagggtcacgcttgataataaagcgggcagctccctgacaaaagtggcataccccatccaccaacacaatggaatgatctgaatgagcatgatcagtctggttcataaatgcatttcacctccaagaaaatcaacggcatgaataccagcaacgcaaccatatgaatataaacaaaaaaacgccgaaagtatccgacgcttgtttagaaatgtatagtctttacctgttcgaaaaactagctcaatgctttctcaaacagctgtttcgtattaatttgctctaaaaactcctcatggaacttatccatacacttgcagataaaatccttatggcataccgggcaaggcgtcgttagcagtcgactaatattcgtcaaggtccactccggattacgttgagaaaaaacgcggcactccgttccatcggccaaactcattttaaactcataaagcccttctttttcgttgctgccagccagcgtgaaattaacaatattcggtctgtaagacatcatatcacccgtatttttcaaatttgtttcgtacctgatgaccagaatcacctaagccatcttaatgaattttggcgatgatgtcaaatggtcgcaaatctcagcgaatcaagatctatgtgcaaaagccaccgataaatcggcggccagagtgtaaaagttatagaaatgcagtcaaatgacattaagctcgacatcaatgttaccgcgtgttgctttggaatacggacaaaaatcatgcgcttggcgtgccagatcttcggcctgggcgcgttcaataccgggtattttcacatccagacgtaccgccagctggaagccgccatcgcttgggtccttgccgatagatacgtggctggtgacctcaacattgtctaccttcaccttagccttccgggccacattagccaatgcgctctcatagcaggcaccatagcctgccgcaaacaattgctccggattcgtagcttctccgcctgcgccacccagttccttcggcgtgctgagcttatgcttcaaaactccatcggatgaagcgactgaaccgtctcttccaccatgtaccgttgctgatgctgtgtataatgcttccatgatttcatctctccttctctatatcatatgttttccgcaggaatctatcgtcatgttaatacatgatttccttctcgtatgtactttaaacgaactacacaaaatgaatcatttgaaataaggttgttaacctgtacatttaccgtttagttccacctcaccttgtttacactatatgttataagcccctagcttgatgggccgtcaacatatgtcttgaaggctcactcgcatcattttattgtatctgctcagacttccatgactgacaaccctgtcgtacgcgagatcgtaggctacttgttggtgcggggtggagtccatgtgatggcctatgccaaagcgttggaaaagcttacaggcgtaaaatgaccaaaatgcttccgattcaccgggctatttatcgtttcagtccgaataactacaaggaaattgataaaatatggagcagcgttcacccggaagatggacaacaatttaaaaaaatccaaaacgaccaagccgctcccctcagagcgatatagcttggttttttctagtgttcagctttataggatggccatattgcttcaaaaatacgattaacttgcttgaccacacaaaagttgcactagacaaaaactattgtgagtgtacaatagggataacacaatcgttatgtcactaataatatatttcaacatcaataaagaaggtgaagcgtatgaaaaatacaaagggtaacttcgcggaaatcgcttcactgtcggaagtgaatcgttccttgagcgtcccgaaagacggaacctggtttcggaagtttcttgcctttgctggacccggctatatggtcgcagtcggctatatggaccccggcaactgggccacagacatcgctggcggatcgaaattcggctacacgttacttagtgtcattctaatctccaacctgatggccatcctgctacaagccttatctggcaagcttggcattgccacaggtaaagacttggctcaaatgtgccgtgatgcttacagtcgtcctgtcgccatcggcttatggctcttgtgcgaaattgctattgcagccatggatttggccgaggtcatcggttcagccattgcgctgaagttgctgtttggtctaccgttactatacggagtcatcattaccgcatttgacgtcatgcttattttactgctgcaaaacaaaggttttcgggcattggaaacacttgtcattgtgctgatggcgacgattgccggctgttttgggattaatctcattttggcacaaccggaatggggcggcgtattgggcggctttgtaccagacacgcaaattttgacgaatccaagcatgctgtatattgccatcggtattatgggtgctactgtaatgccgcataacctgtatctgcattcttctattgtacaaactcgcaaatttgagcagacttcagcaggtaaacgggaagctattacatttgcaacttgggattccagtatagcgctgatgttcgctttatttattaatgcggccatcttgatcgtggcagctgctgtattccatacggcaggaagaacagatgtagccgaaattagtgatgcctattatctgctttcgccactactgggaaccacgctggcaagcatactatttggggttgcgttactcgcctcaggtcaaaattcaaccgttacaggcactttagctggacaaatcgtgatggagggctttttgaatcttcgtctttcaccttggttgcgtcgtctggtgacccgcctcatcgcgatcattccagcggttatcgtcactgctatcgcaggtgaaaaaggtgcggaggaactacttgtgctgagccaggtcatcctatccatccagcttccctttgccatcattccattactgctctttaccagcgacaaaaagattatgggtgaattcgcaaataaaatgtggcaaaaagtattaacctggatcgtgaccgctgtcattatcatcttgaatgtagtgctcatcatccaaacgatttcaggttaatcggtagccaaaatatgaatatattaaataggtatctcactagccccaatggcagcgagatacctttttttgttcatcctattttatttgtcctgtatacataaagaatactcaacgcttggcaggctctacctttatttgcgcctcaagcgcgagattcagcttgagcacgttcacacgcggctcgccgaataccccggcgctgcggccttctgtctgctcctgcaccagtgctctcagttgatcctgcgggatacccgtcaagccgctaatgcgcggaatttgcacccgtgccgcctgtggcgagatgtgcgggtccagaccggagccggagtttgtaatcaggtccaccggaacctgactgacgggtacatccgggttatgcttctgccaatccgcaattgagtccttgactcgttgtatcaaggccggattcgacggcgcgtagttgcttgagcctgaaccagccccattgtaatcaacgctcgatacccgaccttggaaaaatgccgaatcggcaaaggactgcccaatcagttcggagccgaccacccgtccctctgcgtcacggagcatacttccgtttgcttgctgcggaaacagaacctgcgctactcctgtactgactagcggatatgccaaaccgcacaagagaatcatcagcaccgaagttcgcaaagctactccaataactgtacttcctcgcatctcttgtctctccggttgtccttccgacactgtcccggtccctgtacgtttgttatgaccttgcccgccagattcggctttttcgtgcgcagcaaatctgcgtccagacatcatccgataaaaaccactcatgtcgttcaccctttctgcactaaatccacaaatgcaccagcaaatcaatggccttaataccgacaaacggtacgaccataccgcccagaccgtaaatcagcaaattccgtcccagcaggcgatccgagctcatcggcttatacttcacgcccttcatggccagcggaatcagaagcggaataataaccgcgttaaagatcagcgccgacaaaatagcggacagcggggagccaagccccatgacgttcaaagcgcccatttgtggaatggccagcatgaacatcgccgggatgatggcaaaatatttggcaacatcgttcgcaatgctgaacgttgtcaatgctccgcgcgtcataagcagctgcttgccgatcgcgaccacctcaataattttggacggatccgaatccaggtccaccatattagctgcttctttagccgcgactgtgccgctattcatggccagaccgacatccgcttgcgccagcgcaggtgcatcattcgtgccgtctccggtcatggcaaccagcttcccctgttcctgctcacgtcggataaccgcgattttgtcctccggcttgctctcagctacaaagtcgtccacacccgcttctcgtgcaattgtagctgctgtcagcggattatctccggtacacataatcgtacggatacccatttcccggagctgatcaaaccgttccttcatgcctggcttcactgtatctttcaaataaataatgccgtatatctgatcatccagcgcgactgccagcggtgtacctccttcagaggctacctgattcgctttttcctccagatcggctggaacactgccgttttgcgatacgatccattgccgaacagaatccaccgcgcccttgcgtacctttcgtccatcggccagatccagaccactcatccgggtctccgccttgaattcgataaaggttccacctgctgccaaggatgcatccaacgtatgctcctgtttgcgcatcaattcgagaaccgagcgaccctctggcgtttcatccttcatagagctaatcgctgcccacttcactaactttgccttctccacgccctctacaggcacgaattcactcgccattcggttcccgaaggtgattgtacctgttttatccaaaatcatcgtgttgatatccccagaagcttctactgccttgcctgacatggccagcacgttaaactgggtgacccggtccataccggcaatcccgatggctgacagcagtcctccaatcgtggttggaatcagacagactagcaacgaaatcagcacaggaacaggcaaatcaatgttaaaatgacgggcaatcggcgctagcgtaaccactacaattagaaaaataatcgttaagctaatcagcaaagtgttcagtgcaatctcattcggcgttttttgccgctgtgcgccttccacgagcgaaatcattttatcaataaatgtctcgcccggctctgtcgtaatccgcaccttaatccggtcactgaccactcgcgtcccgccggttaccgagcaaaagtcaccacccgattccttgatgaccggagccgattcgcccgtaattgcagattcatccaccgaagccagaccttcaatgacctcaccatcgcttgggatcatttcgccctgggagacaataaccacgtcccccttacgcaattcggttgagctaaccacctgaatgtcatttccgatgagtttgttagcttgcgtatcctgcttggatttttttaaagaggcagcttgtgccttaccccgcccctccgcgagcgcttcggcaaaattagcaaaaagcaacgtaaacaacagaataacaaacacggccaggttaaagcccatttccttgccagtttcaaaataaccgggaagcagtaacatgagcagcacgaccaatgtaccgatctccacgacgaacatgacaggatttttcatcataatcatcggatttaattttataaagctatccttgatcgcatgcttcaagatgcttctgtccagcatgtgtttgcgttgttccttcatgatcaaacaccccgttcatccattctcattttcttcttcacatggtcaaaaattcagcaacaggtcccaatacgataacgggtaaaaaggtcaacgcaccaatcagcagcacgaccccgatcagaatggctccaaataacttgttgtccgtgcgcagtgtccccgtcgtcaccggagtcggtgctttggcattcaacgaagccgccacagccaacaatgcaatcatagatacatatcgtccgaagaacataaccatccccgttgtcacgttccagaatgtgttgttatccgaaagaccttcaaatcccgaaccgttatttgcagcagatgacgcatattcatagagcacctgagtcaacccgtgatagccagggttagtgaccgcatcatatccccaatgactcataaacgcaagcgcagttggggcgagaatgagaaacggatgtaccaaaatggcaatcgcgatcagcttcatttccttgccttcaattttcctccccataaattccggagttctcccgaccatcagtccgcatataaacacacccagaatcgcatacatcagcatattcatcagcccgacacccttgccgccaaaaatgacgtttagcatcatttctcccaaagcagccataccacccagtggggttagtgtatcatgcatattattgactgaacctgtcgttgccgctgttgtgaccgcagtgaataatgccgattgtccaatgccgaaacgaacctctttcccttccatgcttccctgagaagcatccacacccagtgtctggattaacggattacctgtcttttcagacacatacgtaatggatagaaaaataagaaacaataccatcatggagctaaaaataatccagccctgcttacgattacgggcaaacaatccaaaggtatacggcaacgaagccggcattacccacattgccaaaatttccagcacgttcgtccaaggacttggattttcaaaagggtgcgcagagttagctcccgcataaccccccccgtttgtccccaaatgcttgatggactccagagaagcaatgggtcccatagaaatctgctgctgtgttccgctcagcgtcgtaatatccgccgtaggctgtagcgtctggggtaccttcaatccaaccagcaccagcgtaagcacaaaggccagcggcaggaaaattcttataatggctttaataaaatcttgaaagaaattgcccattccttcaccgcgccgcgtcaatcctctcataaaagccgcagcaaccgcaaaaccggaagcagccgaagtgaacatcatcatcgtgacgaacgccatctgtgtcagatacgtaagcccgctttctccgctataatgttggagattcgtattcgtcataaagctgattaccgtattaaaagctagtgatgcttccatattactgtttcctgccggattaccgggaagcattccctgtaatcgcaacagcaagtagctgatcgccacaagcacgacattcgttgcaatgaaactcataacatacgtagtccaacgcatgctctccagcttcttcaatcctactaccttataaatgagcttttctgttccgccaaaaatccgatccgtccgattgggttcattcgagaatacatgatacatataggtgcccactggctttaccaagagcagcaatatgacgatcacaatcccaatttgaagcagctccatcctctattcctccttcaaaatgctcctgcgtttggaacaacagacctgcttcagagcaccaaacgtgtgcacacgtttgcgaaaacctgctacccatgatgcttaatattcagatctgttgttcccgcccgttctatcccctatagctgactagaacttttcagggttcaggagtgcgtagattaaatacataaacacaatagccgtaagcccaagtataacgatcatcctcttcgtcctcctttagaggtctgcgcatcacaccagcgtacaaacagcagtatcactccataactcacagccatgacgagcagcatgtatatatccatcatgtttataccctccgtatcggtcctcagatcgccattcctatttcatcataaaatcataaaacaactatgttataagtgcttatccgttcagcagaaaacccacctctccgttcaatgtgtagatcacatggtccgctcccaatcctcgataaattccttgtggattacagccgtgcgtaataacatagatcgattccgatgttagcggccgacatatttgcaggaaacggcaagtcagattcaagctgttctcgaacaaatacacactaccaatttctttttttggaaaattccattttcccgcttgcatggtattgatgcggacaatgtgctccacacccatttttttgagctgtcgttcctcctgggcgctattcgtcagaactgcaaacgccaattttttgaaaataagcaatttcacaaaacttctgcccgcttcattcggtgcagtgacaataattaaccgaccttccatcagtagctcctctcccggtataaaaagacaacaaaaagaagccgaaggaaaaaggctttcctccggcttctgacatatccatgataaaataaaccatggctgcacacggcggtttgttgcctctccctgtacgcttacgaggttagctgtcggattcggacgtgagagtcgccctatttctggcacttgaccggaaaattcaccccatgagacccacggcaagccgtacagtctcgattggttcccccgcttttgcaactgcaaaattcagcgctatagacatttcgttgttgcttcattcaagttaatttgaaattacgtcttgaatcatacacccgcgcatggaagactgtaaagctcaactgcggggttataaatcggcctttagagcatagaagattaataataacgcttacaatgcaactatgcttctcacagctcactcaatctctgtttttcatcccttttcgaaaatgacaagcatgtcaatattggcgtagggtagagcgtttttggcctttttttgtaaaaagaaaagaaaatacgctatatgtaccagctaaacaccgattgaacccgcttttataagaagaaacaccttaattcgctccatttgcagtgcgatttactgttttgaacaaaatacgattttacagcggctaaaggcttaatacagcttttccagacttgcaaccttactttgaattgcttacaatttaattgctgaatattgaataaggagagatactatgaccgtttatgaatatgatgcgcaaaccctgcaagggaaaccaattccgttatccacatataaagggaatgttctgcttattgtgaacacagccagcaaatgcgggttaaccccccaatacaaagcgttacaagagctatatgaccagtaccatgaactggggctcgaaattttgggatttcccagcaaccaattcgccaaacaagagccaggttccagcgaggagatttccgagttttgccagatcaattatggtgttacctttccgatgttcgccaagacagatgtcaatggcgatcaagcgcaccccttatttcgctacctgacccaaacagctccgggggtattagggtccaaagcaatcaaatggaattttactaaattcttaattacacgagaaggtaacgtatttaagcgctatgcaccacaaaccactccagataagttggcgggagatattgagaagcttttgcagcaaaactgatattcttcttcacagttattaaaacaaaaaaagcatcccttcacgtaaaccgtgtcaggatgcttttttaacaaggtcttgcatataatgcggtcgagaggactcgaacctccacgggcgtacgcccactaccccctcaagatagcgtgtctgccattccaccacgaccgcaaatcataatgtattgaggcaacagatttattatactctctcatcaactatttgtaaacacaaatataataattattttatatgttattttatctaacatatataagcgataataatatttaatttgacacaaaggctactaaaatgtaaatatatattacatatatttcgaattttttcgttatccctaagtaaagagtaaaataatataacataaggattcacttcgaggaggcgaaccgccctgcataaaggcaaccgtttgctgaactatgcattattgttggacccttccctacctgttggtggcttcacccgttttaacggactggagaaactattccgcaacggacatttgaacagtctacaagacctggaacattacatgctggatgatttgtatcctcaatttacaaccgtggacggcatggctatcaaaagtctgtatgtcgccatccagcagaatgacggttggcggatcgctctcattgataagatgctgcatacccaacgtccctccttgcagcatgtgaaggagttgcgtctatccggtcagcgtctacttaagctcgctaaggctctttatccttggcttgaatttgaccagttggaatccatactcattcaatacaatgcaattggcacactcgctaccgttcacacctggattaacttcctcctcggaaacgatgtagaacagaccgttcacggctatcttggtgcagcggtgtccttctgcgtggaagatgccttcaaactactcaatcctccttatgaggaaaagaacccttttatggagcgtatgaccagcgagctgctctccgcatggaagaagcttaacaaacctgagccaactgcatttcagcgtcgccttcttcacagacattggtgcagctcctacatcactctaccgctttatatgagccataatagccaattggatgggcctagactgttttccccctcaggtctattcaaacgccttccagcatccccctgatgcgtcgtttcgctaatgtggcagcaacaccaaaaacactctgtccctttcctcaggtggcagagtgttttttatccacacataatcgaaattcacaccattagtagactctagacgggttatcagaaccacctagcacttaattaagtaattaattcaacaaaataacgtatttgcgattgtaaaaacacgtataaaagtgtatcatagtttcagatggttaattctaacatgtttactgatgattattataacacaccaattattccgcaagaatccgtaaggggcgatttctcttgaacaacaaaatgcctgtcacctccttcgggtgggccatcaaacaacggcttgtcgaacttcgactggatcagaaaacattttgtgagacacacaatattccgccttcacgcttgtccaatctgattcacggcacccgcaaagcacaaaggtacagaaaacaagttgctgcaattctgaacatcgacgataacgattataaggaggcaccgccactctaaacccaacaagcattccagttacatataggtcattccatatcaccaagaaaccaaataaacccgtaaagcgaacccctccagttcgtttacgggttttcaacccagacgatctttagccaaaaaattattccggctttgttttatccttctcacttttttgcttacggtatttcgcaaattcaacatattctaaaataaaattctgttcttccgtctcaagatcttctgcctggcaattcagtggccccatcactccaaaaaaataagcagccttctgctcctgaagtacgccttcccctggcttaatccctttcattaaccaatcaagcgatacattaaaaaagtccgaaatctgaatcaaatgggcggtacccggcgttgttttacctcttctccaatcaccgagattccctgaactgattttaagtttttcacaaaatgccttcttggtcattccgcgatccttaatcaaggcttcaatccgctgataaatagtttgatctcccaaaatgtttcccctccgacacagtaactttttctgaaataattttcatttttcagccttactcattagaaatcctcatcaaatcctaagcaaccattaccccatagtagaattgcgctggtttttctctttacgaaagcgggtaaattcaatatactcaagtataaaatttctttccgtctcactaagcgtttccccctggcaattcagttgccctgaagcgtcaaaaaaataagggtcttgcgactccttcagcacctcaccctgtacatctcgacccagcataatccaatccagactggcatcaaaaaaagaagcgatttcaatgagtttattcgtgcccggcgtcgtttttcctcttttccaatccccgaagttccctgtactaatgcctaactgctggcagaacgcctttttcgtcattccccgttccttgatgagttcctcaatgcgatggtaaatagattgcatagaagttccttcctccctagcaggctctcaaataacgatatcatgttctctgttcccatttcaaagatcacgtatgctaaaattaccgaattatgtatgttggtttccattataccacaacacgcaacaaaaaccgcctgttttccgaagaaagggcggtctttaagccagttcacttacgctaatcacgtagcagcgttgtcgattttaagtaagatatgcttcaattcattcaaagtttcgctcagatgcaataaatcttcttctggcagatacaccagtctttcttgaattttattggagaaggtatgaaatacctgttcacaaaaagcatcgccttcctgtgtaatcgccacattcacgactctgcgatccgaatcacacgactggcggtcagccaacccatgctccaccagtttgtccagaagaggagtcatgttcggacgtgagacattgagctgtttggataaatcagataccgtagacaagcgcacctcacgcagaagcagtaatacctgaaagttattaggcgacaagtgtaatgggaaatcgagcggaccgtaggtgaaaaatttcttcttcacaatcggaaacaagcccaaaatattttctgatatatttcctaacagttgagtgtccatatttttcaccgtcacttcataagtttatacttatcattctataacattatggcattatattatactatggaatcattatttcatcataatcattactttattacatcactacacaaataaaaaaagcctctaccgcgagagacttctccgtttattccattgatgcggtcgagaggactcgaacctccacgagcgtacgctcactaccccctcaagatagcgtgtctgccattccaccacgaccgcataacaaaatataaatggtgagccatgaaggactcgaaccttcgacaccctgattaaaagtcaggtgctctaccaactgagctaatggctcatgctgttcatccaagctgtccgccattagaccagacctcaggaatttcccttaagcatgcaacatgtagtctataaagacaacaatgacccgtaggggattcgaacccctgttacctccgtgaaagggaggtgtcttaaccccttgaccaacgggccttattattatgcgccaacttggcgacaagaaagagtatatcaaatagaataacgaatggcaatacttatttctaaaatttttaaaaaagcagtttttataagtataaaatgcatattaacttacaatcccttatcttaaatcactaaaatcctgaaaatagcgataaacgattgcaatatcacttgtatttacttataatcacttacaagataccgaaataattatatatcagaggagctttctatgtatcaggaagaacgaatgttaaaaatcgttgattacttacagcttcataaacgtatttcggtggatgatatttgtgaattttttaatgtttcacgagatacggcgcgtcgagacctcgtaaaacttgaagaacatcaaaaaattattcgcacccgcggcggcgctcttctccctacactgcatcacgatccaattggaaattataacgaaagactacttactgtatccgaggagaaacaagtgatcggacagctggccgccagcatggtacgagataaggatcgtattatattggattcctctaccaccgtacaggcgtgtgcagaaagactgaatgtgcaggaatgttcggtcatcaccaattcaatcaatcaggctgacgtgctatctggaaaagacggtgtctccatacatctgttgggaggccgcctgcaaaaagaacaccgatatgtatatggctcctccgtgatcgccactttgtctcactattttgtagacaaagcctttatcgggattggtggtatatctgcccacggactaagcctaattcatgaagaagacggtatgctgaagcatcagatgatgaagcaggcagatcaggtgatcatccttgcggaccattcgaaattcggaatcaattttccatatcgttttgccgatctgtctgaagttaatatcgtgattaccgacagattgccagaaccagcgatgctggaaattttgcaacattatgatgttgaagttgttgtaccctcataaaatatgaaactgcttagctagaactcaagatttatcacagagatatcgaaagacaggagttggagagaaatgaaactgtttgcgattgatatggatggaacactgctgaacgaggaaggaaaaataagcaaagtaaacgcggaggctatacgccaagcacagcagcaaggcgttcaggtgacaatcgccactggtagagccgcttatgacgcctggacgaagctagaggaagcagagcttgtaactcccgtcattggagcaaacggcgcaaccgtacacgatgtgcatcgtcgtcagttaacctccactcctatgggccgcagtgaaacgtttgaagtgctgagctggctgcatgacaacgacttttactatgaggtcatgacagaccgcgctatttattctccacaaaacggacatcagctgcttgctgttgaaatggaccgcttgctgagctccaacccggatatctcgctggatactttattacatgcagctgaaaaacaatatgaacagaccggacatacccgcatcgcttcatatgaggacattccactggatgtagagatttataacgtgctctgtttctcctttgatcaagccaaattggagcggggtcgtgagcgttaccgaggttttcagggcctgaacatggtcatctcttcagaccgtaactttgaagtcgagcatagggatgcgtctaaaggtaatgcattgcgttatttggcgaatcatctgaacattcccatgcaggaagccgtagcgattggggacagctacaatgatatctccatgctaacaatggcaggaacaggcattgccatgggcaatgcaaaagacgacatcaaggccgtctgctcccaagtgactctgactaatgcggaagatggcgtcgctcatgctctgttgaacatactcaagacagtcgaggctgacaccgtgaaatagacgtcattggctgcgtacaagacaggctaacgccgcttcaagctgtacgcagcacgtcccctctccatttaaacgatttcagaccaccgttattctcaaagcagatatagacgaaaaggacgctcgcaagcatcattacaatgcatacgagcgtcctttttctacttaaaataccaacggagagagagggattcgaaccctcgcaccgctttcgcagcctaaccccttagcagagggtccccttatagccacttgggtacctctccatggctccccgaacaggactcgaacctgtgacaactcgattaacagtcgagtgctctaccaactgagctatcagggaacattactgtaaattatcttacagtatggttaatttaccatgattcagggggtgccgtcaagtgccaacaggcgaagcttccctccacatttcccacagcgataccgctgaggattcatcttacgcttgcgcatatactcctgctgacaggaaacgcatactagcttgtaacgataaggctgaggcttacgttccgttcttcccggcagagtctgacaatgcctgcttcctcctacacgggccagccatgctttgaagtcagcatctcgatgctgatagcccatcccgcgcaaatgcaaatgataatggcacagctcatgcttaataattttctccacctcagaacgtccgtaagctgcgagttgatgtggattaatttcaatatgatgacttttcataaaatacctaccacctgtggaagacaagcgcgcattaaaggtggcttgatgtcgaaacggcacgccgaagctctccagcgaaatgcgctctacccattcttgaagctcttcattactcatagaacggctcattgaatggttcattgaatggttcattgaattgctcagggacttggactccatcctaacggtctctcctcctttgctccttactgacaagcatattataaaataacgaccgaagtctaacccccaattcataagcacactttaggtacccaccccatatgctaaacatacagatgtaacgcagaggaggagatcggcttgcctcaatggctcagcaaccagctcatgcgggccttttacaaaaaggaccggcgccaaattaaactattgaacgattgttggtttttttatcataaagcacctggcgtggagttcgatgtcaacaacgggtaaaagttacaggcatccaaaaatgaaagccggaagctccgatacagttcggagcttccggcttttgttataccttcacaagaaggttgtacagctttatttaaagtattatgcctgcgattgcgcctctgcaggaggtttcatcgtcagaccaaccctgccttttttcaaatcaacattcaacacccacaccgttacgttatcaccgacagatacgacatccatcggatgctttacaaagccactgcgcagctgtgaaatatgaaccaacccgtcacttttaataccgatatcgacaaacgcgccgaaatcaatgacattgcggacggttccctgaagctccatacccggtgccagatcctcgatcttcagcacatccttgcggaataccggcaacggcagctcgtcacgcgggtcacggcccggacgctgaaggctgtccagaatatccttcagtgtcggcacgccgacttccagcttggcagccaattcgtcaatgttggacacgctcagtgcttccattgcagtcttagtacccagatcgtgagcgctgatgttcagttccgccaacaggcggtctacgacagcatacgattcagggtgaatcggtgtgcggtccagtggattttctccacccggtatacggataaagcctacagattgctcgtaggtttttgcaccaagacgtggcaccttctgcaactgacgacggttgctgaattttccgttttcctcacggtacttaacgatgtttttggcaatagtcgcgttgatccctgctacataggataacagcgcagaggaagccgtgttcacatccacaccgacatggttaacggctgattcgacaacgtcctttaagctttcatccagatgtttctgcgacacatcatgctggtattggcctacaccaatagccttcggctcaatcttgaccaactcagccagcgggtcctgcacacgacgtgcgatggaagccgcactgcgctcggccacgtccaaatcaggaaattcctcctgtgccagcttggaggcagaatatacgctcgcgcccgcctcattgacgatcagatacgctagactgctgtcaccaatgtcagcgatgacttccgctacgaattgctctgtctcgcgcgaagcggttccgttaccaatgacaatcaattcgatcccgtattgggcaatcaactgcttgaacttttcagcagcctcgcgcttcttgttgttcggcggtgtcggatacgtcactgccacttccagcagcttgcctgtgtcatcgacaaccgccagcttacagcctgtccgataggccggatcgacaccgagcacacgtcggcccttgatcggagcctgtagcaacagactgcgcaagttgcctgcaaagatggagatggcctgctgctcgcccttctctgtcatttcagcgcgtacttcacgctcgatagatggcgcgataagtcttttatacgcatcctcaatgacactgcggagcagatcttgcacgactgatgatcctttaatcacttgacctgccacgtaattgtaaatggaatctggcactacctccagaccaaccttaagaatgccctcccgctctccgcgattaatcgccagaatacggtgaggtggcattttcttagcaagttcacgatagctatagtagttctcatacacggattcttgctccgcatccttcgcttcggaggtcaacataccatggtccagcgtatatcggcgtacccattggcgaatagccgcatcatccgctatattttcagctaaaatatctaaggctccttggatggccgcctcgggattttcaactcccagctcagcattcacataggattccgcttctttcaaagcatcgccctgcttcggctggctccagatccagatggagagcggctccagtccccgttcctttgctacactggcgcgggttttacgcttttgccgatacggacggtacagatcctccacttcctgaagtttaaccgcagaggtgatagcagcctgcaggtcttccgtcagcttgccctgctcatcaataatgcggatgacctctaccttacgatcctccagattacgcaaatacaccacacgatcttcaatttcacgtagctgattttcatccagctctcctgtcatttccttacgataacgcgcgataaaaggaattgtattcccttcatccaacaaactgatcgttgtccggatttgcttgagtgccagcgacagctctctcgccacttgtttgacaatccgctcttggcgttctgcttcgttcggctcctgccggatttccgtcttcgtttcctcgttagacaaacctatcccttcttcctcacagctcttgtcttacaccatgtctttcattatcacaaaaaatgattcaaagcgccagcaggtgacgttaaagcaagccctacctgcatttttcattggacacgcaaaaggacagcgcccaagcgctgcccttttcccgtttcactcgtcgttccatcacgctaaaaatcaatcaaaccgagactgatttgtagcgaatcgctcactttgcgcatggtttcttcgtctaaatgggtgattttgtcggtaagcctctgcttgtcgatcgtccgaatttgctccagaagaacaacggaatcacgatcaaagccatgcgtcgccgcgtcgatttccacgtgtgtaggcagctttgccttctgaatctgggcggtgatggctgctacgatcacagtaggactaaaccggttgccgatatcattttgaatgatcagcacaggtctgacgccaccttgctcggaaccgactacgggtgaaaggtctgcaaaaaaaacgtcgccgcgctttacgatcaatatggattacaccccgctaactgtacggcccaaggtgctgtttgcatcttcctccgcgtgaaaggcttcggatgccatggttaagttaattttagccatttccatgtatccacgctgcatagcttcacgaatgtaacgtttttttcgttcacctacatacagcttcatggcctgcctgataaattcactgcggttggaattttccatagctacgatcccgtccacttcctgcaagagatgatctggcaaactgatcattattcttttggtgttctgcaaattggccaacttctcttccacccccaaaaccttgtcgccattgtaccattataacgttattcccggtaatttattcaaacggaatacaagagaatgtatatgacattcgtatatcatctatgctgcattccattataaactacgcagttcgttttcgtacaggcgtttgatccccgaaatacaagtgtcagcggagcctaatgcgtcttttgacagttatagcgctcttttctttcctttgtacatatttcgggacgttctgcgaaaactcctgcttttattcggtaatttgcgttatgaaattaattccagcgggttggaagaagcgagttcactcgaacaacaggaacatgacctcgtgtgtatacacgcggtaccctgtctgcgatcatgcagattacctcatagtggatcgtaccaagcttggatgccagctcatccgccgcgatagtttcgccggactgctggccgatgagaacaacctcttcgccggtttggatttcttccgcatcttctgcgaaagattgtaaggataccatacactggtccatgcaaatcgtaccgagtaccgggacgcggcgaccgcgtatcaacacttcgatcttcccactcagcatgcgggagtatccatccgcatagccgattggcagtgtaccgatccgttcttcactggaggtcacgtaccgggtgccatagctaactccccagccgggaggaagcgtcttggtataaaccactgccgtctttaatgacaacacaggcaacagttcaatggcttgccggttaacctcatcagacgggtacagaccgtatatactgataccaatccgcaccatattgggggaaagagaaggggtatcaatggtggcggcgctgttgcccgtatgtataatgggaatggtgataccttgttcccttagcgcttccgccacgccccgaaaccgatcatattgtagcagtgtatagcttttgtcttcttcatccgcgcgggcaaaatgggtgtacatgccttccagcagcacttgctctaattcgttagcctgccggacaaaagccatagcctcttctccaggcaacaaacccagtcttcccatgccgctgtctattttgatgtgcaccttcagcttgcgttcgtttccttggcggtccagtctgcggataccctccagcacttcctcactgaacactgtcaatgagatatcatgctcccaagccgtttgtacagcttccggtgaggtataaccgagtactagaattggtagctgaacccccgcatgacgaagctccaacgcttcatccagaaaagcgacgctcaaataatccgcaccaaggcgttccaattcctttgaaatttccacggcaccgtgtccgtaggcatttgccttgacacagaccagcatcagcttatccgctggcaatgccttgcgaaaagcttcatagttggcgccaaggagatccaggtttatttcggcccgggtcgatctgtattgtgcttgcaaaatccagtcaccttcttcaattgttagcctgtaacataacctttaccattcggagtgtggcacataccttacttccaaaggttaatggtaatgttcagaaacgtggctgtcaatggcagggggcgtttgccagcatcctctaccatatctacaatagaacaggatatacaagcgatgcacatcttagactgcgaatgaataaaaagacggatacgggcggcagcagagcatttttacactctagaccgtctgcatccgtctataaagttttatttacccgattgatcctgtatagaagcggcaatttgtatcatttcgctcacaggcaggtcagcactggtgattctgaactcgattccgtcattcatccaggtcatcgtctgctgttcgcttccggtcagaacggcaaagcttcctccaatatcaaccagttcgcctgcggctagtgcgactgcccgatcttttggacgcgcctccacaatggtataattatacgttccactataccgcagcatcacggcatgtgtaccattatcctccagctccggcgtatccttgatctgtactccggctggcgtgtaggatggttcgatcaagccaaactcacccatcacagcttctgccgcatctgttcccgctgacgttccgtttgcggcatccgatgtgctcggggtttgttgctgcgcctctgcattggctgctgcgtccgatttggacgtatcatttgtggcagtaccgtccaccttcgcttcccctgacggctgctggactgcatcccctgctgttccctgctcttgtccgggttcgccagacgtcacgccagtcgtcccatccatcgcaccggaaggatcaagctgaccgctgggctcaactgctccagaagatggcgccccttcgctacccgtactcgtcttacctgaagccatgttccgctccatatcaaaagagtctttgtcaaacttcgtatcaaaagcaaattgatcgaatttcagatcaacaactaccttggcattcgcatcagacacctgtacctgagtgggtgcatagtcatttttggacagccatatcttttgtctcaccagcgcatggctgttgtaattcgctgccacatcaaacacataggatttatcgtcggtagccaactgacgggaggcatcgccgataatgctgcgaaccaacgtttcatataaatatacttgaccctgattgtttggccagtcgcttttgaaacggaagcttttgttcaggctgggtgtcagtacaaatacaccctcatcattacgaagcacgatttgcgtaacatcctttttctcgttcgtcatggcaattcggtaataggacggcttgcggtaggaaatatccaccttgtattcctgcggcgtgtcgccggtatgcagcgtcatcaaagctgtaccgtggtagctgttcaggtcgctcaccacgtcactcaaatctttaaccacatcgtccgcgctcttcttgccgcacccggccagcagcagcgttacacacatgaccatggcaagcatccatgaaatccggcgcatgtcatcaaccccttcagcacatgttttaaatgaattagtacatgtctatgaaggacttgttcgatttatgcagactggcatgacaagcttgcgcgtatccttgcgtaatgctataaaatcttttggagagtgataataaattcatacaggaaataaaaagaacctcccccgttcagttcactgctttttcattttaaagaaattgcgttgattggtgagcctaccgatgaattattatcacgtcccaattcatatcactgtctgcttatgttcatcggtgggacaggtatggtggacattctctgacgaatattattttaatcggcggtttaggcaattgaccgggattcccccgggcaagtacgcgctttctgtctccggttctgtgcgcgtcaaggattggacgggtcaccatattcatattccgcgccgagcaagccgcatcatctatcatggagaaacgatgggcgatctattggcattaggggccaaagccagcggcggaagtctgcgactcagtgaatacagcgtctataaacatcgtcttgtgaaatgtcgccgatgtgggccttccactggatacccgcttgaccagtgctctcgatcctgatctaattatcatcgctaattcagatgaacaggaatatgagcgcattgccagtatcgctcccaccgtcaccttcaactccttcgccacgctggaggaacggatgcgtacacttggcacctggctcggtaaggagcgggaggccgaacgctggttgtctaccttcacagcccgtaatctggcaatgtggcagcagctcggtacgcaaatcacagccggagaaacggcctccgtcttcaactggagcgatgccatgacccggcaaaaactgcttactgcactgcccaaactgctcgtcacttcatcctgataagctgccattttctaaagatactacattagaccttgaatactcccatctgcctccagcgacatatgctcagctgctggggatttgggcaatcctggcatcgtcatggtattgcctgtttccacgaccacaaagcctgcccctgcggacaaagaaacgctggctacgtgaatggtaaagccttccggtgcacctagctgagaaggttgatctgagaaagaatacggtgttttggccatgcatacaggcagttgtccaaaaccaagctgctccataccggccaacgcccgtttggccgcaggagtgtaagctacctctgccgcaccgtaaagctccttcgcaataacactaattttcgcttgcaaatcaagtgtatgctcatacaatggtgcaaaatgggctttgttctcctgaagcaggttgagcaggctttgggccagcttctctccaccttggcttccctgtgcccacacctgtgacagttctacgggtacacccagcttgcggcattccgagaaaatcagttccagctcggcatcgctatctgttacaaaatggttgactgctactagtactggcacgccaaacttttgcaaattccgtacatgccgattcatgttgactaatccaagttgcaattgctccagattttctgcgtccagctcatttttagctacaccgccgttatatttcagcgctttggcggttacgaccaacagggccgcatctggctgcaaaccggattgacggcacttgatgtcaaaaaacttttccgctcccagctcggccccgaatccagcctccgtgacgaccacctctcccagcttcagggccagcttcgtaccgatcaaactactgcatccatgcgcaatattcgcaaaaggtccgccatgcacaataactggagttccctccaacgtttgcaccagattgggtttcaatgcttcccgaagcagcacagccataccttccaccgcatgtagttcctcagctgttaccgtttcgccatcttcgttataaccaatcaccatccgacccaatcgcactttaagatcgtccatatcttcacttaaacataataccgccatcacttctgaagccgaggtaatgaggaagccaccttctctcactgctccattacctgaccccaatccggtcacaatatttcgtaaactccggtcgttcatatcaacagcgcgtttccacacgatccgctccggtttcaaccgcaaagcatttccatgaaataaatggttatcgatcatcgctgccagcaaattatgcgctgccgaaatcgcgtgaatatcacctgtaaaatgcaggttaatgtcttctgccggaacaatctgggcttgtcctcccccggttgctcctcctttcatgccgaagcaagggccgagggacggctcacgcaatgcagcaacggttttatgtcccagcgcattcagcgcctgtgagagcccgatggttgtcagcgtttttccttctcccgccggcgtgggattcatcgccgtaaccagcaccagctttccattcgggcgatcccttaactgctcccacagggacggattcagcttcgctttatattttccatacgtctccagatgttcttcttcaattcctgcttccttggctatatcaataatcctcttcatctttcgttatgtaccccccgttttataagtctgaccgatggtgtcaaaccctgtatcgttttattttaccaaagtgtgccgcttattgcgctatgattcatttcatcgcaagcgttgctatcatgtgagttataaaaaaagagcattccccggccgcatggacttcggtgaatgctcttttgacacgtctcgttttaacaagcagctctcaaattaacctgcaaagttagcagcgtaattttcagcaataaatcccttagaaatcaggatagcttgggatttcttagtagcaggaccatagccttgggtcagcaggtcattaatatgtaagcggttatatatgaagcaaaatacaaagttggacgccccactcgtaaggatcgataccagaaaaataataacagcccacttccaatcccctctaaacaacgcagggaaaaaaccgaaaaagagcgtagtccatgaaaaacctactttgcgttccttgatcattccagttttatttctcaatttaatcttcatttaccccttacctctctttatatagtcttttagaactatattagattatataggacagagggaataaatggaactcatttcgtaaaatcataaaattctcaaatactctctagtttataatgcttttctagcatttctttaaaaacatcaacagggtacttgtattcgactgttttgaaaacaatccggttattccactggtttttttccagctcgcacccatgctccatatccagttccttcatgataaaaataatctcctccaaggttcccattacactatgactattcgtcgtcgtagccagcatctgctcgccttcctgtgtgtaggcctttacgatctgttcatcaaagccttcgctgatcataaattccttcaaggcttgcataaaaagagctggcaagtttttgtactgcgattttttaatcccaaaaagcgtgatgcttaagcgggatatatcatgcataaatactatattttttcttcgattcagtaaaaacaagctggcatgccaactattcaaaagcggataaatatcaacttgaagtggttcagtctcccattccttcagcagtttttgtgttcctcgtatgacaaacatcattgctctcctttattgacggtcctgtaccgcagcgtgattcgacatacctaatatctcatatgaggcatgtcccggatatcataacaccgtatttcaaacatcggattataaactctttcagtataatataggggctagcagttgccagtaatttgatcacatcttctgttaggagtggagatgaaattactacagtgccttcaggttaagaatatttagatcatttcatgaggtggttaaagcaattacctaagtgtgagtaatcgattatatttgagactgatttcattacttttaacggcacatgttagagaatattaatagttatttttgagaaagccttgcctctacaaggttttctcttttatctaaaaaagaatagttaattctaactgagtaaagaatatagtagagttaagtcgcatatcatcagattaactgctctaagccaaaatcataagaaaatctgtattaaaaagctgacttctcgggataagaagtcagctttttacgatttaggccaagaccttttctgattattcacaaatggattgcggtttaaatagagttttttattcttgtctactaactatacttttaatattttctttaaatgtacttagtttttgcccatcaatatattgattgttttctgcgtcaatactattaagactagcttgctcttttaacgcctgattgaccgcataaacgtttccgtttttaatgtcaaacttaccttgatattcaccagccacaaagtaaattggattaattttaggatcttggccctttttcaaaaataaaacgagttcatcgccttgcttaaggtagggattgtctgttttttcaacaatatcgtctgtttttattcctaattgggtaataacaatatttttttctgattctgttcctttaatcacatcagtcaattctgcattataccgtgtagaatcctcctctggtaaagtcccctggatacctgttatttttacctgtgcaaccaaatctacagcattagtcaaagcatcaagtgtatcataagatttacttaggcttaggcttaggcttgtaataactttggtttttccgcttttttcaggctcagatttattcggtgtcgcttgttttgagtctgcaacgattggtgcattattggttgttgattggagaacatcactttttactaaatacccaaccacccccacaatggccacggcagctattgttgtaataatatatttcttcatttaacttacctcccttattaataaagatcattaataccaaacacatcttcgctaggctgtggagtgtaaattccccaattatcatagcgttgtggtgtagttggatacatagcatttactaaagtcttcatctagtcctaagacatgtcctagctcatgggcagccaccgattgtgccttctgagaagaataattttgggtgaatgcggtattgaaccagctataggaactatagatataagaaactaaaaagtttatcaaatcattagttcgcccagaagagtagtagtcgaagacattcattacgaaatttataaagtattactcacaccaagcacttttcagacaaaccaatacattccatattgcagttaaaggttattagaatcaacttttcagttttagcaatttttattacagccaccagggtttcgaattttttgcccacccgcagtcaacttctcaccacctgtcatatacaaaaatggctgtatgccttgcttctcttaggtttttcaacttttcatcatgtttgagaggttaggaaaaaacagccctttaaccctccttcgaaaattccctattcaaattcgttggatatttattatggaaatccgctccactgctctatataattcaggtacagttcgtcacacgagcttaatctaaaaattaggggtgtaccacacctatgtcacaacatattttactaattgaagacgatctatccattgccgaaatgctactcaaagcactcagcaaggaaggctacaatttaactaccgcctatgacggggaagaggggcttcttgcctttgaacgtcatacctatgatctggtactggtggatttgatgatgccgaaggtggacggtatggaggtgatccgccggatccgtacccacagcgccgtacctattctgattatgtcagccaaggacagcgatgtggataaagcgcttggactgggctttggggcagacgattatgttgccaaacctttttcaatgctggaaatgacggctcgtattcagtccgcgatccgcagatctactacatatgcccgtcagcaacagcaggaggaacagccgcaagcacaagtattgacctacggcagtctgcgcattgattttgatcattttatagtcatacgcaatgaaaatgaaattcagctaacagccaaagagtccgatattttgaagctgtttgtagccaatccgaatcgggtatttacaaaagcacaattatacggatttatttggaaagacgattatatgggcgacgagaacgtgattaacgtccatattcgccgtctgcgtgagaaaatcgaagaagatccctctcatcctgtccacattaaaacgctatggggcattggctacaaatgggagaatggctgatatgaacatcgagaacatttctgaatggattgtcggcctcatcctgtcagtcgttatagtatggctttggcgggagcgtatggcctataagcgcaaaataaaggatatccgaaccctactagaacggattgtgacggtgaatcatgcggaaaagctgctatatgtcacaggtgacgttgaactgcaacgactcatgacggaaattaaccgactgctggacttgaatctcagagtgtctgcagattacaaccgtagccaaatcgccatgcgcaaaatgatttcgaacatttcccacgatctcaagaccccgcttacggttgtgcttggatatgccgagatgctggatggcgatccaactattttgccagaagaacgtataaaactgctatccaaaattcatcaaaagacaagtgaagcgattgagctgatcggcagcttttttagcttggcgaagctggaggctaatgatacggatattccgttgactcgactggaagtgggagaactgtgcagacgcagcattttggagttttatgacctgctgaccgcacagggatttaccgtgcatattgagatcccggagcaccccattcatgccttggggaacgaaggagcgattgggcgggtgctgaacaatctgatctcgaatgccattcgttatggggcagatggacggacgctgggtctggctctattggaacagcaggatacagtgcgtatagaggtatgggatcgtggcaaaggcatacaggaatctgagcaagataaagtttttgaacgcatgtacacactggaggactcccgtaataaggcggtacaaggcagcggactgggccttacgattgccaaacgcctggttgaaacgatgaacggagaaattcaattgactagtagaccttatgagcggacagtcttctcttttacattgaagaaaatcaactattaatcgaactcagcattttgcataattcgatttgtgctcaacttaataaatttgtaagaatctcgaaagaaaaatgaacatttcgccctttatccttgaattatcagcagtatacgaagggagaacacccatgacttacgtaatacgtacacatcagttgaccaaggccctgaagggcaatgaaattgtagcgggagtcagtatgaatgtgcgcaagggagaaacctatggctttctcggccctaacggggcaggcaagacaacgatgatgaaaatgattacgaatttactcaagccgacttcgggtgaaattgaattattcggtgagaaattaacgccaaaatcgtatcatctgctcggacggatgggttcgattattgaatacccgattttttatgacaggctgacggcacagcaaaatctcgaacttcattgtgaatacatgggctactataataagcaggcggttcgggatgccctagaattagtgaatttgcgaaatgcggatgacaagccagtaaaggatttttcgctgggaatgaagcaacgtcttgggattgcccgcgctattgcaactaagccagagctactcattttggatgaacccattaatggtctggaccccgtgggtatcaaggaaatccgccaactattccacatgctatgcaaggaatatgggatgactctgctcgtgtccagtcatattttagcggaaatagagcagattgcagatacggtaggcgtgattaatcacggacgactgattgaggaagtatcgatggagcaggtgcgggaaaccaatacggaatatatcgaatttacgaccaacgattgtaaaaaagcgacctacgtcctctcccatcatctgaatctgaataatataagggtactaaatgaacagagtatacgtatttacgattcaaatgtaccgcagaaacaaattacgaaaacgctcattttaaatgatatagaggtggattccattcatcagaaaagcagcacgctggaagactactttttgcgcctgttaaacggaggtgatctccatgcttaaattgatgcagttggagctgaaaaaatttcatctcgcgggttatatccgatcagcactgattgccaatgcatgcattcttgggctgctctgtattatcgcgctggacagtcaaagtgaaggaatacccgaattcacacagtacactcaactcttggatctaatagacaattttgtgagagcaacatttattgtattttcctccgttttgctatgccgctttatcgtcggagaatttaaatccaaatcgattacgatcttgttcatgtacccgattcaccgtcaaaagctgatgatcgccaagctcttggttgtgctgctgtttacgttcttgtctattattatttcggaaataatcattacggctgctattcatctgctcaaccagtttgtcttgattgtaccggataaccttactctttccatactgggccaacaatcagcacgaacgctgatcaatgccgttgctgccagctttatgggattggttccgctgtatatggggatgcgaagatactctgtacccaccaccattgtgacctcaatcctgattgtagcattgcttttctccaataataacggtgctccacttagttccatagcccccgtgcaaattggcttctctctactaggaatgcttgtggcttatgcggcgattcgacgtattgagtataaggatattacctcgtaatatgtaatctcctagagcgccttcaaaaaaaagatgaaaatcattgttagatatacacacatttttcactggacttcattctaaaacaggtatatcctataggagaaattaaaaacggaataaggatcttcggggtagggtgagattcccaaccggcggtatggctcatggagctaagcccgcgactctgtatctggcaacaggatacggactgatttggtgagatgccaaagccgacggtaaagtccggatggaagaagatcgaaatatcaacatgccgcgaagtggatgaatactgcgttattagttttgcagcaacttcatttaacttgcataaagcggcaagtttatttgatcaacccccgtcttgcatggctcgccatggacgggggtttttgtgccaccggtcctgtattcgcaaggagctaattgagtatgagtcaatcttctactgtactaacatccaaaggttttgatcgtagctcccacatgaaaagcggtttttggctggtcgcaattggagcagccttgtggggcgcagacccgctttttcgtattattttgctaaagtcatttacttcaacacaaattgtacttatggagcatgtgctgctcttcctcgctctgacaccgatgctgtggaagcatcgtgaggaactcaaagcggtacggcttcgtcaagttttcgctattttattcgtctcgtggggcggctcggctctggccagcgtgattttcactatggcactcagcaatggtgatttgaatgctgtactcttactccagaagcttcaacccttggtcgctattgttctagcccgtattattttaaaggaaatgttgccgcgtcattttggagtattaattgtagtcgctctgttcgggacgtatcttctgaccttcggttggtcgctccccttcggacatgttcgtgattttgttcaggttggtagtctgcttgcactcggtgcagcagtgctgtggggcggttcgacagtcatgggaagttacttgcttcgttcaatgaaatatgaaacagtaacctccctccgcttcatggtggcgctccctctgctgattgtcctcacctctgtagagcatgcgccatggaatatgcctgccggtacatgggcgggcgcagctgtgattatcaatctgctattgcaggcattgcttccgggccttctcagcttgctgctgtattacaaaggcttaagtacgaccaaagcgtcttatgctacgatggcagaactgagctttcccatggttggtgtcgtgattaactggatcgcatttcagcaaattgtcactgtagcgcaattgactggttttatgctcatctggattacgctctttatgatttcacgtcagcaaaaaaattaacagtttaacgtccctttcatgactcacccaagccaaatcgtgaagatgcttttgcatctccgatttggcttttttatatattcgtatttatataaaatacagttctttagacctatctttcagaaaaagtgtctaaaacatgtaattattcttcgtttctcaaagattacatctataaaattagtcggtttctgtcgaataaaacaatgtagtgatcatcagacacagaggagcaagagctatgactaaaacaaaacaaacagttccgtggtggaacaggtttctcaaacagttttatttaatgaggacaagattaataatatcttttttggctgtgttattgattccgagcgcacttatcgggtacttttcctatcagggggctacaacacaactcagtcagcaaatgggcggttccgtatacacgaatctgtatttgatccggagcaatgtcaatcagtatgtagcacctattatgaaagacctggacgtgcttaccactgaaatcaattctgattccattggtaccaaccaagaggcccttcagaagaagttggatgtcatcgtcaaggctcatcccgagctagatgccgcgcttctcggtaatgcgaaagggcaatacatacgttcgccgaaaaaacaggaggccgattatgacccccgggagagaaaatggtacaaaaatgcgatgctggaaaagggcaaagtattcgtcggtgttccagttgccagcgtcacgacagggaatttagtcgttaatatatcgggaacgctggaggacggtgaaggagctgttgcattggctttgaatctggacaagatgggtgaaagtctgcagtctgttaagattggtgaacgcggaggactcattattgttgattctgaatataaagttgtatctgggactggaacagcctttaacaagacaggcaaaaaaccggctgacgccatagagggacttcccgaagtggcgacaaccgtcgaaaatgatactccttccatgtcgcaaattcaatttatgaatcgagatatgctggcctttacacttaaggaccctctcaccggatggagcattgtcgcactgtcggatctggaggattacagtgatgcagcccaaccgattctgaagcaaagcctgattgtgattgtcatttccatacttgccgctgcgatcatcattgtgcttatggtccgctcgttcttaattccgctgcgcaagctgcaagcaggaacacgcatcgtccgtgacggaaatctgaccgaacgtgttaacctatccagcaaggatgagttcggcgaactggcacagaattttgaccagatgacgcattccttgcatacgatggtttccgaggtcaatcaaacgtcctcccgacttgcttcctcttctctgatgatcaaggaaagcacagaacaaacgacggagtccgtacaacacgtagcggaaacggttatggaatccgcagaaaatgcagccaccagcgccgaggcatccgagcaaaccgctaatgccgttgaagaaatggccaagggtgtcagcaccattgccgaatcagcaagctccatcgtagattcagcaggacaaaccgagcatgatgtagctcaaggcagtcaaatgatcagccatgtgcggacacaaatggaccgtattctggaagctgtaagccaaacggctagcctgatggatgagctatcccagctctcagacgatgcgaagcagatgaatacagctattgccgccattgccaagcaaaccaatttgttgtctctgaacgcgtctattgaagcttccagagctggcgaagccgggcgtggatttgccgtagtcgctatagaggtacgcaagctgtctgagcaatccaaggaaagtgcagattccatcagtcagatcattactcagatgctcgatttgattcaacgctccaccgctaccatgaacggtaatgttcgtaaccaggtaggtgaaggattacgtattagccaagatgcagaaggtgcatttacgaatattgaacgctctacatctcatattgtggaacaaattcaaagtgtgtccgctgcggctgaacaaatctcagccagtacagaggaagtttcggctactgtcacccatttggcaagtctgtctcgcaattcggcggacagttcgcagacaacctctgctgccgctcaggagcaaatggcggccatggaggaaatcgcatcttcgtctcaggagttgtccaacatggcccaggatttgcaacagctggttaagcgatttaagatttaagttacacatcgtatcgttgcaatttcatgaaattaagaatgagcagcagtatatctaatgactaacaaaagccttcgtccgtatgctagttacgggcgaaggctttttccatgtgagtacttggggtgatttctctcttgcttacttatagggtcatctgaccagttaactgacggcgtctatctccttcggggtcgtgctccattttaatatcctgatggaaaatagctgtagtccgctcttccctgttgtacatcggccaagcctcctcggacagcacaggcttcccgtcacgtgcaaaagcaacccatgcctgctgcatagcttgagcgagcttctgcatcgacggttgaatctctaatccaagcttacctagaagctccagattatcgaaaacaaacgcaatttcggcaccgtgaaccgcttgtccaaaggtaggatgccccggcaatgtccaatcaaaacgatacatccatacaggcgcatgcgccgactgcgcaacagcaagagccaatgcaggacgccaaaaaaatagatcagtcaacatttgtgcctgtccctcaatcgtaacaggaaatggttctatcaggtcgctgatgtctgacatgcccgtcatcatttccaatgcctgactcgctgttgacttgttcattagatgggattcttttcggatgaaataggccccctcatgcaggttcgttccaatcaaaacggatacctgctttgctgaaccttgcgcgattgcagacagcggttcatctggcaaggtcacaccgtccacgacgggttgatagatcatcgccatccctggtccgatgacttcatgcgtcttcgccatagctagcatcagcgcatctgtcggcagcgtaaacaaccgttctggatgctgagtgtccacacccagctgctgcagatacacagccgtcacttgttcggcctgtgaggttggcaatacctgcgacgcaccgctctgcaaaatcgcacgctggaacagtccctcagcggatggcatcgccaataaagcggcaatactcatcgcgcctgccgattcaccgaacaccgttacttcgtccgggttaccgccaaaggcagagatgtgatccctaacccattccagcgcagcgatctgatccagcagtcccgcattagaggtcaggccatctccctttggagtcagatgcaaaaatcctaacggccccaatcgataattgatcgtaacaaccacaacatcgccattcttcgccatgcgttccccgtcatataaaggtataatcccggaccccgtgacaaaggcaccgccatgaatccacaccatcaccggacgtcccttctcaggagccttcgaagcaggtatccaaatgttcaggtataagcaatcctctgactgctcaggcggttccaccagatttccagtcatactttcagcggatggcataggttgcggacagattggcccaaaactcgtcgcagcccgtacatcctcccaagactccaaaggctggggcgcatgaaaacgtagttttccaacaggaggctgtgcatatgggatacctctccatacatgatatccattccccgtttccccacgtaattgacctaaacgagtatgtaccgtaatactctccatcatgaagcctcctttatttcgtatcttcaacacaacggtataatatcaatctttacatatctctattataccctttgcacacggccaaaccaaaaaataccggaagcacttttgcgctccggcatttttataaacaagatagggaaatagcgattaatcccgaacttcttctttgggaatcaacttgtaaatttcttcgctttccatagagtcaattagtcggtctagccacttgtaataagcgacggcctgcttcattttcatacgatcttgttgaagaatcgccttaaattcctcgtactcttcaccctgattcatcaatctgtccagctcatcaatggctttgcgcaacaccagtaaatttgtttctaccgcttttctccatttaatagcgaagaaatcagtgaaggtttgatgccagtcatattcgacttcatacaagtctttgcgtgagcccttgctccaaaccttatttaccattttcagatccagtaatgttcgaactcctgtactcatgctcgttttgctcatttccatttcacggcccatctcgtccagcgtcatcggtttatccgcaaagaaaagcaaaccgtataaatgccccgcagacaaagtgatcccatacaggtccatgtttttacctatagcttctataacacgtttgcgaattttttgcagcgaagcctgctgctcatcacctaactggtacaagctcatgcttgcaacctcctaattttagagcattttgcacaacctagtatgaacgatttacccgtaaaagattagctttgacgcaatgtatgaaatctttcaataataaatgaaatgtttcaaaaacaaagcttctgtctatattacaacagcatggatcgttcaaaatcataattcgcaaaattgctaatgatagtaaacttttaaaattatggatatacataaatctttttcttatggttatatttcattgtctattttaaaaaaagcactatcggttgtaaagttccgaatgtttgagcattctatagaacgaaggagcatatcaaaggaaactttgtacagttttttctgtacgtactttatgaacagtttttttgtttgaaatgtaagtagtgcttctgttacaattaattttgtcattaaccgttcaggatgttcagaattatgatttttatactcaatccttaatgcaacaaggggttaataccaagcaaagtatagaaagaagaggtgtatgtatgacgattttggaagtcaaaaatgtcagcaaactctttggtcctcacgcagagcaaggtgttccgctcctggagcaaggctggggcaaggaaaagttggccaaagaaaaacagattactgttggtgtcaataaggccaacatggaaattaagcaaggtgaaattttcgtaattatggggctatcgggcagtggcaagtccactttggtgcgaatgctaaatcgcttgattgagcctacctccggtgaaattctggtccacggcaaagatctccgtaagatgaacaaagaacaacttcgcgaagttcgtcgtaaaaccatcagcatggtttttcaaaaattcgccctgttcccacatcggactgtattagaaaatgtagaatatggtcttgaaattcaaaaggtagaaaaagcacagcgtcaggaaaaggcgcaacaagcgttggaactggttggtcttaaaaactggggcgataaaatgcccgatgaattgagtggcggtatgcagcagcgtgtcggcctggcacgggcgctggctaatgaccctgaagtgctcctgatggatgaagcgttcagtgcattggaccctctcattcgccgtgacatgcaggatgagctgttggaacttcaagataaaatgaagaaaacaattgtgtttatcacccatgatctggatgaagcgttgcggattggtgaccggattgccttgatgcgagacggtgcggtcgtacaaatcggtacaccggaagaaattatgatccaaccggctaactcttatgtagcccgcttcgtcgaggatgtggatctgtccaaggtattgacggctgctcatgtcatgcttcgtccagaaaccatcaccatggatcgtggtccgcgtgtggctctggaattgatgcgggagcgtgggatttccaatttgttcgtcattgaccgtactaaaaagctactgggtgttattaacgccgaggatgctgttcatgcactgcgcaataatttgaaaattgaagatattttgattactgacggaccgcaggttgctgccgagactgtcattaatgatttgtttgaaattacaagctcgtccaaggtgccgctggctgtggtcgatgacaagcaaaagctgctgggcgttatcgtccgtggagcattgcttggcgcacttggtggagatgttaccactacaaaggaggtgaatgcccatgataccgaaactgccaatcgctgagtggattcaatccattgtcgactggatgggtattcatctggctggattgtttaatgttatttcttctattatagaagctgtagtaggctttttctcaggcctgttcatgcttccgcaccctctggtgttcatcgtgatcatcgggattatcgcctttatgatcgggcgggttcagcttacgctgtttactgtcatcggcttcctgctgattgataatctcggctattggagtgaaacaatgaatacgctcggactggtcatcacgtctgcgctcgtatccattgttatcgggattcccatcgggatctggtgtgcatacagtaaatccgcatcccgcattatcacgcctttacttgattttatgcagacgatgcctgcgttcgtgtacttgctcccagcggttacctttttcagcctgggtgttgtacctggtgttatcgcatctgttatctttgctatccccccaaccattcgcatgactaacttggggattatgcaagtatcaggtgagctgatcgaagcctcagatgctttcggttcaacctctgcgcaaaagctgttcaaagttcagcttccactggcattgcctaccttaatggctggtattaaccagacgattatgctgtcactatccatggttgttattgcttccatgatcggtgcagaaggcatcggtgctgttgtataccgtgctgtgacacagctgcaaatcggtaaaggttttgaagccggcttagctgttgtcgttctggctattgtgcttgaccgttttacgcaaaacctgtttaaacctacgcaaaaaggcaaaagccgcgtatccagcaagcaaaaagtatggattacttctgcagttacagctgtcattttgatcgctggtgcttcccaatattttattggtacagatcattccgcatctggcaaaggtaacgctgctgccaacccggttggcgaagaagtcggttacaaaattatcggtattgatgccggggcaggcattatgaaatcgactgccaaagcaattcaagactacaatttgtctgattggaagctggttgaaggttccggtgcagctatgacggccacactggacaaagccattaaagcgaaaaaaccgatcattattacaggttggactcctcactggatgttcaacaagtatgatctcaaatatttggaagaccctaagaagtcttatggtgaagccgaggggattcatacgattgcccgtaaaggcttgcaacaggatgctcctatcgcttatgagtttctaaaacgtttcaaatggacaccggaagatatgggtgaaatgatggttgccattcaagccggaaccagtcctgaacaagctgcccaggattgggcggagaaacatgccgataaggttcaggaatggactaaaggactgcaacctgtcaatggcgacacgttcaagctgagttatgtcgcttgggattccgaaattgccagtacgaatttgctaagttatattttggagaacaaactaggttacaaagtaaccgcacttcaagtggaagcaggtcctatgtggacgggtgtcgctagtggtgatgtagatgcttcaccggctgcatggctgccgttaacacatgcggattactgggctaaatacaaggataagctcgacgatcttggggctaatatgagcggtgttaaaaccggattggtcgttccagcttacatggatgttaaatcgattactgatttgcaggataacggagccgaagcggctccggcttccgccacaaccgaggactttggcaaagaggtcggttaccgcattgtcggtaccgaccctggcgccggactaatgaagctgaccgctaaagctattaatgactatggcttatccgactggaagctgcttgaaagctctggagctgctatgaccgctacactggataaagctatcaaagccaagcagcctatcgtcgtaacaggttggactcctcactggatgtttaacaaatatgatttgaaatacttgaaagatcctaaaaaagcgtacggtgataaggaagaaattcatacaatcgcccgcaaaggtttaaagcaggatgctcctgtggcttatgaatttctaagccgctttaagtggactgctgaagatatgggtgaagtgatgatcgcgattcaggacggtattgccccacagcaggctgccaagaactgggctgataaacatcctgacaaggtacaggcatggatcaagggcctacagcccgtcaacggtgatcctttgaagctgagctacgctgcttgggattctgaaattgccagtacgaacgtattgaaatatgtattggaacaaaaattgggctataaagtaacagccctgcaagtggaaatcggcccgatgtggactggtgtggcaggcggaagtgtagatgctactgctgcggcttggcttccattgacgcatgctgattattgggctcaatacaaggataaagtggatgacatcggaaccagcatgactggcgttatgtccgggcttgtcgttccatcctatgtgccgattgattctatcgaggatcttaaggcgccgcaataatattttttccgtttttaaaccatacgaataagtaaaaggcagatcagggtttactcctgatctgcctttttatgatatccatatttaaagttgctctcagccttttagcgtgaatccttcttgagcgggcacatcggcatactgccctgtcgtctgctgctgtctaaagaataacggatagatcacaaaggacaccagcagactcacacaaccaatgacgcctagagcaatcatatctttgaagatgtaggtgatatccagtcctttgagcgtgatgttccgtacagcgtccaggtaatacgtcagtggcaatatttcagcaagcccccgcaagaaaccgggcatagcctctaatggccacgtataacctgacaacataaaggaaggaacagcaatcagcatcagcgtttgggtcgcatccactctggtcttggaaaagagactgaacaggaagcctaatccgcacaaggcaaagttaaagaccagcgacaccaaaattaacggcagtacctgtcccctaaacggaatatcaaagcataaagcactgatactaaatacagtcagcacattgaaagctcccgctgcataatacggtgccagtttggcaatagccaaccgccaaggggtatttctccatgcaccaaatcttccccaagtccctgcttccttatcacgcgtgcaggacaacgcgataccaagcagcaaacactgctggagagccgcagagataacccctagtggcatgaaaagcttataatcatataccgggttaaatagcactctggatcggaacgggatggtagtcagcgtcgacgcagcctgatcggcgttcattcccttttgtttcatggaattgaccgatactccagcgctcacgctgctaatgacctgattcgcaatccgactggcactattggaatacatcatattactgccgtcaatcagcgtgagcacgggtggattctccccatgcttaagccgagtcgtaaagttgtcgggaatgacgattccgaccttagcttccccggtctctacctgacggacagcatcttcctgattggtcgcttgccgtgtaacggcaaatgagtcggtcgaatcgaacgcctgaataatctggcgactgagctgtgaattatctccatcgtacactgtgacaggcatctcggtaatccgctggtgtgaatataggaaaccgaatagtatcgtatacacaatcggcgtaatcagcagaatagccataaagcggcggtcccggaagatgctcagccattcctcgcgaaacacatcacggatacgaagtctttcctgtgaatcctgcatattactgcgcccctttgcctgtaaacaggaccgtggagcctgttggaaccgaagcagcaaggtccggcaatgctactttaacaccgaaggaacggacatccttgtcaccggagctttggctcggtttttgaatggcaaagtcagcagccgattctaacagaatgactttacccttcagctccttaccgccagacagcaatttaatttggacagtatcccctgcttgaaggccattcagagacgtttcaggtacatagaatttagcccaacgttgtgtcgaagtttcaatggtatagactgggaatcctgcgctagccatttcacctaagctaagcgacttggattttacgattccatcttcggccgcatatagagtcgtgtaactcaaataggtctgagcctcttgaagtgcggcttctgcttgggctacctgagcattggcacctgcaaccgcagattgagcctgctcaactgtggattgcgccgccttcacagcagattgcgcttgttctaccgaagcctgagcagctttgacatcttcctgttgcacagcaactttgcccgctcctgcctgtgcttccttcaccgcagccaaggcttgacggtattgagcttcagccgccgtaatttcctccttgcggctcccctcccgtgccatatccaatttttgcgactctgcattatacttggccactgcttgttgatgttccaatgtcgcttgatccaaagatgcctgggttgctgctccggcttcttgaagctttttggcacgctccaggtttttaacggtcaggtccagcgtttccttggctatcttcacagatacttgcaattgctcaagctcctgcggtcttgccccgctcttgagcgcatccagttttgccttggcggcgttcgcagccgctttggcctgttcgatctggctggaggatgcctcagcggtcacactgaccgatgtcgtaccttggctcttcttggcctgagcggcgctcacagtagcctgtgcctgacctacgcctgcttgagcctgcaacacactggcttttgctttggatacattactcttagctgccagcaacgccgcctgtgcctgcttcaccttatcttccaactcgcgactttccagatgggctaacacctgcccctttttaacctgatcgccttctttgacgagcatctggtcaatccgtcctgccattttaaagctggcattgagggtatccgactccacataagccgtaggtatggaagaagactgatccgcagacaagctgcttccaccccgtgggaaagcagtcaaggcataaattcctaccgcgattaaaataataagtacgacgtaaatcgtatattttttagctttcatgttttcatcactccatctgtctattaatgttgcatgcccaatgcattacacacaaatacttcaatactttctcgaacctcttgcagattcatcgtttcaccccaaaccatggaacgcatcggagcgaaaatgtaaatcccaaataagcaattggctgttgttttggcatccagcttacttgaaattttcccatataacttaccggaatcgatctccgcctccataaaatcaaaatagtctgccagcacctgcctaatattaaaatgctgttcctgtgagacccatcccttgctaaccagtaaacggcagaaatccggctctctcccaatgaactcaatatgtacttggatcagcttgtgaaccctcagttctacctgatccataggaacctgagccatcgcttcatggatatcctgcacaaatcgctccatccccatcttcaaaatgtaaatgtacaattcttgcttgtttttaaaattgtagtacagggttcctttggctatgccacaaaccttagcaatttcttccatgtttgtttcgttaaatcctcgttcggaaaaagctttaagtgcgccgttaaaaataatttccttcgtttgctgtttcatgcttcctccttttttgaactgaccgtccagtacaaaaattatgtatttattataagcccatctttagttacccagcaataggaaaaatgaaaataattcattttagacaattcgtctaaacgcttattctaaaaaagaaaatgcaaaaacggatcgaataagtgagggggtcactcatttcgatccgctatgtcataaaatcggatgataagggggccattctacagattaccaaccgattttaagggaaggccgactattttttcaccgtttgattgtattgcgcaattttgcctgtaatttcttgtgtagcttgatccaatgcctgttttggctgttgctggccactcagaacggcctcgattgcaccttcgacgatttggcgcgcttctgggaatacgcccatcactgcgccctgtgtagcggtggattgtgccgatgcgtgcaattggtcaaccgccgtctggaattgcggatattttaccatattgtctttgagtaccttctcgtcataggctgctttcgtgatcgggaagtacccggtatttacactccattgtgcctgtacagctggggaagcgacgaatttaatgaactcccatgctgccttctgttgggcttcaggcttgttgttcataatgtacaaactcgcgccgcctacaaccacgccgccttctttagcttcattggctcttggcaggaatcctgtgcctacttcaaatttatcgccaacctgctccacaatattacgcagcgaagcggtggaatccagcgtcatcgcaatttgtcctgcggaaaaagcctttgccgtatcgtctgagttacgtcccagattggatacaaccttttcatcgatcattttcttccaccacgtcagcgtttttacaccggcatccgaattcagcatggattccgttgccgcttggtcacgaccattgccattattcacataatccgcgttctgattggcaaacagttgctccataaaccagccgtagagggcaatggaagcaccggatttaccatccttgctcaaggcttttgcagccttttcgaactcatcatacgttttcggaggattagctgggtcaagtcctgcggctttgaatgcatccttgttatagtatagtatcgggtttgacgtattgaacggcatagcgtttaatttaccatcaatcgtgtagtaacgcgtaatatttggctctaactgcgacagatcgaacttgtctgcatcaataaattgttgtacaggtgtgatcattttggagtcgatcatgaatttactaccgatttcgtatacttgaatgatgtccgggccgctgttggaaccaagtgatgccttcagcttgttcaagctgtcatcatatttgccttgatatactggctctacctgaatgtccttatgactggcgttaaagtcagcagcgatctgcttgattgctttttcaccgttaccggacatcgaatgccaccaagtcagcttcactggagaagtcgctgctgccccatcactaccattactcggcttctctgcagcagtattattgctacaacctgctgcaaccaccatggcagtcagaataagcagggtcaatgtacttttcagacgaaaaaatctcataatctctcttctctccctttgattaaatgatcttgaattggcattctcttgcgatattcttgtgtgttgaagctctgtatatgggctgcttgcgcaggtgttgcttttcatttgaaatatgtgatcagcctttaagcgcacccgctgccattccacgtaccaactgctttagtccaaagatcagcaggagcagagacggtaaaatgacaagggccgtacccgcaaataccaaattccatgaagtcgattcctgaaattcgagcatggatattccgatctgtaccgtacgcatattctcactattggtgatcagtaaaggccagaggtatgaattgtacatattcaggaacgaatacacagccaatgttccaagcgcagggcgcgataatggaagcacatggaacacaaagtaacggatatgtccgcacccatccatacgagccgcctcaaacagttccttgggaagctggagaaaaaattgccttaacaggaatgttccgaatgccgtcgccagaaaaggaaccgtcaacccttgatacgtatcaagccagttccagcttcgtaccgtcaggtagtttggaataatggtcacttcccaagggatcatcatcgtcgctacaaacatgctgaagatgaagttttttcccttaaattccatcttggcaaaggcgtaggccgccaagctcgctgtaatcaactgcccaatcatcgtcagacccgaaatgagaaatgtatttccaataaaggctgcaatcggaacaatttcaaacacttcagtgaaattctccatatgaaaggaatgcggaagaaagcttggtggataagcgcttgcttcctccggcgacatgactgccataaaaaacgtatatataaccggatacaaaatgagagcagctgcaatcgtaagcagtacatacagcaatgttgaattcaggtgtcgtttcattggtaatgcacctttctttccacccatttgaactgaatcatcgtgagcagtagaatgacggcaaacaagacaatggcctgcgcgctccccgttccaaaccggaaattaacgaaagcttcctgatagatggaatacacgaatacattcgtactgttcaccggaccgcccttggtcaaaatgttaatttgagcaaaagactggaaggctccaatgatggagactactgttacaaaaaagatcgtcggtgataacagtggcagagagatacgccagaacgtgacgagcgggccagctccgtccattttggcactttcatacatgtcatctggaatcccttgaagtccgctcgataagataatgtaattgaagccaagattcatccagatggtcatcatggctactgagaacagcgcccaatccgggctggtcagccacggaaccggattaatatgtagcagggaaagcgcatagttgaacatccccagtgtcggatgaaaaagaaatttccaaatgaccgcagatgaaccgaccgacaacaccatcggcagcgaaaaggcaaactggaagatacgcattccccgcaatttactgtgtgtaagtgcagccagtaccagcgccaataaaatacctactggtactgttaacagtgcaaacaggagtgtgaccttaattccttgtagaaacagtcccgagctgaaaagtgtagtaaaattatctaaccccacataagctgcaacgtttcctgcgggatctgtagaatgcaagctgagatatacggacttgatcatcgggtaaaacataaatacagcaaacaaaataagcgatggagccaaaaaggtatacgccagcgcgttttcgcgcaatctttgaatttttagcgaacccgtgcgtatgcgggctttagacgaagtctgttgctgactcctcgtccctagtcccatagatttattaagctcacccaaaacggagcgcccctttcttttcaaaccaacctcagtaagtgtatcgttttgatgtaaagggaacgtcaagtggactggagtaaaatgttaatgttttttcattttgtaaaagcaactctctataggtataagcacaaggacatagactcctgcatataatgcatcattacagggtatggaggttagaggcgaatgccatacaacaccgtcaatccgcaaactttatatcaagctagaccggaattacaggcggaactcaaaaatatccgcgatcatttgcattatcaattaagcccctacatgaatcacacggttagggtgcaaacgatggatcatcaagtatatgaaggaacgattgtacacatcgatgcggatcatttgtatctgagagtccctcagcaatatcactcccccttcccaggcaccaccacgcctgatcgctcctatgcctacaataatgtcattctgccgctggtgttgtataatttattggttatcaccctgttgagctgatgctcgatccacatctctctaattaaaagacaaaaaaacctccaaattctgtaaggggccttcctggcacattacgaagttggaggttttagttatttgtttttcataatcattagttctcacaagagatacctgcttcttgctctagtacagctataaacctttctatacaatctccactcggcaggtgggtgaacacctcgttcacaccctgattgatcagcgtgatgttccccctaaaatccgacaaattcttatccagcttagccagtgaaatatgatgataattgatgaacttgacccaaggagtacccatagtgcaggaataaaagatgattcgttgggatgtcactgccagcattccatgatgcgatatcttctgggagctctgttgcaaatcatacatacaccccatacatgatcggatgtgttcgcccgcttctaacgtcagactaatagctcgcaactctttttcatttgtttgcatcccgtctcatctcctgttcgaagttcaggaacgagtcacagctccttgacttcagatcagcttttacggcttgtcccgccgacctcttcatttttcgtcagattaagactctcgcggactggacaatgacctacctcaactgcacattgaaaccaaggatggatatgttacaacttaacatgggtacgggatgttatcaacaagcaagctatcactctttttcagtataactccgcaatctgcgcattgctgaagaagcaattatatctaattttaagtgattggaatggatgaatttcagaaacgaggaatggtatacgcttcttcttggcaagctaatgtgagaatacgttagaacggagaagaagccttatgaaatataaccgtttgctgtgcgctggaattgctgtttctttactgtgtatcagctcttgtcccactccatctaccaatgcacaagcctcatcatacgcctcccccactcctacaaagggaagggcctattacgaagaacggggcgacattgtgtgggaagttcctacccatcgtaagcttatcgctctcacattcgatgacggaccggacaaaagcaatacgcctgccattttggatttgcttaaagagtacaatgctaaagcaaccttttttgtcgtcggcagccgtgtagaaaagcttcctgatattgtgaaacgagaacgagcagaagggcatgaagtgggcaatcataccttttatcattcatcttttcagtatatttcccgtaacaaagctctgtcagaattggatcaaggccaagcgagcatcgttcaagcaactggtgcaggaacccatctttttagaccccccggcggctcctacaccgattcgctcgtcaagctttccaaggaaaaggggttcaaaattattttatggtcctggcatcaggacaccctggactggcgaaaaccaggtgtacaccgtatcgctcatagggtgcttcgcaacgcccgtaatggcgacattgtcctgatgcacgattatgtacatcaaagtacacaaaccgtcgaagctctgaaaatcattttaccagagctcaagaagaaagggtttaccttcgtcacggtatccgaattgctctctaatcgggaaaaaccggatgggctcattgaagtgaataagtaaaagagagcaataaaactccgtcaattatttggtgacggagttttatacatgagggttttgcgaaaacctaataaggaactgataattctccgagcgataatgtgttattaacgaatggctcagagaatgtatggtatagctggcttgaactttaaagaagcctattacatcatattgctatttcatttgctagctgtacctttcagtccaatgttttggaggctagccattgcatcatcgttattttctttccgttaatcaccttcgatacttcgttgttataaatgtaaatccaagaccagtggccattgtattcatacggtgtttggtcgctctttttgtacagaccagaggtatctactacgctatcaaataacgacatatgaacatcctttgctccagcattcactaaacggttgtaggtcggaaccgtataatcgttcggcggtactacggtgtcggttttggcagccacaaaccagatcggaaggtccctcatttcgttaatctgttcatcggttataaggctatccttcaaggcttcacaggcaaccacagcggctgcaaaatagtctttataatcacggatcatcagcatagtcatgtaaccgccgttggagtctccgccaatgtagattcgatctgtatcaatgtctttgttcttggacacgtactccttaattaaggacatcaatgcttgctcgtatttggaggtgccgtctccgaagcctgtaaaaccatccatccagtaggttggagtctgaggtgccagcacataagccccttcaaaataggattgaatatctttagatgcaaaattcgctgcattatttccggaaatcggaatcgtcggatctgtacctccctcacccataccatgcagccagatcaccaaggggtttttcactttgtcttttggcggtgcatagtccgcataggttaaagtaatcccgtcaaaagtagctttgccggttgcaaattgatcaactagcttccgtatctgacctgcggaagtatcaattttcaagtcggaaatcgttccggatgtggttttaatggctttatgctgcgtgattgtgtatttgttatcattccatgcgttaaacccggaacctgccgcatcataatgaatagctgagcttagtgttaaggctgggccgacttccatttctaatacaacgtagcttccggttttatttacagggttgccacttttgtccgatacataggccttggtgactttccggttgccactctcaataaagggatttaccagtctattgtcgcttcttcccacatgcaccttaaatgtatcctttgttatcgcatctttaggtactggcttacccaggttaacaatgatcttcgtaatggctgctccccaatccttaacctccgcaaccgtccggtacgaggtggactgtatctttacatccttggcccatgcaccggaattgaaagcaagggtcgtaccgatagctaaagtgaataacatagttgttttagcagccttttgaaaccgtttaaacatgatgtcttacctcccgggtccattaataaaacgcttacattatttattttaatgatttttttatttgtatcctgtcttttattagcctatttcaggtcaattactgactccttgctccagaatacctcttgttctcttttcgatattgatgcggtgttgcctgataaacctttttaaataccctagcaaaagacttctcgttcggaaatccatgctccagcgcaatttgtatgatggaatgatccgtattcatgagaactcgaaaagatctctccagacggatggcattgatatattgaaatagggtcatccctacatgcttcataaaaaaacgggacaaatattcgggagacaacccaaaaacctgagctatcgaatccaaggataaactttgatcgtaattctttttgatataatcggttatcaacgtcagccgctccaaatatttatcggagttaaagccgcggatagattcatgatccattgtaaaatgcattaataacagatacaccagtttataagatagtgatgttaaatggatatgtgctaaagagtcattatgccggttgagataagccacaaataaggtgtttaacaaatcacgcaactccgcaaaatgctgtaatctctgctcgttagtttcgaaaatggaaatacagtcaaatgagatgggattactgccgttaacatttgctctaataaattcagaaggaatcagaaccgttatagcctctctcccttttcccttagccacagagaaggaatgaatagcattcgaattaatgagcacaatatctccttctttggagctgtaactcgcgccatcaatatagatattatcgatttttcccgaaagcacataggatatttcgatgctatcgtgccaatgcctaggtatgtacgctggttcattggaggaatgaactataatttttaacggaaaatgattgtctgcctggaccagctcatatttgtattccaagtttgtcgctcctctcagatgtgaactcataaatagaagaaaatggcttcagcaaagtgccgaaaccacttgtatttaaccttcctctctctataaacaaaaaaacctaagtataacaaaatacataagatccttagatcttaacattttgttccttaggttttgcctgcgtaacagtaacaatcctagtgctattcatttaattaagctaagtatatagcgggttgaaaatcatgtcaacgctttcaatttaaacgtaatgaaacgaaaaaaccttatagatcatgtgtaagtctatatatatcactgcaatttggatcattaaaaaaggctgattatgagagtgtccataatcagccttttgttttacactatgtggtcaaacagggcgtctaatcatagaagcccttgatgcataaggttttttcaacctattacatcatgccgcccatctttgatttactctcgcagaggaacgtcgtaaaacttatcttctattgtatagcttgtttgggcttatcttcagaaagttttattcgtctacatccgccctcagaactggccttgtgaatctggtggagttaaagggagtactagttgtgtctcatctattattttgaacaagcattgtattgaagagccagcgaaaattccatctgaaatactgagctagatgccaatcttcatagccatttaatacaccttcatttaaccagtaagactctggttttccgctcgtcacagcttcagacacataagcgatcgttttttctaaaaagcgaatgacatctaggattttatctggagtggacacatctccatgcccgggaatgacagtatctaccttcagatctctttgaatgtgtctaaggatgcgtatccaagcgtagggattaccgtatggcatgaccggaatcgtcttgttggttattaaatcaccagcaatcaaggttcgttcttcaggcacgtaaataacggcatcgcttaaagaatggccgcctccgtaggataaaacttcgacagtgcgttttgctccttttataactagtttatcgtcaaaagttatcgtgggtatcaccctacgaagggaagggatagcatcatacagggctctctgcacggaaagatcatagccgatttcggttaacatgtgcggatttttttcttgtgaacgtacttgatgtaggctatttattaacttctgaatgttttgttgcattagatcaatattcactttacccattttagatagcaaatctcttgtccaaacggtagatataaaatcactttccatgaattcctgattgccgttgacatgatctccatggaaatgagtattgatcacatatttaattggtttattcgttaattgttctgcggtttgacgtaacaaagtaccagaatgcggtaggttggttgtgtccacaacaacggtcaaatccccaatgtcaataattgctgcattccccagcgaaccactaccaggtaccgaaatagcaccccagataccttccgctgcttgttgaatcgtgaaatatttgttgttcattgtttatgcctccatcaaaataagtttgacaccatttccttttatctttagtttttttatgtttcatgtatatcaattagcaactttagcttacaagttagagttaactagaaatcaagcacaaatttttgaaatgaagttagaggtgcaaatatcgacttcgagttgagttaaagatgtataatagttttaaattttggtttagaaaaaaggagtgacataaaaaacaatgcttactataagtcaagtatcagaaagaacagggctaactccttatacgattcgctattatgaaaaaattggagtgctacaggaaccaaatcgaagaaatggaaggacacgcatttataccgaaagtgaggtttcatatatacaatgtttaattagattaaaaaaattgggattgtcgcttgaggagattacggaatttactcgtgacggatgtgtactggataaaattcaaaaaggggaagaagttgctaattttactcctgccttacacatacggatagaaattcttgaaaagcatctggtggaactggaatccaagcggcaggaacttgagtgcatgatttcccttgctaacgagaagatagccctgtaccaaaaacttacgaaagacgatatagtaatgtagaagacctggttcaccaccagcatatacgatggcaacagaattgattgaactaacgggaaacgttagttcaatgaaatagcgatagtctagggctttattttcccgtcctaggctaccattgtttcttttattgtagttatcaaaactttattttcatcgaacatttaaatagcagttctgccttgaatgtccgtctgtaagcaatttttcaactaaaaagctctgccgaccttaagggggactgacccccgtttgtg

SEQ ID NO: 59 - DNA, 678 bp, Unknown
  Kingdom: Bacteria, Phylum: Firmicutes, Class: Bacilli, Order: Bacillales, Family: Paenibacillaceae, Genus: Paenibacillus
ttcacttcctctcgggatttcaaggcttttttccgtggcttttccggtcctccttcaccgcttcgttaagctcgtccatatagtctttggtattctgcaacacttgttctttggtgtactggtgcctgttagcattggctttgacgtgtgtggaatcggtgacgagaacacgcccacccaccattcggtgagagatcgcctgcagcacaatttcatcgaagatatcttgaaagatcgtggtgtctttaaagcgagtgcgacgattccagctaatcgtcgtatggtctggaactttatccgttaagcccagccccaggaaccagcgataagccaggttcgtctgaatttcacgctcgagttgccgttctgagcgaatgccatagaaataaccgagaaagatcattttaaacaacacggtaggatcaatggcaggacgcccgttgtccgcacaatacagcgggcttaccttctcatgaataaaggagaagtctatatatgtatccactttacgaagcagatgatcttgtggtaccagttcttccagagaaaccaattcaaaagattgttgttggtctcgatgaggtcgcagcatatcaacaccgtccgttctacaatagttacctatattatacaacattaacgcggtgtcgtcttaaacaaaatgaacataaaaaagct

SEQ ID NO: 60 - DNA, 4408 bp, Unknown
  Kingdom: Bacteria, Phylum: Firmicutes, Class: Bacilli, Order: Bacillales, Family: Paenibacillaceae, Genus: Paenibacillus
  misc_feature (1586)..(1603): n is a, c, g, or t
tcggttggtctttaatggagagtttgatcctggctcaggacgaacgctggcggcgtgcctaatacatgcaagtcgagcggggttgtgtagaagcttgcttctacacaacctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagatagacctttccttcgggacagaggagacaggtggtgcatggttgtcgtcagctcgtgtcgtgagatgttgggttaagtcccgcaacgagcgcaacccttatgcttagttgccagcaggtcaagctgggcactctaagcagactgccggtgacaaaccggaggaaggtggggatgacgtcaaatcatcatgccccttatgacctgggctacacacgtactacaatggccggtacaacgggaagcgaaatcgcgaggtggagccaatcctagaaaagccggtctcagttcggattgtaggctgcaactcgcctacatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctatggagaatcgtttccnnnnnnnnnnnnnnnnnngcctcggggagctgtaagcaagctttgatccggggatgtccgaatggggaaacccggctgtcttcatcgacagtcactttctgctgaatacataggcagaatagaggcagaccaggggaactgaaacatctaagtaccctgaggaagagaaaacaatagtgattccgtcagtagcggcgagcgaacgcggattagcccaaaccaaggagcttgctccttggggttgtgggacgtctcacatggagttacaaaggaaccggttagatgaagaggtctggaaaggcccgccagagaaggtaaaagccctgtagttcaaaacttgttctctccgagacggatcccgagtagtgcggggcacgtgaaaccccgtatgaatccggcaggaccatctgccaaggctaaatactccctggcgaccgatagtgaagcagtaccgtgagggaaaggtgaaaagcaccccggaaggggagtgaaatagatcctgaaaccgtgtgcttacaagaagtcagagcccgatctatgggtgatggcgtgccttttgtagaatgaaccggcgagttacgttcccgtgcaaggttaaggtgaagagctgaagccgcagcgaaagcgagtctgaatagggcgaatgagtacgtggacgtagacccgaaaccgggtgatctacccctgtccagggtgaaggtgcggtaacacgcactggaggcccgaacccacgcatgttgaaaaatgcggggatgaggtgggggtagcggagaaattccaatcgaacccggagatagctggttctccccgaaatagctttagggctagcctcggaaagaagaatcgtggaggtagagcactgattgggtgcggggcccgcaagggttaccaagctcagtcaaactccgaatgccatagatttagttccgggagtcagacagtgagtgctaagatccattgtcgaaagggaaacagcccagaccatcagctaaggtccccaagtgtgtgttaagtgggaaaggatgtggagttgcacagacaaccaggatgttggcttagaagcagccaccattgaaagagtgcgtaatagctcactggtcgagtgactctgcgccgaaaatgtaacggggctaaacacaccaccgaagctatggcttgatgcattgcatcaggggtaggggagcgttgaatgcgggttgaaggtgtaccgtaaggagcgctggactgcattcaagtgagaatgccggtatgagtaacgaaaagatctgtgagaatcagatccgccgaaagcctaagggttcctgaggaaggttcgtccgctcagggtaagtcgggacctaaggcgaggccgataggcgtagtcgaaggacaacaggtcgaaattcctgtaccaccgtaatccgttatgagcgatggggtgacgcagtagggtagtgacgcggactgatggatgtccgtctaagcagtgaggctggtgtgtaggcaaatccgcacatcgtaaggctgggctgtgatggggagcgaaaattatagtagcgaaggtcatgatctcagactgccaagaaaagcctctagccaggagaaggtgcccgtaccgcaaaccgacacaggtaggcgagaagagaattctaaggcgcgcggaagaactctcgttaaggaactcggcaaaatgaccccgtaacttcgggagaaggggtgcctcggtagggtgaatagcccgagggggccgcagtgaaaaggcccaagcgactgtttagcaaaaacacaggtctgtgcgaagccgcaaggcgaagtatacgggctgacgcctgcccggtgctggaaggttaaggggagtggtaagccttcgggcgaagctatgaaccgaagccccagtaaacggcggccgtaactataacggtcctaaggtagcgaaattccttgtcaggtaaattctgacccgcacgaatggcgtaacgacttgggcgctgtctcaacgagagatccggtgaaattttaatacctgtgaagatgcaggttacccgcgacaagacggaaagaccccatggagctttactgcagcttgatattgaatttgggtacgatctgtacaggataggtgggagccgtagaatcttgagcgccagcttgagaggaggcatccttgggataccaccctgatcgtatctaggttctaacttggtaccgtgatccggtgcgaggacagtgtcaggtgggcagtttgactggggcggtcgcctcctaaagagtaacggaggcgccccaaggttccctcagaatggttggaaatcattcgaagagtgcaaaggcagaagggagcttgactgcgagacctacaagtcgagcagggacgaaagtcgggcttagtgatccggtggtaccgcatggaagggccatcgctcaacggataaaagctaccctggggataacaggcttatctcccccaagagtccacatcgacggggaggtttggcacctcgatgtcggctcatcgcatcctggggctgaagtaggtcccaagggttgggctgttcgcccattaaagcggtacgcgagctgggttcagaacgtcgtgagacagttcggtccctatctgtcgtgggcgtaggaaatttgagaggagctgtccttagtacgagaggaccgggatggacgtaccgctggtgtaccagttgttccgccaggagcaccgctgggtagctatgtacggaagggataagcgctgaaagcatctaagcgtgaagcccccctcaagatgagatttcccagtatgtaagaccccttgaagacgacgaggtagataggttgggggtggaagtgcag

SEQ ID NO: 61 - DNA, 28956 bp, Unknown
  Kingdom: Bacteria, Phylum: Firmicutes, Class: Bacilli, Order: Bacillales, Family: Paenibacillaceae, Genus: Paenibacillus
cccttgaagacgacgaggtagataggttgggggtggaagtgcagtaatgcatggagctgaccaatactaatcggtcgagggcttatcctaagataaaacgcaaatgagtttcggatccagttttcagggtgtaaccttgatataaatgtttaatattccctgatagctcagttggtagagcactcgactgttaatcgagttgtcacaggttcgagtcctgttcggggagccatatggagaggtgtccgagttggccgaaggagcacgattggaaatcgtgtaggcgccaaaagcgtctcgagggttcgaatccctctctctccgccataattcatttgtagcatggcccgttggtcaaggggttaagacacctccctttcacggaggtaacaggggttcgaatcccctacgggtcataaaaatatcataaaagggcttgcaataaaaagttcattatggtataatatgagaagtgcttaattgtggaggcttagctcagctgggagagcatctgccttacaagcagagggtcgggggttcgagcccctcagcctccaccatttgaaaaataaatatttattactgtcgcggggtggagcagttcggtagctcgtcgggctcataacccgaaggtcgcaggttcaaatcctgcccccgcaaccatttaaaaattattatggaactgtggtgtagaggcctaacatgcctgcctgtcacgcaggagatcgcgggttcgaatcccgtcagttccgccattagtattataacgtgtaatgaagagccttattctaaggctcggtagctcagtcggtagagcagaggactgaaaatcctcgtgtcggcggttcgattccgtcccgagccacttttaattgaatattttatgtgccggtgtagctcaactggtagagcaactgacttgtaatcagtaggttgggggttcaagtcctctcgccggcaccatttttggaggattagcgaagtggccaaacgcatcagactgtaaatctgctcccttacgggttcggtggttcgaatccatcatcctccaccagttttataggggcatagtttaaaggtagaacaacggtctccaaaaccgttggtgtgggttcaattcctgctgcccctgccaatcattcattacttgcggcggtcgtggcgaagtggttaacgcaccggactgtgactccggcattcgtgggttcaagccccatcggccgccctttacttattggggattagccaagcggtaaggcaacggactttgactccgtcatgcataggttcaaatcctatatccccagccatctttatgcggacgtggctcagcggtagagcatcgccttgccaaggcgagggtcgcgggttcgattcccgtcgtccgctttgttatactctggcgccatagccaagtggtaaggcaaagctctgcaaaagctttattccccagttcaaatctgggtggcgcctccataattaaatatgccggcgtggcggaatggcagacgcgctcgactcaaaatcgagtgggaaaccgtggaggttcgagtcctctcgccggtattaactaaaagagttcattagagatagtctctagtgggctttttttatttgagctttagtaccccactcattgcttgagctgaagacacctttgagttgtattccaaatgcgaataaatattggctattattgcgtaatcactgtgacccggccattcctgaacttctttcatgcttacccctaatacatctacataaatatactccaggtattcaagacaataagaattgtcagaagataagcgataggattcctgttattccttcatacggatcagaagctcatagaacgtatccaccagtggcagtatacggcgactggctttattcttggttcggtccttttcaatttcaatatatctaccattcaaattgcccgatgtggcggtatgtttaatattaatagtccaattcaataaatcaatagccgaccatttttaatcctacgacctcgcttcggcttagcccataaaaggcagccaggataacggaaaactcaattctttcgcctcggattactgcgaggagttgatccagctcctcggcattgtagaagctcacgacgtaattgttcttttttgggctttcaactaagtcagggagattcgctacaatcggctttattttcacggcatactgaagggctctgcaaatgttcgcgtggtaatgaataacggtattggcgctgacaccttgcacattcatttcatgggtatacaaggtcagaaaatcctctgtagttaaatcatcaagcaatacatccctttctctcggaaaaaggatctacgcggccttttacagtgtcggaataggagatataggagataagcctgatactgtttttcatcatctctagccattgaagcataaagtctgcgaacagccttttgctattaccggatggagtagccgcttttactcttacagcatatcttcgttttcaaccgcgagtgcttgtccttccatatgataattcttcctggcttcctgaagcaagatttcggctcttttcttggttccttttatcttaagccccgtagggatccattttggttatcgtttaccattctcatctttacagttaggcggatgtcccgttgcgctttctcctcttccaacaactccagagggtgaacccgatcctttttcaaataccggttgggcttccgaatggatttgctacaaaagtggtagctgaatccgccgatggattgctttagcgcccagaaggtgcatttgattttgaaccgggcggtataaagttcgatgatctaggtcgcctccagtgtcagatcggtgctggctagaatggagcatcgcctgttcggattcaccagcaaaaaccacagtttttggtatactctttagccctataacatatccgacacaggtaactaacggattgttctttgccgtacatgctcacgatagcgtactcaaacgcggcgatacggctttaaaacagctcggccaagcaccacctttgtcctctttttacggtagcgaccccggtctgtggcaggtgtaccatgacgttcataggcaacggtattggacttggcttcggttaccagatccatccgggtgctgccgaatgggttccattgttcaaccccccgcaaagcaggattgatcagaggtatgcaaaaccatttccgagacgtgccctagtcaaaacacagcatgaggccgatgacaatgacaacaaacccatgaaaagcgcctccaaaattgcgtcacatttaacacaattgatattgattatcaatatcaattgtgttaatatgattttgttcactagtgaacaaaaaaatctaatggtgacactgaacttggtctgcaactactacaagagaggggagattgggaaattggagtttcaaaatcattttaaaggtcatctttacgagcaatatattaaaatgctacatctgaatgagctgtatactgaacaagaatttaactcgtttcggcaacaggccagaaagtacgagattgacatgctctccaacaatattactagtgtacacgttattgattgcattggtgattatgaaccgataaatcataccgggattgtggagaagatggggttgtccaaagctagcattactaaaattagtgcaaagctgctggaaatgggcttcattatgagaagtcaactgaacagcaatcgtaaggagatttactttagtttaacggataagggaagacacgtttatcatttgcataaagaactgcacaaagaaaaagaagaaaggttttaccaattcattgaatcctattcagaggttgagctgcagactattggaaaatttatgagtgatttggtggcgcgtgccgaagaatactccgaagggaagtttacgataaatgacgacattaaagattgaggaattaagatccaagattgaagggaaagaaattttaaaagggctcacactggagattcatggcggagagattcatgcgattatggggcctaatgggacgggaaaaagtacattggcttcagcattaatgggccatcccaaatatgaggttactggcggtaaggtgacattggacaatgaagaccttctggagatggaggtggatgagcgtgcccaggcaggcttgttcctcgctatgcaatacccaagtgaaattgctggcgtgaccaactcggactttctcagaagtgccatcaatgcacggcgtgaagaaggcgatgagatatccttaatccgttttatccgtgaaatggagagcaaaatgaaggggctggagatgaacccggaatttgtgcatcgttatttgaatgagggattctctggcggtgaaaaaaagcggaatgagattttgcaaatgatgctacttgaacccaagtttgtgatcctggatgaagtggactcagggcttgatattgatgcactgcgtattgtggccaatggcgtaaatgagatgcgcagcccggatagaggctttttaatcatcacccattatcaacgactgttgaattatattaccccggattttgtgcatgtcatgatgcaaggccggatagttaaatctggcggtccggagcttgcccaccgtttggaggctgaagggtacgattgggtgaaggaggaacttgggattacggatgagacggtaagggaagcttaaaagccggagaggaggaacagcacgtggatatacaagctagagtttcaatgaatgtggacgatttacgcgcatggtcaagcgctaaggatgaacctcgttggctgattgaacgccgcgttcacgcactcgaactggcagggacgctggagttgcctaaagtggagaaaatcaatctcgaaaaatgggatatctacgaaagtggagattacaaagctgagaatgcgtggtctagtttggaggaagcgccggaggttgttcgaggtttggttacttctccggtgaaaggcggactaatcgttcagttcaactcggatgtagtgtatacgaaattgtccgagagcttagccgcccagggagtcattttaacggatctgcaaactgcggcaaaagagcatgaggagctggttcaacgttatctctttcaggcagtaaagccagaagaacatcgtttatctgctgcacacagtgccttatggagtggtggcgtttttctatatgtcccagacggtgtagaggttgaagcacctattcaagcgatctttcttaacgatacaagcggtgtgtgttttgctcctcacgtcttaattgtggcagggaccaacagcaagatcacttatgtggataattgtgtatcgagtggtgatgatgtcaaggtattgcataacggtgtgacggaggtcttcgcgggggcgggctcaaaggtgcaagtagcttcggttcatcagcttgctgcaactacaacagatttcacccagcgacgggcggtcgttcttgctgatgggggtgtggaatggattatcggtgagatgaacaatggttataccgccagcgataccaagactttgctacaaggcaacggggcggtctccgacaataaggtgattgctattggcacgggcaatcaaaaatcgagctatacaactcaagctcagcattttggcagaagctcggtaagccagatgattacgcgtgcagtcatgcttgaagaagctacggccattatcaacggcattacaaagattgaaaaaggtgcaacccattgtgatggtcagcaaacagaacgcgtgcttatgctaagtcctaaagctcgcggcgatgccaatccgatcctgctgatagatgaggatgatgtaaccgcgggtcatgctgcatccgtggggcaagtaaatgcagagcaaatctattatctgatgtcgcgcgggatatcacggagtgaagccgaacatcttgttattttcggatttctcgctcctgtcatttcggagatcccgctggaaggtgttcgcagtcgcctaaaagatttagtggaaagcaagctaggcagatcatagcaaatcaaaatgaatcttgaaaggttaaaaaggagtgatactaatggctaaaaaagcaccagatatgggcgaatataaatatgggtttcgcgacaagcaccagtctatttttcaatctggaaaaggtctgacggaagagattgtccgggaaatttcccggatcaaggaagagccggagtggatgctcaattttcggttgaaagctttgaatcaattctacaaaatgccgatgcctgaatggggagcggatttgaccgggctaaatcttgatgacatccagtattacgttcgcccttctgaaaaacagggaaagacctgggaggaggttccttccgagatcaaagcaacctttgacaagctgggaatccctgaagcggagcaaaagttcctggcgggcgtatccgctcaatatgagtcggaagtagtttatcacagcatgcggaaagaactggaggatcagggcgttattttccttgatacggatagtgcattaaagcaataccccgaagtgtttaagcaacattttgggacgatcatccctcccgccgacaataaatttgcggcgcttaatagtgcggtttggtcaggcggtagctttgtatacattccgaagggtgttcagtgcgaggttcctatacaaggttatttccgtattaattctgaaaatatgggtcaattcgagcggacattaattattgccgaagagggcagctttgtccattatgttgaaggatgtacagcacctatttatagtaccagttctctgcatagtggagttattgaaattatttgccggaaagattcccgtgtccgttacacgaccattcagaattgggctcctaatatctacaacttggtaacccaaagggctgtggcagaagaaaatgccacaatggaatgggtggacggcaacatcggctccaaggtaacaatgaagtatccggcagtattattgaaaggacggggagccaaggggtccatcctgtctattgccgtagccggtaaagatcagcatcaagatgctggcgcgaaggtaattcaccttgctcccgagacaacatctacgattatatccaaatccatcagcaagcagggcggaaaagtaaactaccgagggttgtccagcttcagccgcgattccgcagggtccaagtccaatattaagtgcgatacgttgatattggacaacatgtcaacctcagatacgattccgtacaatgaaattaaaaacgatcagattactttggagcacgaggcaacagtatccaaagtgtccgaggaacaattgttttacttaatgagccgcgggcttacagaacaagatgctacacaaatgattgtaatgggctttattgaaccgtttaccaaagaattgccaatggaatatgccgttgaaatgaatcggttgattcaatttgagatggaaggaagcatcggttgattcattaatttaatagatcaaacctttatcattctttaaagaagtgcgaggtgctagtaatgaagaaaaataattcggacgattcagaactagctcaaattacccgagagatacgaaaacttcagttctgcttctatatgctgtcaggattgagcgcaagttgtggtgtgatgatacctttagactctatttatacgcttataagggaactttcggatcaagaggtcactcttaggcaaaaagcaaaggatcactcagacgatctagggtgaaaaaaggtctgaattgacggttggtaaaacaatgggaggagttgacataatggatgaaaatggagttttattcgatgaagtatcggaagttcttctcaaactacgtcctttcttactgcgtgacggtggagatgctgaactggtcgaggttgagaacggtatagcaaaattaagatttttgggagcttgcaatggttgcccaagtgctacgattacgttaaaggttgctattgagcgcgcaattcttgaggaaattgatgatattaaagaagttgtacaagtattctaaaatttccacttcatcaaacaaggtattatcaagattgtattcggtatcgagtgggaaaccgtggaggttcgagtcctctcgccggtatacacaaaaggatgataaagtgcttaaaagcattttatcatcctttttattattcatattcatgattttggcaacaaggttaacatggatttgacccggtctttgatcttatagtaagatggtggtactgaaaaaacattttcagtttattaagtacgagagaaatgagggcgaatatgcaggaaagaattttggaggcttttgtagatgaagttcatgaaaatggattgaaatttacgatggatgatcttgcgaaaagacttgctattagtaagcgtacattgtatgaaaatttttcgtctaagacgcttattttagaaacacttattgagcgtacaaatgatgatatgattcgaaaaactgagcaaattatcgaaaataatgagttatctttgttagacaagattaagcagtcgattagggtcatgcctctgtattataagttttacgatttaagaatattggaccagatgaaaaagtattatcctgagcaatggaaaagggtacatgccgatttaaatgactggtctccgattagaacattaattcaggaaggcatccgagaaggaattattgtgaacaaaaatgaggctctgatcatgaagcttattattgaatctgtaaatttaacgcttgatcagcgtttctttctggataacagtgtgacggtagaggaagcaacttattctattgtagatattttgttgttcggattggtcgaaaaataaaaaatagcctcatcaatatgctgcatatttgaagaggccatttttttatatgaaaactaagaaaacaattttagtttcaaatgtttttgaaaaagaataatgaagtttacctaatgttgaataaagagatacggaaaaggaagggtggaaatatgtctatactcacaagaaatcgaggagcaatgctgttattgatgcttaacatttttttggcattcatggggattggattggttgtccctgtgttacctaagtttataagtgagctagggatgaatggttcctcgatgggactgatggttgcagcttttgcgttgacacagcttttgttatcaccattgtcaggaaagttgtctgatcgttatggacgtaaaaagttgattgtttctgggatgttcatcttcatgttatcagagcttgtttttggactggcgaattccattcctaccctgttcatagcacgaatcatgggtggagcaggggcagcgttacttactccttctattatggcctatgttgctgacgtgacctcgtttgaggaaagaggcaagggaatgggaatgatcaatgcagcgatcaacacaggcttcataatcgggccagggattggcggattgcttgccacatatggaatacgcattcccttttttgcggcagcaggagctgcgggaatagcagctatcttgtctctgttagtactgcctgagtctttaagcaaggaaaagcaacaatataatagagagcttccacgtcaaaaagaaaatcttttgcagcaatttgccaagtcatatcaatctccatatttcatgggtttactcattgtatttgtcgttgcttttgggttagcgaactttgaaacagtatttggactgtttgttgaccataaatatggttttacaccgatggatattgccatcatcataacgacaggctccattttgggagcagttgtccaagcgactatatttggatggatcattaatcgttttggagagaaaaaaataattcacctctgtttggctattgggggcctgttcatttttctaaccctatttgctgaacagtacgtgatgattatgctgacgaccttcatcatttttctggctatggatatccttcgtccggcagtaagcacttctctatcgcggcaggctggagatgagcaaggctttgtggcaggcatgaactcgtcctataccagcttgggtaatgtgattggaccgcttgttgcgggattgctattcgatgttcatattaatctgccttatatggttgcagctatagcgttactggcttgtctcgtcctttcactacgttccaagcaagcgggtgagcaacactcgatagcccatgcagcagaacagcatagaggaggatagccgcaggtctatactcatccccgacttaggtctaggttcaaaaaccgtctggggtccgttttgtcaaacgcttgttcagcgtacaataaggacataagcaagacacagtgaaaggcggtgagagatgatgagagttaacaaagggaatgggttagccattgtactgatcgtgttgggttcgattatgctgctcggtaagtttactccgtttttcggtcactttttaggacatctgattggttacttaattccgatagctatggtcatgctaggctactacggtgtgaaaaaaggaaatgcgctcttcggctggatcgtacttgtacttggggtactgattttgcttggcaaactgtcctggcttctgggaccgctactggcaatcgggttaatcatatttggtgtttccctgctgagtgaccgcagaagacgttactgattttagcagtttggcgaatgaagaaagattacagcaagaagtgataattatggggatacgaattgtgaaaggagcagatgcaaatgagtgtttttcgaagaatgcgcgatatcacggtagcgaccttcaatgagcatttggaacaaagtcaagacccagtgcaactgattgaccagttcttgtataatacccgccaggaaattgccgaagcggaaaaactccatcaacagtatgcgatgcatacaagacagatgaagcagcagttggatcatgcattgtccatgcagaccaaacgggaggaacaggcgctactggctttgaaggctgatgaagaacatatcgcgaagctggcccttcaggagaaaatgctatatgcagaaaaagaagagcagtatagagaactgtgggagcagagccgtgaatcactacgtgagctggaacaacagctagatacattaaagacagaatatcaaacggtacacagcaagcgtcagtattatgcggcacgtgtacaaacgttgagactccagcagcaaatgaacgaacgggctggtacatacggtggacggaatgttccccgaatgttcaaccgcttggaagaccgggtagccgatatggaagcagaaacgatgagtctgcgtgatttacgtcggagtgagggcgaccatgcacaggatgcccaaggcggtggatcgctgctcgaacaagagtgggcgagactgaaaagcaagctgaacaacagcgggaaggagtaatttgataatgacccgaatttacagatcaagccgggatagagtaataacaggtgtatgtggcggtctttctgacgcaacaggaatggactcaacatggattcgtattctggttgtgatcagtttctttattacagcaggaaccacatttatgatttatgtgattgcggccctagttatctccaaggagccgagatctcctttcgatggaggatttggccctgacagcggtccctacaatcaacaggatccacgctattatggcagtaacaatacaagatcgcagtatgggcagggaactggttacaaccagggcggtgcatatggcaattcgaacccgttttttggtcaagatgcccgcaactcatctaaatttaacacaggtcagaacagtgacctggattccatgatggaagatatcgagaaaaaggcaatgaaaaaagaattggcagagttacgcaaaaaagtagagcaatttgagaagggagatcgtaaataatggggatctttaaaagaatgaaggatatgacaagagcatcggtgaatgaagtgttggataaagtggaagatccgattattatgttgaatcaatatctgcgcgatatggaggcggaaattcacgaggctgaggtaacggttgccaagcaaatggcgaatgaacgacgtatgaaacagcgtttggaggaagcggtacgtgtatccaatgagcgtgagaaacaagctgaatccgcattgcgaaatggtcaggaagaagtagcgcgcaagttgttgggagagaagatttattttgtgcagaagcaggacgaataccgcgacttgcatacacaagctgagcttcaagcaaaagaattggtacagcagcttcacgacatgaaagatgaattctataaaatgcgcaacaagcgcaatgagttggtatcccgtgctcaaatggcgaaagccaaaaagcaaatgtctcaaatcaatagtttgcacacgattgaaagtgggtctgcttcactgggcttccaccgtatggaagaaaaaatcatgcaaatggaagctgaagctgacgtactgcgtgctccttaccgtcaagctccaggagaagcatatgttaatccggctgaggctgaaaaacagtttaaagtggatgagcagcttcaacagcttaagtccaaaattcagacaggtgctaaaccagtcgatatgaagaaggactgactactcggaaacaagacattatgatatgctgtatggaatggacattggtcgatgatcgtgcctaatctgtatggttcaggaaagccatatggcggaatgttgcgccactatggcttttccgtcctgtataaacaaaaagggggtgcagcatggagagaagaaaatcagccttggcactggcagggattggcatcgggattatcattttattcggtcagtggattgggttcctctccgtggttgcactgatcctaatgttggccggaatatataagatccgcaattccaaaatcaaaaagggctacacgatgcttgcgattggtgctggactgttagtactggatcatttgttcctgtttgtggtagttacactagcatcattagctgtattctattcacgttcaaggaagctgcataaaggtcaaagctccatattcaagcacaattttatatccaatcataaatgggatgaagtgccttggagcctgcgcagcacaagcatatggcatgtggttggggacgtggatgccgacctgacgttggctctcccagaggaacgtgagcccgtcatatttttgcaggggatcttcggtgacattgacatcaccctaccggataattacggtgtagaggtggagatgttcatattgttcggacagattcagtttgaccgggatcatgaggcggggatgctcaatcgactggtttggaagtctccccattttgagcagagtgagtataaagtgaagtttgtcgtttcgtacttggcgggcgatgtccgcgtccgattttattgaatcaggaggagccgggatgaatcataaaaaaacgtccaacatggtaacccgcagtatgggtgaaggtatcctcctgtgtgttgttgtgggcgtagttgtcttttatatgctgtatacatatggatatgtgaagtcgttcccaacctggggaatgatattgaaagttgcaggagccgttatattggtgttgattggtacaggggcaatgtacggattttatgaaagttaccgctttaaaagcagactggaaatgttgagagagacgttgctgatgtgggaaaagggaacgccagcacgtgagttgccgcccctagggcatgatgagcttggcaggctgggagagcagctggaacgaattggacgtaaatggcaggaacaagttacgtctttacaacgcttatccacggataatgctcagctggcagaacaggcacggatgactgcgattgtggaggagcggcagcggctggccagagagttgcatgacgccgtatcacagcaattatttgctatttcaatgacggcgacggctgtggggaggacgctggataaggattttgataaagcgcagcggcaagttgcgctaattgaagaaatgtcttccgtggcacaatccgaaatgcgggcgttactacttcatctgcggcctgtctatctggaagggaaacggcttgagcagggtttgcgtgatttggtacaagagttgcaggcaaaggtaccgatggagattgattttgaaattgaaagcggagtacagttggttaaaggcattgagaaccacttgtttcgcattgttcaggaagcgatgtctaatacattgcgccatgccaaagcaacccgcatggaaattcgtatcgtgcaacgcccggattctatcaggctgacgattcgggacaacggtattggttttgaactggatgagaaaaagcagacttcatatggattatccacaatgcaggagcgggtcagtgaaattgggggggctattcagtatataacggctccgggaaaaggaacacggatcgaggtgtccgtgccagttattaatgatgaaagcggaaggaacgatgatcatggaaacggaattaccgattagcgtactgctggtagacgaccatgaaatggtacggattggtcttgcggcggtgctggggacggaagaaggtattgaagtggtcggcgaggccggaagcggagaagaaggcatacggttagcttccgaatacaagccaaatgtgattttaatggatctggtcatggatggcatggatggcatcgaaacgacacgtcaagtaactcgcctgcttccagagaccaaggtgattgtgctgacgagttatttggacgatgagaaaatgtatccggtcattgaggcaggggcatttagctatttgctcaaaacatctcgtgcttccgagatagcggatgcgatccgtgcagctgcacgcggacagtccgtactagagtcacaggtggcctccaagatgatgaatcgattccgccaaccacaggctgaggcacccgcgcatacggagctgactgatcgtgagatggaggtgcttcgcctgttggcacaagggaagtctaaccaggatatcgcagatgagctgattatcgggattaagacggtaaaattccatgtcacgaaccttctcgctaaattaggagtggaagaccgtacacaggcggcgatctatgcctataagaacggattagcagagtagaagtagaagtagaataaacgaatacaaagaaccggagacgacaatagtcctccggtttttttgtgttccataacaagttgtttagatcaggaggaataaaaaggcgattaaagccagatctaatgcaagccctgccccgtatccatatccgccgtacccaccgcgatagcctgttctgccatttccataattactatagccatttccagcaaatccgcctgagtcataaggaaaggatgggctcagaggtgcgttgggcggcttaattaaggcatttagtttggccgaggtacgagctttgtttttaggattcttttttttctttttagaggaaatctttttgggggtttgttttcctttgttactggagctaccggcataaagactgccaggaaaagaaggtggatatccgttcaacatcagcttgcctttgctacacccacttaagatgccgatgtgtcgtgtaccatcacgcataacggcacagaccagacgtccaccatgaggtgccacattggcttcatttacaggataaatcggaaacatgatttcacctcttttggtgtaagatgcattgtgatcatagtctattcttacggtgcctacgatgtatggtcgaacacccagtaggcagatgaatattttagaaggactttgccgtagttctgtgtgtataaaacctctgacaatgggaatgctattgatagattcatagatttcaatccagccgaaaaagaaagtatccagagcgtaggtgtgggaatcggatggttgtggagcggggggaacgataatgttaaaatcagagctgattaaaaaggggattattgtaattttggtattaggaacggtgctggtactagctggctggcgttacggaacctttcagacaaaccgaaatgactcccgcgaggcagaaacggctttacgctcattgttaatcatctcggatcagaccccgggtacgttggataagctggttgtgaagtggcaaggcgattggatttctaaccatgaagagccagcagatgtggcggcacagatagctgatcagctgaatatacccacagtaaacaaactcgtagaaaatggacacacggtttatcgttctgttcgtgatagtgaggatctaagaatccgcttaaatgtgatggaacgtcaaactggacaatggtatgtagttgttcaactggagagcaatgatgcaggacgtgagcggttgattcagcttcataagctttgtgctgagcaattaaagtctatgggaattcaagcacagtggaacacggcccttcagcgttcgctgcatacaaaggaatccaaagatcaactgttgaaactgacagaggcgagcttagcagggaatatctcgatgcaggccaaagaaagatatacggatgcgactactgtggctatatcctatgaagctccagagctgccgttaatgattcaaagcggtgagcatcaggtccagatgcagatggctgtacatgaagatagggagcagcaggatatacgtataacactcggtttcccgctcatcacgattgaatactgacttataaggtaaatttatgattcatcggatagcttatccatgtaggatatgataaaatatcatcaaatctttagttccatgtttttcgaaaatcaagtatgatcttgtataaatatacacaatactacatgcagatttcggggattgtggattgcggaatcttgacatgggaagaatgaggtacttcatggctgacatacctgttaaagaatctgttgtgacgcaaggcgcagttctgtttatttttggcgctacgggcgatttggctcgtcgcaagctttttcctgctatttacagcttgtaccgcgaaggcaagcttgctgacgattttgccgttattggtgtagcaaggcgtcctcgcacagaggaagaattccgtaatgacctgtatgcctccatacaggagtttagtcgctacaaagcagaaaatgatcaagaatggcaggcatttgccgagcattttgaatataaatcgctggatatcaacaatgtcgaagggttccatgagctgagacagcagacggagtctatagaaagcaagtttaacataccgggaaatcggttgttttatttggccttggctcctgagttattcggaagcgtgtcgaagagtttgaaagatggcggcatgatggatggcaagggctggaatcgcttggtgattgagaagccattcggttataacctcgaatctgcacaagaattgaacgttgaaatacgagaagtatttgccgaagaagaaatttatcggattgatcactatcttggcaaggaaatggtacaaaatattgaggtgatccgcttcgcgaatgccttctttgaaccactgtggaataataagcatattgccaatgtgcaaattacgcttagtgaaacggtaggggtggaggaacgcggaggttactacgatcattccggcgccttgcgggatatgggacagaaccatatgctgcaaatgctaacgatgattgcgatggagccacctagtcgtttgttgcctgaggatatccgtgatgaaaaggtaaaagtgctgcgttcgctgcgcccttttgaaacgtctgaggatgtgaaaaccaatgtggtgcgtggtcaatacaccgatggcagttatcgcggtcagcagttgccggggtatcgccaagaagacaaggttgatccacagtcgaacacagagacttattttgcttcacgcgtgtttgttgataatttccgttgggctggcgtaccgttctatattcgtacaggcaaacgtctccctgtaaaaacaacggagattgttgtggaatttaaaagcatgccaacgaacgtgtacctcggtcaaaagcataagctggaaccgaacttgctcgtgattagggtcaatccaatggagggcatttacattaaaatcaatgccaagaaacccggttcggaatcagatattgagccactggctatggatttttgccaaagctgtatggtgggtatcaactcaccggaggcttatgaacggttgctgatggatgcaattgagggtgattcgacgtacttcacgcgttgggatgaggttgccacggcatggggattcgtcgatcgaatcgccaaagcatggcagcagaccccggatacgctggaaacctatgctgcaggttcatggggaccggaaggtgctcacaagctattggagcaggatggcttcaagtggtggccggttagcggtcaggatgaagataatgtcatctggcgagtaggcggcgttcagtaatcccgatttgtcctgcatccccctatgtcctgttcaggacgtaaggggatgctttgcgttcggagtgtgctataatagcttagtctcaggttttcagtttgcaactgattataagttaaaggcaggctaaaacatgtaaatagatcgtatttataatgaatatggtaacggagtacgccgaatactggagctaacggcaatatagccgatagagccgatgaacttatgaaaacaggcgtgcatcatggcctttttatggatagcttgagcagtaatgcaatggatttgatcatgaagggatatgtgaaatgagtaaaacaacagatatacttcaacaggaagtcgacaaacggcgtacgtttgcgattatttctcacccggatgcgggtaaaacgacactgacggaaaagctgctgctgttcgggggcgcgattcgtcttgcgggttcagttaaagcgcgtaaagcaagcaaacacgctacgagtgactggatggagattgaaaaacagcgggggatctctgtaacatcctcagtaatgcaatttgattataatggtcaccgcatcaacattctggacaccccaggtcaccaggatttcagtgaagacacgtatcgtacattaacagcagcagatagtgcagtcatgctgattgacgtagcgaaaggtgtggaagcgcaaacgattaagctgtttcaagtttgtgcgaagcgtggaattccgattttcaccttcattaacaaactggatcgtgagggacgcagtccttttgatttgatggaagagctggagcaggtgcttggcatccgttcggtgcctatgaattggccgattggtacaggacgcgagctgtgcggtgtctatgaccgtgtcaaaaatcaggtcgagctgtttcagggagatgatcattccacgatcaaagtacagaaagtggaagattacaatgatccgatcattcgtgagatggcgggcgaatatctgcatgaccaattatgtcaggacttggagttgcttgacgttgcgggtgacccttttgacatggagaaagtacagcgcggagaattgacacctgtattcttcggcagtgcgattaataattttggtgtacaaacatttttggaaaacttccttcagcttgctcctaaaccggagccgcgccgtagtacagctggggaaattgagccaacaaacgaaaagtttaccggctatgtatttaaaattcaagcaaacatgaacccggctcaccgtgaccgtattgcatttttgcgtattgtctccggtaagtttcaacgcgggatgagtgttaagcatgtacggatgggcaaggaaattaagctgtcccagccacaacagttcctggcacaggaccgtgatattgtcgaggaggcttttcctggcgatattataggattgtttgacccgggtattttccgtattggtgattcactcagccaaggtagtgaggttgtgtttgatgaattgccgaccttctcgcctgagatttttgccaaggtaacggtgaaaaatgccttgaagcacaaacagtatctgaagggtattgatcagttgaccgaggaaggtatgattcaggtgttccgtacggtaagctttgacgatacgctattgggtgttgtcggtcaactgcaatttgaagtatttgagtaccgaatgaagggtgaatatggcgttgatgtacagcttcagcgtatgccattccaatttgcacgttggattgtggatgatcagattgacccaagcaagttccgtattaactctacgctggtaaaggataagaaaggcaattatgtcgccttgttcgaaaacgagtatgcgatgcgtacggctatggagaaaaatccgacagctaagttcttagaaatggctccataagattgaataagcagaacagtttgatctcagtcatttagtgtataccacgaatagtccactcgatgttaatgcgagtggactattctcattttcgaataccggtaaaataatgagcacaattaaatcggaaccaaatgttaaatagctagagctaggttaagggtacgggtttgattttatcgatttgttcatgtgccaaatggacgaaatcgtgctgctggtttggactcatatgcttccaagcaatttcaagaatgacacccaacccaggcaaagcggcctccggtccgtccactgacccaataatcatgtccgtaagatcagcttctgatttgccgtgtactttgtgaacaattgcttgtcgtaaatccattgtaatgggcatgtgtacctcccgtatgttgtagtagtggtcgaatgtattatggcttgggctgttgtccagtatacatggagaagcatttggcataagtatgtcaaaatttatgtttgtagcatgatatgctatactatgacggacagtatggtgatcgggaggtaaagaaggaatggcaaaaaaacagtatgcggtcattggtatgggccgttttggttccagtgttgccagtgcgctgagtgagatgggttttgatgtgctggctattgactcggacgagcagcgtacacaggaaatgtcgaatattgtgacgcatgcggtgtctgccgactcgacggatgaggaagcgctgcgagcgctgggtatccgtaattttgacgtaatcgtagttgcgattggtgaagatatacaggccagtattctgacgacattgattctcaaggacatgggcgtacccgctcttgtggtcaaggcacaaaatgaactgcatgggaaagtgctgcaaaaaataggtgcggataaagtcgtttatcctgaacgggatatggggttacgggtagcccatcatttgacatctcccaacattttggattatatcgagctgtccaaggactacagtattttggagatgagagccgccgattccatgattgggaaaaatctcaaagagctcgacatacgcgcacgcttcggctgtaatgtgatggcgattcgcagaaatcaggaaatgaacatttcaccttatgccgaagatcgtctggagccgggtgatgtactggtcattgtaggccacaaggatgatctgaccaagctagagctggcatttgcagcctaatgagggtttgatgttcaagtacaagtgaggcatcatttgtttttaagaaacggacaaagaaacggaaggttaaacgaatggaaatcatttcaccgaataatgcgcgtgtaaaagagtgggcgcaactgctcgagaaaaagcatcgcacacggcagcataaatatattgtcgaaggtattcatctggtgcaggaagcgctgcgttcggacgtggctgtcgaaaccgtcgcctatgatttggacaagggcattcccgccgagctgaatggccttgatcaagccgaccagccggtggaatgggttcccgtgtcagcggcggtcattgcaaaatgcaccgatacgaagacgccgcagtcggtctttgccatcgtgcgtaaggaggagcgcagcgcattcccggcattgctggagcagccggatgcactggtgatggtgctggacggggtgcaggaccccggcaatgtaggcaccatcatccgcagcgcggacgctgctggagccgcaggcgtaatattgggtcatggctgcgccgacctgtacaatcccaaaacgatccgctccacgatgggatcgttgtttcacctgccggtgattgaaggcagcctggaggagcttttaccgcaggccaaaagtaaaggtgcccgcttgctcagcacctcgctggatgcgagcttgtcatgctataccatagatttgcgcacttccacttggcttgtaatcggaaacgaaggccaagggatttctgctgctaccgctcgcatggtggatgagtcggtattcattccgatgcaggggcaagcggaatcactaaacgcagcgatggcttctacggtgctattatttgaggcgatgagacaacgaaactaagagaagaacacgggtgcatgtgtgtggtttataacatcaattgagacaacttataacatcaaagtgagacaatataagtgcccgtaaggccagtaaagacggggaagttttctactaacaaaccaagtacttgttgtttactgatctaagatttgttgtttttatagtaaaaaaaaagtagtgaaatttctataagttgttgtaagataaacactctccaatgaactgtctgccatggactttttgaagggaccccatactgtttggggatcgtttacaggacaatcgatggaagttgaagcggcggttcgatttagtgtactgaccgatgtggacctatgatcgaagttttcccgttggaacaagctagtgaatcatatgagaaaatgatgtcggctaagacacgattccgtgccgtattgagtatgactaaatgataactcatttccaactttgacgatctaaacgttatggaccttaagcctgtattggctttgaggtcctttattttgcgaaaacgataggttcgtacattggatgatatatctgagcttattatcaacaggaaaactagctacctggctgctgtagataataaaagtgagatggccagaaaaacaattagtctgttaagtaacgaacagaaatacctagaaatgagaaacgcttatgtaaacaaagctcatttaaattttagttcagatcaaatcacaagtcacaatgaagagatatataaccgtgtgcttgaaactaacagtggtgcttcaccaagagagaaccttcagagaaatgtgattcactcttgacagaaggagagtatagatttataattcaactaatcaattgaatatttgttaaagataaattatatttagtggggggatctccagtgggagcaactgcattgacaaaaaatacgttttcaaatcaaatccagtctggcgtgaccttggtagacttttgggctccatggtgtggaccatgtaaaattcagcttcctattgtggaagaattagctgatgagctgaaaggacaggcaacgttggcaaaagttaatgtcgacgaggaaaccgaattagcttcacaatttcggattcgaagtattccaactttgttgctttttaaagatggtaagctcgttgatacaatggttggtgtaaatcaaaaaaatgtccttaaagacaaaatttttaaattggttaattgatgtgaaaatcgacaacattataatgaaataatgttgtcgattctttttttgttctgagagcgctcccttcaacgtagcggatgcagtttgagagtgactcaatatcatcatatagagaagataatcttttaacatatgtgactccctgatgaaacatggatgaaggagagaaacaatgagaaaccaagttgaaaaaaatgctccggtgataatcgttggaactcggaaaattcgatcttggacctacatggttctgccacactatgagaaaattaatactcaactcacaaaagaactgggtttggagacatttaatcaatttaacaaataacaaaggacgaatgctcttagaacgttcccaacatgaaacaccacaacaacgtcttctgccagatgaggcaatggagccctcactaagatttgttggtggagtacagtctatgattgaggcgataagtgctactttgccataaggagcaatccagcttaacacacgtgtaacttcgattcatcaagaagaagacggtacaatctgcttagaagccaatggaaaacaattttagacaactgtagttactattgctattcacccacggctagctgaaaagaatataaaacttgccaaagcttccttatgatctgcagacatatttagttgataaaccaacatggatggccggtcaagctaaagttattgccatttacgacgaccattttgacgtgaagttggactctccagttttacatcaagttgggtgggatctctacaagaaattcacgatgcttcaccaggtacagggacaggtgccctttttggatttttggtttaccagtaaaggagcggcagactttgggagaagataaactcatgtaacttgtgttggaacaattggagggcatattttttacgggcactgagacggctgattaacagggaggacattttggaaggggcaattctcaatcagctgatcaaatcgtagccagatttctagaacgatacacacaataatgaggaaaaaacttctacttttgtaaatatttttcttatggaaaaaggatttaaacaatgagtcattttaagagaggagaaatttgagcgtgcgtttagtggacttaacctcaatacaagaaatagaatccttcatcggaagtaatcctttgagtatgttatacgtatctcaagatgattgtaatgtatgccatgccatttaccctaagctcaaaacaatgcttaatctataccctaaattggcacttgctcatgttgatgctagtcaagtggaggagatcacaggaaggtttttaattttttctgtgccgacgatcttggtttttcttgatgggagagaatatctacgcgaaggtcgttttgttcaatttgaacaattgaaaaaataattacagttattgtcagatgtagtttaaatcttcgattaaaaacaaaaggcacaccttcagtattatgtcctttcttaggcgttttattgaaggtgtatttcaagtaatggccaattctgttgttagaaaaaccacctttaccaagtaaaaggtggtttttctaacaacaaaacatgcgttatatgttcttttatgttgattttcgttccaccaaagtaaactctagtgaatttagtgcgtttttcgtctggttaagcttattatgaataataataaaggcattgtcggcctgaaagtcaacaggatagttaatcgttgtcagatccagcaaaggagcgagtgcggaattattaaaccccataatgccccgtccgtaaaccgattcctttatatgttcccactcctggctacgatgcaggacatgctggcatagccattccgcatctcttgtgaatcttgaacggtattttctcgaaagccaaaaaattctcggatttgagcgcggtgatatttgatcatccgaccgttccaatcgtattgtgcatacagttctgcgggcacttcgatttgcttggcgatgtatgaaatgacggtcttaggtacttcaaatttatgaacggaaatcgtgcctcgtattggaagaacttaaacatgaccgcgaaaccgatcctcgtctcactgctcttattccccatttgctgcatttcgttcgggagaaaggtaaaatgctcaatcagctcgtccagttcccaatttcgcttcatgtaatcccttccgaataaagttcctattactgtgagtaacggaacttagcacttgaaataagtatatccaagctgtatatgttagacaatatgtgtctcaaataactcgaagttccatatacaaaaataaattcggaacttttatttattcatggggactaggctaacgggcaggttagtttaaaaaccttcttaatatactctttttaagggtggatctttttctgatgggttcgtttctcagaaataaaagcttctttgtacgttcttgtttacaaggttttctcgattacaatggataatttgtagttagcgtaattgtttagctctaataaaaattggtttaacgcttcattacttggaaacctacattcaagcagatagcatccatcaccgcttattttgtaattatttaggatgtgatcctctttagaatgaatgaatgaaagaaatggttgatggtgtgtatctttaatatagatatttagaaatgcatacgtaaaacatcctaattttgcgtgattaactttaatgctgtatccctctataactccagtatcctcaagtttttctactcgggctgctgctgcaggtccagttaggtgcactctttcccctaattctttcatggtaattcgactattttgactcagctcttcaataattcgtttatctgtttgatccaaatcaaacgcatctcctttaaaaaataaagtaaaaagaccaatacactttatttaatctgtgtatttgaaggttacatctagtataaacttatcattgtcaacaaacaaaattaaaaaaaacagaaggagaattatatataaatatgcacattcaacaagttcgaaatgcaacaatcattgttcactatgcaggtaaaaagttcctagtcgatccattacttgcgtacaaaggtctgtatggtccattcccggcggggatcagagaggatttgagaaatcctataattgatttgccaatgtccgttaacgacatcattaaggatgtcgatgctgttattctgactcatttgcatctagatcactacgatgatatagcaaaagcagtgcttccaaaaggcactaaagtttttgtacaaaacgaagaagatgctaaacaagttgaaagtgacggttttcaacaagtagaagtacttgctgaagatacgctttttgaaggtattcagttaattaaaacaaaaggcgagcacggcagagggaaagatttattaaaaatgatgggtcaggtatgtggtgttgtcttcaaacatgccaacgagaagacgttatacctagccggagatacagtatggtatgaaggtgtcgaaaaagaaatcatttcccacactcctgagattatcgtgttgaacgctggaaataatagttggcatgatttgggctcacttataatgggcaaagaagatgtttacgaggtgcataaggcggctcctaacgccaaaattatctcagtccatatggaagcagttaatcattggacattatctagaaaagaactaaaaagctttggagaagaaaagggattcacctctaatttattagttcccgaagacggcgaatcgtacactttttaatgtgcactgcgaaaggttggaatatgagtcgcattggagattgtgttgttcaaataatatgagaccttcatatgggtctcattttattatgaatttttataacaagttatttattcctttaatgcagaatattagctcacttgcatatcaagtatttaccaaaatctacagacaggagaatatgctgtgaaacaaacgaatcctaaattgtggacgaaaaactttattattctttcgtctgtcaatttcattatgacattaattttctttttattaaacgcgacaatcactctttatgcaattaatgaatttgatgcatcaaccggccaagctggtatcgtcgcaggtatttttattatcggttcattattagggcgtttgtttacaggacgtcttatacattccaaaaaaatcttgatgaccagcttgtttttattaattttaacaacattactttatttcgttcatcttaatgttaactttctcatattaaatcggcttttaaacggtatcacagtgggtattatatctacaattgtgagtacggttgttgtatttagccttcctgcaccacgaaaaggtgaagggataagttattttgcaattagtacggccttggccacaggaatcggtccatttattggtttagttttgagtcaaaactcaaactttgaaatgattttttctttaagtctattgcttggaatttttagcttagtaatcgcattttttctgaagtttcccgcaacgtacaagactgagaagaacaataaaaagggaataaaaatctctgactttgttgagccaaaagtaatgccgatagcaattattatttttttcatgactttttgtttttccggcatagtttcatatttaaatatttatgctttggagttagggttaatagacacagcaagtttcttctttatggtatatactgtttttgtcttaatatcacgaccttttacaggacgaataatggacaaaaaaggtgctaacattatcatatatccggctcttattatatatggagtagggatgcttcttttaagctcagttaacagtagctttacattgttattggtaggagcattagttgctctgggatttggtaatatttcttccataactcaagccatagccatcaatttagccgaacctcaccgagttggcttagcaactgcgacgttctttatattctatgatctagggaacggatttggcccatcgattatcggtttgataattccagctacaggatatagtggtttgtatgtaatactcggattaattgtattagctacactttttctatattacatgttgtatggaaagaaagaaggtaaaattcaaaattaagtggtaaactaaagagcacttaaagagaggatcctgagaatttgaactgtgacctgtaagagatagacatatatatatataatttttttcatataaaagcgattggcataagtacgaaatcttcttaaaaaatagagcgaggagaaatttatgactgtagtattaaaaagagttaataacgagaatattgatgaaataaaaaaaa

SEQ ID NO: 62 - DNA, 24615 bp, Unknown
  Kingdom: Bacteria, Phylum: Firmicutes, Class: Bacilli, Order: Bacillales, Family: Paenibacillaceae, Genus: Paenibacillus
ttcagggtgtaaccttgaatgtatgtagaaatacatacaataagcgcatggctattcattcacacgataagtgatgaaccgaataaccatacggaagaatttgcacagcaaattcatgtttggtggcgatagcggaggggttccacacgtacccatcccgaacacgaccgttaagccctccagcgccaatggtacttggaccgcagggtcctgggagagtaggacgtcgccaagcaacaagtaaagaggaccatgatctcattgagatcatggtcctctttggtatattacggtacaaaccacatatataattgcttctatgctgtgcattcaaagaggagatatgcttttgtgaatagctattacctttggaaacgcttatttttaaaggttgtccttcgtaggagtacagttgtttgtacagggaaatactaaaggttagggctattgatgaaggcttgacacccctataccgctttgctaagattgcaataatatattttcagagagccttgatttgtccatgtcggacagacaacaagaccaatacagactaaacaatttgaaggaggatcatcttggtgtgggaagataaattcggtaaggaaggccttacctttgacgatgttttgctggtacctcgcaagtcggtggttctgcccaaagaagtaagcgtggcgactcgtttgagtgataacgtgaagctgaatattcctttgatgagtgctggtatggatactgttactgaggcagtgttggcaattgcgatggctcgcgagggcggtatcggtattattcataaaaatatgtccattgaacagcaagcggtagaggtggatcgagttaaacgttcggagagcggtgttatcaccaatccattctcattgactccagatcatttggtgtccgatgctgaagcagttatgggtaaataccgtatttctggtgtacctgttgtaaacgaagaaaacaaactggtgggtattattactaaccgcgatcttcgctttattcacgattttaaccttaaaatcagtgaagtcatgacgaaggaagaactggtaactgcacctgtaggtacgactttacaggaagcggaagtcattttgcaaaagcataaaattgaaaagcttcctttggttgatgatgaaaattatctcaaaggacttatcaccattaaagatattgagaaagctattcaatttccgaacgcagcgaaagatgcacaagggcgtcttctggtcggtgcggctgtcggcatttccaaggatacatttgatcggactgaagcacttgtaaaagctggtgtggatatgattgttgtggactctgctcacggccatcatattaacattattgaagcggtccgcaagctacgtgaagcttatcctgatctgacgattgtagcaggtaatgtagctactggtgacggaacgcgcgaattgattgaagcaggagcatctgtcgtaaaagtcggtattggtccaggctccatctgtacaacacgtgtaatcgcagggattggtgttccacaagtaacagcaatttatgattgtgcaacagtagcacgtgaatataatattccgatcattgcagacggtggtattaaatactccggtgaaattacaaaggccattgcggcaggcgcttctgcggtaatgctgggaagtctttttgcaggtacggaagaaagcccaggcgaatctgaaatttatcaaggacgccgctttaaagtatatcgtggtatgggttctatggctgcgatgaagcaaggtagtaaagatcgttatttccaagatgacgacaagaaattggtaccggaaggcatcgaaggacgcgttgcttataaaggaccactttccgacactgttcatcagctgttgggcggtcttcgttccggtatgggttattgcggtacagctaatattgaggagcttcgtaacgatacaagctttatccgtattacaggcgctggtctgcgtgagagccatccgcacgatgtgcaaattacgaaagaagcaccaaattactctctataaaattcggctgtagtagacttgacgacaggcagagcgtatttcgctctgcctgtctttttttagagatacccctgtgatagaatagacaagtgtccgcctttttgacgaaattattgacgaattaggacacgtaggtcttttggacgattcctaccagtgaagaagattcgagcagaaaatgctcatgacaggatacaactaagcaaacgaagtgaaactggattttataacacttaaacattaattacattggccaagtagaggctgtaaccaccgtctcgttattcatagcgatcgggttgaggtacgagaggagtttgtattcatttgaaagcgaacattttaaagcaaaaaaataaaaaacgcagcatgattaaaaagagtgtgactgcagtcatggtgcttaatatgatgtatatgtcggcattgcctgtggtaggcaatttcgatccgagcgtggctacttttgcagctggagcggcaacacaggcaaccaatattacggggacaggttctattaacccccctagtctggcactacgttccgccattttgatcgagccttccactggacaagtattgctgtctatgaatccagatgagccacttccaccagctagtatgactaaaatgatgacagaatacatcgtggctgagcaggttaagcaaggtaaactcaagtggacggataaggttacggttaacgagaatgcttctaagagtattggatcacgtatttttttggctcaaggggatcaacatacggtagaagagctttatattgcaatggcggtaggttctgctaatgatgcaacagtagcccttgctgaacgcgtatctggaactgagcaggactttgtaaaactaatgaatgaaacagctcagaaaatgggcatgaaaaatacgtattttatcaactcgactggtttggaccgtggtgatatgccgaaaggcttccagccggatacagaccgggaaactgtgatgacagccagagatgcagcgacattagctagtaacattataaaggatcatccggattatacacgatttacgacaattcaatcttacaaattccgaccgactgacaaagcaccaattattaactacaattggatgttagaagcaaacaaaaatattactaactttagaaagtttgcttatcccggcttggacggaatgaaaacgggccatacgagcaatgctggaaactgttttacaggtacagctgagcgcaacggaatgcgtctcatcagtgtagtcatgggagcagattcagagcctcatcgttttacagagacagctaaagtgctgaactatggttttgataattttgaagtgaagcaggttattgctccaaagacggtggttaagggtgttgagaatgtgccagtgaccaaaggtacggaaacagaagttccgatcgtcaccaaggatgcagtaagctttatcgtacctaagggtgcgagcaatcctaaggtaacctttacaacgaacattacaccagcaagctctctggtggcacctttgaagcaaggggccaaagtcgggacaattacgtacacgtacaagacagacggtgtggataaagggcagacaaaaaccgtggatctggttactacgacggcagtagaagagggcggctggttccggatgcttttccgggcaatcggtgatttcttcggagatctgttccagggaattaagaacctcttctaaaaaagcgaagctaagcgatctaccttgtttttcattacttattttgcagcttgaaatgattgtgtatttggcattcgtgcggtaaaatattaagttagaatctaaacgtaacccttataggaggcaacgacatggaaacgggaacttcgcgtgtaaaaagaggtatggcagagatgcaaaaaggtggcgtaatcatggatgtcatgaacgctgagcaggctaaaattgcagaggcagcaggagctacagctgtaatggctcttgaacgggtgccttcggatatccgtgcagctggtggggttgctcgtatggctgacccaacgattgtggaagaagttatgaaggttgtttctattcctgttatggctaaggctcgtatcggtcattatgtagaggcaaaggtactggaatctctcggtgttgactatctcgatgaaagcgaagtgctgacacctgcggatgaagttttccatattgataagcgtgagttcaccgttccatttgtttgtggagccaaggatctgggagaagcgctgcgtcgtattggtgagggtgcatctatgatccgtacgaagggcgaaccggggactgggaatattgttgaggccgttcggcatatgcgttttatcaatggtcaaattcgcaaggtgcaaaacttgtcgaaggacgagctgtatgcagaggcgaaaaacctcggagttgcatatgaactgctgttggaagtgcatgagcttggcaaactgccagtggtcaactttgcagcgggtggtgtagcaacacctgccgatgccgcgttaatgatgcatttaggcgctgatggcgtctttgtaggttctggtattttcaagtcggatagccctgagaagtttgcacgtgcaatcgtggaagcgaccactcattatacggattacaagctgattgcagaagtctccaagaatttgggagctccaatgaaaggcattgaaatttccaaactggcaccgcatgagcgcatgcaggatcgtggttggtaagaaagaagggaccggcatgaaaataggtgtattgtcgctgcaaggcgctgtaactgaacatatacgtagcgttgaacgtgcgggtgcggaatgtatagcggtgaagaagatcgaacagctcaatgagctgtccggtcttatcattcccggtggtgaaagcaccactattggtaagctaatgcgcaagtatgatttcatagaggctatacgccagttttccaatcaaggcaggcctgtatttggcacttgcgcgggattgattgtactggctaaaacgattcaaggacaggaagaagcacatttgggactcatggatattacagtatcgcgtaatgcatttggtcgccaaagagagagctttgaaacagacttgaacattaaagggattgaggaaccggtacgtgctgtatttatacgcgcgccattaattcagtctgttggaacgggagtagatgtgttgtctgagtataacggcgagatcgtggcagcccgtcagggtcatttgctggcttcatccttccatccggagttaacagacgattaccggttacatcaatattttgtggatatggtccgcgaatagtgaaagtcaggtttgtagtgtaggagggattacctgtgttagatataaagattttacgtaatgagcttggtcgggttgagaaagctttgcagaacagggggaaatctctggatctgattaatggttttacagatctggatgtaagccgtcgtgagttacttcaggaaagtgaagggctcaaaaatcgtcggaacgtggtatccggtgaagtagccaagttgaagaagaacaaggaaaatgcggatgatcttattgcagaaatgcgccaagtctccgatcgtatcaaagaattagatgagcaagtacgcgaactggaagttcagatcgatgaattggtgatgtctattccgaatattccgaatgatacagtacctgtaggtgcatcggaagaggataatgtagaaatccgtcgctggtcggagccgcgcgagttttcttttacacccaaagcgcattgggaattggctcaggatctagatatccttgattttgaggcagcagccaaggtaacgggttctcgttttacgttctacaaaggactgggagcaagattagagcgtgcgctgattaactttatgatggatctgcacagcagtgagcatggttatgaagaaatgcttcctccatacattgtaaatcgggacagcttgtacggaacgggtcaacttccgaagtttgaagaagatttgttcaagctgcgtgatactgagtattatctcattcctacggctgaagttccggtaacgaactaccaccgtgaagagattatgaatgcggagcagcttccgaaatattatgtggcatacagctcttgctttcgctcggaggcaggatcagcaggacgtgatacacgtggcctgatccgtcagcatcagttcaataaggtagagatgcttaagctggttcacccggatacctcttatgaggaattggagaaaatgacgaataacgctgagcgtgttttacagctgctcggacttccatatcgcgtgctggcactttgcactggagatatgggttttacgtctgccaaaacgtacgatctggaagtatggttgcctgagagtggcatgtaccgtgagatttcttcctgttcaaatacggaagacttccaagcgcgtcgtgcgaacatccggtttcgtccagattcgaaggcaaagcctgaatttgtacatacgctgaacggttcaggattggctgtagggcggactgtggctgctattttggagaactatcagcaagaggacggaagcatcgtgattccagaagtgttgcgttcatacatgcgaggcattgaggttattgctcctaaacagtaagtgttgcattcttagaagttctgtggtaaaataattttgttgcgcctgagtatgtttgaaagggaagcagctttatccatttaccacctggagaggtaccgaagcggtcataacggggcggtcttgaaaaccgttagagtgcaagctcacatgggttcgaatcccatcctctccgtcagtttaataatttacttgctgcataaggatttgtagcaagtatgactaaaacgcactttaccgttggatagcggtgtggtgcgtttttttgtgttcgtgaccgttggataaacatctgacggaggtataggatgaggtataggattatgaatacaaacacgggtggcaaactgcgtaaacgcgggcagcggaagaatagtttggacattcctcagcggtttctcgaccgtctgagtccatcggttttggaaacgtctcgggtggcgcaggatgagagagcgagcgtatcgcctgagattctgacactggagggctgttcaaacgctattaccgcatactctatttttttcatacatcagtttgcaggcctataatcaattgcaactaatatctcgacaggtcagatcattgtataccaaatatatcttgcagatagttatcaagaatacgaaggggctcgtgtaaagcttggtttggaaacttatgagttaccttatagcatattcttggaggcaccgataccgatagtttctgaagaacaaaatctcccatccgcatcatatgtgcgccaatcgaagcgggaactatcgaccattgtctagcgtccttcaaaaaagtagtgatgagtcccgctgagtccagatgaacacgggacgggcaaagagggtcccaccactggtcatgtctgaattgaaactctctattccaatttatgaagacttcgtcttgcgccgacaattcttccatttcaacagtatctccggcctgccgccccgacacagccaggcgcaacagcatcatttcttcagtaaaaaacggtttaacagtgacactaggcgacacgatttctcgcaccacaaacgccacatccatctcgcgccgctcaatactatcaaaagcttcctgagtatgctgcgtacgaatttgcagtcggatggacggggtatgctgattaagcattctatatacaggaggcaaaacaaattgacttatactttcggcagcgcttattgccagacttaactgcgaaccgctagcctgcaagatttgtgtttccctccagagagcatcccatctttccgcaatgctaaaaaagttttccccttttggggtcagactgattttgggtgccccttttcttcgctcaaccaaaaggccacccatttcctgttccaatgtctttaaccgatagctcaccgtagcttgtgacagatgcagcaattcggccgctttgcttatactctcggtccgtacgatagctaaaaacgcttcaatcccaggaaaatacatagaatacctcctcaatatatagaaatgattaatatagttcacaaaatatttgagttttacaacattattctttatgtttaaaattatcgttaataaagacgaggggtcaaattttattatagtgcgttttcatattcccaggtattcatgccggtaatatgggttgtaaggtagcgcagcgtcttggaaactttgaggcatatggtccgatcctgcagcgcctaaatgcaccgatcaatgacctttcaagaggttgtactgccgatgaagtctataatatgggaataattacttcttctttaaaaggataaaatgaagatcatcaaacgggttttcttcgaagaatggtataggtaatgaaaggtggtttagcaatgaagattctcatagttggctattttagcgagacctcgaaatcaaatattgtaaggtattttcctcaagactggaatgttgtaattgtcccgcccggaaaagaaatgctgcatcatattgaagattgcgaggtaatcatccctgaacatattaaagtggatcacagcctgctttctattgcgaaaaaattaagattggtacagacgggtgcaggatttgataatgtagatgtccctgcctgtacacagctcggcatttgggtggccaatgctgcaggagtgaatgcacaggcagtggccgagcacgtaatggcactgatattgtcttattataaaaacataccgtttcttgatactttcatgaaaaacaggatggatgaaagtcaattggactatacagggagtgaattaaaaggcaaaacgattgggattatcggtttgggcgctatcggaaaaaaagtagctgcattttgcagggtttttgatatgaatgtgctggcttatgcgagaaatgctcttgtacaatctgacggttttgtgaaaatgacggatttcgatactcttgtaagcacatcggatatagtcagtgtacatgtacccttgaatcaacaaaccaaacaactgatcaacaaagcggcatttaagaaaatgaagaatatcgctctttttatcaatacagcccgcggcgggattgtcaacgagagagacttgattgatgcattaaaaaacggggatatttcaggcgcatgcctggatgtgtttgaatctgaaccgcttcctattgacagtgagctccggaatctggataatgtgatacttactccccatacagcaggaatgcctgatggtcgaaaatttcataaaaaaagatatgatttctttataaacaatataaaacgtgtagaaaatggtgaagagcctgaaagcaagctcaatcagttattatagttttggtgcaataaaaatgagctagcggggcagctccgtgcacctggttgcctccagataatggcaaggggacacggcagtgttgcagacaggccagcagttgtggcggttcttgcattagacttcacaaacccagtcataccaaggctcggcggcttttcataggtagtagcggtcttgaaaaccgttagggtgcaagcccacatgggttcgaatcccatcctctccgccatattctaaaataaaccaagccattcaaatacgatagctgatacattggcctttataagctaatgattaggaatcatggagagtggcttttttgttgtataaaaagctcgtttttttcacacgttatcagatgtggaggtgctggcatgaatcgagaaatgacagtagatcagcaaaagctggtagaggcctggcaggaacaactgccgattcttttgaattcaggggacaaatcacaggtacaggcagatgaagctgacaaccgggctatacggatccatatcgaggtagaaggccgacaaatgtactcctttgattttgcatgtacttatgtagactcccgggaagtacaggttagcttagtcgatgtagaacgggacggacagtctgtggatgaacgaacagatatcattcagcagttagtgtccgattatactcggcatattcaccaatgtgcccaaacattacagtcattgacgcactcgtaggtcatgaaggaatgaggaggaagactacatgacaaaagccaaaaacggtctggataaaaacctgtctaacattgttgatgatttggagcaacgcccagttaatagtcatcaggcacagcaagtgcagcaggatcgtaatgatcgccgtcatcaggattcactaaatcacgataaaacggaagatttacaccatctatagtcctattttaaatggtaataaacgggttcgttgatgtaccacaaatatagactgagaatggaggatgcataaatgggcaagcctaaagccattcctgtccccgaagcacaggattctggtggaagtaacgaaaagcgggagcgtagtcatcagcaagagccgttatccggttccaagaaggtgaaacagcggaatcacgtggatcatcataatagagaaggctcataagcaggcagacctttctcctaaaatatattgcgtagtgtagacaccctggtaagagagccagggtgtctttgtgcttattgtaagaaatttttccaataagtgtttcgccgtttgagaatatgagttaaaataggaggtgtgtattttttttgttagcataaaaaaggggttaattacgagaggagagaatctacacaatgagtaaaaagttatccgtcttggtactcactatggtgttgcttttgacggtagccctggtaggttgtagcaagaagttagaaccgaaggaagctgttacgactggtactgcaaatgcaatgaagttgaactcttatgaatccaaaagtcaattcacgattaaggaactgaccattacatccgcttctgttccaagtgagcaaagtgcaatggtaactagcatgctgaaaaatgctgatattacgctggatggtgtataccaaaaagaacctttccaatctgaaatgacgctcggcattcatttgaaaggtgatctttccaccagcttcacgattccaatggtaatgactaaagataaactgtacgttaaaattcctaatattccattttacccacttccacaggatgttgtaggtaaattcctggtcattgatccacaagaactggctaaacaatcaggacaagaatttaatcctgcagccatggatcaggaaaaatcgcagaaatttgcgaatgaagtgattgctgctattatgaacgagtatgatcaagctacgtacttctttgatattgatcctaaagacgctaaattgccacaaggcgttgaagctaaacaagtcgttcaattcaaaattacgaacgacaatgtgaagcaagctaccaatacatttatcactaaggcgcttcctaaagtccttgatgtgatgtctaaagatgaatatgctggcatgcttcaagtaaagaaagaagagctggctgaagcgaagaaagaattgcaatccaacaccagcgaagttagcaaaaagctggatgagttgaaaaattacttgacagtgaaacagtttgacattaacacagctttgaacaaggataacattcctgtgtatcaagacctgaatgcgaatgtagagatgaatgatccggctacaaaagacaatgtaaaattgtccgtaacaggctacacgcaatacagtaaaatcaatgctaaagcagcatttaaagtgggtattccaacaggtgatcaagtcctgactatggaacagctgcaacaaaaaatgcaaactgttgctccttaagtttgggatgacatgattgtataacatcatttttttcgaatatgatgtaagaaaaccgctcggcataagccgggcggttttttgtttactgttaatgttgtccctgtgcagtcatttagctctgccacacatcatcctcagctaaaagtccaaacatctggtgatcctgccatgcgccctgaatttgtacaagcttgcgagcaatgccttctggctggaagccgcacttttttaatacacgttgtgagggatcattatgcaaaagggtacccgcttggagacgatgtagagataaggcacgaaaggcatattgtatgatcaactttaaggctgcggtcatatgccctttaccctgttcatgatgatccatcatgtagccgatatcagcgaattgtccaactccacgtactagattggaaatagagatataaccgatgagccgttcttcctttaagagaaagataccaaacacgtaacctcggtcctcttcggcttgacgcaatttctgacggatataatcctgctgtttctctaatgtgaaaaatgaatcctcgtaaagcggctcataaggcgcatgggaatccctattacggtgcctaagggcgagaagggcttcgctatccgccaagctaaatggccgtaaaaagataccttgaggcgtattatacaagctcatagacatgggttggtctccttccatggggaattagcaatgagatgaagtgttttggacgttttcccctcaggatgaggatgggggaggagacaatctggctgccgctcttttttgccggagatgccgaaaaaagttcgttaacagcgaggcgcattcctcctgcagtacaccactagttacttctgtacaatgattgaaccgaggctcctgtaataaattcatcagcgtgcctgcgcagcctgccttgggatctgtagttccgtatatcaaatggggaacccgtgattgaacaatggctccggcgcacattggacacggctccaaagtgacatacagcctacaatccagcaggcgccatgcgcctaagtactcactggcctgacgaatggcaaccatctctgcatgtgcggttgggtcagcatccgtctcgcgcaaattgtagccgcgaccgatgatttcattatcttttacgatgacagccccgatggggacttcacctaatatttctgccttatacgcttcctgaatggcttctttcatccaataggcgtgatccatggtggtcactggaaaatgctcctttcaaaacgcggaattatccaacgaacaaatattccgttgttaacatgatgtgaataaaattgtggataacacggcacttgtccacaggtttatccacagtttataataaaatctgtgtatttgtggactacttgtggatgattatcttcttatattgtagggaaaccctcgtctattgacaatactgtacacaaggtgtgtatttatgtatatccggtaaatgtaaatgctggtatcacaggcgctattacggtatcattgagttagcaattgccagtaatcgccagcatacggcaagaggtgagaaatcagtgtgtcgataaaaatcagaataacgatcattttgtcggggtccgtcctgtttatccttttattaaacatcgcactcaattattacacgacccacgaaaatctaagaagtgacagtgaaactaaaatggttctgacggctaaaattatcggaggagctatcgaacaaacccagcatagctgggaggccgttgacaagcagctcggatataatctgtggctttctgccacgttggctgctaatcagctaggtcctgacatccgaaatattcagcaggaacagcttcaaaaggtggcctcactccacagagatactaatatttctttgatgattcgagacgggcaggggtataaggttattaaatcctcggatccaaaagaagtaacgccatctgatccattgacagggtattggaaaaatgcagttgaccaattatatgagcatggacaggctgcaatggcgcaaggtcagaaactggatcatttttggaccggatcatttgactacaccggttcaggctcctcacagattaacaaatggggattttattatgaccaaaaacgtaactacttaattcgaatttcctttcaggatacttcagtgcaagatttcataaccatcctgagccccgatgagatcgtaaagcaaacccaacaagtggattatcgcatcatggagattacaggaattaaccctgcaacctttggtggcgcttcgatggacaagaacgggaacgattcgaaatactattacatgtacaataaaccgatccaatttggcacatatcaactaacaagagtgcaggaagatcgtttggccgtgtccagagcaatactctccggggagagtattgtacaagactgctatatcaaaggcgaacgggttctcgtcagttacatacctttttacccggctaaccgcgaagcctatgttatccgtattgttatgaattatgatacgattacttctgttatttccaagcaattgataagcttaattgctatttccattgtccttttggaggttgtaatcattggaagctatgtgctggcaagtctgtttgtccgcccaattcagtcgattctggggaaagtgaacgagatggctgatggtcattttgatacacggctagaaataaaaggtggtcatgagcttgcacagttgggtgaacgcatcaatgcgatggcctacaacctagggatgtacacgagaagactggaacagatgtatgaagagaaccgttctgtaaaggagcatctggaatcggttattaatcagacagcggatgcaattcatgtaaccgacgaggaggatcgcgtcgttcgggtcaatcatgccttcgaagctttgtacggctggaccaagaaggaattggttggtcgtaagctggagtttgtacctccgcagcaacaggaggagtatgaatttcagaagaagagcctgcttcagggagagagcatcgtatcaagtgagacccttagaatgcgtaaggatggaagtacagtagagatcagtatgagcacgtcgcctattctggatgaagaaggccaaattttggggtttatctgcgtgtcgcgtgatattacgggtcgcaaccgaatggaggagttgttgcgcagatcagagaaactgacaaccgtcggacaattggcggcaggcgtagcgcatgagattcgtaatccgctaactacgctacgaggctttctccaactacagcagcaaaatcaagtgttgaatatgaaacacaacgatattatgatgtctgagctggatcgcattaatttgatcgttagcgagtttttaatactggcgaagccacaggcagtgcattttcagaaaaaggatgttcgctatattgtgagcgacgtgatttctttactagatagtcaggcgcatctgctgggcattgtattcaatcttcaggtcacggacgagcctgccctggtatacgctgaagaaaatcagttaaaacaggtattcattaatttacttaaaaatagcatggaggctatgagtaaaggtggtatcatcacgattcatttgttcttggagggagaaaacgttaaaatcttcatacgggaccagggaacgggtattcccgcagaaatgctgtccaagctaggagaaccttttttcacaaacaaagaaacagggacaggactaggacttatggtcagtcagcgtattatacagagtcataaaggcacactggatattgaaagcacagagggagagggaacgacagccctggtgcagcttccgattgccaagccggagtaacgggctagggcgcaggaggaagtgtgttagtagaaatggagggtacacaggttgcgcattaacaagtttatcagcgaaaccggtttttgctcgcgccgcgaggcggacaagctggtagagagcggccgcgtgacgattaacggcgaagtggctgtgctgggtagtcaagcggaagaaggcgatgatgttcgcgtgaacggcaagccactgcgcgataagtccgatcacgtctatattgcattgaacaagccggtgggcattacaagtacaacggagagccacattagaggcaatgttgttgattttgtgggccatccgcagcggatattcccgataggacgcctggataaggattcggaaggtctcattttacttaccaatgatggagacattgtgaataagattttacgggcagaaggcaagcatgagaaagaatacatcgtaacggtggatcgccctgttataccgtctttcgtgcagggcatgtccagcggggtgaaaatactcggccagcggacgctaccttgtgaggtgacgcgtgtatctgagtatgtattccgtattatcctgactgaagggaaaaatcgtcagatccggcgtatgtgtgctgccttcggttatgaagttaaaaaactgcaacggctgcgaatcatgaatattcggttggggtcccttcagaaaggtgcctggcgtgacctgacagaggctgagaagcaggagcttggccagatgctcgattatacgcttagctaatgccagaggggctcgtatagcctacagcgtatgatcgtcgtatctgaaagggcaaagtacaggaagcactaaacaaagaggcaccagctgcataaaaatgcggcggtgcctttgttcatataacatatgcataatcaaccttcattcgtgcttgaggtaggactgataacctgtgttccgttctgatatttgcggagaacagatatttcaacacgacggtttttggcgcgtccttgaccatcttgattgcttgccaatggacgatactcgccataaccgatggatacaaacttggttggatcgagatctggattgagcaacaagatacgcaagaaattcagagagcgctgggcgctcaaatcaaagttggacgggaactggctgttggagatcggtacattatccgtatgacccgatacgataacatcatagccagggaactgctggagcatactagaaatagacttggccagctttctcgctcccggttttacttcggcttgcccggatgaaaacagggcattatcactaatggtgatcatcagctgggattggttcagcttggtattcagcagaggtgacaggccgttattttgaatatattgatccatctgttttttaagcttttttaaatcttcttcttcccgctgggcaagctgtttttgcagttcagaggtagaagtagctttcgattttaagggttgtgatacttgttctttatttttgcccatatccatggattgtgacgacggattcgcggccgagtgatccagcacgccagtgccgccactaaaagctgaactcagggattgagccatagtttcaaattttttggcgtcgagcgagctcataccgaataagacaatgaaaagagccaacagaagggtcattaagtcggaatatggcaacagccagctttcgtcagcatgctcttcatgcggttcatgtctctttttactcactggaatcgccatccttctgggtcaatgtagcccgttcggtcggagtcaggaagatcgtcagtttctgactgatggcaattgtcgatatccccgattgaatggaaagcagaccttcgaccatcattaatttaagctccacttcttttttggataaccgtttcagcttgttggacatcggatgccacaggacataacctgtaaaaataccgagcaacgtcgcaatgaaagctgctgcaatggcatgagagagcttttccatgtcactaaggtcagccagagctgcgatcagacctacaaccgcaccgagtaccccgagcgttggagcgtacataccggcttgggagaagatcagtgcgccagagcgatgtcgatcctcggtagcattgatatcctccatcagaacgtcccgtacgaattcctgatcattgccgtcaataatcattcgcatgccgccacgcataaagggatcgtcgatttcttctaccttggattccaaggcgagcagaccttcacgacgggtaatggatgcccactcggtaaacgtaccgatgagctctttgcggtctaacagtttttgttcggtgaaaataaccttgaacagcttcggaatccgtttgatttctgccatcgggaaggccataaatatactcgctgccgttccgacgaaaataatcatgtaagcagcgggattattgaccaaattgacgaccggagcgccttttaagatcatcccgacgaccagtgacacaatcccgagcacaagtccgataatggttgaaatttgcatgatacacctcatccatgagaatagattttgaatcctttcatgccgccggggtcgtccttgccccaagcgcgtcattacaagacggattatagtatttatcgacaaaactctcttttttgttaagtgcgaatttccggtataataaggtgattatgtattgaatggcggaaccattggaggaaatggcatgggagtaaagcatgggcgtgagtatgaacaaattttgaacgatttgacagaggctgtggggcgcatcccagatagctatgaattttttgagatggaagcagaagattgggacaggctggatccggcgggacgtcaggaagtcaatgaagctttggcagaagacttattttatgcactgggtacagagcccacaatcactgtagggagtggcgttgtgatctatgagccggagcagcatcgcatctatgtacttattggggacgaggagctgacgtcagtccctttgatttgaggtccgtcttatggatttatcaacggggccgtggtaatatgtacaccaatatatcgtagttttggccgtatttaagcggtcgaaaggcttccgtataaacggggaggagttcgtaacatgccttttacacaagaagagattgaagcacatctggagaaactggagggctgggaactggaggaaggacgttggatcgtccgaaaatataatttttccagttttatgaaagggattgcatttgtggatgaagttgccgctatatctgaagcattcaatcatcatccatttattacgattgattataagaccgtgactctgcgtttgacctcttgggacgacggcggtattatggccgtggatattaaggaagcccaacaatataatgaagcttttgaaaaaatgcgcagcagtcattgagcttgtaatgatctgtcgtatgatgatagaagcgccttcgctatacaacatcgtggttgtatgccgaaggcgcttttatcatagaatctgggttgggtgctcgggacgatataccatacaataaaatggttttttgccatcaggagtctggcgttcataggtatctgtaagctcaaatccagccgccttgtaggcccggatagcgcgcccattccaagtgagcacctctagatcaatttcattcttcgggttgcgtcgttgagcttcctctgcaatggcacggacaaaatcagagcctttgccatgtccgcatctgtcaggatgcattccaagacctagccgggtcacaccgatcataggaaaatattgagcaaatcccgtcagtttgttctctttatccagtacggcaacatattgctcttggcgaagcgtgggacttccaaattcgacttcaagcgccttcatttgttcccaggggagccaaccgtatatgttataaggtggatcatattgccactcacagattgcagccgcttgatgctcgtccatcggtacgatccgatagttggatattgaggccggcatgtgttccatcctccttttacacaggtacttcaatcattaacaacagattgtagacaagttgcagaggaatggcaagcgtgtttatttcatacctaagtcgggtatacattcaataagaaggaattactgctcatatgctcccccagcggtgacggtaaaaccgacgatgttcgctacaattgaaaccttttgaggtctcagttcgtcagtaaagataataattgctgatgttgtggacataaaaaaccgcaattcgattccggccagaatcaaattgcggctagggttagcttgttgtgcgttagttattctacgttatcgtcatcaggaatgtctgaagctacagaatggtaagcgtctgtgctcataattctttttgcaccgacatagcggttagcgtaataattttcgttcagtgagctaactactacaccacgtgaagtcgaggagtgggcaaatttcccttcacctacgaagatacctacatgggaaatgcctcttcctgtggtgttgaagaacaccaggtccccaggtctcatttcatcgcgggatacagaagatcccattttgaattgtgatccggattgatgcggaagtttaattcccagtttgttgtatacgtacattgtgaagccggagcaatcgaatccctcgagtgtagtgcctccgcttctgtagttcgttcctttggcatcttgaatgacctggtccatcttagagtctgcatatgcactgccgccaccgaatgtaaaagatgtaaaggcaatggcaagacccatagctgcgatcgttagcttcttcttcaaaaaaaatataccccttccaatgcctgcgaggttagcttaaggattcggtagaaggttcccctatgaccactctgttgcgagatcaattcacccaaactggttcccccgcttcctaggtgccaggaattaggcttaacttaagatgtgcaccttggagagcagtattcacaataacgttatttttgagataaaggttacaataaagattacaaagttgttactatcagttcactgcgattattgtaacaaagacggctggctttggcaaatgtttcattgcaaaaagttacaaaaaaaatctgctcctaatgtcccaggaacagatcttgttaacagtattcagttatgtgtcgtttgcgcgggtatgaatcaaggtttttcgacagacggaaatgaagtaaaaaacataaaggcagggcttagcttctactagagatatcggtatgccatagtctgtactgcgaactgatatgccacagcctgaccagactagtaacaaaatgatacgattgctggagaatgagcgccagcatgccagtccaaatcatcgccacggtgccaaatagaccgaagaccagcagcacacaagcaccgagcaaaagggatataccgacagctgggaggagctggcgaaagaaggcgagcagggacgatagtatggcgtgaccaccgacagtacccagttgcatatacaggatgcactgccgaatgaaccatccgtatgccatccatccaatgacatagggcaataaatgcagcagataagaggaagattgaagtgctcctgctacaatagggtagagtctcggtactacccaaaaggcgggaagcagcagcagtcccaactcgatggtgtaatacaacagcgacgacatgccatggcgtttcatacccttgaaaaaggacaggctttgcggttcagtcgcatcggtatgcagactttgatatattccggctctaatgaagggagtgatcagtatgcgtagtacagtcgcccctagtagtatccacaaatacacatgtacttcccggctgtccatcagagcaatctgactctccatccaaaataaggtctgtcccagttcgttttgaccctgatcaggataacggagcaatagcgggataacggcagactgcaccagccgatagagaaacaccccccacagtagtcgatacagaaataaaatgataacgatatagaatcgtatgcgcaccagcgcccagccctcttttataacagtccgcatctatagacacctcaccatgacagacttccaagcagtgtctccaacagcttggttacacttacactccaacgggtttgttgcttttcgtccaattcggcttttaggctattgttaatatgcttgttctccagtgcaatggtatataagggatcaagggttacataggaaacgggggaagtacttttgatccgaaaagttgtgcttttgcccgcgccgtcccaagccttgaatatcgtggtaccatccttgaaggtaaattggacagggatcttgggataatccgccccttttttgctgaccgtcacgactgcttcatatccattctccagcttgtggtttgtgatgtgatccactgaaaagtccgccatctggccgtcatatacatactgttcaaaatagtggctccatgagcgtccggtgactctctccacgatacgttgaaaatccattgaggacggatgcttaaatcggtacgtctggacgtaggtccgcataatgcgatccatttttttcatacccacctgacgttcaatgccccgtagtaccagcttgcctcgagagtaggcattttgcgcgtactcagcagctgagccatacttccatgactcacggtttagcggctgtggggaagctacctgtcccgattgtaatggcaggttgggggtaagcccatattcttgctccataagccgctcctctgcataggaggtgaagccttcatccagccacggctcctcaaattcattattggctaccattccgtagaaatattgatgtccaatctcatgaactaatgtccgttccagactatagccaggattcagattacccgcagcagcggccgtgatgagtgtcggatactccataccgccggctccattgcctgatttgggtggaaccacgatggatagggtggaatatggataaggcccgtaccatttgctgtagtacgaaagggcggccttcgctgcgctcatatagcgccctttgagctccttgtgcgacgggtcaaggtagagcttgattttgacaccagggacttcagcagaagaaaagggttcttctacggttacaaagttgggtgaagcggaccaggcaaaatcgtgtacatcatcggcataaaattgatatattttttggccgttctgtcggacggcaccacgggtgggaaatccggtcgctgctacgatatgagtttcaggcacccgaatccgtacgctgtaaattccaaaatcggcataaaactcggagttaccatgatactggtggaggttccagccctcctcggcgcgtccacgctgtccttcagtctcgtagacgctgagcttcgggaaccattgccctgccattacaaaatcatctgtcgcacccatacgagcgaagatggcgggcagttttacctcaaacttcatatataatgtgatttcttcgccacctcgtaccggcttgggtagacgcaccttcacgagcgaacggtcgcctgcgttaccgtcatctggctgcacatattggatgcggtgcatgagagataaaccgtcttctgtttttagttcagtcagcgtcatggagccaaagccgtctttgggcatggtgtctccgcgcagctttccaccggattccttcataaaggtagtttccatggaaaagaaggcattcgggtatagatgaagatacagatcattcacggttttcttgcccggatgcttccaggtcagtgtctcagtgcctcgcaaaacctgtcctttttccagagacacatcaatgtggtactctaccaccctcttgctgaggatttctgtagcgggctgtggagggttcttgggcaggtcaggcaggatgtttgcccctagaggcttgcccatatttggggcaagcgcagactcagacagggagccgtatagtggttggcctatggactgcgggtcggattgcggttggggctgccaggcaaaccataacgtccctgcgaggagaccgagggctagtgtagacaataaaacgattttagtgcgtgctggggtcatacaatggatacctcccgttgacaagcatctacagcatgtatatgtttgctttcaggagattattagttaaaatatttatagtgtagaatgagtgtgaagacggaaaatggaggtctagtgacgcatgagtgaaaatcagccggacggcaaaaaacagattgcattgaacattgtcagtggcaagagtaaacataagggtttcggcgcaggctcaatcgacctgaacagcatgtccccggtcatcattgaccgaggagaggcgaaaattgatatcggtgccatgcatgccaaaagtaaagtagaacgtggtatcaagttctctacgaataaagaggatgtaccgaacggacgccaagtatggctcgtatgggtagctgtggatcgtacgcccgaaggacgtatgtacggcggtgccaccgcctgcgagatgctgattgacgacgaagccaaacgcggttggaaaatcctcgccgatcacgtcaatcgtatggattatgcgctcaagcgtcgtttcatgctggaggatctcggaagtgaggataaggcagcacttaaaagtctgctgatttctcataacgaggaatggtgggacgcttcgcctgaggaattgaagcaggtgctggaaggataggcccagcgttaacgcagtaataatattgtaaaaaagcagccacatctgaagtgaccccttaaagttagacaactatttttatgcaaccagttgggcatgagctcggtattgtaccgggctcataccttttaattttgacttgatgcgcttgtgattgtagtaattaatgtactgctctagttcttgcttgaa
